United States Patent 7,491,813 (PROMOTER POLYNUCLEOTIDES IDENTIFIED FROM ZEA MAYS FOR USE IN PLANTS) - sequence listing, part 3

SEQ ID NO: 4273 - DNA, 1075 bp, Zea mays
actcaaatgacatacgcaacgcgatctatggctagcttcgacatagtacttagggtgcgtttggtttagccgtgaattgtgaaaaaaccgttgtcagctgtctgctgcgaaaaactcttgtgaaaaaaaaccgaaagtcgtttggttgaaattgttataagttgtccactataaacaataaatatttttattttatttgttataacacttaattattttaatcctatgttagtttcaatttattatgtatgtttattaatataacgaacttcgataaacagtaaaagagggtccaagctattttcaaatttatactaagaaaagttgtcttttcaaaatagccgtagaaaagctaaacccatttaatttagcttctgcttttgtgaagtaggttttaagagcatctccaagagactctctatttaactttttatttatctttctataaagattaaactctatatgtatcatattattccaacagactctgtaacacgcaacttagtttggctagctgaagtgtctagccaaatttggtagcaacgggggcaatttggagagctggatggattggctagttagatggctagtctattgaaaaattattttgctattaaatatctaaattttaacttgacgagtcatttgactagtctctcagagatgctctaatcctttaaaactcattcacttttcccgttccaaagagaccttaatccctttctttctcaccagcaaatcaattttggagagtgagaaaaaataaagagagaagccagccacagccagcgagcgccccctccggctccggccctcctcttcctcttcccccaattcccattcccaattcgccctcctcaaatccggcgcccgcattcccgaccaccccgcagatctgggatccgccgccgacggatcccctgccgcccgcaacgacccgggacgcgcgtgatcccgccgcctagccgccaagttggcgcctcagcggaggtcgcagcgcctcgccggcggcggcgcgggctctgccgccgccgccgccgcgcagccgcccggagcctccggcgcacaggcagcg

SEQ ID NO: 4274 - DNA, 292 bp, Zea mays
tgagcaattttaaccagcacaaactctccaagaatcccacagcagcacagacggtatgcagcttctttcttcagctcaaccagggaacacacacattggcatccctctctccctctatatctgaatggaagctcacacaaagtagcccagagtaaccaaaccagcccccacctaacatgcaccagatcgccttttgattcatgggtttcacagggcaccgcattttgctcataggccttgcatatatacatggggatttcatgccacactttacagtgctgcatagccatac

SEQ ID NO: 4275 - DNA, 1500 bp, Zea mays
ccgaccctccctcgggggctaaaaggggggaaccccctctgcgtcgaaattttcctcgaaaaaagaccttttctgccagaatgtctttcgtgcttttttgactacttcgaaagtggatcctgaaaacgacggagtacacgtaagcagccaaggctgaccgagccgagggactcctacgcctccgggatacggatacctcactcatcaccttctgcgataagtaactcgcgttcggataagtgattccgcagaccgaacaagtcttcacgctcgaaagctcctctgccgaagcgattcttcgggccttctcgactgcgtcggtgacagaaccctatggacgggtaagagtgcgcgtaagcggcaaggccgaccgagccgagggattcctacgcctccgggatacggatacctcactcatcgccttccgtgaaaagcaactctcgcttgcacaaacaattctgttaccgacaaacaagtccagatactcgaaacaagaggaaaagaaacgcagctttacaacacgacgatggtgtgtttgggcctcggcggccgcagaaaacatacacacactacaagataatccgatcctgcaggctcggatcttgacacttgaagggagcagcagcaccctcggtgtcaactacaccttcggcgaggttcgacctagcctcggacggcgaagcagtcggagaatctccactctgaaggacgacatcatcaccacgcccaggccatcgccgctagggtcttctccaggaatccggctcgagcagacggctcggccgatcaccccgaggcctcggccagctgtcccccgaagacatcagcccggcccgaggcctcggcaactcaattccggcgtcgggtcccgccagtggacgaccccggccaggctctggccgaccaagtcttcttttcgaagccaactctgcctctgttcgagctgacaccgctacccctggcttcggctcatcgaagagcggccgaggggttcctttaactaagcaagagaagcctcggacagcaaggccgaccgagccgagggactcctacgcctccgggatacggatacctcactcgtcaccttcgcacgaggcgactcacgcttggtgaagcggttcagataaccaacaggcgagtcttagtgcttgaaaatgaggaaaaaaacacggctccgcgccgaaaatacatacatgttcaggccccgacagccacaatgaacagaagaccggcattcaaggtgccattacaaacggaaccccggttccacctccgcaggtacgaacaaccccacacgattggggggcctgcggagcaacagaaggccgacgggtggctcgccgtcgcccgctccggcagcagcgacaacgacccccgctccgggtggccgaactgcagcagcgatggcctcagggcggacgccgctgcaaccttgccctcgcccacgccgacgctcgaggggcgaggacaagtacaaagagccggaggcccggagcgcgg

SEQ ID NO: 4276 - DNA, 822 bp, Zea mays
gcggatgtggcacggaagtatgaaatcgttgagacagtcttaggggttgtagtcagtctgatcatctatctgcatccgatgattccatccgcacacgtccgcgccgtaagcaatgtaggccggcaccagcaacgtgccaaaatgaaatgcagaccgagagggtgcctgtttggcaacgatgtttcttaaaactatggttttacaatactagactttgcaattatcatgacaataccgtagttttgactgttccaaaaatactatggttttgggaaacaatgtttggatacaatattgtaaaccatgatactagacaaaaactaggtatgtcatgaaaactttaggttggagtagagttttcaatagtctaaaaatactatagtatatagaataacattgatttgaaaacataattttcagaaatacaaccaaacacctcatatcataaaatactgttgtattaactaaaaccatagaaattgtaaaaatacttcactcccaagagaccctcagcgtcaacctaacccggcgtgtgtgtggtatgggttagcataggcttaaccggtggggacaagccaggctcagatgcggcagaacatccgtcgaggacaagccaggctcagatgcggcagaacatccgtcgacgtcgccgacaggcgacacgaggctcacggctcacggctcaccagtcacctctaggtcttttccaaaaaaaaaagaagcccctcctatccatccctatccctacccctacgagtatccaagtccaaccagcaagaggggaggcgctgcacgcaggtcacgcggcgatggacatatgcg

SEQ ID NO: 4277 - DNA, 1500 bp, Zea mays
attaaaggcacgacccatttagggcacaacccatttagtccatcgacatatataagtagttctataacggttttgtaataatgtaatgagatgtttgaagttctataatcgttttatggttgttgtcttgttctgtaatgacaggctagagttttgtagactgtagttctcaatgtttacaacaattttatagctattttatctatatttgaaggtctatacttattttgttctaaattttgcatgggtgctttaacaacccaacatacctaatgggttactgggttgccgtgctaaacgggacgacacaacccgtctaaagtttactgtggtgtgctatgggccgagcattaagcctgtgggtcggcacggtacaacccgatgtgttaaccgtgtcgggcaggcctataagtgaagcacgagcctaatcctttcgagccatgggacgacccgcacgacacaatgtacacctatagatttaagcaaaaactatgctaaacaggtagcttttggagcagcttatgagtttagctgcttatcagaatgaactaaaagcagccaacaaacagaagttgcttttcacctactttttagacaagctgctttttcaacaaggagtagctagggatgtaatatggttcggaaaatatttgtccgaatctgaattcgaagatagtgaacactggttcagatggaattttcggatatccggattttttggataacatatacgaatacgggcatcctgttcggatatcgaattcgaatacaatatgtctgatatccattggatatcgaatatccaaatatcttctcggataaatcttctcggatatccggatatcttaaccggataactgtgtgcattttgttgattttttatagaaagaaattaataatacacaaatatcatcagaaattcatgaaattttatggaggcataacatatgtccacatataatcctctaaaatacttggatcataaaatccacaatatgttagtgtttctttcatttcactttcactcgttgcgtgaattacacgtgaaatcactctaagtatccaaatcttaacataatcaatactttattctaactatgatatatgtggaattatgttttacacggtatccaacaaaaaattcgttaacaacaatatccgtgtccgactagttccgtattcgacacacagctatttgtatttgtatccgaaaacattcgtattcgtattcgtatccgaagttatccgtattcaaatttaaatccaaataaaaatataaaaacaaatatgatttcagtgatatccgttattatttgatctgattatatccctgcttcccctaataacaaatgacactgtttgcgcgtgttgactaaaataattgtctctgctgacttccggtcacgctcgctgtcagataccatcgcttgctctagtatttatgttggcccatcccccacctaataacaaactagagagccctgacgaatcttcttcgtg

SEQ ID NO: 4278 - DNA, 1040 bp, Zea mays
ggtcagcttgttgagatcgcaacgtgtgaatcttggcaagaatcctacgcagacctcttcctggcacctagggctatctcttgtatgtgagttccaatggtagatatgccctagctagggagatatgcgaacgccaaatctgggttgtgtcactgttcaccccgagacaaaagcggtgtcaaatcatgttaaacgaatttggctagggttcaaatttttccagtgggttccttaggtaggttggctcctttttggtattcagaccaagtggttttggcaccatttactaactgaacacgtctaatctttaaactagggtttatttttgacttagagaagattagagagctctagtgtgctttctacttaaggaatggattttgggtctttaaggggcctttttgtaatgattcctttactgtttttgtagatacactagtgtacttagattttcgttgaggattagaaacatgaattggccacttgattagcttgcccactaatcccttgcttggaagtctagtgctttaagggtctaggttttaacctcttttgcccaaggtgacaattgctcaaaatgtttggggtgaagcttttgtcattaacattcttagttaatacattgtttccaaggctttggggctccctctcctccacttaatacatgtgataacaagtcatgtgtacaagtagggccttggtaacacctgggtgttacaaaactaaagcttctaaggcaattgaaaaagaatatagtgatgatgaagaaaatgaaagtgagagtgatggagatatggccctatttgtaaataaattcaacaaattcatgaagatgaagagaggtcaacctagaagaggccaaacatcaagaaggaatgctttcaatgatagaaaatgttttgagtgcggggaacccggtcacattgccatgaattgccctaacaagaagaagaagggcaaagatggagatgataagaagaagaagaaattctacaacaagaagaaagatggcaaagcctacctagttgaatgggattcgg

SEQ ID NO: 4279 - DNA, 1496 bp, Zea mays
ggtacaccacgtccacggggaccatttcactgtccactggacacacacagggcgcccctgacgcctccgcgcgccggaccgcacccccgccacgactcctctctgatcctgccaggtggtccctggctaaggacagcctgctcggcccacgagggcaccctgggcagcatttactctatggcttcattggccgttagattgcaaaccgacggcagttactctctgccccgtcagccggtttttaaatgcgttttcccattcagggagggagtggcatagctagtaatatttgaaaatacggaagggcgaagagggtaattcttcggttgaaagggtcgaaggcgatcggggctgcggttgaaggtcgtggaagtcaggaagtgggaagtagtagctgagggagccagaggttcgcgcggagcaatggagctctttaatagcttcggcgcattcaccgctttaatggccacttcttccaacgcctctgtcccggcttccacgcgttctcagtgagggctagggtttgcccgcgccgcgtcgctcggcaaggaggaggacagggtgcgctgccgtcggcggcggaggcgcggagctcgttcgtcgccgtcgcgcccccctggtgcgtctctttcccttcggtgactctggttttccggttccgccttcgtttgagggcggggtgtgaattcggcgccgctcagatgggagctgcagaaatcggaacggttttgtctcccctgtttttgcagttggtatatcattcgtttgtttatggaacgaaatgcgagtcaaatccagcgttgcatttttttttgggtgggggggctggggatttccttgtcgggagagaagaaatttcgattctggctttgattcctcccacatggagaggccaattctgaggcgcgaagcgcggcgagatctgcgagggcacgtccggctcgaataatttgtgacggcgattcctgtggcgtgccccggaatactgtgggtaggcggaggacgaggctgcactgtgcaatctgaccaccagccgaagccgagggtccggggtcatctttcccgtctacagtgccggcgaccgcagcggtggtgcccgctcccatctgcggccaccaataaaggctgcgatgggcgggacctaggccaacacttgaactggtggaaaaggctgcctccttttctaactcaatcatctttacctgtcgtgttgctcgcctttttggttcaactccgcctgccaagcaggttcggcgtccaactctagtggcaactaccagtggtacggtactcgctcgcttgctcactcgtctcccctccctgttgccatgagagcgcggttgctgtgttgtttgtactaggcgggcatcaattctagtttgctttggctgtttcttcttgggtcttaggttgttgagttgtttgctttggcagttgggttttctggcttagtgcttctggatttgtaggcatcgctggttgtctagaggaagaag

SEQ ID NO: 4280 - DNA, 88 bp, Zea mays
aaacaaagaccgatcaatctgagggacctgaaccgtcaagccagaccaaggcttaaatgggtctgtcttctccaaccaaagccaacga

SEQ ID NO: 4281 - DNA, 1500 bp, Zea mays
agattttatagcgatcggttaggataaacgtgacagccaagaaacaaaaaaatcaaacggcaaaaggtagccgcgcccccgcaaggtgaggggccggatttcggcggaccattcatgcgcatgtcgtgcgcccgcgcccttcgccccgccccggcaaggcaaggcaaggcaagtgaaagggaaatgtgcccttgggccatttctaagtattttggtgattaagtgcaaacacaggtgccaatatgtgaaaatatgcccatggatggacaagttgcaaatcacaagtaaaggtatgtttctaagccttagtacattggttttgtgtactaatataattgtctaagtgtttagaaacagaaagaagaagagaagagaagacttggctgtgtgcagccaaggggctgtttcggtctggggcaccggactgtccggtggtgcaccggacagtgtccggtggggcaccggacagtgtccggtgcgccaggttgcctcggccgaagaggccgctctcgggtttttctccggcgacttcggctaaaattcaccggactgtccggtgtgcaccggactgtccggtgagccaacggtcggccgggccaacggtcggccgcgcgatcggcgcgcgacacgtggccgagccaacggtcggaaggaagcaccggactgtccggtgtgcaccggactgtccggtgcgccagatctgcaacggtcggcaacggtcggcttcgccatttaaggaaataaatcgggcaccggacagtgtccggtgtgcaccggactgtccggtgcgcccgacgacagaaggcaaagatggccttccagatttgttctcaacggctcctagctgccttggggctataaaagggacccctaggcgcatggaggagtacaccaagcattcctacaactcttctaagcaccaagacatcaatctcacgcattcgtttcattgtgatagcatatagagctcttgtggagttgtgaactctttgtgttgcgttgcgagctcttgttgcgacttgtgtgcgtgttgttgctctgattttcgagtcttgtgtgcgttgctcattcccaccttactccgtatttctttgtgaactcaattgtaagggcgagagactccaagttgtggagattcctcgcaaacgggaaaagatcaaaggaaagaaaaacaccgtggtattcaagttgatcattggatcacttgagaggagttgagtgcaactctcgtccgttgggacgccacaacgtggagtaggcaagttttgtacttggccgaaccacgggataaccaccgtgtcaactctgtgattgctttcttgtggttatcgtgttttgagttctctctagccacttggccatacttgtgctaacccttaacaagtttttgtggcttaagttttgaacttttacaggatcacctattcacccccccctctaggtgctctcaattggtatcagagccgttctcttcaagaaagggactaaccgcccgaagag

SEQ ID NO: 4282 - DNA, 1500 bp, Zea mays
ggaatgactctctttatgcttcaacatgtgtgtttgacatagagatagagatttgagtttgatttgcaaaaacaaaccaagtggtggcaaaggatgatccatatatgccaaaattgaatcaaaatcaatttgagttttatttgaagtgattttgcacttgttctagttgctttatgttgtgttggcataaatcaccaaaaagggggagattgaaagggaaatgtgcccttgggccatttctaagtattttggtgattgagtgtcaacacaagtgcttaaatgtgaatcaatgcacatggatgaacaaagtgcaaatctagagcaaaggtatgtttctaagtcttagtacattggttttgtgtactaatatacttgtctaagtattagaaacaggaagaagaagagaagaagaaagttggctgtgtacagccaagaggctgtttcggtctggggcaccggactgtccggtggtgcaccggacagtgtccggtgcgccaggctgcctcggccgaagaggccgctctcgggaatttgctgacggcgtacggctaaaattcaccggactgtccggtgtgcaccggactgtccggtgagccaacggtcggccagggccaacggtcggccgcgcgatcagcgcaggacacgtggccgagcccaacggtcggaagggggcaccggactgtccggtgtgcaccggacatgtccggtgcgccaacggctcccgcatctgcaacggtcggcttcgccaaataaggaaaggaatcgggcaccggacactgtccggtgtgcaccggactgtccggtgcgcccgacgacagaaggcaaagatggccttccagatttgttctcaacggctcctagctgccttggggctataaaagggacccctaggcgcatggaggagaacaccaagcaactcttgagcattcttgatcatccacactcagtctttgcgcatccgtttgtgattctaagtgattcgagctctgttcttgtgagaaactgtgagatagtctttgagctcgattcttggccgtgtgtgtgcgcatttcgctgtggatttgtgtgtgttgcttccctcccttactccgtgcttctttgtgaatcttaagtgtaagggcgagagactccaatttgtggagattcctcgcaagtgggataaagataagcaaggcaaaaacaccgtggtattcaagtgggtctttggaccgcttgagaggggttgattgcaaccctcgtccgttgggacgccacaacgtggaagtaggcaagttttgtacttggccgaaccacgggataaatctctatgtcttctctgtgattgtcatattgtgcaagatctcctccttagccacttggcaactattgtgctaactcttaacaagtttttgtggctttaagttaagtttttacaggatcacctattcaccccccccctctaggtgctctcaattggtatcggagccgttctcttcacaaagggacttaccgcccgaagag

SEQ ID NO: 4283 - DNA, 1500 bp, Zea mays
acctaaactaaaaatcagcaacgcatcatcccaggttaaaatcacaatggtggcaaggactaggttgtacccagttggttcgttcgctaggtgtgcgagcgatcagatatgggttcgatccctaggattgccccatttcaggtttttccttggtagggttttacacacgcgttcgtgttcagtggtaccacgtatttgcacgcactagaggtctagatctctcattgtctactatattaaaacaataatttttttagttttccaccgtcgtctctttcataaaaaagtacatatacttctttctaatctaattcgtggtctaaacatcatcctttcatgctatatgcaaaaataagataaaattatgtacaattgaaggttcaaactttggttgttggttccacatttacaaccacctaaccaatagaacatataattttgtgttctattaaaataaaagcacatggtatatatagaaacacgagcgtgtggtgtgatatatgtagtggtgtgagttattttttgagagatcaggaggggggaaaccctactggaaattttattattactggaaaattacagtttatatcatacagtgagccaaattacacaagggaggggctaattaagattgtccttgctgaagccagttaggaatggaggaatcgaatcttccccgtactctatggatgagtggtgtgagttattgatgtgcttgtaccctataaaaaaaatcacagcggtggcggtcaatcatcaaaagccgtagtcagtcaccggagtgctgccaatcgcgatcagggctgaaatacactgccagcctcttccaacagaccaccacacctcgtccctttcgactgctttctgctaaaagacgtgtgcggtggcttaaaaaaaagccccagaagcccagaacgccactgcggcccaccaaaaaaaaaagccccggcctcgctccaagcccgccgtcccaggaggtggatcggccgctccactccacaatccacacgaaaccgcccccggccgcacgagcacgaccgaaaccccagcgcggcgcgaccgttggagccgcagattttcccacgctgccccttctctgaccgacgggtgcgtgcaaaggcaggggtagttcagggatttgggggagcctgagaaagaccaaggtcgcgcacactgcccgaaacctcatgcctcgctgttggtggaccggaccgttactgcacacctgtttgtcacaggcaacacgcgtctccgtcctcccacctcactctagccttctcccccagcagcaaaaatggtaaaaggtgcgaagactgcgtgacatgtgaagaagagggcagagagagtgctccagcattagcctttgctctcgtctgctcgctcaacggctacttcctgcgtcgccgtggtgctgggtttgggagactgggggaggcggattgtaggaagagctggtgtgtggtgcggtggtcaccaaagagcgccggaaccggagcggcg

SEQ ID NO: 4284 - DNA, 785 bp, Zea mays
ctgcagacacatcccggtataaacagatatccttttccatgaacagagaaattcttttatcattcgtatttataacattgatatgatccaacatataaacgtactgtaatcatatatttctagtgaacctagatattaccgtaccaaaccaaatccatggaattcattatgcttaaaattcattaccaatatcaaatacccaggccatcctgcttccaatttgaattttttttctctcatgaagatggtaaagatactcaaatttgtttacatatggtatcatatttgggcttttgtttaaggaagttagatgccaaatcttgtgtacaagttcagagctaatcagatcaatgtctttcaactgccagagcaattccagagagagaactacgaccgccgccgccgccagtgcgacaggcgcgaccagcacgtcctgcccacgcttcaccacacaagcggctcctcttcacaatcgccgtcactggaatagcagttatgatcggctccatactgttccagagggacgagggtttctagctccagtagccatggactcgctctgtcaaggtgcttcttgaccgggagagtcatgcggtcatgccacaggaaggtggtattaatgtataataactcgttcgaatcaattacaataactggagtttgttagggagtatagccccaggcatgcattcgtcaaaaggcgaagttatgttctgcccctggcagttctgagacttgtgtttgctttgacactgcacttgaatttgttcatctgtaagtcagag

SEQ ID NO: 4285 - DNA, 1102 bp, Zea mays
tgacctcacatgaaatcctaaaacttctacggaggccggcgtggggcccactggagcatcctttgccgagtgccggtccagcagacactcggcaaagtctccgtcgctgtcacttggtgtcgtcacagcgacttttctttgtcgagtttcagctggcacttggcaaagactttgacgagtgcccgatataaagtactcgacaaagtggccgttgccgatgtatagtttaccgagttctatttgccgaatgtcacactcatcaaagtgtttgccgagagaactctgttcttgtagtgcattaagtggactacaaaaaatcgattaactctcggtatgcatcttaatttttgacagctcacaagttgccgctaaaaataacttgcttattttcggttgccatgtgtccgccataaaaaaataagttattttcgactgctgatatatggtcgtcgaaaataaacgagttattttatcggcggctgacacatggcgtgaaaaataagttattttcaatggctaacatatggtcatgagttattttcgacggctttcacacgtagcaactctagatttagggtgtttggcagactctgaccagcttctctttagagttgtgctcaggagtcatgtcaaacatgcccttaagcgcgaataaggtaaaaaaaacgtaccatttgcacggtatttatgcataggtcttagcctcataggcatttcagtatccatattacacaggtctagcccacataatagtgtttagttcaggtgcctattgtttttttccatgtttctttcatgcttcgaggcgccaatggtttttattaaaaaaaatgctacaaaagtcgatcttgacatgaccactaaacaagttgcaaagcttgcacagttcagtgctaagctagctccactgcctataagaatyyccatggggcttcaagacaaggcccatgcatytgaaacttacaattgagctgtctcatctccacagctctcgctgatatagcatatactatcccctcatagaaagcttcaggcacagcaactcagatcctaagtaaatcattttggcaagcagcttcattaagctttccacacatcaaat

SEQ ID NO: 4286 - DNA, 475 bp, Zea mays
cctcagatcgaggaccccgtcgaggaatcgctgtttttttttctggaagttcccatcctgaaattggttatccatgtcttttgagttccccgttccgattgctcaggaagtttcccactctggaaccggccattgcttgattgcttcttggtctaccgtgtacttcaacgttgccttgcctacatgtctcagcatcttatatatatttagacaagacacttgtggtctacatatcgactgtagtgttgggtatctaacctcctggtaccatctatactccttcaatgctaagcaatcattgactgatatagtgatagctccagccaacagtactttcagcatttcattttgttatatatgcatcttgtcaattctttgtttgcccctgttctcctggtggaacaagtaagcgcgtgctaatccgatgccgaacaatttttttttgtggcgcacaggttggtagcatgtgagagtg

SEQ ID NO: 4287 - DNA, 242 bp, Zea mays
tctagcacggtagagcctcgtcaaagctttgcatggaagatggaacacggatgcaagccgttgagcagggagattttgtggccgaagaagttgctcttccatggaatggaatggacgactcggcgccgagaatattctcacttcctcctctctatacattggcggcgcactcttgcttcttccgcatcctctatatttggccgggttggagcagcagcgatcgatcgcccggggctcggcca

SEQ ID NO: 4288 - DNA, 326 bp, Zea mays
gcgccatggtttgcagtttggcacgcggcgggtggtcgtcgcggcggcgtaaggaagggttttgtggagaatgctgtaggctgtagcggcggtacccgttcgtgcaaggatggtgggagccggacagtcaaagtgtcgaaccaaacccgagtcaccctcgcgcgccgtatgccgtttaggctcggtcgccccatgttggcccgatcggtttcattttgtagctcaaagctcaaaggtgaggctagggtttctttgcgccaaaccagcgaggcagcgactgttttgtcgccacaacactcccgccgaccccctcgccgccgccggga

SEQ ID NO: 4289 - DNA, 871 bp, Zea mays
tccgatgggaattcctcgttgccgtgcctactcacgtgtagggctctccattcacatcctctcacatcttcctttgaactggatgaatcgtttgtttgccctccaaattcgccctttgtgctgcccaatcggtgttgtgtcggagtaaatattcccttggatatgctgctttcctgcatcctttttcctctattacgcctgcgtcagcatgtcttagaggtgtttaaaggcactagaactgatagttagtggctaaaattagttgagacattcaaacatcctatctaatagttcaactattagatatttttggtaatttagttaatagttaggtagatatttatcagctagctaatttcaataacattttttagccaattaactatttgttctagtgtattcaaacacctagcatggataatgcaggagacaaataataatagaagaaattgttgggccacaatatgggctataggtacaatacaagtccagcaaaatgcagaggcccaccggcgcactgcggcgtccgacgatgcacttttacaagaaattgatgagtaggactgaacgcccggacaaccgttggatcgatttgcgatggacgtacgcacagcagcctgcagtactgcagacgatctggttccgcacggccctgcgtaacgaatatcgtccgtacgatcaagagcgaacgatatctgacgaggaagcaaaccaggcgtggtcgcatttaaaaccgccagctcagcgcagcgggcagattagtcgactccatttcgcttccccgtccatctcattcctcttctctcctcccctccctcggcctttctcccatccccgttcgaagaagccgccgataccgcggcagtcgagg

SEQ ID NO: 4290 - DNA, 282 bp, Zea mays
ccagttcaacatagttaactagtacaaagggtgggactgaagcaaccggtgaactctgtgtaacatgttatttatgtttgcctgcctgaagtaagcctcaacaacgtgccaccatagcaatatttgttataagaaatagttactgtaacatggatttcagtatttttctgtcagttttatgctcttaccagtattcagtcagtggattgacattttgtatacttttctcaggtcccattatatccggcttcattatttcagaatgaaacagatggggaaggg

SEQ ID NO: 4291 - DNA, 300 bp, Zea mays
ttgcatgcctgcagacgaacttggagagggaagaaatgtcctttgcaaaagattgtagatgccctgacgcgacacggcaattcccaagcaaccattccctgtccattatcgtaaactcagtcctctggtcctttgtaaacaactcccaacgttggcacggctccaaagcgccgtgccgcgcccaaaacaagaacgctaatctaacgcatgcatggaacgtaacaaacaagcacgtagttcttattaaattgtccatgcacgctcacagctcacacactggctcacagcaataagccagcc

SEQ ID NO: 4292 - DNA, 1500 bp, Zea mays
gattggcaactgaaatcacgctggggatccatccattgtccatgcattaggcatgggcggcagcgagagaggcgcttgcacacttactgctgtctgaacgctcgcgcgctagaacctggaagactctcacgcgacgtgctatacgctacacgcctagtagacgcatgcactcgtagttgcagcgagcttcgtgtggtccataacttgtggctccgtgacttgctaacaactgtagccgtctacgtacccgatcaccgttcttttatttgcacgcgtcgggaatccccctacgacacgaagcaatgtacaacccagatgccttgttgcggttcagaaagcactacgttcatacaatttaatatatataataatttcggtatcttattcaatagaaccaattaagagaaccacgttaaagatgttttgtcatcaagatacatacttatttttttttttttgcaattattcgcttacctttaagattcgggtcatattaatatggattctacccaacattaattatttattcacatcgtttgcgctagctaataactggcgtgacggatcagctcgaagccttcgatgcgagccagccagccaaccaacgccggttagttgatcgtgtcctcgtcgtcaccgcattgaatgccacaaacgctatcgccagccgctcttttggatcgcgcgagagctttccatgcccgccgccctgcaggctgcagctggaagcctggacatttactatcaagtgatctctaccaagacggtgcaataaaatctcctagaacaagagagggagtcaaatccgcgtaaaccaatgcaagggtggtgcgcagggccccgcgggcaggcggtggcatgaagtttccgtttgcttgcatgtggagtgtctccggggccggtccggacgccgcgtgctggctggcctgtcttttcccgtgaccccatccgtttccaagccactccaacccagggagggagcacacgtacgcgccccggagggagtggcgacagtacggatggcatccgtgaacaaacaaaatattgccattattcaccaatcacatgctaataataagctcatacagtcattcactggaactggaagtacacacaccgatcgatcgacattctgacctccacatgcatggtaaaaccaaccaaccccagtcgactgtcgtcgcagaccggccggcagctagatctcgtcgctaggaatcaatcagcacaaccccaacctaaccgtgactgctcctccaaccatgcacgcgcacatgcagagggtcgccaatatgaatgctgatctagtgcttctagcaagtaggagtagtagcaaccaagctaccctatctataagtactacggctcgaatgtgtcggccgacggcaatcaccattacatttgatccgccgcgcgcggcccgatcgacgagcgagagcctcattcacaccccgatctagctagctagctagtttacgaaaaaaaaatctggccacaggg

SEQ ID NO: 4293 - DNA, 1316 bp, Zea mays
ggtgagctacgcatattcttttcgattttgtatcgtccaatccgattccgatcttgccgcaacttttgatcttccttctcgaactgaaccacctacgtaacaaactgtttattttcttcttctttcttttcccaaggattctaattatacgtagacctttgatccgacgatgcttcatgtctttgtttccctagctggtcaaatctggacgtaaacccggcggcagtgctcgatcgcgccgggccgtcgaagtgaagggaatcgagatcaaggcggcggcggcggcgaaggcgaaggtattgccaccgctgcgaatcctcgccgcccttgcgatagcagcatggaccttattcctgtacgtgcatttctccgtgatcaccggcacggtggaggtgatgagcaacggcgaagacctcgccgacccctgccggggacggtacatctacatgcacgagctgccgcggcgtttcaacgccgacatcgtccacacctgccgcaaccgcaagaccgaggaccactggggcgacatctgcgcctcccttagcaccgcgggccctcggccgtccgctcgacggcgacagcgtcatcacgggcgaaatctgggtgggaccggcacgcaccagttcgctctggacgccatcttccacaaccggatggttcagtacgagtgcctgaccaaccactcggccgtggcatccgccgtgtttgtcccgttctacgccggcttcgacttcgcccgctaccattggggctacgacaacgccaccagggacgccgcgtcggtggacctgacagagtggctcatggcacgacccgagtggcggcgcatgggagggcgcgaccacttcctcgtcgccgggcgaacggggtgggacttccggaggatcagcaacctcggcgcggactggggcaacgacctcctcgtcatcccgggagcccggaacatgtccgtgctcgtgctggaatccacgctgaaacgcggcaccgacttctccgtgccgtacccgacttacttccaccctaggtcggatgccgacgtgctccggtggcaggacagggtgcgcggccagcgccggacgtggctcatggcgttcgtgggcgcgccgcgaccggacgttcagatgagcatccgggtccgggatcacgtcatcgcgcagtgcaaggcgtccggcgcctgcgccatgctgagctgcgcgcgcacccccagcagcaggcagtgccacaggcccgccaacatcatgcggctgttccagaaggccaccttctgcctgcagccgccgggcgactcgtgcacgcggcggtcggtgttcgactcg

SEQ ID NO: 4294 - DNA, 1500 bp, Zea mays
tccttgagattaagaagaagcactcgccggtcttggtgatcggtggattgagggaaagggtcgaaaaagacccatccttagtggactcctcaatggggattaggtttttggtgaaccgaacctcggtaaaacaaatcacccgtgtcacttgtgtttattgcttgtgatttgtttgttttctccctctttaagttctcttgcactattcttattgatattactttgtgttacctcaagttaaattctcatatattgaagcaacaccttgcaagaaagaacttatgttatttctcttctcatctaattcctcttgcattattctccataaacattttagttgtgttgcttttgttaattccgcaatatttgaaagcaacactctttgcaagcaaaggacttagttttatactccgataaattgcgcatattgttataaccactaatcaagggatcaagtatgggtttagagttataattttcaggtttcgtctattcaccccctctaggcgactttcgagaacctactccccgttgaggagtccacgtaggacatgtcagtttcaaccatttccatctttcaaacggtcatttatactagatgagtgcttcttcttaatctggagggtcatttagacccgcaaggatcaacacgcacttaggcgtctcttgttatctttacaagtgaatgagaaatagaagatgaggaaagcatgatcaagaaaaccaagccaaaagagcaacaagaaaatcacaatgtcacatctctctkgagtctctccaaaacactaatcactaatgatctttaaacataattatggtacttggagaggactttgatgctttgagtgtgtggatggagtgaagtcttgctctttgcaatgaatattggtgctggaagctttgatgccattgaaggggatggttgggatggtatttatagccctcaaccatcatatagtcgttgcctttttacggacagttcgcgagcctagtccgaatgatcggcacctataagatcaatgactagatcacaaagatcaattgtaatggctatatcacaaagatcacaaaatctggatccccgataaaatttcgtgtaggctataccgaacattgccggaggtaatgaggaggagaaaatgaaccgttacagtgtcttgtgtaggcatctgacagcaaggggtcctgatttctgaacctgatggcaagcggtgagacaactccctcgggaggcagcgaggacctccttgacggcgcccctcgacggcgtaccggcggttccacctccatttggcggcgcgcggggggctgcacctcctttgggcggcgtgcgcgaacaagagccgcagcctctcccgcttgtctttgggagggaacgctggcaacctcatcttctttcgacgctagatttggacagtaaagtcccgcagtgacttgccagttgccactgccagagcggtcaccgaatctgaggtctgagcccagcgggccgcggcggct

SEQ ID NO: 4295 - DNA, 1175 bp, Zea mays
tagaatcacactgactgaaccagacaaaatcttccctagagtgacgattggcgtcccctccccgattcttcacttcacgcagggtttcctcataaattgagggatagtaggatacggccaagacgagaccatacggtttgccaacaccatggcgcccacggcccacccataggcagatacggaaacggcatttgcgtgttcccggacgtcgcaggggcatatccgtcctccccgcagaaagaaggcccctctatctgtatcgggccatttcgctacgtgcgccctccctaaaatacgaagcgacagcgtatctggtgcacaagtgcacaaattccaactagaacgttcatcctaaaaccaacgaatygctccctttttgcaaaataaaccttgcgcttgttcctttgctggcgctgcgcatttgcaattagctcccacgggcaggtgcccttcgccaatacagagcggccatcatccatcttcacttcttgacgaaatcatcacatggcctagctggtcgccgtcggtcgcccacaccgccgctcgtccatgccacccgtcgcccacgacgtcactcggaccgccgtcgtccgcccacgccattgcttgtctacgccgccacctgctgcccttgccgtcgccctgacgcccatcactctattaaaattgcatcaacatttcagctctcatatgtgtcatttcaacgtttcagcgggaaaacaatttatgattttagccttgtacatgtatgagaaggatgatggtttgcctcgatcaaagctggactcaaaactccgtatcaggggaagagcacctggcctcgcgggggctaatcacaaataccaagcaccagcagcgtggggtttattttgtaaaatcgtgggaaccattgatttcggaatgtacgcatcagatagaacttgtgcaccagggatggtttctgcacccgatacgctgcaaacaaaacgagagcgaagcgaagaagcgcgtcttccacggttcgtctcgtccacttgcttgcctcctcctcccctctcccgcgggtctcctccatcctccgcctctcttccccacgccgccacagcttcccgcactccaaggcgcggcaccaaccaaccgcacccccgcgggagctggcgtgagcaggtctgcgtgcgtgtcgctatcttcccccc

SEQ ID NO: 4296 - DNA, 422 bp, Zea mays
cctgacagctgtgttaggctacttcatatgaggtacgtggagtctacttgtcatggtatcatgtgggcacaggaagctcctcgtccagccaaagaaacaatacattttttcttattaacaaaaagtaaccgaacaatgctgttatgtaaaacagcagcagtcggttaaaattcgaactctcttgcgaagcaaactgtgcaggaatgtttaatgatcataatgtgatggtcctgtaagaatcgtgcagttgttccaaatatgggttaaacttagtttacctgttacattgtcatgtggttgtgggcactgtgaaagctctttggccactcacagaagccctagaataagaatattgctaatgatgagaagtaactaaaacaatatcatacaattgcagtgctctctccaatagtttggagggt

SEQ ID NO: 4297 - DNA, 495 bp, Zea mays
gccatgtcgacctctggcttcgtagactgggtctcgacctgagcttcttttacttattaaccccgatcgagctgaagatcaattacaagacgtatttgattttgccacggtgcgcaagaagtttcaaagcagctggttgagtttcagctccgcacgtcaccggcaatttctcgttactcaacaatcacaagctagctcaaaacgaatacaagtcaagtcaatgacgcgttttccgtacggtccagtgagcagatttttttttgtctcatctttattttagcatatcagcggctagtgaattagtgataagatccatacatattttcataggatcattcgtcaacgctatcgtatccttcaccaaaaatatacaattatacatacatatatatatctgtacatatacatgtcttgatcgatctttataccaacgcaaactcacagaagcaacgtgagtacgtgacacgcaaatcatcagctcaaccagaaatcaga

SEQ ID NO: 4298 - DNA, 816 bp, Zea mays
cggccattaagaatatgcttgccatgttccttttcttttctctttttctttcttttctaggttgtatgcatcttatggttgtagaggccgggagatgatttgtatcaaacttttaaatgcaatgaaaatcttccttatcgaaaaaatcttatttcagtttatttgtgattctatagtgatattttactctcatgacttttcatcataatatatccaacttatataatttagaagggaaacaaacatggccttaagtatcattccattccatcttatcattgcaaccaaacacttgcaaccaaacacttactaaagtgcttgtcggaggtcaaaaagtaatgtgccatcatggggtgcaactgtggcgcagagtccctaccgggagttccttcaatttcaatttttggtatacgtatatttgatacaattcaatgagctctcagataaattggttttcgagtacaaaatttatttcctcaatccatcttttcttcttttcgacgatgaaagtagcaatccgcttgaattctacaagagcattcgaacacgaacaaatttccagcaagcaacagccaacaaggttccgcaccgcacggccactttggccttttggatcctcggggccacctgacagacttacctgaccccagctgtcattgactacggaccgcacagtacaccccctcgtttcccttcctgcacagtacagtggtacttgaagtcgaaggcagcgcagcaggtacgccaggacgccattagcagcggttggccaccagcccaccacccgacgccggaggcccggaggaggaggcggcg

SEQ ID NO: 4299 - DNA, 1500 bp, Zea mays
cttgaactaggctagctagttaattgtgagtagggcaggatatcgagccggctcggcgagttcgagttcaagctggctcggcgagttcgagttcgagctggctcggcgagttaagctaacaagccacagagttagctcagctcgtctcgtttagcttgcgagctagaccaggaaaaacaatatgtatataatgatcaatttctagttaattccaaactaatttaacaatagaaaatagtaattatactcatagtttcacgaaccatatcaatgtaacaccaaattaacacaagtcatcactcatgaattcacaattcactcgcatgttcatcagtttaatccatagttatattcgcatagaccaatttaacacatagacacattttatcaatcattagtttaactcataggccatagacatctcacatatatataacatgttcatcaatttttacgtaaatgataaacatataatttcgttttactagaatatggtagctcgtttagctcgcgagctggctcgttaacgaaccgagctggctcgttaacgaaccgagctagaatgtcagctcagctcgtgacaaaattcaaacgagccgatccgagccgagccgagctgaccacgaaacgagcgagccagcgagccacgagcattttgtccagccctacacacacatacacatacacatacacacttgattacttgaagagcacgtcatgaattccaatgcttctcttctaaactcgtgagcttagaacgagtgtgcagcagcaccgttcccatctagatacgcgatatgatgatacaccgaaatggtgcccctttgggatgtgacgcgaattgccaaatttgactgaatcctttccagccctggaattccaccccagtcattcaaccaatcaaccacacgagggcatccctccagactccagtgatccagtccgtggccgtggcgtgctggaccggcggctaggcgggcacgtcagccgccagctaagcgaccaactcttcaaaaccccggtctctccctcgagcagtcgagctcctccggtctctgccatgaacagcaaatgagcagagctcccaagccgttcaatcttcaaatcatgccgtgcttcttcctttttttgccatgctcgtccggccaccaaaacagcaaatggcctattttctccccctctctgtctgtctgccaagaacagcaaataagcagagctccaagccgttcaatctccagaccatgacgtgcttcttccttccttttttttgccacgctcgtccggccaccaaaacagcaaatgggctattttctctccctctctgtccgtgtcttgttgtagcatctcatgattcttttttctacttgtacaggattaggagtgcacctattttgattctgcgaactgagtaactgattctaaaggtaactgaaattctactctctgaaacttgcattttccaagattctaaaggttgtaattagtttttaatttgtctag

SEQ ID NO: 4300 - DNA, 162 bp, Zea mays
ggatttttagaattcttcgtcatgtgagtctctgaccggattgattgattgattaacgagtctctcgctcctggaactcgcagggcgtacgaccgggcggcgatcaagttccgcggcgtggacgccgacatcaacttcaacctcagcgactacgaggatgac

SEQ ID NO: 4301 - DNA, 288 bp, Zea mays
ggtaaagattctcatttttttcgcaaacaaatgtttagtttctgcaaacttttatttataattatgtgggtggtgaaaattagtaatctgaacagtgcttactgaaaggagactttgtccagcctcatttgagtcctttctgcagctaacgtttgcagttctactaagcatttatatttatacaaaatattattcactcgatcgatattctttgcttactatttgatttttctatcataaaatggattatccttcacatatgttattttaccttatgaatcttatatc

SEQ ID NO: 4302 - DNA, 1500 bp, Zea mays
ggtcgttccacctcgcagggttgcttgatagagacttrgtcaacaagtgtttgtcgagaatcttgagcctactttggactcccgattcttgggtacctgataatattgttatttattgtgcaacatgatttgaataaaatacagataagtcttgtcaaaattttaatttttttaactaaaatacgtttctcggtcaaaaaagacgaaatttggttgagaaacgtaaactgttcaggaaatgcgaaattmgagcaaaattcagttatttttcgttttcgaaaacaggcagaattaggttaaaggcctgtttggtttactacctaacttcccacattttacctaaggttagtttttcaattcggacgaaccttaggtaaagtgtggcacagttagacgcgaaccaaacatgccttaaaaaaagatagaaaaccctggttattggagacagcctaggagcagaattgtcatgtgccgtgagcagccgtgacttcgttgtgttttgttgcctcacgcggtaaatagttggaaacaagcgctgcccacagcaaaaagctcggccgcagacatttccggtgctgcgggcgctgcgcatctcttgccacccaggtgggagtttgtgggccagtccgtttgaaaccgtgacactgtcgtcagggcccaccgccagtccaccttttcctctcaccccatcccatctccggatctatcgccctcgccatcggcaatcgrcatcgccaccggtagtgggagggagcaagggggggacccaggccaacgccgcgcacctttgccctcttatcatcatcaacatcaccacgggcgggggagacggccctcgaagcgtacccgtccccatcctccttttccgaaccaccggagcgcggcggcgcggcgcgagacccttcccggcttctactcctccgatcctccgcaccggctgacgagtagcccactcactggtaagccccgcccgctcgttgctcccttcgtgcctgattcggtccctccgtgcctgattctgtcacgcggttttctcttgtttgattggatcgattgtttgctgcggaatctgcgtagtgcttgttcttagtctctggtgtcatgggaagaaatcgcgtgcctcagtgccctgtacggagtgaccgatctcggatggggactggcaggccagttttgctgtcattagtgatccgcgcggtgcgtaattgttcgagatttagttctatttgggaagcccagccgcgatacatgcaaaattcagttccattcccctgaaatttcggtgcctaatttaaatcagttcccttgcactggaatttcgttgcctaatttgttgttgttgttcctgctgctctctagggagaacctaaccaatctcctgttcttgtgcagggggacgtgggatcgatcggcggctgatgggaggctagattccgcaatcccacagactagacacatccccttcgcggttgactttggcgaatcgaccttgatctgaaa

SEQ ID NO: 4303 - DNA, 612 bp, Zea mays
accaccccaccattcattgcatccaagttttccacttcccaactactacaagagctctagcattcaattctagacacaccaaagagatcaaatcctctccaaactccacacaacgccatagtgactagagagagtgatttgcttgtgttctttcgagctcttgcgcttggattgcttcttttctttctcgcttgttcttgagatcataactccattgtaatcmaggcaagaggcaccaattgtgtggtggcccttgcggggaagttttattcccggctttgatttgagaagagaagctcactcgatccgagggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcgcggactcgtttctttattactaacgctaaccccggcttgtagttgtgtttataattgtaaatttcagtttcgccctattcaccccccctctaggcgactttcaattggtatcagagcccggtgcttcattagagcctaaccgctcgaagtg

SEQ ID NO: 4304 - DNA, 976 bp, Zea mays
ctgtcctattcttctgatgtatgggtatgggtcactgtagagaccccggtgtccattcagcgctgcgaggcctagctggctaggtgcgactgctttcaacctccactacggccgacgggtcgtctatgatttaagttggatagtgttacgtcctcacatatttgttcgtgctgttcaatctaactagcatgctagagttatacctgctagtatatgaggtaatcatgatttatattatgattttacgggaaattgtctacttttttttctgaaaaaaatgttatgacaatgctatgtatacctatcattgcaagtgcagtgcagccgataaaggcatatgtatatcaaccatgtcaaacagtgacaaataaaggagcaggccgggggcgcctttgagaaagaaagagagagaggtggccacatcctgatctgtgttcagtgttgtgctgctgctgggtttgtggccactggccaggcaggccaacaccaatggcgactgcatcattgcccacacaccgaaagctaagcaagggagaaataaagggagaacagctcccgtgcactacccccagcccagcagctatggtattggtatggtagctagctagggttctgtaaccaatctcacccatcttttctttccttcgtcggagaaggggagaaaagcgtacctgaaacgattccctgcattccattccgctgcatacttgcattgcatctcatccctcctgctcctgcgtcctcctcctctatttctctcctgctgcttgctactacctcatcgatccattccatccatcgccgaggggggagggccgccgcccgcccgggtcgcatcgcatcgcctggtcggccggggactcggggcaggcgagcgacactagctataaaagacctcccgccgcctgcgactgggccgtgtgcaagcaaattaaagcgcaaggccgatccgagggtggactgtggagggccggcc

SEQ ID NO: 4305 - DNA, 1207 bp, Zea mays
ggtacattcaggttcatctgcccagagcgcagggtgatgcttttattttactgctgggtcatttttgaagcaacaacacatgtttaaaattgaagctgatttatttctgttttcttacattttttgctagacaaaactactattttttttttttctgttagcatgtttttcctgggatgccaatcgagtaaagcatgactgtgcaattgagtagggtcggagtcaggacctttttgtgctgtcacttgacagcattagattctacgaattcatggctatattactgttgagctaacagaaaacaatgataataatcatgtttcttacactggtracatcaataattatcaactctggatccgccctgcagttgaccatggagaggccttgcaactatcagcaatctattttcagttgcattgtgccctagtaaaatttctatgaagttaattaccgtatagcattatccacttgcatattttcattatttttctcttggctatacatgtttacatttgtctgcattcttccttttttaaaataaaaatatgccctgctttttaggaaaacacatataaggtagcttgcctgctttctttgtcaacttggtttggcaaatatatggctgtatttgttatcagttttcatctcatctaggcaggataaaacagggaacttaggagcgcatattcgttgatgcctgagtgcaatgtgcaagagcacgtcacctactgaattttacatatttctattagttttctctttgggggttccatttgacttcaatcgttgtcgacttgatttctgatgaaaggaaraatgactatgttatattataagctttccttctcagctaggaagataatacaaaaaaaaaactgaaaagaaaggtttggatagcctcttactctgattcattgcaagtaactaaatgcgatgcaacagttcatttgtgaatcaacgatgacagactgcaaaacccatccacaatattgaaacttttattttcagaatgtcgtgataaatttattcattcacatgatatgaatccttttatggtgacttggtgcagggccacttcgatatactctctctttcgggctcattcttgcttgcagaggatggtgacactcgcagcagaacaggtggtttgagcgtggcactggctggaagtgatggacgcatagttggaggttgtgttgctgga

SEQ ID NO: 4306 - DNA, 763 bp, Zea mays
ttagctagttcaatccaactaaaatcaagtaatatttatcgaattactagttaaccagttaaatcaattagcaatttttatatagctaacaattaccacccatgcattcgaaaaggctcagactattttcagagtacatatatttattttaaacgtcattatgtaaactgtatagtytaaaaaacaaaaggagtttttatgtggccatatacacatatcctacgaattgggggccgcagcgacaagcgtgaggacaaaatcgtacatctcacaatcgcaagcgccggcccgggcgatggatatgaggggccgccggccgccgcaccaggcaccwccgcaccgcaccgcaccacccaaacggytataattaggcggttccaaaggaaacgcccctctctcgctcttgcggcggcgaccccgcggtttcgagccaatcaccgccaagtcctcgactccagcgcccttgccttgccaccccggccccagctaccacggggagctgcaaataacctgcggccccgaggaccggacagcaaaagcgcccaaccgctggagctccgccccggcgatcacccgccgggaacgtagcgcccggctccacagccgcgccattcgagctgctgctcgcgcgcggctggttcttctcggggggattttctttttgcgggcaccctccgctccccctcaccgccctgccgtcagccgtctcgttttcggattcgtttgctccggcggtggccgacctgccgtgcggggcgcggtg

SEQ ID NO: 4307 - DNA, 1500 bp, Zea mays
gggtcgggggttggtctaagcgggaggtggacgaagacaacgtaccgctgtctccattactctaatctaatgcaggaatgctcacgaggaagtcgccgtcacgagcagacgagctgaggaaaacgagctcggcaactctacaactcctttttttttgttggttttctatataccgcatgggttctaggaaggttcctcgctccttgttcttggagtggacattggagtctggaggcaaacaccgtgatactgatactggcatactgcagcgtgtgacaaggcgagctctgctcccgtcaagccacgcacgaggactcgaggaggcattagctagctgcaagcggctggctcaccggtgacggtgagagaaaccgtgaagcaaaccaaagcaaggcaatgccggaccttcgtgcaaggtcaggtgagtgattgacgacattgacaggcttgaaaggccggttcgtctcatccgctggccgccggctgcgcccgctgtcccccttcgctcctcttctcatgggtctccctaaaacccttcctaaccctgaataataaaaaaaaaacttcatgtccctcctcgcgaatggtacagtgtggtattgtgctactatcgcgaattcctcaatcaggtcaagcctcttccttcctcgaatccatgtcatctttgacgaatccaagcactaggaatctaggatcttgcttggtctcggagttggaggcggctctaattcctccgcccgatcctcggttcggtccaaccacacacctccgctgtcagtccctactgctattctctccttcactcctcgccgaaactgccacgcaggagcacgaggacctcgtgagcccaagcttgaacgctcgtttacttttcgaggttggtgcggttctcgcagctgctgatgccgccgccgccgctttgtttaagcagcaaaccaccgcacctgctgtttcttctcggtccgctttgatcaatcgcctccctttctttctcggtgatcgccttttcctgagattgaaattttatttgtcggtggtccggcactttggctccgtctccgtggccggccgaacaggcggcagacgcaggcagcagcagcagcaggcgctggtggtggcgctggccgttggcgttggcgttgtgaacaagaaattcctcgggtttcacgcggctcccgtcgctttggcgttttggtcccttccttttcttcctttccgctagttttctggtgacggggggtttttgcgctctggttcgtgttgggtttataggacggcacggcaccagctgagttcgcttccccatccccatccccatcccgctcccgcttgctccgtgccgtggtctccgagatcggggttcctttccttgccgatttgatccgcccagctggaaaacgaaaatcgctgatgggttttggaaggaaagttgtcatttcttggtgaggtttccgtttctggatcgactagctgatcgatcgtagtatcgtactagccacc

SEQ ID NO: 4308 - DNA, 1349 bp, Zea mays
agtggaaagaaaggcactagcctaggcacgtcgcctcccagaggcaacatgcaagagatccatccatccatccatgtcttgacttgctgctggctgctgcacgcactcttgccgccatggatgcatgcctgcctggtgcactcgtggagctgctagctgcctgctgctccactcgtgaatcgccgtccttggagctcccgcagcagccaaaaacaaaaacaaagcattgctgtgctgctctcttttccttgatcctgttgcggtgctgtgctgtgctgctgccaccaatgaccaaagcaaaacccacatcatatttgctgctgtctcttgcgatgatgcaacgccaacgcaggcctgccgctagatcgagtggggttcccaacatgggtggtatagtactactccaacgagctactgcacttttgcaggtcttcccgatgacctcttgcgttgtatgcatggattgcgagcaagccaaaggaaagaaaaaaaaacactacttgcacactccagcagctgcgcctgtttgtctttctttctgtctgtccgtctttctttcttttgaaatgtgcagttggcgccaacatctactcatctagctacctacagcacacccaggagctaggaggaggagacaaggacgacaaaagcggaattcccttggcaaatcagcaaccccgagagggaatccatcaccatcagcacgcttaacagaccacacgagcattttgcttgcatgtcctctaattaggagcagagtttagtattttttttttcttttgggtccgcaagaagcttaaagcaagggcgtcgttgggttgtgggctttggagccttctcccctcccgctttcctcgtggccttttctcgggcgtgcaatcaatgcgtcggagcgagcgtgcttgcttgtgagggggtgcatgcggatgacggagctcgctggcattctctcttattactactactactacctgtcaagctcaacaagtcaaaaggctttgcatgtccccacccaacccaaagttcattttcgtttttaagctgcgctagtagctgctgctggtggttcgaagttcattcagagagagcgcgagagggggtgtggctgtctatggcgtacgagaggatacacgaagctcctcaggtaatggccgccggaccaggcaccggcctcctccccccatcatcgcttgctgcagttcttccatttcttttgctcaggtcatctttgaccaatttaaagacctgctactgctggacagcagtgcggaggtctactagtatatgaattcacatcacctcgatgttgttcttgtgtgacggctcggatcggtggattctggacgcag

SEQ ID NO: 4309 - DNA, 1500 bp, Zea mays
ttggcggccccggtgttgcctacgcggtggggttgggcgctgtttatcgcacgtctagagatagacgcgcgggaaccgcgccttcatacttcagtaaggggtacccctgttccagggtaccgataggttcgacttgaaaagtttcctagcacttagatgaacatagttagcaactaaaaacagtttacttagtgctagaatcatatcttattcttttaatgtgataggatttgcaatatggtttgatttagacgtaagaggtatgaaggttatgcaggacgatccccattcttctcaatgttgcaacgactgttgtaacgatgagggctaagtacaggacctcgtcgtcgagccctttccagtagttttattcatcgtgtcccatgggctttgggtttttaactcgaccgccttttctttagtagaggctacaatacatagttagaatacataattctaactataaatcctataagtaggtttccattcatggtgtctaaaaaatatgcaccaccaacaccttcatgtaacgccatgcaatctttatttgcttttggttgtcttccttatgctgaagttgagtcccgtgtccagaagagtagcaagtgcatagctcggaataccacctttaaytgaagtgtagtccatattttatggaaatctgggttcttagataatctatctatcatgagaatctagatatcattgggcttacgtgcggaggaagatgaaagggtctgcacggttttggatttagaaagcgacaaacgtctcatcacaaaggcaggaagatgaaggggtctccacggttttggatttagaaagcgacaaacgtctcatcgtaaaggctcgacgaattctcattcacgttgatttaaatgatttaaaaaaaatgattctcacataaatgagctaaaagcaaaacgtttgggtgccacaaaccgattctgacggacagaatccggccaagaccaaagcaaataagaccataatccacttataagcagaaacaaacatagctagctacaaaatcactttataaacagytacaggggaaaaaaagacaccctcaaaattccaaaaactccatggattattttgggccatttgagagcagtgagtactgacaagcagtagtgacatgtcaaaatggcgccttgtactactaccggtcgtggagggcaacctggcagctgtcctctcccctccaccgacagctcgtcgctgacggcgacggcccgcaagccaccgccatcatcgccactcgcccactccaccgctcgctcccacacctgtgccagtgccatccctttttgactcctcggcctccctcaaatcagtcgtcaccacctcactgtccggctgtccctgtccctgtccctgcgcatcaatcaatcccacggtcttcctgccgcttcctcggctgcccccatcctccgaatcctgcctcgcctcgatctccccgttcctcgtgttccgacggagggtggcgggcgacta

SEQ ID NO: 4310 - DNA, 731 bp, Zea mays
ctgcaggtaaaaaactgtcttttgtttcatttgctctcattattagttgtgaaagaattttttttgtcttaaatatttttgaggaaatactctatttatttaagataccgattctggttactgacagttaattccaagagtttttatgacttgttcctttcaagagttcctacagctctgtacctgatttagtattcttgataacaaacagtcaaacttgtctgacttcttatgtcgcttgaaaaaatgttaggtgctttattttacctcaagtgaaatgaaaccaaagtactcaatctaccccttccattccaaaatgtaggtcattttagttttgtcctaagtcaaatgtttctagcttgaccatgttttagaaaaatgcactggcatgtagagcatcaaattagtttcattaatttcaccatgaaatttgtcttgatagtgctaagctaagcattgtagataatatatttttctataaactccgtcaaagttagagaagtttgattttatttaggttagaaatataataccatattacattacatttttgggatggaagtattacttcaacatccataaatgctcatctgcatttatttttctttcaatctaaattttcaaatgttatttctgcctctggtttactttgtgatggctcatgatatgtgttgtaatcatatgggcagaaatcttctttacagtatgctgatgatcctgatcaacaagag

SEQ ID NO: 4311 - DNA, 557 bp, Zea mays
cctgcgattcggtcggtcggtgcggcgatttagtcagggttgcttcttatcgaaggcagggcctcgggcgagccggagatgtgtccgccgttggaggggggcctcgggcgagacggaaatcctccgaggtcggctgcccttgtccgaggctaggctcgagcgaggcatgatcgagtcgctcgaatggactgatccctgacttaatcgcacccatcaggcctttgcagctttatgctgatgggggttaccagctgagaattaggagtcttgagggtacccctaattatggtccccgacaggtgcacaccggacagtccggtgaattatagtcgtacgtcgccgatgaattcccgagagcggccagttcgctcgagccagcctggcgcaccggacactgtccggtgcaccaccggacagtccggtgctcccagactgagcagagtcttggctgctcgagccaagacatttccaattgttcttttcctgtttccagcacttatacacagtacattagtctctaaaacaatgtactaagtctgagaaacataccttttgac

SEQ ID NO: 4312 - DNA, 463 bp, Zea mays
ggtccatcaaatcgcaagtttagccagccccagccccagccccagccccaggcacagccagctagccgtcaaatcactcacactcatcaaatcaaaggggaccaaaaggatatctcctggctcctgcccctctcccctctcctagctactcgtcgtataaaattcccctttcgactctcccccctccccacacacacctgactctcctccatcccctcctccgatctctcaccacgctcctcttctgctaccttgctttccctgctgcgatccgttccttgccctattagtattagctagccggccggccggatcgatcgagcaaggaggggcgccccagcagtcctcgtcggatcgatccatctcgtcgacagcgtcagcgcctcaggtggatcggagcggaggtggtggaccggagctagtagctgccagccacacatttcggtcgtcggaaccacatatc

SEQ ID NO: 4313 - DNA, 922 bp, Zea mays
agcactgcacacgtcatcggctacgacgactacgatcgagcgacgagcgagcccgctcgccgcatgcagttgagaagtgtgcctttcaacaactctattatttatttcgatccttcattgcgtagtactagtacgttctcggactatggatttggtcgatgatgtgatgatgatacacaccacgattggagtaattaatactactcatgcttcattagtactggtggttgtaattaatgtagttgatcaccattttaagcatgcatgtctcaaaacaatcttgtttattattttttcagctaatatataagctagagtgttcttgctttgtcgtcatcgtagtttcgatcttcccaccagttcattttttttgctttcttcattcaatcaaagctagcatctatatgtatcaccaaaatccatctagctagaacacaatttagaaacttttgagctcttaattaaatctgaacacggcggacagtgctatcggcctatcgcatgcactcatgggtttttctgataatgaaatgaattcacatgcctgctgcttaattacatgtattgaaaacttctgctgccatgccgagagatagagatgaactaaccagcagcagcagcaggtttagatctccgatccaagacgtaccatatatatgatgaatccgcaccagattctgcatcaacgtcttattaccgacgtggcctcctgcccttctttcgttggatcgcctttccgtttgtggaacagattcttcccacacctccatttactgtgcatgttgtggactagtcacctatagctagcaatagtcctcatcaccaccagtcataaaaaaaagtactgttgcgttcactgtacgtgctaaatattagcaccaccgtacacacgtacatgtacaggccacttgagatgtagcat

SEQ ID NO: 4314 - DNA, 595 bp, Zea mays
tttaaccacataaaagttcaaatattacaacaatataaagtttatagcttactaaattaaaaaatataggcttcattggacccggtgaccgtagtttaaaaatttaggttatatcagtctggtccatattatttactatcagaccgtagtttaggctcgtaatagaccgtgctcatgctaactaaaaagtctggcctacgttcccatagctactcacaatcatgaataagcccatttcgccacgtgtattatttcctccccggtgaccgtgaaggcgtccgggatcacgtgcgaatccacgacgcgccaccagcctaccaccggtgaccggccggccgcacttcgctacctgtcaccgccggcggaaatggcacacgtttctcagttctcacgccttgacgcgcgcagccgacggacaactgctttcttccccctccagccctcccactattttaaacggacccgaggctcagtacagagcactgacacgctcgcctaattataaccacaccgcctagcgccactccccacgtcactcgctgtctgttgtagcaccgcaccagtcttcgccgccggtccgcgggcagatcaagag

SEQ ID NO: 4315 - DNA, 459 bp, Zea mays
ctctgtgactgattggacatttgatggacgttctctgtctagtcctcaagtcatttctgtcgaccatattatgcactctactggctatatttggcttccctctaactcttgttgatatctcatttttgtcttgaggtattcactgcgtgctctgcacagatgtgaccgtttgaaaaatatactgataattcctgggcgtcccccccccaatgggtgtggtcaagggacggcttggtacgctgagtgttttagccggtttcctctgagtagtaatgcgatgggacggatagtgtaatcatatcttttgcactgttgactggagtcccaatgggtgtagtgttgcatgaaacggcgtccgccttctgacgtgtcttcgggagggtggaagtgcttattgaatgccttgcgcctgttcagtgaccgcggttagaagtgagcggttgcctttcccttctataa

SEQ ID NO: 4316 - DNA, 1214 bp, Zea mays
ggtgccactggtcttcttagatattagtatagtttagtatagataaaataatgtagtagtaattagtgtagtagtagtaatagtagtataatgtagtttagtagtagtagtaatgtagagtagaattagggaagtaccaactcataaagagttggtttgtaacttgttaacttcccttcaatgaaaattgtcgtttatctcctctttttgatgactcgtcactgcttttgctgaatgttgaaccgattcttttgatatagtagaaacagcaccgagcgattgtgaagattgacatcagcgttttagaagtaacactaagcaatcgaacacaagaccgtcgttttagaggcaatgccgaatgatagaaggtcggcatcggcattttagaagtaatgccaagcgacaaaatacggggctaatattttagaaataacgccgagtgatagaatatcggcatcagcattttagaagtaatgctgagcgtttgaacacgtggtcggcgttttagaggcagcgccaagtgatttgaaggtcggcgtcggcatttttagaagtaatgccgagcgattgaacacgtggtcggcgttttagaggcagcgccgagtgattgaaggtcggcgtcggcattttagaagtaatgccgagcgattgaacacgtggtcggcgttttagaggcagcgccgagtgattgaaggtcggcgtcggcattttagaagtaatgccgagcgattgaacacgtggtcggcgttttagaggcagcgccgagtgattgaaggtcggcgtcggcattttagaagtaatgccgagcgattgaacacgtggtcggcgttttagaggcagcgccgagtgatttgaaggtcggcgtcggcattttagaagtaatgtcgagcgattgaacacgtggtcggcgttttagaggcagcgccgagtgatagccagcttcttcaagtttctttgaggaaaatggccgagtgatgaggtggcacatcggctttcttggaaataactgttagatatccacgtggcatgctgggatttcggagatgaccgccgagtgatgactgggcacttttgaaaaggtatctggctcaagaatatcccttaagtgtcgcgctttcagccgcctttgctttccgtgccctagttcttgcatttccgcatctgagtcttctctgccactcgcctcctgctctgtttcgccagcgagaagcaag

SEQ ID NO: 4317 - DNA, 1482 bp, Zea mays
cgggatcttggcttttaccatggagaatgccataaatcatgaaagtaattcaaaaaacaagaataacctagtaatttatttacacggatcaaatgaataagcattaacaaaatatgtcatagatgtagcagtagaaccacaatataaagctatatagaacacgacatactttaagaaacaggggttgagacgttggttttcagctatgttatgcaacataagaatgttattaacgggttgatcaacatcaccacaccgatctgcatgtaatgatccatttagattttacccacaacaaaaatctacacagaacagacatagtggagcctaatcttacatctgaccataaaatggtgtaaagtagcagtgccctcaaagacatttccaaatatatctatatagatgatgtagccactaaggtagggactatgaatactttatggtagtacaatttgggagctattagggacagggccatacaacatgcatgataacttattgagtttgggtaaaatgtgccaatacttgtttcattggtaagaacttgcatttatgataattttatgatttagatggttttaaaataagaatgttcgctttagactaaagtcggctattcggacagatgtagctgcaatctataaagacaaaacacggtagaagtattagaagccggtacatattaaaaccaagcgaacaagcaattataaataaaataaatgcgaatacattttatttaatatttatatttaaatcaaatatgaatatgcatatctgtaacactaatggataccgggtgtgaaacatctgcatccataattgcatatctaccaccgtccaccgagcctgtatgactgtatcagtcacggagctggatggcttcgaaaagcccggcagccgctgtccagtccgacgcagctccacgattgcgttcagtcccttcccgggtcaacccgcgccacatcatcgcccactcaccgggccacggatcgtgtggccgcccggacacggcgggcgggcccccaggcccacgaggcggatcccgagccccgtgccgactcggacgcgcctccctcgctttcatcgcgagatacgcgcggacggccgcgcgccgctggtctggtcgtcatgacagtcgccgccgcctcgtcccacccgacctgaaccccgcaccgtgacagccacggcccaccggacgcgggaccctcatgtcggcgggcacgcacgtgcccccgcatcggcgtcgttgcctcgccaaggccgacgcggatccgagtcatcccgcgtcaccatccatttgacgaggcggtttatcccccagcaccccaaccaacctttccacgtaccaccgggtttctgtccgcgccccgcccttcaaaagcaggtccgcacgccggccggcgagacgagacgacaccaccacgccgggacgggaggcacaggtgcggtctgcgtcgagagttggtccactggcaggccgga

SEQ ID NO: 4318 - DNA, 73 bp, Zea mays
cctccaagttaagcgtgcttggcttggagcaatttgggatgggtgaccgaccgggaagttttcctgggtgcgc

SEQ ID NO: 4319 - DNA, 982 bp, Zea mays
ctctaactgtatctaaacactgggatggaccgtccctgtgtcaccacaacacgaaaacagtctcagcgtgcattccggcccacgaggcagtgatcctcctgaatgttcacattcaaattcccgaatgttcacagaccaactcgtcttgtactcgacgtcacgctttacgaaagccagccgcgatctcgaggcgtaggcagcccagttctacaaacttcagatctacacttccatgctacgatttacgaccacacactaaatgccagttacgacagagcaagttatcgtgcacgacgaatgaattatgatcgtgggttcgaaaaggtccgcgatccctttcccttttctccggccagggactgggtacgcccaactgaatgcgttgcttttactacgtagttgtgcacggtgcacccatggactagtagccagtggcctgcctacggagtctttggtgaaaccagtacgtgcatgctctcgaagttttttttggtaatcaagtacagttatattacaaacagaaacgacaggtagtcattgcttattgtttcaataagtttatctgcttccttctggtatctggaaaactgaaagacattcttaaaagaaactaaaccatcgggactgacgcctctgaacttccgtgactagaagaaagctgaaattacctcatggtcatgactcatgatcagctctggtggaaatacgccaccttgattgcccactctccgcccgttgtcgccacaactcgcccgcggtacaacggcccggctaaaacgaggcagggcgcgcgcttaaaatagcccggcacggcgcgtacccaccaccacccgcccgccccgcgccgcgcaggcaccacccgctctcctgcggcctcctcctgtttgtgttttcaccgtggtgccgccgccgctgtctcctctctccagctgcggcgaccgcgaccgcgaccgacaggcggcagggggcaaaggctagcgag

SEQ ID NO: 4320 - DNA, 292 bp, Zea mays
tgctaagaaaactgttgagaaagcttttggtcgaaagctatcagacattttggaagagaaccctgttgcatctggaagtgttgctcaagtgcatcggactgttctacgattccggtatcctaatcggtagacaaagcgtgtaactgttgcagtaaaagtaatgcatcctggtgtaggggattcaataagaagagatttcaatatcatcaatgtcgtagcaaagatatctagatatatccccacgctgaattggttgcacctagatgagagtgtacaatagtttgctgtcttc

SEQ ID NO: 4321 - DNA, 696 bp, Zea mays
agcggagacaactcaaccatttaagttagccttgctctacctgaagtattaaggtgttactaaagtttctatcataccatgtatgtgtgattgagtctttgtgatttataggaattattatgggccaagcccaaattctctaacagatttgtagatcactaataatttattcgttttttatttgtcatattttagttaaaaataaactagcgagcgataaatattgcagaatagaggtagtagtcgatgtgctattagagaaaagatatattattacatgatatatctctgggagaaagaattgcctcgtgacatcaaattctttttctcataatatgctattaagataaataaatatcacatttaattaataagtactttctctgttcgttgtttttagattttctagatatataataggattattatcttaacaatacactatgtttacgtagaaaaagaagtatgtgtctttacaaagagggccattacggtaaggcttgatttttctcagtttacttgcactgctaactcgcttctataaaaggataagctccctgtgcaagcaaaagcccacagaacgagtgaggccaggcgacttcatactgctcgcctcgccgtctttcccccaatctgttgctcctccaagctgcgggcgatcgccgtaccccggccgccgcagggaaccccctcgcc

SEQ ID NO: 4322 - DNA, 1392 bp, Zea mays
tatgccttgccttttttgggacagctagcaacaaagtggtcaggactgccacagttgtagcattagtccttggacccgctacggcgccagctcatacagttgttgtggaaccgcgtgaatcggttggccacaagtgccaactcctcatccccaaggctctccacctgctcctctatgattgacaacaaagaagatatagcaggtgaggggttagaagtagaaccacctccagagaccagggccattgtcagtgtttgtgatccgaccgtgcaccacggggttgcccatgtgatgcttttgggtaggacaacgtcgttgatcgcgactcgatggttcatgttataacacgacgggatgacatgcagacttatacagggggccacgtagagctgtgtaataccctacttcctgtggtgaggctcaagccaattttcgaagctcatgccaactttcgaagataatagacttgaggctttaaaagaaaacaaagtcatgtgcttcttctggattgttttgattgcttcgtcttattgttgtattcattgggtgcaccataggtgcacccgatgggtgtggcccccgagctttgaaatgattttgagtttagcatttttttttattttggcccttgagtccattgggtgcactgtaggtgcacccaatgggtgtagctctcgagctttgaattgatttgagtactaatcaactcaaaggtcttaattgcttgcttttgagtttatcatttggatttattctggtgatcacgtctgggctagttcttgcctggtttgaacatgtcttgactaaaacccttgctaactaggacctggctgatagagtctagaccgatggaggtccgactggacggcactcgaccagggtcttcaatgcttctgttgattggactttggccgatagaactctagccgacttcagtttggccaatttgatttttttgtcgtttggtattcactgcggatattttacagatctcattgctccagaaattctcgaaaaatctaggttgtacacctaatggatgcgcccaataggtgtgtatccattgagtagtgtacactgtcttgtccaaaaatagtaacctgacgtgatgaggagatgtaatgttgcgtctgagcggttgactttaatttcttctggtgctgtgttacatgaataggtgtcagcagtctgctccctttcttggaaacttaagtggctattgaagtcctcgtgactgtttgctaaacgagcgggaagtgaagagatgccctttgccctctttaaatagtctacttccctgtgtccgttttcttcactcgctcttgctcttctgcgttcttcttcttcttcttcttcttcttcttcttcttttcccactcgttcgaaaaaacc

SEQ ID NO: 4323 - DNA, 222 bp, Zea mays
cagtcaccactaaccatgcagagacacagcccacttgcctcgccgcgccgcgcttctgccgaacccaagccaggcgcggaccggagaccccacccgcattctactactacaaaaggccgcacgcccaaacgcctcggagctccaccactcccagtcccagtctcccaccgtcccacgaaacacactcaactctgccccgaagcggagaaccgccagccagac

SEQ ID NO: 4324 - DNA, 255 bp, Zea mays
cttaccccagataggtatgagaagataccccgacggggaaatccccattgccatctctaatttcagcatactctcgttgcaacgcacggacatactacgaatccaattacttgaggtactaattttaagaagcccatgggaatactctcgtttcaaaaagaactccttccacgcccagccatctctaaaccctacccacagccaccgccgccgccgccgctccctgacccctagtgtccggatttaacttcaaac

SEQ ID NO: 4325 - DNA, 422 bp, Zea mays
tgcagctttgtccgttgctactcactgaagatttcaacccacaaaattctattcacaacttgcataagaaacatcgggtcatcggccatctcacgttctgaactgaactcatgcgagtccatcaaaatagacgacaaaattgccgagatggaaatagtcagcacatttatatgacgatcaaggtagtcaatcctgtccacccagacagactgaccgatttatcttctcttcgtaataacttgaaatttcccttcaatcctgatcacactgagagagttcatgttcatcactcctttgcccgctacatctctctctatatatatatataaattatagacaaattatagatcttcagacaaattatagaccttacgaggagcatttgcattttcatcattctccagcttcttcagtagctgtaa

SEQ ID NO: 4326 - DNA, 173 bp, Zea mays
ttagaatcggggccgtgcagtgcctggcgcggcaccattctgagatatgcttatttaataaacaaccggttgactatactcaagccattggggtaaaacacagcgttcattcgcagaatgaagcgtctggtgctgtggtacccggcgatatcgacaaacaacagcggtgcttt

SEQ ID NO: 4327 - DNA, 924 bp, Zea mays
atagtgcaaatccagttcattttcccctatagttttgatcggcgatcgccatatacaccactcactgtgtaggatgagtcgaatcgatcgccacaaaattctatgtggtttgaagcaattttgttgcattagttgaggaggtcaaactctttgctgatgcggggaattgtgtgggcagcagatttgcagtatttggttgatccaggatcagataaacacgtttgagagaagagctatactggtacaacgtgtggttgataatcactgaataatgactctgcaagaaatgagattgtaccactcaccaagcatctggcatctcaggttgtgtctagaatatagcttgggaaatagatatcaggaattcaagattgcacgaggggaggggaagggataatatctatcagataaaaaaaattcaaattagtgtcaatacctctcaaatgcaagaaagtggttgagggacatttctttgctgtttttaagcttttttggaactttttacagttcaaaattacacaactcatgctttatcgagcatgccactactaaagtagaccattattaccttaaaaacataactaataagtagacgactgctagatatgaaaattatgaaaacttaatatatatagtccctctaatactctttatcctgttactgaaactttaaattctccatgaaaatttgtgctggattcaaattcactggaatttcaggaattaacctaaatagaaattttattttaattaaaaagcctggcccatcctcccagctgaggcgcgatcgccgcgcgtgcaagcacaggcacagcgcagcgctcgccctggtagttgtcgcgcattactccccgccccaaccccatcccgaactcactcacggtgccgcggaacagcgaagcaaacgaccagacgtaggaggag

SEQ ID NO: 4328 - DNA, 732 bp, Zea mays
tgaaaaaatggaaaaactcttaggaaaatgatgtttccaatctaactctaacatggcttcttttccttgatttcggtaccaattcttagaaaaccggtactaaaattaagggacagaagcccggttcttcagaagtgtacaattcatgcaatgaaaaaattgttgcaacatatacaatatgtttacgggataagccttatcggcgttaataactgttgcttctaggtgtaccacttctctcaagatttagcttgtgtgtgtttttttttcttcttctcaatctgttgactctgcgctcattgaaccacccggtagacaacaattattggaagaccaaatttgaatatggatttctttctcgtgtgtggctgccatgcatttacactaacatgcacgcacctcatgcgcaaataaataataacaataactggctggccagcctgcctaaagatctagatctgttgactctgcgctcaatgaaccacctgtcggccggtagacaataattgttggatgaccagatttgaatatggatttgtttctcatgtgtacgtgacagccatggattttataataatatgcacgcgcatcatgcgcaaataactaataataactagcacaaaactctatgctactactacatacatatatgaacaacagatcgtagacatccattggcagcaagaaagaaaccaaggtacctagttcaaagagagcttagctaggaataca

SEQ ID NO: 4329 - DNA, 816 bp, Zea mays
caaagtagtcactcggcaaggcaggtagtagtccagcctcgagatgctgaagcagctgtaaagcaaagtggacgatggtctagcccccgagcggtcaaagtagtgactcagcgaggcaggcgatgacctagcccctgagtcggtgaagcagcgagtcggcgaagtggaggatggcccagtccctaagctggtgattgcgactcgatggtatgtgcggatgtacgtcagatcacacaaggctttatacaggttcgggctgatataatgcgtaggtccctacttcctgtcgacgttgaatatttcaatatcgctggagttcacggattacatatgagctatgggcggtggagagtgagttctccagtcgatctagaggtggtgtggtggctgaaacggaggtggtattttaattgccttttacaaatcatcttgaaaatagtattttaattgccttttacaaaacatcttgaaaataagtactgcacaaggcagcaagcagctcatcgtgaatctgatcttgacatctctgtgttcaagctcatatgcacgccggcgtcagtccatttagtaacctatgggcccacgagacgaagcaaatcagcccagcccatcgaacaccaactactgcgagatccagccgtcagatcctgaaacctttagatccaacagtccacgtcgtctgccttctcaatataattcaaacacagccgcgaacacaaaccctagcctccacccctcacccgccgcagccaaaccctctccagcagccgtcgtcgccaccgctgcagcgcggaggcgacccccatcgccgccaag

SEQ ID NO: 4330 - DNA, 253 bp, Zea mays
atcccatgcgccgctttgcttcacccgcctacctatcaagcattcacctgttggttactcgatttgaatatcatttagatctgtttgaggttggaacataaatgcagcagtagtttctgtcttattatattggtacctctgttactgagttgatgtggtcctggctcctgagcttaattttgttttcgtgttctatccttagagacgattgtaccttttggccgtttcactttcattcatacataggtagatt

SEQ ID NO: 4331 - DNA, 1381 bp, Zea mays
tcttcttgcgatcactcacttgtaattgaggcaagagacaccaatcttgtggtggtccttataggaactttgtgttccaagtgatkgagaagagaaagctcactcggtccgagggaccgtttgagagagggaaggggttgaaaaagacctggcctttgtggcctcctcaacggggagtaggtttgcaagaaccgaacctcggtaaaacaaatccttgtgtctcaccgctttactcgcttgcgatttgtttttacgccctctcgcggactcgtttatatttctaacgctaacccggcttgtagttgtgattatttttgagaatttcagtttcgccctattcacccccctctaggcgactatcacccttgatcatctttatagctcatatgtataggtttgagggtaagattgtaatttttataaagttgtatctctcgactataaatagaagaacaatgtcatacatgagatgcacctttttttactagagtgaactaatttgctccgcatacgagctattttctcttgataccttcatgcaatttcttgtaaaagttgaaggtataaaaaacgagtgaccaacagccgaaactcgacgctaaaactcatattaattctagacaatatgtaatctaaattaatgtccaaaataagggttgtttggttccctgactaaagtttagtccgtatcatatttgatgtttgaatgtcaattatgagtattcaatatagtgtaattataaaaatatttgaatagacagagactcaatgatgagacaaatttattaaacctattcagtgcatgatttacccatggcaacttcagtagaaattactcaccgttgtcactccttacaaaaagacgtttcatctattttctgccacgtaacataggactaaaatcaataattattatgttaataagccaaacaatttcacttagattatttattctagattatataattcattgtattagctttaccgagcgtaaaatattagacactcggcaaaaaacgcgattccggtagtttatttaatctgatatataatcgagactatgtagaacattctctaaatatataaaatcaaggctaaagatatccactgtactagcctgcagtctaatcgacactagagctcgtattaattctagacctactctaatcgaaattaaattccaaaacaaatcggttggctaccggtgatagaccatcgatagatgttgagaacccagaatataacattaattgataagaataatttcttacataaagaggtgaccggtaggactgcaggagatggcaactgcctgcgctcatgactgaatataagagagaagtgaaccaaagcttagctagaaaggtggtcatcttgcagg

SEQ ID NO: 4332 - DNA, 256 bp, Zea mays
agctgatgatcttcgacttggagacgcaggcaggatcgcgtcccacactgtcatcgaaagatgtcagcgcgatggtaaggtactacactactactacggtactacctgtggagctgaaacctggagcgaagcgcgtgtatggcagtcagcagccaagtgccagcagcagcgtgtgccagccagggaaatcccctggcctgtgcgcgcgttcggttacaccgctagcccctcgaggaggcgcgggaggtcagcatgc

SEQ ID NO: 4333 - DNA, 726 bp, Zea mays
gtgtgagtgtttcaacgcatcttgtgtctttctttcgccttttttttcttctctctctgttgctgataataaatactatatctactacgtataaaatacatttcttttactgcgggaagcgtccagacgcctccctcctatcctatgagagaccgaaacgtttcttggccgttgaaaatgctttcaacgcggtctaaaaggcagcagagagcactctaacgttacagccttttttctatttctacgcttcgaggagaatattacactttagggttaagccacagatgatcgattttgttccaattagctcaaaagacataaacgtctaataataacgatccataatttgttagaggaggggtgtatatatatatgtgcatgaatcctaaaggagagatgggagaccgagacatcgggatcagcccgtgctcagtgctgacgtcgtcactcaaatgctgtttcgtccccgtccgcccatgtccatctagaattcgatccagtccaaactacctttcccggcttggtcaatcctgtcgccttcggtccatctcacacagactccggccggcggctccactccactgccccgccgctcggtgccgtacgtcgtcgtgctccaccgcctcgatcctcggtttattgctttcctgcatagcttccttagctagctaggtctcgtttcatcagtctcgatctgctgctcgttggccgccggcggctacgagc

SEQ ID NO: 4334 - DNA, 256 bp, Zea mays
atagtgactaaagccaggagtcatcttgaggcgaccacctagcggtgtgacgagctaactcttgttgcagttgtcattgtagcagcacttcctctatacatggattaccattggacatagacagatgttggaacttggatggtgccatgcgtacatatgttggacctaatgcggtaatggaccgtcggccaaattcaatcgcctctaggtaccacaccggcgacggcgtcttcggcaaggcttgtagcagtagctc

SEQ ID NO: 4335 - DNA, 1500 bp, Zea mays
ctccggctgccacgatggcatgtacttagggcgctagctcccctccgctagacacgtagcactctgctacatcccccattgtacacctggatcctctccttacgcctataaaaggaaggaccagggccctcttagagaaggttggccgcgcggggacgaggacgagacaggcgctcgcataagtgaaagggaaatgtgcccttgggccatttctaagtattttggtgattgagtgccaacacaagtgcttaaatgtgaatttatgctcatggatggacaaagtgcaaatcaagagtaaaggtatgtttctaagccttagtacattggttttgtgtactaatatacttgtctaagtgttagaaacagaaagaagaagaaaagaaaagaggtgaaaaaggcttggctgtgtacagccaagactcagctcagtctggcacaccggactgtccggtggtgcaccggacagtgtccggtgcgccaggctgactcggcgtgaagtggccgctctcgggaattcgccgacggcgtacggctaaaattcaccggactgtccggtgtgcaccggactgtccggtgagccaacggtcggccgggccaacggtcggccgcggaatctgcgcgcgacacgtggccgggccaacggtcggaagggggcaccggactgtccggtgtgcaccggacatgtccggtgcgccaacggctcccagatctgcaacggtcggctgcgccattttaggaaggaaatcgggcaccggacagtggtccgggtgtgcaccgggactgtcccggtgcacccgacgacagaaggcaaggttggccttccagattttctctcaacggctcctagctgccttggggctataaaagggacccctaggcgcatggaggagaccaccaagcaaccttagagcattcttgatcatccacactcagtctttgcgcattcgtttgtcattctcagtgattcgagctccgttctagtgagaactttgagatagtcttttgagctcgattcgtggccgtgtgtgtgcgcattttgctgtggatttgtgtgtgttgcttccctcccttactccgtgcttctttgtgaacttcaagtgtaagggcgagagactccaagttgtggagattcttcgcaaacgggatattgaaaggcaaagcaaaacactgtggtattcaagttggtctttggaccgcttgcgaggggttgattgcaaccctcgtccgtttggacgccacaacatggagtaggcaagcgttggtcttggccgaacccacgggataaaaccactgtgtcactctgtgcttgattctcttgtggtactgtgttttgttgagacttcaccttagccacttggcaataatcgtgctaacacttaacaagtttttgtggcttaagtttgaagtttttacaggatcacctattcacccccccctctaggtgctctcaattggtatcagagccgttctcttcaagaaagggactaaccgcccgaagag

SEQ ID NO: 4336 - DNA, 1161 bp, Zea mays
cgctcgccaggcagttggggcttggaaagggcgccggcaggggctccccgcggtaggtggcggtcgaccgagataattgacctgttcctgctggagtcatgcgccgtggacgcgacgcaaggttcgctccggtccgggcgtccggccatgggtgcgttcctagctagcaaaccgaacccccagtacagggctacagagcgcgcacatggccgcgggccgggagcaggtgtgtgtgtgtgtgtgggcgggacgacggtccccgccgcggcggaaattaccgcgcgcctggcgcctgtgcgcgcgtatgggcgcacatgccgccgcagcgcgtgtcggcgtcgtcttcgccggcgtcaggtcagccagtctgaactctatcggtatgctcgcgcggtgcgcgccagccagccttgcactttgcacgaaccatggtcgtgtgtgcaggtggcgcctgtttttcttctagcaggtagtggtggtaggcctgatggagtgtgatggtggactgctcgacggacgtaccctaatagctgggccgagattgcagatgactgactgctcctactccgagtagtctcctgctcttcggtcttcaatggcacaattggccgctgctctctagttccagaacaaagatcactatggttttcatgctgatcataatctattactaatatttgtataattatatatttatctaaaaataattcaataaattataataataccaagttgcctgaacgcctaggcgccaattaggcatcaacactccagcaagacagcagaaggtcagtagttagtaatcagtagcaatttagagattaagagtacaagttcagacttcatcgcaaacaaatataggtgataagtccacattgaccatagcgaccaaacaaacgaaaagttcaatgacataaccaaacaaataaactcaattactcaaacatgaggtagagtggtagaacatcacctaatcgatatctaagtccgtatcatttaggccacactcattctcatcacttggagcaccaacatttggaagagtaggcagcgcagcactgctgcagagagcaggaagacggcgcgcgcagcactgcagaggcgaggtgcagagtagagacaaagggggccagcgctgttgagggaaggggcggcgcacag

SEQ ID NO: 4337 - DNA, 1069 bp, Zea mays
ggaattcttgatgcacaaagttttttgcaaggaaggagacttgttttactagatatagattacctatccgccttatttcagtgtaacaatttgtcagaagatctttgtggaaaggtactcatggaaagaaaatatatagaaggcaaggggaattgggagttcaagctgggcacatgaaacagtgcctgttagcaatggcgaagctagaatgaatcaaaggagggtgcacatactttgagggtgtatagcaatgatttataggtggtgcatatatggtcaaaatctggtctaaaacattgattttgtaaattttcttgggtgcatgtgcatcctctctcctgaacatagcttcgcccctgcgtgttagcaaaatgttttgctcagaaggcagaatgaaacagatctctggaaatcgatagttgaagtagaataactcaaatagggattagctttgtctgggggaatggagttcatgaatcatatttatttattttttgtctgcctagtggcttattttatctggagttggtcagcaatttcattgtttcacaaaacaaaaacatgttcctttgttgttggctgagttgccttagttgtagcatttctttttcttctctggtgccgttgtttgcggtcttcttctttattaattaacataatcgacatttatactgcttgattagtttccaaaaagaaaaagaaaggaaaaaaacctgttcctcgactagattaatgtcgccctggattgatcttgcagctctaagctggataatggaaagcatttgatcacccagtgtttcttgttgcatcttactttcatctgcacctgatttcttcaggatgaatgtttacatatattgttttagtccatgttttggtattgttccattggcacattttgggtcccctggtgaaaaggctgatcaattttgatattcagtttcgccagatggattatggaccaaacattactgaccaaatctttttttcagctgcctataaatctcagtttgggtagactttttgcgttgctcagcgttatgttatcactcttgtaggcatctgaagt

SEQ ID NO: 4338 - DNA, 429 bp, Zea mays
gatttaattagatcaactcaaggtcaactcaagttggacaaagttgaacacgcgagttgcctgtgggcaaagttgctgcccaaaactatttccttggttgtgaatttctcaagcggtaaacaatatttcctttactcgctcgatgctttgaccattctgtgccatgtgacattattgtagtgaccagacctccaacggtcgggaaattggccgggttccaacgggcgggtagtcagtcttccccttccctcggctctgctcataacacgcgcaacggctcgcctcgccgccctcgccagtcgccgctgcccccgcaaatcaatcgagcgcggcaaaggaggagccgcgatcaagcaaacggaacctagcacggcaggacgcaggggataacagagaggggggccgcgcgggagggaaggggagggcggg

SEQ ID NO: 4339 - DNA, 1070 bp, Zea mays
gaatcgagataagattgcccaggactgactgatacgcaaacggagcaaaagcagactgtgtccataattaccctgaccaagctgatggaaccggcgggagtaatraatacaacaacctggcgcgaagcagcacgcaccgtgttcactgatgaagcgaagcgagggcagatctgcgcgagatccgggcggcccgccaaatccccgggggccggggcggcgcgcggcacagcggtgcaccacagaatcggggccggaacagcgaatccgggcggatgcagcacagcagcagtacgcgctacgcggccaacccaatccaatcgaagcgaaggcgcagcacacggcatcttctcttccttccttcccagctcccacccccgccggctttctccctgatttgtgattttcccacaacgccgcagagtgaggctgaggctacggcagggcagccagccagcagagagcgcaccgtcaccgcgcaccacgcggccgcctgctacaggctgtactgttctggtccggcagcacccacccggccacccctcactcggtcactccgcagtccgcactctccctttccttttcaggaatcatctacctcgcccgcttggcaccatccctacgctacgcctcgtctactgcctgctgtcatgctgtgcgtgggtgggcgggccccgccgcgccgttccgtgtggcgaggggagcataaacaatgactgactgggccggccggccccgtagccattcgtctgcctttccctctcccagtttccgtttttttaatgctttgtttactcgcggggatcatggggtaatcgcgtgggccgtgcctggctgggtttatttatgccgacctgccaattggagcaaatcccctttcctgcccctccccctccgcctttcctctctctcgctctcctcctctcctctcctctccttccgcatcacacaccacgactcccaaccgccggttggctttgctgctccgagctcttccacacccgccctctctcttgtgggtcggcggccgagtgtctgcgtcgtccacggagatcagggatcggcggcggggt

SEQ ID NO: 4340 - DNA, 1500 bp, Zea mays
agtaaaggagagctatagtaaactagagcgtgtgaatcgtattcccttgttgagtgagaattaattttagccggctagccgctccggtcctttttgttttcttttcgggggaaaaggctatagctggtagtaggattcgacacacaacgtatatattatatatattttctctcgatcgcgcgctcgacagccgatcgaatccttatctaacttgcacaggcagggtgattattagctttatattattaagtatatatatgcaaaataatgcgtgcacgacaatttcgtagctaagattaaatagataattaagcagaaaaacatttccgctccaccgtgcatccgatcccgcatcatcaaagcatgcagaaacttttttttggcggtatgcaacgtacgtgccgcgatcgatggtgcaccgacacgtggtggaatcgcgcgcgaaactgctctgtcgcccgaattcagtccggacataaaatatggcagtagccaggttccaatattccatgcaacgattatttgtttccggcggacactcacgtacagcacaggccccgctcatttctttgttctaagtagtactagagtctaaattttcatcctaattttctctgctcagtccaatttagatgtccctactctgatattatagtgcttgtcyttacaaattgccatattttgttttaggcctccgtacgacggtgcaattatatatggacgatgtatgtcggatgcactgcacattatcgcacacacttttctactacagtgtcgggctgtggggatctttcgtttatttcttttcgcaaatatattccaggtagcttatcaagcacattgcattgggccggggatcgaatgggagaatccttaactaacaactgttacacagtgtgtagagagagatacatacgcatatattctccgatctctctccggtgtgtagactcaagtttaatccctctgttccttctctcttgtttaattaatttcgatgttcagaataaaaacagcatctttggtgtgacctaaccaacctaactgtgcgaccccactgcacactactactactgcatgcaaaccaagacatatgttctctgatctcttgctacctttgatttgtcttctatatatcggcatcatggtatctagtgccccccttaattagctagctattaacgtacgtaacatatatacatgtatgtctcctccatgcatacatgtcacatctacccggcgcccacatcatcaatatatatacctttgccactttttgcctggctggcgggcttcgtgctctatatatacaccccttgatcgatcggcctccgccatccatatccccagcagtacttccaacttccaagcaggagcaaacgctagccatctccacctcaagttagctctctagctatactaagctatagcagcggtgctgatcatcgctcgctaccacaccatcaccaccgaccaacccatcagctagctagctatagc

SEQ ID NO: 4341 - DNA, 1006 bp, Zea mays
aggccaagacaaaaatctgggaatgcaatattgcccaattgttcatgggtttagcttgtgagatcatcgtttcatggcatggcaatacttcggtatagggatggcaacgagtacaaatccactgggttttggcatctcaaactcatatccgtggaaaatatttatacctttaaaaaacctgtacccatcacgggcttgaaattttgcccaaaaccgtatctatcgggttagtggatattcacgcgttaccccaggtttcatctctaatatgctagttcttctcataatcattaagtatcgtaatgattaatgagatcatggttcaaaatttatatgatgaacaacgagttcatgatttggtataaaaattattagtagagagaataaaatacaaataataagttgtataattaagtgaccttgcactaagttatccatccaccacttatgtaacgcttgtaaaaactataataacaaacatacaacactctcaccaactacttatacattcaccatttgatacaaattaggaattaaatgaggagataacaagtttgttgttcgtttataaaataaagtaacaatatgctctatgtttggtggggtttaaaaaacccacgggttcacgggtttgggtactataggaacaaacccgtacccacaaacccgctgggtacagatttatgcccattaacaaacccatgggtatgaaaattaacccaaacccgtaccctaatagggtaaaaacccatcgggtttcgggttttgggtactcattgccatctctagcatggatgtgtaccagtaccagtacaaaccagtggcaggcagcggtgtcgccggcaaaaaatttcgaaacgagaggtgtctgcctatcactgccatttcgctcgcgaagaaatcgcgaggggaagcgtgacacctgacgagctgagcaggcaggcggtagtggccgagcgaaagcatcctcgatctcgtcgtatcgtagctgccgccgctcagagca

SEQ ID NO: 4342 - DNA, 1271 bp, Zea mays
ctattttgttgaagccgtatcggtcgtgtttcataatgtcaaatctctcatctgtcaggcggcagcaccctgacgtttggctgttctccatttccaggcttccgagttccgactactgggcgccacacgcggcgcaagcgcaggaggcacgccatctgttcttgctgtcgctctccccaaccccaagcataaacccctgtgtcctcgtacaaaccgaaaccgaaaccaaactccgccacgagtggggcgagcggatacacgagctcgtgaaagcttgatctgctctccttgttttcgatctttcgcagtcgccgatcccccctcccgctcgaggttgctgtttttctttttgagatttcccccggatcttttcggtgctgttttgttgttgtttcgtttcaggatcgcgtagtctcggcgatttccccgagagtggtccgtgcattctcgcctcgttttgttttgtgattttcactaggggtttggtctgatggatgcgcgtgcttgtaggttcttggaacttcagggttggaggaatacggtgtgcgctagacagcagtctccgcggttgttgtacacttgtacgtgaaatcccatccgactgcaatttatatattttttctgattgccggtgcgttgtttcttggcattgtagtttgctcgtcagctaccgtctgttccgggatatcgacatcgtttgttcttttgcaatgcctttttgttgtggacctctgcctcaggagagaatcagcttgtttcattgaagacttccctgtgtagttttcggtttcgctgatgtgcagaaattaactgaaattggtattattatggccttatggacgatatggataagttatgagtagttctccacctagatttagtattcatctcttgtcaaatttacagagtaaaaaattgcgtaaactttagagattatcactgtaaaagtgcattcacatataagagcttggggttttaaagaacattttttcttaacgtataaaatgtacattactggagtaactagagtccaaataaataagatgcgtgggactcttttaaaccttttaattctgttgtggctactcaagaatatatcaatgcttagtttgattcatatattggtatcctgtattcctgtgatatgatatagatgattttgtcaatttggaactgtagaagcctgcttgatttcgctcttggaaatctcgtgtagctcttctgaaggctatttcttactagctctacggggaaaactttttgcagacaca

SEQ ID NO: 4343 - DNA, 1500 bp, Zea mays
tgttcttctccctcctgccgccgcggcccgctccgctcccgagccccgttgcacctccacccgccgcttccgtcccgtctcctgccaccttcctctcaccgcaatcgagtcgctgcgcctcctcccgcccgccacctcccgcagccgcagcaggacgagctcgtcgccgccgtgtactaggtacgtccgccttctcccagccccgttctgacggttctcgcagtggagcgggaggagggggttcctctcctctccttcgacgccgttcaccggccggcgcccgcagtccgtgttgaccgttgcgttgctctgctttggtttacagaagaacgggaggtcgctgtcggtctcccgcacaatcctgattcctggacctgcgccgcgtggtttcgcctcaggttggcttcctgtcttcgcccggcgcgccttttccacctagttcctcacattcgtttgggggtgtacagtacaggggtagtagacgatgagcatccttggttgctcctgcctgcgatatcctgcagtagtagtactataattcctgcttagtgttggcctgcctgagttgttcatcctgtttgctgactcctatttcctgctgctgcaggttggagtgtctcttctgtttgagcaaattggatgaaagaggatgtctatgctgtttcagattctttcagattcacttgtttgaagtcttgttgtcttgtgtgaccaaatgggtttatctgctatttgaagtcctgtttcagttttatgtatgttctgtaggcaaaatagaaatagaaatagagatcaaaatttgaatttatatatctacaatttgattgtattcaccttcaccggcggacgccagttgggatttttttataagttattgtaatttataattgtataaatttggatttatgtaatttatggtgttgtaatttatgacgttgtaattttagaaatgtagttgagtagtgcaacttagagctaaatccatacaacttatctaaaacagcaaacacaacatgggttgtgctgatcctggctaatttgaaacaaacaaccaaacaagagaagtattttgatttgcatcaatacatacaggctaagtccagcctgcatctaggcttcgaccaggatctgttgatcctaacaaccaatcacatggacattgaccgtaaccacgctgacacgctgcaggctgtagcaacatagaaacagggctgtagcaacccttcgcgtacacagcgccgcttcctctccctttaaatcgagcgccgcttcctctccgccgctttctctccccttcactcgagcgccgcttcctctccccttccatcgagcgcagcgcatgcgccgccgccaccactccgcaccgccgccagttccccacttcctccccacacccgaatcggattgaagccagaaggcaaggtgaagagtgggcttgggtaacggttgcaaagagatatccccaacagttgcagtcactcgcatccagtcggctcagct

SEQ ID NO: 4344 - DNA, 1357 bp, Zea mays
ttatatagaattctacatgaaaattttgttgcggcacaccctatatgaaaattctaggtccgcctctgtctccaacacccagcaagaaagagaaaattgcagggattcaatacgaagggaaacagaacctgatttgcgcaaccctttcagcttcaacttgtagacaaaccaccgttgatggagagctcacagctgcagtacgcatagctcaggcagcctactcgctcttcactcaattctaggtgattgtcttctctactccttgttgcgcttctgactccttcactggactgcaaccttaccttcaccgtggaacgtcgctggcttcttcttggcgcgctgcaccctcttcttcttgtcgtctgtcaccaccaccctgccgtcgcccagcacctctttgagctcctccttttgcttcttctcggcaaccacgacgagcgtctggtccttcacgcagtggtccacccagccggatgtctctcctcgccgccggatccaactcctcaacgcatgacgccactgctacagtggcacgccaactgcgccttgactggtaccatgttgaagcttctggaatacactatctgaatgcgtacactacttccatactcagttacattacatatacacacacacgacaatgggccaggccctacactattttcacagcccaacaagattggagaggctaaaatagtaaaatcttcatgctatacaattttaaataataagaggattttagcctctccaattcccttcattctcttgactcccaaacatgtcctaaaaccattgtatttggctgactggttgtggcctgtttacttttttctttttcttttttcctgtttctttcttctactatgctgaaataggtctactaggtcttacggttgtgctagcttgattattaatttcgaattagtgatatataaataatatttggtctaatttttttatatcactatataagatattgcccgtgtttgtttcggcttttcgcagcttctggccaccagaagctgctgcggagtgccaaacactcagctttttcagtcagcttctataaaattcgtttgggtaaaaaccatttaaaatcaacataaatatataatcggttgagtcgttgcaatagtagtaatccgtcactttatagatcctgagccccatggacaactttatcttcctccgcatgtaatcctaatgatactcagggtctgtttggttgggctgtggctgtggaaaaagttgctgtaggctgtgagctgtggaaaaagctgctgtaggctgtgtgctgttaaaaagctaaaaatcgtttggtggaaaccactaaaagtcgttaaaagttcttcgatat

SEQ ID NO: 4345 - DNA, 196 bp, Zea mays
ggtaacatatacatatataattggaattcatccttgtgttactttgtatttcccaataacagaaccacttctgttatttttgtgttagaatgtgtaggagcactgtgggcacacatataccagccatcgattcatatatatgcaagataagtttaggggtagaaagcactatccaacataaaatgtgttagctgtc

SEQ ID NO: 4346 - DNA, 874 bp, Zea mays
tgcagtgataccttctcttctccgtcgtctatttactttttcctaaccatctaatcttatgctcctgccatgccatgccatcatcgtctgtcggtgttggcgtttgcttcctctgcaccctatgctttattctctttaatcacctgctcctgtttctttgcttctcgtgccgtgctgttattgcctctctttttttacaccaagcctgacggcaacgaggttcaccgacatggcagtacgacttcgagggccgcaaggacctggccgcgttcgtcaagaccgtcgccgacgccggcctgtacgtgcacctccgcatcggaccctacgtctgcgccgagtggaactacgggtcagcagcctcacctcatcactcctcactcaattcagtagtggcctgccctcacctcatcaccaccctgcagctagcctcacgcaccgagctagcgatatgattttactgcaagcgttttcctgcggcggcatcgtcaactgttgtgtgttcagggcagcgctactcagtttcccgacagggacaggccaaaggccgaaccccaccatgcggccagcggccggccgtccagcccagcgcgcccgcgtcccatggtatcatatcagggcgcgcccgcgcctccctcctccagtggggcgctgccacattcctccacccggaggatcacctcgcgtgtccggccggcacctgccgccttcctcctccggtcctccccgttgctgcattggctagcttagctccgagcctccgactcgatccatcctgctgacctgagaggcgcggtacgtacggtaccagcagctgcaggtcagttagttagctagcccgtccccccgtcccctccaggctccagtagttagcccc

SEQ ID NO: 4347 - DNA, 300 bp, Zea mays
ctgaacctccatgccctatgctgaatttgcttctcagagagctattttttcattaatgttttttatgtttgctgcaaaagctttaatttttcttgtcaaactagattgtgttgtttagggagcttgcacaacgattaattggaaggaacatacgaaagaaaagaaccggaaggattaatcatgctgtatatatataagctatccttgacgctgcttgttgtttgctggttattgcaggttgaagataccttggtagtcagagcatagaataagggtggactgttattaattttccatagg

SEQ ID NO: 4348 - DNA, 737 bp, Zea mays
atctcatatttgttttcatttttcttttgggttcagtgctgtgcacggatagctaatggatatacaaatacggattttctcaattactattacaaaaaatgtcggtaatgaatatttcttcggatattgggtaaaaacaacattcactgcactaatttgatcacttcatcttttgcattttgcccgaaaattattgatccatcgcaacacctttctcgtatgtctcaatgcatagtgttctttgattataatctaataaggagactaaacgaaggattaaggtattaaataatatgtatctaatgtggaggacactagcagcatcatagggtgcagcaagcaacgcccggcgtctgagaactgatgttgggtggctgctcttttatatccaaagaaattataactatttatttgttagtcttggtagtgtatagtatttaagtctaaatgctagccggatattgatttgatatattcgactaagttgtcagatatcggatataggacggataatggttacattgtagttatatctggtatccacaataaataaccatacttgtatttaatatccaaatactatcttttacacccctagtaacttcttgcttggtcaatgttgcgttcgtttaaggtgttgcttgaagatgttgtaggaacagaaatatggttgtttgttaatattttctttctactgtcctgaagctttcaagactaatgtcccgcgcaatgctaat

SEQ ID NO: 4349 - DNA, 1500 bp, Zea mays
atcactagaattttctaacacatgtatattgttagttatcacctcatgacactacataaccatattaattaaaaactttccttctaataccaacgcatgaatatttgtcctaaatctgacccatagctctagttggctttcgaactttcaatttcatggccacacgtcccaatgtcatgatggttttgttattgacactataattataagcctgtttggatctatggtgctaaaatttagtactacacttttgtttaaactttagtatttagagatccaaagaggagtactaaaaacatgttaaaaatgaagtgttaaactttaacgcccaatatcagtttagtttctcaattcgtgctactttactaagcacattagatccaaacaagtcctatattttattcttcatggccagtgaacacacaaatcctttatgcctgcattctttttttacacaattaaatcgagtacgtcaaaacccacttcccactatctaaaatatcagcacaaaattagatttccttactgataaaatggaactttaagcgtgcctactagaagctacctttccttccgagtcgcgaaagaagaaatggccgggaagatacacagaagacccaccaactaaaaatggcgctcaccacggcctccactgaaaccgaagactagccacatcttttaaaaatcctcgcgcaagtaaagcacgcgagcaagctataaaatataccttcccgtgaatccagatgaaacggaccgacatgtggggacacacatttcatggtcccatgtgtcatgactcatgagacacaatctacgtgaactcccccggtgcttttcccagagagagaataggacaggatggatcacattgcgcggcagagaccccgccgccgcatccgcaccgcaccctcacaccgactgcgcagccccaccgggtcctcgtccctgtggcccacgtgtcagcagtggacgccgcgtgcgcctaaggcgaggcgaacaactacgaacccgtcgaatcgaacggcgagcggaccaacaaccccacatctatgaattcgagccgcaggatgcagcccagccgcgcctccgccgtcggatggcgggtcgtctctcggatccgccgtagaatatgaatttgatttcgaaagggaagtgtgggagagaaagaaaaggggagaggtggcaagagagagaagagaagagaagagaagaggggagtcgaggtcgagagcagcagggagagggaaaatccactaatccccccaccccggctctctcgaaacccgccattcccctccgccgcaaacacgcgtcggagctcgtggcgagcgccgccaccccgcactcgggctggggggcgtccctccgcccccttcgatctagagccggcggccgcgatcccgccgcgggtcctcgcggccgccgcgaattgggtttgtactgacgttaccggtgggcggaggcgctttgatcctgtagctgccgggttgggttcagtag

SEQ ID NO: 4350 - DNA, 851 bp, Zea mays
tggtgcatgtatggtagtttagtcggtgaggggcatttgttggtgtggctctatatttatttgaagtggtggattatatagtgttgtagattatagattagcacacagtttcaactattatgttttctgttattaacaaaatatggatagtttcagtcacaagcacaaccagcttaaatctgttgtagcagacagccggcttcactctgctattcacatcaagcatagtaaaatagtaaacacaagcaacaaagcgcatacaaaaaaggcagaatagaagacacatgcaccaacatagtacttctcatgataattctaacagtggcggaaccaggattcacagaagcccctagccaaaattaatgtaacaaaagtacaacaaacattagcgtagtccaaaagttaaaacaaaacattatgttacataaagataaataacatataaaacacgaagtcacagagtaatatcttcactcttcatcgatagttttaaatgcaggagtagaagctattgattttttaaaaaaaacatgtaaaagcaagaaatctatactactatattaagagtgtaaggggtaggctgcctctacctggttcttccttcagtcaatttgcaccgtcgatctgtccctgctcaatcctcaccctcgaagcaaaagatagtggacacgatcgccgtatgtcttactgttttgcacgatggccacgatcctcccccacgagccgccgcgatggccgcaatcctcactctccctccccccacgatctgctcccccatctcaacaatccccgccccatcgccgtgcgtctcggctgtcatcttccctaccggaagcagcggctggggcaag

SEQ ID NO: 4351 - DNA, 377 bp, Zea mays
gggacatatcggctccaattttgaggagggttgtattttgctgcgtattctatgtaacgcgttacttaaaaacgagatcaaaaccacaatataagtattcggtatcgctttatttctcagataagtctcaccgctcacaacctgtttacaaatagatcacaagaaatatccacaaaaagattgtctataatttgacccgggagtagagtgaaacctgttgcataatttttagcaagcgctaactttaccttgtggtatagcaatggctatactttatagcaacatctatcaatgcgataactataaccaaatttcacttgccttgaatgccccgtaagctggatgggtcagacaagcgttaggacagggtcaaaact

SEQ ID NO: 4352 - DNA, 141 bp, Zea mays
atcatggcgaccaacctgtagtagtgcttgcacatctcccagctcgcgcacccgatgctcctcaacgcctccgtcgccggaggggcgagcatagtcaacgtctcctccatcgccagcgtccttggcttcccgcagtaagtt

SEQ ID NO: 4353 - DNA, 54 bp, Zea mays
atcatggcgaccaacctgtagtagtgcttgcacatctcccagctcgcgcacccg

SEQ ID NO: 4354 - DNA, 141 bp, Zea mays; identical to SEQ ID NO: 4352

SEQ ID NO: 4355 - DNA, 248 bp, Zea mays
cctgtccaatggaatggtaaaatgatcatggtaaccgtgtaaaaaagcaaaattggatggctgcaaatgtcagggttatcaaatactcactccattcttttttatttgtcgtggtttagttcaaaaataaactagcaaacgacaaatactcgagaacggatgtagtatttcagattagggcataacaatgttctagcctccctttatttgttgttaattgtttgtttccttaatttgaaggtgacggg

SEQ ID NO: 4356 - DNA, 218 bp, Zea mays
ggtttgtgctatgtatcatcactactctccatatttggagagtttacagtgtgcttgaggagtgagtgccgcagtgcagacgaagtgagaagtgaccacttctcactcattcattttattggtttcattttactctcctgattagatatagacctgacttatgtgcagggagctcccagcaagggacattcttcaagccctgagggacgaaacgatga

SEQ ID NO: 4357 - DNA, 248 bp, Zea mays; identical to SEQ ID NO: 4355

SEQ ID NO: 4358 - DNA, 60 bp, Zea mays
cctcgaaatacagcagagctgtgggctgtcgctgacactgctgtgagctctgtgcttgaa

SEQ ID NO: 4359 - DNA, 85 bp, Zea mays
ctgcagctatatccgcttccactactcctatatacataaccgctggcaggcaggctcatgcgattagcgcggcggcagggcaggc

SEQ ID NO: 4360 - DNA, 965 bp, Zea mays
atgagcgtttcaacgttttatcgttttaataacctaggaattgtgcagacgataaaagaaaaccaaggctagaaaactaaaatacaagatgaattgttcgattttgaacgagcggatatatagaggggttataggtagtaaaaagaatattaacaactttctgatcatccaatgtatgaactgcatctacgtaggcatgattacataaaagttactccaaccttccacatacaggaaaccgtacaaaattttaatccaccagtctagggtgacactgctgcagcaagcttgcttaataaaaaattatacagatatacagaaaatccctcaagatactgcctattccaggataaaaaaaattagaagcatggttcataacatgtaaaatcacttgggcaaatcaaatgtttagtgattgcactcgagttgggaggtaccgtctcgttgcctctgtcgtcctgggttgccagcctagctcacaatccagctagccgccgagataatagggcccacttgtcatcaaactattatgcaccttactacctgccaaacaaagagaaaatgcaaatccctatccagcaagaccaacacgaacacaagcagcgcatacttcacgctctcttcacgcctcccttcgtctccctgtctctctctcccccatacatcagccgccgccgcagcaaaaaaaccctaaacccccaatccaccaatggcgtcaagcatcatcgaccttgccgacgacggcttcgcggcgccttgcctcttcttgcagggtgtatcctacacatacgacgacgtaagttggttcatatattgttaactcatgttgtttgactgctatattattttgtgccattctatgtttgacgcatgaaactttcatctgctctttgatgaaaatgttttgagttataactcttgacacactacttttaggacgaacgtcgagttaaaaatacagaggc

SEQ ID NO: 4361 - DNA, 936 bp, Zea mays
atcttatcccaagatttgttggcctaggaatcagtatttcgtcaaatcatcaattttgactgtcaactcggaaaattgagctgtgacaatccgagacctctctgaaatgttgaaacttggaagttccaaatgatttgtacacctgcatagtatttagattttcagccgtatgcatatggtttaagtgaactgctggttggatattttggggtatatctcaagtattttacagcagttcatacgtagcagctcatgtgtctgcaaagcaaaatagaatgcagatgggagacagagaagaccgacacgaagggaaaaaggttatcaatgcagccatgcaatcctttgtgaaatttgaagttaggtttatgcaacgtcacaggagatagcattataatctatccatcgttatgttaaggctgcacacagctcctaaataatctgcaaatttggcacactacaggtactcattcagtaatatactgacggataacgataacgagcacgtatcagattcccacacacaaagttattgttacaagcacacaacagtttaccagagcaaagtacacatcagatttgcttgttccatttccgaagcacaagtctacaggtgtcaaacaaagtttgaatcattgaaagcacatcagatttttgtgctccagcaatctgtgctactactgaacattcagtgtaagtataggccatttcacttgtaccattggtccacaaaagaccatagttagccctgtccaaaataccactcgtatataattagcatgtaaataccactctagtcttgggtttccattccacccaatgtcttcacgggtggaaacccaatgcctttgggtgggaacgctggcagccattagatcttctttcgacggtggatttcgacagtaaagtcccgcgggccgcggtgacttgccggtgggc

SEQ ID NO: 4362 - DNA, 300 bp, Zea mays
cctgtttgaaagagcagcaacatttataaagttaagccttcacagcataggatagaactacgctgttgtggaaaaaaattaaacacctgacaagtgcatatgtactacaggtaactcagagatgtaatatcatagcattgacaaagctaaagcaacttacaagctcaaccaaaataatgaaatacgattccaatttgaaacacagtaacatgtctaggatagatgcaatttcatgagcacctaattgttctgcagacatatcttatgcaggtaaaattgacaaatattgtggaatagtga

SEQ ID NO: 4363 - DNA, 1010 bp, Zea mays
tctattcatttggttttaattcatacctgcttctgctgtttctaggtaaaaatgtatacctgcttctttcttctactgtttctaggtaaaagtgttagggtgtcgtagctttactttaattgatgaatgcattgctttcaaaaaagaagaagaagatgacggaacatatcaaagcagcaaaaagacatgaaaataatcagagatttaaacgggtcgggggctcggggctacacatacccaacaaagttggcaggatatatttcacgtttgtggtggtaaaaaggctctggttccgtcgctccccagcagtaaaaacggattatatatcatatatccggcgagcgagctatagatcgtgattgtgttgtgttgtgcccacatggagtcgattcgccctgacgtcgtagggacgctagctctgcccgatccagtgctcctgacgctgttggctgctgacgcttgctcagtccggtggcacgccagcagggacaggtaagcaaagctccagtaactttttttcgcccgatgcctggcgaggcgaacaccaaggatggatgggagatgggacggagggagggaggctgagccactgttcctccgagcccccgtggcggccacgtcgcgggggcgtgacacaaaggacggcaccgaatcctgttgacttcccacaccacacgtcccccgtcgccctcgcgccttttataagccttccttccaccctgcccccaccccggcctactcgatccatcccctgtcctcttctttcttagcttgagctcgtagctggagcctggagcgcaacgcaacacaacgacgacgctcccgccgaccgcctgtcctgcggctacagccgataagctggccggtgtagcagcgagacaaacaaggcctttttttcgctcagctcgcaccccccgcgcccttcattccacgcgggtcgtcgttgtagttcttcgagcaagcagctctgagcctgagcgccgcgcgaccagtctcgatccaggccaccg

SEQ ID NO: 4364 - DNA, 83 bp, Zea mays
tgcagctcctcaaacaaggaattccaaaccgaaaccacacagctccccagcttccagcaagacagagggagaaagaaaccatt

SEQ ID NO: 4365 - DNA, 1427 bp, Zea mays
tggttggttgtccactagcttgtttccttctcctttctggatggaagctggagagctgtgagtgacttcagtttgcttgtgagttgtgatgctgcaactgcaagcgatgatgttcagaggccgcctgaccgtgagtatatatagctcactcgactgctggtggagccaaatggttgggcaagaggcaaggcttatgggcacggcgagtgtgcgatgttccaagacgcgtcagggagcaggatttggatgagattttgatggggccgagtgtcttgcacatgctggtgccggtcatggggcgctttccggtgcttggaatgccatgcttgttgtgtcttggccgagtgtctcgatcagatgaagatggcaatgccatgctgcgaaatagagctcacatgacgtgctaccgatccagctgcaggcactgaattgaagagccgataaagctgtcgagcaacttgtctgggccgctggacaggcttgatcaggtagactgtactgtacgtctgtaccgcgaattgaagagacgataaagctgtcgaggaactgtctgatatcttgaattgaacccaatcttcaagtgccgtacgtccccacaggtgaggtgcttcctcacatgcgctgtcaacctctgccacttcttggacagctgagcaatcctctttgtgctgatcacattcatggttagttctttctttcttgactggaaactggagagctctttctgagttgagattgtgtgatggtgttctggggccacttgacctgaatatgtagctctactctttctgaacgattcggatgcgactctgatggggaccaagagtatggtgcgtgccggtgctgaattcttgggaccaattcccgtggagcatgagggccaggtttattcagctggcgcggctgtgccatcggatatcagcaaatcagcctgggtttaaagcttaaagattaaacagaacgagcttgggcacaaaagctagcttccagatgccttacaagtaataatcatcggtatctcactgcgcaatcatctcatcgaaaagactgatactgacaaattggacccggttcacatgtggtcctcatgggctcatggtccatgaggcatatcggcatggcatcacactgtgatatgtaacgaaccagaaactactacaattggctccagcaagtgccaaacactgcatgttccaagctcatggccttgcctcttgcttgtctgagatggtgactgcacttgatctgcatcctcttcgctttgccctgacctataaatcaatcagcatagcaccgagccaccaacacctcatcagcctatcaccagcgacctaaaaagcacagcacctagtagctgaacagcaccatatacaatccgaatctctgaatattcagttgagccaaaaaggcaggaagaaggaggaacc

SEQ ID NO: 4366 - DNA, 1450 bp, Zea mays
aacaagcctcttggaactgatcatggttcctccttcttcctgcctttttggctcaactgaatattcagagattcggattgtatatggtgctgttcagctactaggtgctgtgctttttaggtcgctggtgataggctgatgaggtgttggtggctcggtgctatgctgattgatttataggtcagggcaaagcgaagaggatgcagatcaagtgcagtcaccatctcagacaagcaagaggcaaggccatgagcttggaacatgcagtgtttggcacttgctggagccaattgtagtagtttctggttcgttacatatcacagtgtgatgccatgccgatatgcctcatggaccatgagcccatgaggaccacatgtgaaccgggtccaatttgtcagtatcagtcttttcgatgagatgattgcgcagtgagataccgatgattattacttgtaaggcatctggaagctagcttttgtgcccaagctcgttctgtttaatctttaagctttaaacccaggctgatttgctgatatccgatggcacagccgcgccagctgaataaacctggccctcatgctccacgggaattggtcccaagaattcagcaccggcacgcaccatactcttggtccccatcagagtcgcatccgaatcgttcagaaagagtagagctacatattcaggtcaagtggccccagaacaccatcacacaatctcaactcagaaagagctctccagtttccagtcaagaaagaaagaactaaccatgaatgtgatcagcacaaagaggattgctcagctgtccaagaagtggcagaggttgacagcgcatgtgaggaagcacctcacctgtggggacgtacggcacttgaagattgggttcaattcaagatatcagacagttcctcgacagctttatcgtctcttcaattcgcggtacagacgtacagtacagtctacctgatcaagcctgtccagcggcccagacaagttgctcgacagctttatcggctcttcaattcagtgcctgcagctggatcggtagcacgtcatgtgagctctatttcgcagcatggcattgccatcttcatctgatcgagacactcggccaagacacaacaagcatggcattccaagcaccggaaagcgccccatgaccggcaccagcatgtgcaagacactcggccccatcaaaatctcatccaaatcctgctccctgacgcgtcttggaacatcgcacactcgccgtgcccataagccttgcctcttgcccaaccatttggctccaccagcagtcgagtgagctatatatactcacggtcaggcggcctctgaacatcatcgcttgcagttgcagcatcacaactcacaagcaaactgaagtcactcacagctctccagcttccatccagaaaggagaaggaaacaagctagtggacaaccaacc

SEQ ID NO: 4367 - DNA, 1205 bp, Zea mays
cccctgcctcttccaagctccagtatctatggctatagattacaagcccataaaaatatttttatttagttttaaattgtgtatgatggtgaattgagaagcaatttgattaattatgttgttgaaggttgaaaaaatgattatgtctatcatatccgacgaatattcgaaaccgtcatctgatggtcacgggtatggatataaatatatttctatccgcaagtatggtcgtggaccgatattatttgtaaccgcggatatgattgcggagcaatatttgatccattgccatccctaataaatatcccttaatctaaaaaatatgtttgtccctggtgttcaccatataatctggtgtttatgagatggactaacacgtcatatgatgacgatgttgagcacttcaacgtgaacgagtgtaagcctttgatcttcactgtaatatgaaggttaatgcatgattgggtgatatatatgttacacacggcatataattcagtgacagggagtgctgcaatatgtctggcacctgttggatccaccggtagcaatctctgggtggctagggcgatatcacaatgtgctgccatgctgctatgcctcatgggccatgaacaccaaatgttgattgggtccaagatatctgacagctagttcctcgacagctttatcgccctaatcagtttgcgatacagtctatctgattaagcctgtccaccagaagttgctcgacagctttatcgcctcttcgcggcctgcagctggatcagtagcacgtcatgtgagctttatttcgcagcatagcattgccatctgatcgagacactcagccaatgcttccctgtccatattttgatgtccctcgttgatcgtcgatgcatccgaagacacaacaagcatggcattccaagcactgaaagcgccccatgaccggcaccagcatatggcaaacactcggccccatcaaaatctcatccaaatcgtgctccctgacacgtcttgggacatcacactcaccgcgcccatggcgcccttgcctctcgcccaaccatttcgctccagcagttgagtgagctatatatattcacggtcaggtggcctctcaacatcatcacttgcagcatcacaaagcaaactgaagtcactcacagctctccagcttccatccagaaagaagaaggaaacgagatagtgaacagctaacc

SEQ ID NO: 4368 - DNA, 765 bp, Zea mays
agtttatctgtaggaaaggggtgctaatctgtcgcggtgaacctgggtgtgattcgtattatttcgattattctccggttggtttgtactattttttttttacctcatataggttggttgtgaaagatgggggtgcattgtgttaaaagttgttttacaggatggtggtgaaatcttcgttagaacatggataataattagtactatagattctttcttgtagtagccttagcgtatatgatatttactggatatgtcgttcgccctatcgctctgccttaaatatctacataaatacagacatacagtagaataaatagacacaaacactgtatgataaacttgaataaatatctgatcgcttttgctcaacatacgaattaagcttagattctcctgcttctgccaatgttctcgacgaaggcctccccaatgccctccccgatggcctcgatgaggccgccgatgaccccgaacagcgcgttgacggtgaccctggcggcggtggccagcgcgctcctcttctccggcggcacgacaccgtgcacgtagagcccgttcaccacgtccttggcgcacctggcgtggaggtagtagccgcagggcaggcactggtacgcgtgctgccccgcgcgcctcgtccgcctgcacgcctggcacacgaagctcgtctgctccgcgccgtcccgcgccaggagcagcagcgggtgctcgtgcacggccgggagctccatccgccgcgccatcgccgcgcagcacgggtgc

SEQ ID NO: 4369 - DNA, 482 bp, Zea mays
ggtccgaccccgccatcgctgtccccacgcggttgctccaaggaaggaaactctgatcccgctatccccgcccccgctctctctcgccatctccgtgcggctgctccaaggaaggaaggtccgaccccgccatcgccatccccgcgtggctgccttcccctctcgccatccccgcgcggctgctccaaggaaggaaggtccgaccccgccatcgccatccccgcgcgcccggtcgagcgccaccagccgcataagtctgggctagcgccgccggccaccattggctcggtcgagcacctcatgcccacgacggtcagtcgccgccttcatggctcagagtcgtcggtccctgcccaccaaggtcaccatgggctcgacgacgatggcaacaaggtcaaggtcgtcatcacaacccaaggtagtagctcttcagttcccccgccattccccaccacccctccaccgtctccaccgcacacagc

SEQ ID NO: 4370 - DNA, 796 bp, Zea mays
aatctactctgtctatatattcacaaattaaatctagtctctttgtctcataaattttataaaaaaaactctttgacgcttttttttgtctcgtgtccagctatatatttgtaaaaaagatattcttaaccgtttaatgctttgtttgattacatttagatcaaaaaaaattaagagaaattaaatccttttctatttaattttgactagggagagatttaatcttctctaacaagccttaagccttaattattggatgaactcagatcaaatttatacatatgcttacggttgagtcatctggcctgtttgtttcaaattttggccagattctagccattggaaacagtttttgatcatcaaaagttttgcttgtgtaaaaattgtctaaatcaaaatgaatgtaaaatccatcgtgacaagaaaaaatcatcactttctaaaatctaaaccaagtagactttctcatcctcatcacttaagcccatcaatatttagataatcgtgataaattaggtttgttcgaaatgtctaaaactaatagttagtagctgaaattatctgaggggtttagaacctgttagctaatgaactaattaattgttagctatccgttgttagctggttcaacattgctaaaattagctaataacttattaactggataataattagcgcaataggtttgaacaggttcttagataatccattctcacaaaagctgttctgacagccctacataggatatgttcgcctttccaaaggaaaaacagagatagaatcctacctatctagc

SEQ ID NO: 4371 - DNA, 297 bp, Zea mays
gctcggctcaggcgctcagctccttctcttggaatggatttgggtggcaatggaaatgggagatgcctgtacatttcaactagctgttagagttgatcgatcgattttgcttggctttttttggattggttttggacaatatttgatttgatctgtctcttgctttgcttaaactgtaaggtctcctttggtcttgttatcatttgctaagactggcgctaaagaagtcgtgtaagctgaatgtgaagtcgtgtaagctgaatgtgaaatgatgcttcacaagtgtaaacgtgtgcg

SEQ ID NO: 4372 - DNA, 1500 bp, Zea mays
gttttttagtgttggtcttttccttttgcatgatcatctaactatgttcgtcgtctactgctcacgggagccggcgaggtgcctgctagactcggcggaagtggagtttagttacgatgccgacatcagcctcgtgtccgtcgacttgctcatgccggaccaggagttgtaccgatggaggctggagattaaggtgtaggccgtgacacgcgtgcgcaggagtcggtgtcggcgcttttcttgggactgattaattctaagttggacgaccattgacatttgtgatgtgcacgagatgtattgtggtgtctcgctgtataattggtactgggagtatgttttgctatgtccgtatttatataccatgtgtgctctgaatgttgtataatactatataataagaccatctccagcagcttacccatactcatattgaaaccacactctacaaacaatacaatctacagtgcaaaaggtgtttttgtgatcatatgggtgaactattgtacattgcacctatatgatcactaaaaacactgttttgcatcgttttatattgtagattgcactgtttatagagtgtagtttgaatatgggtatgggtgtagtttgatctgctggagatggtctaaactctaaaggatgatctccttcaataggaatctcttatctaaacaataaatgtttttaataggaacctcttattcatttcgatcatgtattattaacttaggagatgcctatttcgattaataatgacattgagccaaattttggttattcaaaatggtagacttcaacatttatgattgttatgttgatgattgatagcatcactaaataatgacctgcgcgtgcacaagtgccctccgttgcaacgcacggatatatacctagttttttaagaaaaaacaaccagaaaagtcatctcgagcaatggcgaggaacgggaaaccgacacggttttttctattctcttacgtctggccgaaagatgtgtatgagttctgtttatcttttctgtgctactagtagcaaatactacattcgttcttaaatatttgttgtctcttagtttatttttaaataaataacgacaaatagaaaaaatggaaataatagtacataacagaaaaactaaaaaaatatatcgtcgatctggttaatttcaataagctaatgacacagtcaacgtgccacttcttgttggttgtgtcactagcatgctggtcgatgtttagcgtgcacttcttgcttgccgtcctcagtagcatcctggttatatagtatttagttattgttcgtaattcattattaattaatagttatttagtaattaattattttaactaattcaatattaattattaggtggttagtatttagttattaggtggttagtatttagttattagtatctagctagttattagtgggttgtggttaggcaataaccatccatagtggacacattaaatgtttaatttgtgtttcaaatag

SEQ ID NO: 4373 - DNA, 306 bp, Zea mays
ggatctaggtaactaaaaattttattcctagtatatcagatgtttgtacggggtttagggtagttaaaagtattaaatataatctaattactataaaattatttccccgtataaggactaaatagcaagacgaatatattaaatctgattagctcatggttcgttcttatgatttttaatgcaagcatataagtactgttattatgaggtcttgagtccgtctcctttataaatttgtctccgcggcgtggcttttcttccacgtccaaaaaccaaccaaagcacacacacactctgccggccacc

SEQ ID NO: 4374 - DNA, 550 bp, Zea mays
agggtctcatgtcctatgcatgttctcttttgtgagaccttgccacatgtctgcctgagtcacttagtgatcctccatgactcacctttctatattattttgggatgggcgtacttgatctgaatcaaaatgagactcttagagtatataggggcatagagcacacaactagcttagctaggccatgccttcaaaaactgtgcatgaaactctagaagacagacatcttcaaaacttcctcctctctactcgtatttccctactgtcttctaactcgtcaaacaacaaagagtcacaccagattgcccaggcaccgacctcttgaaaagaaccagggttcttataaatcattcgcatcagtcctcacagtgtcttctggagatgcacacaacatatctcccccatccttctctctcacccatgccttcataaacagcaaagttggctagctggttatttgtatcaagatgaagtttgaagccaacacatccatttctcgctagtaagatcaagaaaaatccattgaagcctacttcctacctaaatcttc

SEQ ID NO: 4375 - DNA, 91 bp, Zea mays
agggacataccatgcatgcatgcatgctgcttccttcagcttttttttttcacagcattgtgacgataaaccgagggaaaagtgagatagc

SEQ ID NO: 4376 - DNA, 258 bp, Zea mays
tgcagatggctctacatatcagctctgaacttcaactgcattttttatttttcgttaatacaagttgctactcatgtgcttgtgcctttttttccttttaattcttcttttttcatttcataataatttgagtttgttaaaccatcttggaaattccctattgactttcgtaagctgataggactttgctggtgtttctaattatgttggtgatctgtccaggcaccaaagttctagtgcatcacaaaggatactgaa

SEQ ID NO: 4377 - DNA, 559 bp, Zea mays
tacgaacaatctcaatataagttttgaatggcgcaatgcattctgttttatgatggatagagtatatagatatagatatagatatttatagatagagggagatatagatggtgggggtaggacaaaatatgcataaactgggcaggctctcgcttttgtttttctctgcctatattacccttcttgtctagggaaaaaaataaagggaacccaaactggcaaaagttcaatgttttaccaaagttttagcaatgaaattaaatagggagccaagtacggaaaggcatttgacgaaatatggtatataattatatgctttcaaatctatcccaaaaataaatgaagaaacgtcgattatttttgtagggagattttagtgtttatatactagtgtatatatatagtaccaaatctcgctcctctggagtctggaccagcctgacagttgtgcctatatatagcccacagaaccgagcgcaaatctgcattgcccgccgccgccgccgctagctggacggtatcaccggcccccaaatctttctgactctctcctccttca

SEQ ID NO: 4378 - DNA, 524 bp, Zea mays
aaacttctatcatcgcaacgtacgagcattgtactatcacatatatataaacctgtatggtaccgatgatttcaatgtagtgataaaatagctatattaaaataataaagtttatgtatagctaggatcataaattaattatgaaatattctcataacagtgtaacacatttgtactctggaaccaaacactacctaaattccggaagaaagacgaaccgacattggtactcagatccaaatggcatactatcgccattcgccaccggtaactcttgtgtcccataccaccacatgcactgttgcgcgagcccacacgtcagatcttcttgtgtcgcaagacaggcccacaaactgggactaatggttcgagagtcgagacttcgagtgccttctcccttataaaaccgaacgcccagggccctccatgttcaatctcgttgtccgttgtactctctctctctattcgttccccgcctcaccccgagccagccgtctcgctagggtttcgccgccgccgccgcc

SEQ ID NO: 4379 - DNA, 1097 bp, Zea mays
tcctgtgctcgtgggctttgcttcgcaaaacctgccctgcttgctgctttgtgcttgcgggcaggcttgtgttggctttatttatctatactatgagaggctggtagaggcagaggtagagtgcagaaagtgtgcgactccatgccccgcgtcgcggctcggaccatgtgttccggccgcaatctccggtactgcctaccgccgccgtctccttaatcacgtcggcggacggctttggttccagtatagacggccgtgggccactgggccgtgggctgctgggcagtgcaagtgcaagtggagttcagtccagggcgcggcacgtgggactgtaggagcgaccacgtgaacagaagcagaggccgagggggtgggggcagctgctcgtgcggtgccggtgcgtagtggtggacaaaaaaaacccaaatacctattatctaaatccgaactacccaaatccgtattcaatctacccaaaccctaatagcagcttccgtttctaaatggaaaggtgttttttttatcatgaaaagggcttgtaaaaaaccctaatatattgtattagatgaaatctgattgggtaaatcggaattatcttaacatgaatccgaattttcggatacccacttattttggatacatttcagtccactgtagaccagcactcactgttcatagttccagggctccaggccagttcgtgcagcctccccactccccagtccccagctccagacgcccggcctgtccgtctcagtcacactggggactatttttttttaaaaataatattaataatatctcatgcagcgtcctcgttctcgctcatttgggcccaactattataacgcaggcctccaaatatccgagaagtccggcccatagtccctctcagaccattggtcgaagctgttggtcggcggcgccagaaatatcagacgcgaggggggacctcttcgcaaaatatatagcccgcaccgaggccaagcctgccgtgccgtgccgtgccgtgcgcgacccaaaccctgtgcagtgctcccatcggattcttgcctcccacgccgccgccgccgccgccgccaccgccggattccgcg

SEQ ID NO: 4380 - DNA, 474 bp, Zea mays
tgtatgttcctactaatcattcagtaaccatttcttttggacttgtgcattatcttggttttctatctagaggttatgccatttaagttttcatgtatttattgaaactgttatcttcctgatcaggcgtgagatattatttgtatcatcttttgtgtcagtttcacagttgaaatgctaaattcggatggttttccttttcagatgacttttcatttctacattttggcacatccgcggaggttcttgatcacctggcrggttcctattctggacttgtaggtcgaaggcatatgtgttcactaccagagaccactgcttgtgatattgcagcgacagctattattttgtgtacaaagatttcttctggagtctcaataggagaggatacattggtttatgattcagtactttccggtagaatacggatcggctcgcaatgtattattgtctcggtgaatatacgtgagtttg

SEQ ID NO: 4381 - DNA, 1500 bp, Zea mays
caattaaatggtactgatttaatttgaaatgtgaagttctccaaaaggctttttccagtgtggtgtttctttccagtttgttgctctcctttacagtttgttttctttctttcctcttggctggggctgtctcccctatatttttctaataaacaacaggtcctgccagtttacattcaaataagttctgcaaaaggctacatcatgtgcactaaattcataaacagcaggccctgccattgacagttttacattcaaacaagttttgcatatggtaaagtaccgtttcaggtggttttgccaggatgttaaaatacattatattgacatattagttttgtttaaaattacttaaaaatgaaatattcaagcatatgcactagagttttttggtgaacaccaagaaggcagctgggtaaccttttgagggtagctaccctttgaaatgtcaatgatataaaaggactaaaggaccaaaggttagcagaagttcatgttcactaatgatggtatataaaatttgccatcagttcaagaaaacctactctgattgctcactgtaagatattatcaatgctgcactgggtaacctagtgtgaagaatccctatggtgcctccacagaaacaaccattgtacacatatgaaaatcaagtaatgtcgtagctatgtcattatatgatgacatatccactttacaagcgattatgttatatacaatgggaaataagtaccaaaaacacaagcttacataaataacctaaatatatagtcattgcttcatcaatatattgcagctgtgagtggcctctttagaatattaagttactagtgctttagaggacaattgtgctgtcagggcctaaggaggcccacagaggggctgcggcagcagcagacatgggtcctccaaggggattagataaggatagttagagataagattagaagattagttgagattatttaggagattagttgaaattatctaggaaggttatcagttagtagtttgttgagagttttaaggagataaggatctctagctagacaggggcggtcagtcggcctatttatgtaatcaatggatgagaaataaagtaggcaagaattagaagggatagcctctctccaaaattggaagagttgggctcctccaaaatgtaaattcttcatttggatagcctctctcaaccggtgttggacggctgacagattggcccggcgaggtatggatcatcatgacaaatgcctctttttttttgcgatcaacatgaagaaacagtccagcatattttgctctcttgtgtgttctctagaaacatttggtggcaggtgtggtgtaaagtggggctgcaatacctggcacctgggcctgaggacatgattttccaagattggtggagcaatgccgaaggccaggtttctaaagagaagagaaaaggttttaacacgttggtaatccttgtggcttggtggttgtggaaacatcgaaacacct

SEQ ID NO: 4382 - DNA, 716 bp, Zea mays
gttattttctttttttatttatgatttttatttgacttactgtccagattgacgaaactgtcatgctgcagaactagggttcaacaaattactttccatgatgtcagcgtgtccactgcttgaaccgaaatcaagattagaccggtgaagtgcaagcaaaagaaccccttctggaagatggaatcaagaacccaccgagttacatttgctaggtgagtgccaccagcccacccacaccgcctcgaaccacaacaggcagaatgacgactgaagaaaacattatattgcaggattcatgtcataaaaaatgtggcttctttaactccccaccgcaagtttgcagggaatcttgcaaaggccggtgtggcccgggattggagatcggtgaaaggcgaatatgaggggctggaaacagaccgacaatcgcttcgtgaaaactgtgcgcgtgaattggctccagtaggtcagagaatccagttccctcgttttcttccaggtctcctcaaccgttaacactgcctcctgcttgcgtgttgcgatgactagtggctggtttggcactggcgtcctttactttagtcatcctataaattggcaggggcatgcttcttcttgtcttattaaactcacaacacggtagcagggggtggtagtagaaggcataagctctgttctctgaccctcaagtgttttgagcctatttgcgcaacgaaaaa

SEQ ID NO: 4383 - DNA, 495 bp, Zea mays
tcaaagtagtgacccgaaaattgaaatactacatcatataaatcttttagggtactaaaaataaattgagctccaacaattaatccctaaatcatgtattttagaaaataaattatattattaggaaagaaaaggttgggaatgatgtagaatacaaggatgggacctaatatgagctgtagtatatttgagtcattttatagtgtgtcctatacttttttaataaaaaaatataaaatatgactaagctgtttttatatgttgagctctataccatgagtccatgacactgcttgaaaatgctctaacaaaacagyttgatgggccgcatcttgtatcyttattgggctgttggctttatcctagaaatccaatgtccggccacaacacgctgcgagtgtctcggtagcttcttccccattcacattcggccattctccaccgtccaaccaaccaccggcggcggcacaagrgaagcgaagaggaatcaacgcg

SEQ ID NO: 4384 - DNA, 175 bp, Zea mays
acggacaagtgaacctgccatggcagcaactctagttcctttttttctgtgagcagtcagtgtctagctgtctgcctatgtttgaaattcacctggttgaaccattttttttgttttgttttcttttttgggcaaaagacactacctcaaagttgtacaacaattcaaataggaa

SEQ ID NO: 4385 - DNA, 1500 bp, Zea mays
cgctcccctttgggcgttacatctggttcttgcctcgattttgcgttgggattacgggtacgggtgcctaccgaaggggttggggttggtgaggaaatgactcgttcgatcaggctaacgcgtctttatgcggtattgtataaatttccttctgtttcttgcgcactagaccgcactagtggagattgattgtgcgtgcatggggcctttgatgatcaagtaaagcagttgaaacagcgtccccttggtgttggaatcatgcgaaagatcatggttcgcccctccaactggcaccttccggcttccgggccttgtactgttcctcagcttaacaagtaggattgctcgaatcatgctgttcatgtgttgttcagcggcttggaattcggggggcgtgcttctgtactgttcttgactcttgtggtgttgattgtggaagcggcgtgcttgatgatgcagacgtcgttcccgtggtgttttcttgtgtcctgtccttgagcgagcttcagtggtccccgcacgtcaaattttacaggccagggattttgcgagctgttgtgacggtttcctgaattatgatgggaaaagttgcaacacgtgggagaccctgcggggagtgaggacaaggtcaaggttttgaagctgcgatttgtccatgtgtaatgctcacatttttcagatgcaactgttgcatttctgggtgtgttgtctggtaaactagctacttgctcatctcattggcatgccacttaatacacgacgtgggaggctcgaacccttttcagttatggttttgtagttctcttttgcactccatcctcagtttatctcacataaatggtagctgtcatgttaatctgattatcatgtcaattgtcaagtcattatctatttatctctgaataattgtctgacaacgagccagactaatatgagtgagtcctttcttttgctgtttgtttatttacttcatacttagttgatttagcataaatgtaacctgttataatctcattggcaagccacttaatatgcagcgtgggaggctcgaattcttttcagttatggttttgtagttctcttctgcactccgtcctcagtttatctcacataaatggtagctgtcatgttaatctgattatcatgtcaagtcattatctatttatctctgaataattgtctgacagcgagccggactaatatgagggagtcctgtttatttacttcatccttagttgatttagcataaatgtaacctgttatatatatatatatatatatatatatatatatatatatatatatatatatatatttgattttcatgtcaaatacttgtcttaactgtcctgagaatgaatcagtagttctgataaatataactaatctggatcttctttattgaacttgtgacgctgcagaaaaaaatactaactgtcttactaggagcctagagtgtccgaatttttgccattgcttgtcctgacttgccaacctaca

SEQ ID NO: 4386 - DNA, 1500 bp, Zea mays
cgttttgacctgggctggaaacaaacccgcctgattttgattcccatccctcaatcctcggcctggaacgagtccaggtgacctaccttctggactggatccggatctggaaacgggctggtgaccaggaatgagtgacaacccatgattcactcgatcctgggctggctttgttactgacctgacttggatcttgagctgccgaacaagaccttaaagtaataatatatacatattgatcatggtggaaataatgcaggtaaaataataatatgcatataatattataatggcgaaacatgtatttccgtatttgtgaaatatgtgccaggcaacacaaaaatcgttgtattacgatcaatttgcatataaacaattttaggcgtaatacacacgaaccttataaaatctacggtttcacaacatctccggccaaacgattttttaactttttcacatccgacagctcacagcaacttttctatataaatagctgaacctaagcacttcacaatcacatggcataattattagccttggtctaataaatgttgttaacatgtccaaaagttaaactttactaatcttaaagctatcttaatcattctggtacacagttgactgtaacatgttttgttttggcaccacgcaacggttataccacatttttagaccaagagatgcagtcgcacagccattcattcacaaatcaacagcgctgaatcctggatgggtgcatttgcgggggtagttagcaaatactacccgtcagggatctattaatggattctggataatgttcaagcgggaatccgaatacccgttcgttacagatcgccagcgatttacacatactctgactgtcatgtgggaccagaaccggcgggagccacatgtcatctaaggtaatctaatccgcacggttccgtcacttggcgcacgataaaaagccgcgagacgaacgcgaacgaagtgcgggaaatagtttctctctctcttcttcttgtaagatatttcggagtaggaagtgcgtgccttcctcgcagctcattcgccgaggtaacatcccctgcccttcctcacatttcctccctgttcgtccgtaatagtcgtttccgaaccttgcgtttcgtgggatttgtcgaggcgagggcttcgatttgacccaggaatcgcccaaatccgcttgtcttcgacttcagttcatccccacgaatttctagggttttagtgtcgattttgtcccccttcattacatttgattggcggtgaattgggccccgttttgatgattccttgggttcgttggacggcaggaaacgagatcctctagaggtttgtgctgtttagcgtgagtttttttggggccgatttgctttgctcgcatgggggatcatgtcacggtggatgttggggagctcgtagcgtcccgagtcgttgagacagcgcggttagtgtccggcgccaaggaggaaacagaggcgctggacgctggttgag

SEQ ID NO: 4387 - DNA, 831 bp, Zea mays
tcgcctcgtacatgttctcccgttgaccggattggttggatggccaggatgggtcaggtcttggctgactaggcgtccaggtgaaagtcatggtgtgggccgcaactgtcagtgagacgtctggcgcgtgtgctcgttcgttgtgctcgcgcactgagtctgagctatggcgacgcatgcatgtccttcttcttccctgtccctgtaatgtatacgtgcttgctgctcatcacccagcaagcaagctgtcctacctatatatatccaggccagcttgtattgcgtcgtcatcctcaattcccgccggagcttacgacgaatttgtttgcctccgctcccccattccgtcattcccatcctgtcgtcgccgtcccttcccgagcttttctctccaccaaccctcctcccatcctccaccagagagatatcagtttagtgcttgattaagcaaggatccatcgtccgtcgccgtcgtttaaggatcgaccgatcatcggtggtgaggagcgagcccgggatcgatcgatcgatcaaaaatccatcggcggcggcgctcacccggccggtcccgtgtcgatcgtccgaattgaatgacaacgacgacgagctaggacggcagcagcaatgccggcgcccggcgctgttctattttgatcccaggcccagcgatgcattggtacggtcaccaccgactgctattggtacggtcaccaccaccacagcagcaacagcatcgccctgtcgtcgtcgtccctgtccctccccgcctgcagcagcactagcagcatcacctactcctgccacctgcagcagcagcggcatcgtcgcacc

SEQ ID NO: 4388 - DNA, 433 bp, Zea mays
actcgggcgtgtaatgaaggtactgtatttcccttttttcaactgaacggcaggcaacggcaacggcatcggccatggggtttctccgtcactcattccacacgtcacacgtgagccggtgttgggtgctgagccaaaccagccaatccgggcgcgtcctgtaacggaaaccggcacacgcaggctgcgccgactggccgtgcagtcgtgcaccagccaccaggtcacgcgcattcctgcatttgcattctattccattccatatttccattcatccgctccgctccactccagtcggtcctactagtcctaccctccccgcctccccggcatcccttcgccatagcagcaccagacagcagagcaccaaacccacacttctttcacctcccctgccccctcctccattctccatcgcaatccgccgccgccg

SEQ ID NO: 4389 - DNA, 1373 bp, Zea mays
ttcgcgtaggtaacgacgggcgcgccgccgcggatcagacgaccacacagtgctgggctgcctacctgggcattgggaaccggtggctgatacgggtgggatggaagaaacaagaaggcgaatgcggggaagggtacgagtcagtaattaaatggagcaggcggggagatccggaggggaggagggagcaggacaagggggcaaggcaatgcgaagttacttatgaacacaagagcaagagccagcggtgaatgagagagctcagcctcagctgatgatgcgccgagaggtggcggatggagaagacgccctgtgcttgctagatctagctaccgctgcccgctgtccttctccttgccttccgctgtagccgccggagaagtgggcagtggaggcctggcggggaggagaggcagcgcgcggcagctgaaaacggtagggaaagggcggtcggctgctcgggcagcgctcgcccatggcagccataggggcagtggaggacgggcatggtggccgagcggcacgaggtggctaggaggcgcggccggcagtgggggcctagtggtgcacggagacgacgacgagaggtgggggcgatggcgactgtggatgtggatggaccagagcggtttaggtttttgcgttgttgatggggatgggatggggtggaggtggacggtggattcgtgggccgtgcgggggttcggttgtatagaattggtgtggctggaccagaagttgaactagggctttctttggaattgagagcccagggctcttaatagatatactatatatattaactaatctgataaatttagatttttctcgttcaatgtgaggtctttcttctaaatttttatagtgttggcataataaatcggaacatgcaaaagtagaattttgcttttgcagttctgcagtcgggtccaagtctacgctagggtcagcaggaaaagcaagttgcacaaagaacaaaagcgagtagccagctaggaagggcatggatcgacggagacaatagctcacaacttcaagtggagcaatagggcgggagcttggacatcggtccggtggcgcaatagggaggagaaaggggcgccgttggaagccgccttgaaaggaggaaaaacagcgagcgctcgggagtatgtacgggccacttggggtgtggtgccgaacgtaagcaggcccacgtgcaatcagtggtgccagtggactggatacatagcacatgcatgcaaataagcgtttatagacagactcggagtattttatttaaatggagcaacgacaacgatccccacacatgttcatcagctacagctagcccttgagagctctctctcttttttttttttgagagcagatag

SEQ ID NO: 4390 - DNA, 619 bp, Zea mays
tagaaattcctttaggagatagaatttagggaacgtttctgagacaagctaacccccgtcgtcagccagcgcgaaccaaccggggccgtcggggtatcagttggtccatccgcagggtgggcagccgggcaccggcccgcgcacacgtgacccccgcccggaagccatcgcgtcccgcgtggccacggcagcaggtctgggcagtaggcaccttccctgaagccccagtccggcagcaggagccactgagccagccgtccccgtctcccgcctatttattcttcccttcccacccgcccccaaactcgatccacccatcgcttctcccgctcgtactcctcctctgctcctggacagcagagcacagcacaacacaccgagaaagaacaagcagccgccaccggagctcagaaccaccatcagcagcagcagcacacccggtcaaccttacacacacgcgcgcacacacacatggcgtcgcagcacaggcaacagcagacgggagcggcggcggcggcgtcctccgccgtgggcttcgaggactacctgccggtgatggcggagcggctgggcgaggacgggctgatgcgggagctggcgagcggggttccggctgctg

SEQ ID NO: 4391 - DNA, 1274 bp, Zea mays
ggtcagccagcgtagacgtgggccacagctggtcagtctcaggtggtagggcgcgtcccagggccgccgcgcgcgccgcggtgccgtgctccgcggttgcggtcaccgggcgtcaccgcggggtaccgtataaagggcgtgcaccccctgtctcgcggcccgcgtttgggtaggtagttgctgctgtgctgttcccccccgtctgtccctgagaggcccgcggcgtctccgcttcgcctcaccacccaccacctcctcctcgccggtacccctcgccggagccagcgagcttccggcgaagaaatccggcgggcacaccacacgggggcggagcaggggggaaggggtccggcgccggaatgggggcaagcggtcgggtgctcaacgccgtcgtcgctggtgtcgcgtcgctctagggttaggtaggtgtccgtagctttctccttcgctcccccctcccctttgtcgcggccagggctgtgcagccccggcatcgcattggggtctcgtgccgaccgccaggctgcgtgatccactcgtgctcgagctcggagaggctcccagttgcgtggcatgcggccatctcttccgcctgctgccgctgactaggaattcggcaccatttcttcgctctgaggagtagtaggtggcagtagtcgccgatctggtgagcctccactcgcttcccgttgtatacatggatgctttctcttggggatgtttcagttttgggaatttgttggaagctccccttgtatccttacttgttctgtttcccttgcttgctgtgtgtgatctgagcttgaattcgggggctgacaattgatttgggctgtgctccgcggaattcctcgttttgttttggtggttcctttcatcacaagggacttgcttgtttggagctcgtagagcccgaggcgcattaaattccacatcttatgcgctgttttattggggaaattaaacatttctctcgcaagtttgtgggattcgcactctgatttgtcaaatctactggttctggttcagaagtattgactttggaagctcacacgagctaaaatccgcctttttctctgctgcccgttggctcggttgccatagattcacagatttctgcacgtaaaattgctctgattcaccatgtttacccccatctacacttcatcttttccgcaaaatttatcagttttggcttgatcccaagcaatttaggcacggtgttgttgtcaaggtttgtgcctaacacgttatatgctctggacgcctgcagg

SEQ ID NO: 4392 - DNA, 381 bp, Zea mays
gggcaatagaacaaaacctgcagtcacgactgcaaaatgttgttgcatatatacgtacgctagtggtagatagtatcactatcacacactttgcgaagtttcactttattctaaagactaaacaggtgactagtgtgcaagatgttgttgcataaaacgcgcaccaatttgtattatcgtatccattccaaagacagctgaacaagagaacaacactgcagttgcgcaaccaaacaaaactgttcaggacaatcccatatgcactagtgatagatagtatcgtagtgtcacataaataagattcaaaaagttttatttatttcgaagaggtgagtgagcaaagcaagtgagccatttgcacaggccggcagatcgctcacc

SEQ ID NO: 4393 - DNA, 76 bp, Zea mays
tttagttatcttggtcttctaaatcttgctgagatggtaaatgatttggatgagagagagaacttgacaatgttgt

SEQ ID NO: 4394 - DNA, 344 bp, Zea mays
tgtaagttagtttaactggcgagagttgctagccaaatttagctagtgagagggtcaatttaaagagccggatagcttggcaagttaaacggatagtctgttgaagagctattttgctattaaatagctaaaatttaacttgacaagccatttatccagtctcttggagatgctcttaattaactagctttttattaattacgtataggctagttttgttttgttttgtttttttagaaaacggaacgtgtgttttatttcgagagaagcaacattttcttttattcattacgcgcgtagaggcaatgcggatgcgaatgaatgaatgatgcgtcgctggaacc

SEQ ID NO: 4395 - DNA, 599 bp, Zea mays
ctatagcaatacctaaaagcagtatgatagcaacacacacaaaaggaagtcttgtttttcactatgaatcaattgtcctgttgttccattggacatctacagtgttgctgcatttgctgcaaaacacagaacagtcagaaagaaaaaaacgaagaaacaaggggcgccttctcgttgggcttgggcaggaggttcggagagtgctttttctcgccgaaccggcttgtgggagatgggcaagagggaaggaccggatccgtcttgggaaaatggtttatctacgtatttatatatatatttattcagccactactatttgatctgcttagtgcagccgaacagttttaaaatctcatgaaccactccacgctagatgatccatgaagaattacatccttcttccagttttatatcgtatcgcgggaaagttagccgccatatgcatcacataggacgctcgtctcaaactctggtcgattaaaaaactgatcccaaagacatacttaaaaagcaaatagcgtagagttgtccgaacgcagtctcgtcacggctgctgcgtcgtggtccccaaatcagcaatggagagcagcagcaagggc

SEQ ID NO: 4396 - DNA, 1178 bp, Zea mays
gaaataaggagaaatggataaaagttttttttgcttaaggagtggttatggtgggtaatttctcatgaagttgctacaatagtgggtccttttaccaaatgggtcgaaataagcacatgttgagcagtttatggtatcatgataaccaatcatcgatattatataatgtggcctagtaatttacctatttgtttttaatctagaatatttaaaattaatctagacaggttttatgccgaaacaaatatgtccttagtagaatccagttcctctaaaatgaatggatcaaaacgcacatcaarctatttaattttctgtcatctttatacatgacacttggtccttttttgagttagcttctggagtttttttttttgaaatgttgctacatggcttttgcttctgagaagtcaatggtaacatttcgctaatgttattatctttctacttagaaagaagatacgaaaatacagcaaaatcaagcctataaaatcagctttttaagcctctagatttttcgaaaattaaataaaaagctaacggtttgttttagcttataactttttactctaagaaataactatctagaagttcaaataaatagggccttaagggcatctcaaacaaggtgactcaaatagtgccctaaaaattaaagtactacatcatttaaaatgttcgggtactaaaaacaaattgtgctccaacaattaagtcataaatcatgtaatttaggaagtaaattatattattataaaataaaatgatgagaatgatgtaaaaacaaggatagagtactattctgggcatgatatatttagatcactttatggtgtctctattttttttataaaaattgtaaaatagagtatttttagaactatttatttatttgttaagctctatattttaaaatacagggagataaatcaaacatgctctctcttcggcagctctttcccatccttcacttcgcccaatttttctcccatccctgcccctcctctcgcgattctgccattttgtcccccgctcaccaacctaaatcgagagaattcgatatttgccatcatcaccaaacacgatagtaaaaatgtcacagaagtggcaaaattccaattattatttcacctaaaaccctctgctctcaaacctagctcgctcccggcggaccgacg

SEQ ID NO: 4397 - DNA, 619 bp, Zea mays
tttcttccagtttgtaagtgctctaaattatttttattttaaaaataaataaaaatagagtctgatcctaatttgcatggatgtggtaggatccaattgtaatggcgtatttgaattgtattgtcgtattttcaaagctagaaagtcagactaactctgagagactctatatatatccttcctaatctatgtaagtaaagttttttctaaacaacaatctaaatatagtcatctagctaaattaaaaaaaagcatgaatgactctctgagtgcaaatagcgaaaaaatataaaaagttgttgaatattgaaaagatatataatctaaataataattatttagagagtgaaatttagaaaaagttctgatagatgttatatgacatgtattagaaatccgatcccccaccgcaatcatcaattcatcacggcatcacccccaatttcttctactccaccgaaacataaatctgtagccagcagaaagatcttgcggaaggtggcagacgcatagatgagggtgagagcatttggcggtagcgcttgacgagcgacgagtaaaccctaatgctttgatcgcggcggcgtcgtttgggacactcccgaatcgatccgcctac

SEQ ID NO: 4398 - DNA, 530 bp, Zea mays
cgtggcgggagatacggctgtgtggaggcttgcttgtggaggaggcggcggtgtggaggccccggctcaggcttcgtcgatggtgtcccctccctccctggtcgttgctcggtgcctgtcgggctggtggcaacgtgcaagtgctcagtctttgggcggtttgttgttacggcagttgcggtggcggttaccagcttctccctaaggaccgtaacttctccttgtagcttggtctttattgtttgctaatgttgtccatacctatttttgtcgattagggtcaccttaacattgactcacggattcgcttattgaggtgacacgttttgtttagatgaactctacagacttgatgactgtgttcctattgcttagttcacaaatcagtcatcgtggggtttacatctatagaatgttcagttgtcgtaaagtttgtggtcgttgatattggctaagactaagtggtatgggagcacttgttcagcttgtaggtggtggcaactctaggattcttagatgtggtgatacgc

SEQ ID NO: 4399 - DNA, 438 bp, Zea mays
tgcttcttttctttctcactgtttctggagatcaaaactcccattgtaatcaaggcaagaggcaccaattgtgtggtggcccttgcggggaagttttgttcccggctttgatttgagaagagaagctcactcggtcggaaggaccgtttgagagagggaagggttgaaagagacccggcctttgtggcctcctcaacggggagtaggtttgcaagaaccgaacctcggtaaaacaaatccgtgtgtctcaccgctttacttgcttgcgatttgttttgcgccctctctctcgcggactcgattttatttctaaacgctaaccgggcttgtagttgtgttttatattgtaaatttcagtttcgccctattcaccccccctaggcgactatcaattggtatcagagcaggttcttcattagagcctaaccgctcgaagtg

SEQ ID NO: 4400 - DNA, 1055 bp, Zea mays
agtgagaagtgcaccaaaatttaggggaaataaaattcgacagcaacattttacaaacagttcactaattaataattcaattagttggagcattaaagctacagacgtaacaatagctcgcacaataatcacgtttttccaatttataggatttaacccacatgtttagaagttactaaataagatgcaagtcgtatattttgcggcggccacacgacaccatgagaaccacaactagactcgtcattactagacgctagaacacaagtgtaggcgaaagcgagttatttagcgtttatataatactttttctacgttaatttgtatagtacatagaaccaattaaaccacacattttatttgacttaacgagtagaacactcaacacattcgagagttcgacgaggctgctattgggaactagactcacacactcgtaggtatctatttcagtttttctaaacccgacttgtcgacgctagtcgcttttaaataaattttaggtaatgacaaaatcaaggttattatggcgtcgcctaggcgtagcgacgcctaggcgtccaggcgattctatgttctaggtgtcgatctcgccgcgtcttggatgggtatggcgtcgcccggcgcggctaggcatcaccatggcgtccaatttcgccacggacgccacgaacgtgggaggtttttaggttcgcggctttgcacgcgtatagggcagggttttagttttagggtttgcagccccgcctctcctccatctggcgcgccgccactcctccatctgatgcaccgcgccgttgcctcctccatctagtggccgacctcctccatccgacgcaccgccgctgccaagcggcaagctgctccatctagtgctttcctctgttgtctgctccatctggtgctttactctgctctttctcttcctctaatcttcctcttcctctgctcttcctcagttcatctgtcgctgctcgcctgctctccctctgtccctcatctcctattttgtatgcagcaagccagcaacactgtaacaacaccctcatcaatca

SEQ ID NO: 4401 - DNA, 643 bp, Zea mays
ggtgtgtttcattagttaatttggagcttgcttgtcgctctggttgttccatttgtgactcagagttctcgaatttctacgtttctcctcgtttgctcgctttcgtggtatggaattgcgttttcaattcagtgttcgctcgatgcacttttttttattaggcaactgctgtgctggcaacccttttcagcgagatagccagattggttaaatttagtttactgtgcattgcaattggaagggacctttttcagttgaggtcaattgtaggctgtagcttctattgcctgtatattctgctgagacagggcgactgttggatcccaatattatcgagatggaagctggagaattggttatttggtttcccacatgtcctccggtcatatgagcatctgatatgaaagtttggttctgttctgttgtatggttactgcctctgagttgattatttagtattgtaatcgtattctcaggatgctgttgaattttattcatgttttcaagctcatcttttctcattttttttctgttgggtttcaactgtagcctcacatgacttattgccacaatcaactgttatgtagtctttagtacgaattcttctaggatttttgaacaaggcccgccctattttggggcc

SEQ ID NO: 4402 - DNA, 1500 bp, Zea mays
acacggcatggctcgtttcattcaaagccaatgctgaagctaagcacagccaaatcctaaactgttggtctctcatcttttaaaccatttttttcttttcttcgtgagacggtaatgactattatccatacggacaaaccacttcgacagatctggtatagtagtagacatagcgttaataggacaaccattgatcggttggttctctgaaacctttttagtcatcatgtgctgcttcacagttcacagtagctgaagaggaaaattgtacagaaagacaaaggcagaggaaggaacagcaggacggtcaataaagcattttaccaggacaagtgtctttctttctttctttatgatggcttttctgtatgccctccagattggttgaatgcaggttttcaactccctctctcgttcgttcgccccctcatacaagtttttaaccgacagggaagtagccatcaacttctacaaactaaacctcacattcacaaaattaaatggtaaaaacagggctccagtatttttgtgagggtctaaagttcaaaaaaaaaacatgctgcgaaaccagggacgcatgctgcatagaagattcagatgcatgagtaatatgtattcatgttttgccaactctggcgttcatggcattctctttccatgctctgccaaatctgcttttttttattcatccatattattgtttattgtttctgctccctaataataattgcatcgaagcaaagaaataaagtgaatgggaatgaaaagagaaccttgctgtgttatatgtgagaagtatgactagttatattcaggagtagaagataaaattccatcaagggacaggcagaattgcagaataatacctttcccccccatgtgcgcatcaattattgccgttgcatccaaatcaccagacaccaacgcctacccccaacctcggtaactggcatagtggacccatgctttctgaccccactgtcatacagcacgtccatatgaaataaccacacccagcgaagccgccgccccattggcccgacgtgtccgtgccgttagaagcgaccccacacgtctcaacgggcccacacgtcattcccagccacgcgtcgcaggaccgcgcttcgcggcgtgcctcacgccaccgacgtgtgggatcaggaggaacgcgcaggccccaccggtcagaggcgtgggcgcaggtataaacgcgccggttgcccaccaggcactgctgcagcagcaggagtcggcaaagcaagcttccttccttgcgaacgcaactgaccgctccggattcgccggcccccgccgccgcttcgccttctctctccctcgtccacggcaaccaactaaccgtcgagatattggcggggcgccgatgctccctgactccccgtagcgcgttgcggatgctgtgggcctgtgaggctcgctgccgccgctttgggatctgggctgctgccggagcggcagcggcggttgtgactggcgccggcg

SEQ ID NO: 4403 - DNA, 193 bp, Zea mays
ttgaagaaacgaatggcttggctgaatgatctctggttgcatgtggctgcaatcgactatagttttcacttggcatgcttatctgtatcgcttttagattgtgttagttgtgtgtatttgacttcttatatgcgaactgaactgtaacaactttcctttgttggccggccgcacatgtacgacataatcattt

SEQ ID NO: 4404 - DNA, 1070 bp, Zea mays
cgttacgggtttaggttatctcgtatttgtatactagctgatttttctgcggctcaacgtaaagatcagttcccgatgaattctctatcaatgattatgattttaaaaaaagagaacacaaaaatcaaaaccctaaaccatatatacctcggcactgttgtgattagggtcaatgattaatgaactcacggatatattaaggaactcaccgacatggacaaaatacaaaccacagcatattagagtgacatgtccaacactgttgttgtacatgcactgcacctaagtaatttgtgccacgaagctagcagataagtaaaatataatcaactctaaatagattacaacaaaaagatcaactgaaacaaaaaaaaaacaaaaacaaagtaggcgtccagtgtgatgggctcatcttaactttgtgattgaagtctatatctcgatgtatgttagcgcgatagatgtgctaaactgctgttgtgaagtcgttcatattcacctaaactcgatcgtaagccaagaggcagggacgtaaggtcacttgctgtcgtagagccagtaagtttaataatagagcaaatgatgggctctaaattcttgccatattatttagagcaaacaataaaaacaatcgtataatgatgttggctataaggatggctcttatattactatcttgtccttttcttcttcatctttttttcttgaagcccgtgtagtaggtgrctcgacctcaaaacatatgtgcacaacctttgagatcaaagaaacacatttcactcacttgcatcctttgatccatcaattgggtgagcttaaatagaagtacatttgcatcgttgttcttgcatctcttggcactagttgagagcattggctggtggagcccttgttacaaaacactgttgaagaggaataaaatacataaaatgatttcttttatagagtgtacagctggcagtcgcaagtcgccgagccgtcctaactcagcgagagggtttcgaattggcgccaagccgccaaccatttcccccaatcccgcctgccagccctagggtttctgctacgcc

SEQ ID NO: 4405 - DNA, 246 bp, Zea mays
gcttaaaaattggagggaagataaggggacatcccatgtgaagggagctcaaagcaagtgttggtatgttggtacaggcgtgtggtttcaatggtccatgtgcacacacaactgtaaagactatatagaacatggcccacctggtaacaagtatgtcaccatatgaaacgaagaacatgcaagaactctattttatattatacaatatcacaatagcagagtaagcagacctcatagttggtgata

SEQ ID NO: 4406 - DNA, 89 bp, Zea mays
agctcgctcgctctgtctagtgtgggcagatgtagatgaaccagcgagtaggcacttcttgtaaataacaatgaggtgtagggagtgag

SEQ ID NO: 4407 - DNA, 1099 bp, Zea mays
ctaatattatccatcccgacggccgtgtaataagatgtacagactctgtcccaatggatgttggacccgattcttagttacatcttgtatgcagtgcaggtgtggctgaacgctccccaggcaggaggcatcagtcgcagcccttggctacgccggccgtgccaccaggccctagccatgtttgcagactccgcatgggtaggcactgaagcaaactagtagacctttttggctcttgtacacaaactgaactatatgaaactttggtactacttttttttccctgtcaaatataccccctccggccttccattcatcaggtatgtttgtatgagattgcaagcccagtgtgtgtgtgtgtgtgtgtgggagttacaatatacacgctgacacaccaacaccaaactacacactggaccctggagtacaaaactgtcatctgatacagcgatgggtagagaggccttgaatcatgaaggttacagcgcgttaattttagtgatcgtctcagccgcttggctctttacaagctcgactatcatacagcattaggggcatactaagtgccagggggggctcacggtagagatgccgattggagagatttttagccaacagaaacaagagcggggttgagcgccataaccctccacggaaaacgcatctaccatatatacatgtacaattcttgacgcccaacggacccaaaaaaaaaactgtgggccggtcaagtctcgtgcggacgaccagctagcacctagcagcagttctttggccatgccatggtcagctcagctctactgtgatggacccagaacgcccgatgctacgagttgctcctgagcttttctttcgaggtttcaggtcaaccacgatgacggtgacgttgtcctcggtacccttcttcagcgcgaccctcacgagataatccgctgcggcttgggcagcggggtcggtggtggatccatcaccctcgtcgcacaacgaccacgatgcgccagcggcaccgttgttcttgtgccacacttggatttgccggcgcgcagctttgcatgcctcttcgttcgtcaccacatcccacagcccatcgcttgcgagg

SEQ ID NO: 4408 - DNA, 237 bp, Zea mays
  unsure (1)..(237): unsure at all n locations
ttgactggaagtttagtaaacccggcataaagtatagtccggtgaggggtagccgcggaggcatcagcgtgagcagtcggaaacagtttgttggcatcctcgtgatgattnttattggcagcctgctgctgctggagtcgctcgcgcgcctggtgcatctgctttttgttggatgagcggtgtttcatgccgcgctaaacgcttacactcctttgcgtcttactgaaaggagtctcc

SEQ ID NO: 4409 - DNA, 386 bp, Zea mays
cgaaatggacacacgcgcgcacgtaaaaacgaaaaaaggtccccggccgagaccgagagccgcggtccagagcggggggcggccggcaaggacgaaacggcccaacgccaccacctccaccacctcgtcctcgatcgacacctcccccgtcgccgtcccgtgactccccgtccagccgtccaggcccagctgcccccgcgacccagacgaccacgtccgcctcggcctgcgcctccccgctacaagagtccgtccgcccgccagcgctgcggtgccagcgagcccctccctcctccactctctgcggcgcggagatcccgtcctttctctgtgcccccggtaccgcgaggagccactgccaggcgccggcgtttttggaactgggc

SEQ ID NO: 4410 - DNA, 1451 bp, Zea mays
tggcttttgcctcctaaaagccaaaccaaatgactggatccaggaagcagcttttttaaaaagccgactttctcgcaatgtaaaaatgaaagcacctctgacctacttttagtggttttcggatggaactgtgaaaacataaaatttgaagaatttttaacggcttttagtggtttccaccaaacgggtttttagctttttaacagctcatagcccacaacagcttttttcacagctcacagcccacaacaacttttttcacagccaaacaaacagactcttagtgagcccatataaaaccgtttgaaataaggttttctcaaactggatgccgacgtggcgtgctacgttgagcacactaatcaaagtttggggacccaaatgacacaatatattaaatctggggatccaagtgacaggacatgctaagtttggagaccacgccacgtcgacatccggtttgagcaaacccgtttttggatggttgtgtatatgggtcgtctaagttagagaatccgttggtttttcgatttcggtgacccaagtgacacaacgtgtcaaattcgaggagcattgttgcattttactcaatctttcctctaataagattctcctttttcatttctctacgtataagttaaatttcaagttcatatttttttgaggtgattcacgacattatctacgttacaaaaatatgtttaaacaaatttatcattatttcatattcagttttgtaccattaaaaatatgatcttatttgatagctaacctatcaaaacaattttaaaaatcataatataatgttctaggctaagttatracattagctaaaaaaatggaactaaaaactcactttgtacataaaaaataaaaatataaattttactaaagggtagattaatcaaactcaaataggtggagggggtaaaatgaactacaaattactttatggggttatatgaatattgtttataggtgagagagtaatttagacttttttctaatataatttgtgacacatacgatccattttgcgactttggatcctattactgggctgagactgccgaccgcttggtaatttagctcgatccggcccatcatgtgtttttcgcgtcctttctttcaaaaggactttcggaccatattctccacacaaaaaaggctttcggaccatattttgtgcagaccccaaacaagatgctccgaggccgcagtccggaccaatggtccaatctccaactccaatgccctcgcgccagcaagagaagccactccgacgtggacaaaccacagacgtggagggcatcgattggtctgcacacgcgtccgtctcttagcgaggatgcaggcttaaatcgcagcaccactgcgaaacccgatcgctagtcgtctcgtcactgccgtttgatccctccacccgtttccagaagcttcgcggctccgtc

SEQ ID NO: 4411 - DNA, 827 bp, Zea mays
gtagctagctacttctcatatcaatatatcatggatggatggatggatgcagttcctaatcgagaaaaagggatagttagttgtgtggttttgttgttgcgatggaatgaatcgagcagcatggatggattggttgattattatatcatctataataggggtaaggtgattgtgggtggtggtggatctggcaatctgctgggctggcaaaaaattagtgggaaaaagtgggcctgcactgcatttgcctgacaccgcacgtacggtactcatgatccatcgcaatcgtggtgttttgtttagctgaataataacaacggtggtgttttaattagctgagtagcagctgggagttggtaaccaatccgaggttacacagatgcgcgacatatgaatcctttcctttgcacaaggaaaaaggaatattatttactctccatggtgtagcgcagtgccgtgcccgtggagtgttgggggtgttgctgccagcccagccaacacaagagtccagctgaggcaagagagagagagagacgtatgtggatagcgcaggccggaggcaaaattactactgccaaaaaggctggctggctggctggatggctggatgatggatggatctctgcctgccccctctcgccttttcgctctgcagtgtgcagtgcaggtggggaaaaaagctaaggtagcgtagcgtgcgttttgcttgtgcatggcatgtgctccgatcctcctcctccgacctcccggcccattctttctcccttcttcttgagggggcaccctccgtcctttcctcttcttcttccttcagaaatcgcaagaaa

SEQ ID NO: 4412 - DNA, 246 bp, Zea mays
gccgtatatatatattattatgtacctagcagagtaggattattctacgtctctataatctatatatacgtatccatgcatgcatatacgtaccacttgggcatgtaggaatatatatgcatgtatgtacgcagcaggttgagacggtgcatagtgtatagagtactgtatcccgtattcttgtaggcggaggtctctactagctagtctactatagacggagaataaaaaaacaccaaaaattcc

SEQ ID NO: 4413 - DNA, 449 bp, Zea mays
caggctcgagataagagaagcgggaggcccttcgagggaagtgcgttgaggccccaccggtgtttaggcccgcctattaactattgttggtccaaacaaactgtaaaaagggtacataaaccatcgtaggacatgtgcatcttcatcatttctgaaaggtacagaaccatcgtaggacacgggatatcgaataactatgggtaccctaatcaaatcctgtaaagggtctgtgtctctgtgatattctacggattcagacctataattggggctaaagcatgaagtaaccttcaggatctatcacactgtactatctaagagatgctgcaaaactgctacttacagagagctcacccgatcacggtatctacagtgtatggaggttatcaagacaaacctgtacagcattagcttctaatgtgatatccttgggtagtaaagctcagcga

SEQ ID NO: 4414 - DNA, 301 bp, Zea mays
agtatgctatcaggatgaagaatgcatgactggaacaaggaaggaacgcagcttcatggagtggttagggtgggttccgtcaaatggtatgcgcctccagcctctaaaaatgaaatcctaagcaatctttattatttattaatggaatcccgagccttgcactggagcgcagtgcttcaacagtcacatcgtcttccttctctccttttcagacactgttctcacagaatcacaagcaggggccgttggatgtctgcacttcgcagcagcaacaggatgacgatgacgaggatgcccgtga

SEQ ID NO: 4415 - DNA, 1500 bp, Zea mays
tatctcaatacatgagtattgaggtcaatactagagtatctaaactaggcccaaagcgtttagaaagatttcctcctatattatcctctaacaatgttctctaaagtgtttagaggatgttattctgtcctctgtctatatattttctctcctttcttctatccattttaatactttaagcaacagattaagtaaaactaaaatacgtataaaacatacattttaggatatgacaaatacatatatacaaaaatctagagtaaaataagtctctaatatagatatttttgtatgcaagacgggatatagaggtcacttttggagaggaataagagggatatatttgatcgtaaaagagggatataagaattagatagaggataaaatctttttagaggaaaccgtgaaagaaatggtatagatgacgctgccggagaagaataagatatggaagattgaatcttttagaggagacttaaaaagatagaggtatatgaggaatatatatggcactgctggaggagaataaaatatagagcacgaaatcttttagcgagactatacaaaaaaaaatggatctaggtgacgctgctcgatacagtcttgagcccgttctgtcctattaggaccatccaaccatcccaaatattaggagttgttttgccaaaagaaaagaatattaggagttgctgcagtttcaattctatttttatataaaaaaatgttatatatgaatagacaaagaagcagaagaagaagttgtcatggcatccgattcatggatagaagagacgtgtttcgtgctggtagagaggtgaaagcaacggcgcaggcagcgagccatccgcatccaacaccagcagcacgcatctctgctgccacgtctacagagattagcgtcgccaagcgcatctgctaagcttcctccttcacacaagaagtaaattaacatttcccaggcaattacggctaaattaaagttggcctttgatgcatgtcctcgccgccatcactacgacacaccggtcgattcggtccttctgcatgttgccgtccagtacagtacgacttcatcacttgaacagcacgatctagccatgttgccactcccacatgtctcaagtgtgagccaccacacttgacactagtcattgtgtttaaaagatataactactttttgcataattagcttctttataccacggccgtggcattattttatttcattattgttaggtagaaatcatttgtgaagcattcacgtttgtactggcaatagatagcacttgccgccttgcgttgactgcgatgttcttgtgtgcctgctctgcttcgctgctgctgacggagacagtgggactgactgactgacatggcccactcggatggtgatgccttgcagcgcggccgctcaaagggggccccaggaagacggcggaccaggccacaccggcggccggccgccgtaggggaggcgccggcggcgccgccgccaggctc

SEQ ID NO: 4416 - DNA, 1500 bp, Zea mays
gatacgggtattacttctacaacattttgtttctatatattagagccgctgattattctctttcaccttgactcggaaatttctccggtaaaatcaccaccagatttcattgagcggcgtacgtccttttcacccactctctagtaacacctgtcgcccgcccatgcccccatgtctccgcccatcacccacgcacaagtccccgcgcagcaccagttttctaaagtcacgatcctccttgcgtggcaccgcgcctgcgctcccgtccatccctcgccgactcaccccgtcacggcacgtaagcacactgtccacgtcgccgctgactccggagcccgcgagctgaggtctcccacctcaatcaccccgaaaccgacacccggtttcctccgttttcacagcagtgccgtgcccgttgccgcgcgcgagggacccgcccgacctcggccggccccgcgattgcaacgcccactgccgatgacttccccatgcgcgacgggctgcacggggctggcgggacgcatagaggcggccaaagccgaaagtgcactcgttcggttcctctgtccgggcccccatgacgcgcgcgtctaattttgatccctgcggtggcatgtcttcccggcccaggattagttcgtcgaccgccgagtcaaactagacacgacacgacacgagccctcgtgccatcgtgtgcgggcgccacagccaatcccgtcccggcacgcagcgcggtcgcctttttgattactacaacgatcgcatcaaaccagggcggcgttttgccggagttaacaaaagcatcagaaattgccgccgtgcagaggggacacacgtcacgttgtttgttctccgcctccgcaccgagatcccgtgcgcggacccggaacactgacgcgccgatgcggtggcccaatcgccggccgccaacacgcacgcggggggcagcggttgcgtcgtctggtgcgcgattagatttgattaggttagacgtggtgcgcgataaatgatgcctgctgcttatgaccagcagaccggcgcgcgtcacgtgtcgcggcggggctgaacagctgcggcaacgtgtcgtgcaaggtgagcccgtggacggcccagatgcggtgggcgccagccggtccgcctcagaatgagatcgcgcgacccgactcccggcgccgcgcgagcccgcgagacaggggctttaaaaggggcgcccggcaggcaccacgggaccctctctcaactctcgtttcgccggagtatttagcttgcttcagggagcacgtggcggtggaagcttccctaggggtggcggaggcggtggtggtgcttggttgatgtcgatggcgcaggtctgctgtgactcggccgtagcggcgacggcggcaccggtggccgggccggaggcggaggcgagggccagggcgcgcgccgagaggcgccgccgggccgcggaggccgggaggtggaagcacgcggcggctgctggcacggcagccgcag

SEQ ID NO: 4417 - DNA, 962 bp, Zea mays
tgcgttcgggcggcggatgcagggagccagcgaggggtggccggctcgctcttgccgcggcggtgcgggagcgggactgcggggtttatcgagggcagagcagagcgatcagaggctgtagattgactatgataaagacagccttatataaatctacctctatttctaaatatttgacgtctaataatttaattttaactagaaaatgttatatataaaaacctagagactatatcttatttctcgtttttattataagatactccttccgtctcaaattataattcgtttgacttttttatgccatatttgatcggctcgacttattcgattttttttaaaaaaatggaaaattcaaatccatatttaaaacatattatatgctaaacaatatcatagcaaaaataagcaataaatataatttttttgaataagacgagtcggttaaatttggaataaaaaagttaaatgaattataaattagaacgataggagtatactttaaatataactttatatttatttatttttatgaaaaaattgaataagacgaaaagatcaaacatgttagtttttttaaaaaaaagtcatatgaattataaattgagagggcccgtctgtgtccccagcacccagcagacgaacacaagagtcccatcccatcccatcccatagaaactgtgatgtgatcctgctctccccttcgttacacgcaacgcatacgcatggcatatgctcccacagattcgcttctcccgggccttccctcctgttctgctgctgctcgaatgctccaactaacacccacctccctccctatattaagctgcccgtcgctaatgattcagcctcctcttattctcattcgattacacacacacacggagagatcaaattgatacactgcgatctcgatcaaacaaatcaaaaaaaaaaaaaatcttgcgagacattactgaccg

SEQ ID NO: 4418 - DNA, 1500 bp, Zea mays
gcctatggtattcgaactcgtgaccattctctagcgcgcaaacttctctatcactccatcctgatatcaattgtgtctatattatgttatcttctccacatattataacaaaccgagtgtaaattgtttgtttaaggcactaaatggattcaaatgattgtcaactataaaagttgcataacttttcgagatctacaaattttattttgacagtttcttcatccgagattgattacaaaatttgaattttaaattttaaaccttcaaaaaatatcaactacaaagtttcataacttttcaagaccaacaactttcattttggtggtttttccatctgagattgtttgrgaaattcgaatttgaaattttttaaatttagacgtagtcttcgttaacaaaatgactttaaatcaaaaggttgccaactataaaattgtacaacttctcaaggtctacaaactttattttggttgtttggtcatttattcatccaacttgatggttctaayattattcacaaatcttaaaatcttatgcatctcttgtagtttctaaactacgagagagatataaggtttgtgaacaaatttacttttattttatcatttactgaaatgaccaaaattaaaattgtacatcttggcgagttataaaactttgtttagtgtaaaaacaatattcggcaaagcgttcttcaaaatgtgatttgaaaaattatctttgactagtgtaaaaaaaatagtcggcaaacaagctcttagccgactgtcaaaaacaacattcggcaaagcgttctttgtctagtgtataacgatagagaagattctttgcctagagtaaaaacacttttttgtcgagtatttttatttgccgaatattttttatttggcactcgacaaagatcttctttaccaagtgtttaaaaaacactacacaaactatttgatacttggcaaaaatagtttcttcagaagtgagactaccatatattttcacaaatcaacaagatgcaccaaacccacagcacaattatttatttatttattttatagggaagaagacacctgcaaacgcactgatgtgtgtccatgaccgaacgtcttgttcttctatctctcttagagtgcgttcgtttgtttagaattgaggttaggaatggttccaggtgatcaaagcttatataaattagataagcattcctgattagattcgctctaggttatgattctggaacaaacgaatacactcttattaatgtagtgggaaccaaagtatttctagcttccctttgtgcgccatggctatcattacaaaatactcgagtcttggtatcagtgtggaactgtggacataccactgcacgcatgcaatgccattacatcgatggtgaaccccgggccgaaccccaccatgaacccccactcgcagctcccttcctcgtgatcttgctggcgacgacgtataacctcatcgaggacaaagatcagagtcgggcccacc

SEQ ID NO: 4419 - DNA, 231 bp, Zea mays
ggtaagaaaatgtaaaggcattggtccaatcagtaattccaagcatatttagggcacatgcatttaggagtccaagtgtccaacattgctagatcaataagaaataaagattgatgattcggaaaaaactgaagtagcttaaagaaattgtttgattgacaaattcagatagctgtacctttgaacttcctcttacttggaggactttcagtgtttcttctatctacagga

SEQ ID NO: 4420 - DNA, 974 bp, Zea mays
tctctattctcgccccagtgccatgagaatcatggagcatgctaaatcaatctcagtaacaactgaacaagcaagccctcgatcatgatctcagtgaaatggagagagtgacaacacatggagcacctgatcttgtcccaacgtgacctcatggttgtagtgaatgtcagtctcactttgctctgtgcgacgataatgcactatattgaccgtcatatatactagtatacaacactcacattatgacaatacacaatggtcgtcgaaagaatggagatgtgaagctcctgtattagacgccttaactagaatgggagatggtacgataatctgcttcggcactggagcgggagagtcgtctggtgttgtgagggccaagagacgagattatcaccaaggtagtcataataaccggaggtaaaatgtcggggatcaggacaaccagctgagtttgcatttgtgtaagcagtcaaggtctagatcgggccaatgacgatgtgaaggccataggacaacatgcccttgatgtaccagaggatacacttaatcaacacaagacggggctcatagggatcattcatatagaaacaaacctgttgtacaacatacgccaagtcgagccgagtaagtgtaagatactacaaagcgacgatgaggctctgatactttgtcaaatgagcaataggcgtgccgtcagagcatctccaacaatgtgacctataaaaataccctataatttgaaaataagtatattttatagaatttagggcaccaataaaacacctcgctccaacagtaaagctccaaatctagattatagggcagcccactacggtgtagtatatttgagtcacttgagagggtgccctatagttttttgacaaaatttatgaaatagggcactgttggagtagtttttcctgtgtagagccccatatttcaatttgaggcactagtttgaggcattgttgaag

SEQ ID NO: 4421 - DNA, 1500 bp, Zea mays
cacagccacaaccccaaccaaatagaccctaagcctgggtgcaatttgtttggtggatttagtatatgttatgagtgtgggagcgattcggttgggtaaagtttaaaccggtagattatataatggtttagatataaataggtaagttatgctttttccatgagagtaactttaagggttcgtttggcagggttctggcttgcccaaaaacatctctagtttttttttgtaaaaaagcaatttttcggtagagctgctattttgcgaatcgtttggcataaacgacttaaccgagagcaagagtcattttcttgtattaaagtgccagggcccgtgaagctattatttgtggcttcttctccgtagtacaaaaatggctctgacttttatgtgctttttgcaggatgccatttaaaaaaggtgtttggcagggctagctttttccagagaaaaactagagctgaagcctgccaaacgggctctaaactcgccttacgacatgtgcaactctaagttcttggaacggtttttaagtataaacacaactctaaggacatattttgtatagctctccttcactccggagcagcttggctaaaattctacgtgaagcacctcgctccggagttagttacttactcataatcagtggtagcatcagttaaatacattaaaactccatgtctaggttgatttttttaaagaattttgaagtagcaaaagaggcaaaaaattatattgtggccttcaaaattctatggagtttgctactttggattttgggtgtttgggtagctctggttagctctttcttggagttttgctctatagccaagtcaaattccccctaagagactagctagatcgttttgtaaagataaatttgtctactattagagaaaagacgacaccaatagactttgtaaatgactcttggaatttagtagctctccattcatccactttcgctctttctttttggatagcctacttcactcgacatacaaatttctgaatttacagagtttgttggattagcctactcttttttgtgaaatctattttagagagtagctaaatcactaaatttggctaatatttttggctaatctcttggagttgctctaaaaaaaagcaaatttctctacgtctggagaggttatcaggttaggagcaaggttgttctctccattaatgcattttcaattaaatataaaaaattaattgtaagttcaaacgcaatatctaatagatttgtaaagaacaatttatcaaataataataataacgactatctagttcggccacttgcccacttccatacccaaggtctaataccgaattatcggaaataatgttgattacttaaaaacgattaacgaattttgattgcgtgattgcgtccgcctccttcaaccctatccacatctggcacagaggaaaattggctacggtacaaaacaccgaggcatcgatggactcttccaccagctgacagct

SEQ ID NO: 4422 - DNA, 1234 bp, Zea mays
ggtaactaactggccgatgcttttgcctcaggagctaattattgctatggctcatcgctgtaaccactgtgccatctaaagattatacatcatagttattattctttttcaggtaccctgaagatttcgtttctgttttcaacaaacgatgagtagttcactatgccatttgcacacactgttttgttataattgtcgcatactagctccatgttttgggatatttctaaaaagttcctgctatatatcaataatgtattcgccaaaacctgttctttgatagacattgcccttaactagactgccaaattatgtgacattcattagacttgtgcatttgattatttcgacttatgttgcattatctacattcaaacttaacatgttttctgaaaattaatatctatgagacaatcttattctgaaaaggtttattatcaactttttaatgttgtagataactgttatattaacagtgaacagtccatcctattataatttttgttacaccttttatatggccatcagtaatcacagttaagggttggacaaaggcactatgtagcgtggcccttctaattgtgttgctgaagttcttattgaggttattaaggtttgccaactttttaggtaggtgttccagagcacggaaggcccttgagctaagccaatttttaggagtcgatatttctccaacaggtacttttgcagtagtcgtgagtcattgcttatatgaagtaaggagagaaaattattgtttctattttctgatgcgtgaggttgtacatggacattctacagagagctggtgaagcagtgtggctttcaagtactacatcaatgatttcttatttctttatggacttgtagcacctgaatggaacccatttttgaactctgcattttttaagatgacattattgttgtattgtaatataatttgatatgtatcagttttgttctgtattgattattgccaaagaatttatgagatattgatatcgataatatacgtggtattttttatgtaattgttgtgcaataacattttgctgaatattttgtataccgttgcaacgtacggacaactaactagtagaactaatatctctattagtactgtgcggaacttcagtgaaaatattaagggaaatttggatccataccattaaaagatcaccactttggatccataccattactatctcacttacatgtgggtccacatgagtca

SEQ ID NO: 4423 - DNA, 645 bp, Zea mays
ggctgggagggagatgaacctgttgtggccgcgagggagaaattcctgtggcggagtggaggaagacaatctccgattggcggcggccatgttcatgatggggaagtgaagtactctcaattctgcgatggaaagacgtatcggtggatggagtgcaggggcaacatggtcagttgagaaaacgaaggtaaagaaaataattaaaataattaaaaaatcatagaatactatttagtaagatcacttctaaatactacctccgtgatagaaaaccattgattttttcgaaaatttaatcactcatcttattcaaaatatttatttaagtaataaaaattttaaataaatataaactaacttaaataataaaacaaatcataaaaaataaaataatagtttattatttatttaaataagatgagtaatcaaagttttaaaaaaattaatggtgtcatatatttatgaatatatttatgaacggagggaatactttacttttatggagaagatggggttgagagtaacgtaatagaagccagaaaaaactcaccgggaagaaggaaccagaagctaaccggcacgtcgtgaagctaaccgggattccgggaagcagagacgtccgcccgtcgcccgtcgtccgtcgtc

SEQ ID NO: 4424 - DNA, 1027 bp, Zea mays
caccggacaatgtctggtgcgccaggctgactcaggcgaacttgccgctctctggaaatcgtcggcgacgtacggctataaatcacccggactgtccggtggtgcaccggactgtccggtgagccaacggtcggccgagccaacggtcggccgcgcaatccgcgcgtgacgcgtggccgagccaacggtcagaagggagcaccggactgtccggtgcgccaacgactccaaatcttcaacgatcggctgcgccaaaacaggaaagcaatctgcaccggacatgctacattacatgtccggtggtgcaccggactctccggtgcaccagtcgacagaaggcaagaattgccttcctgaattgctctcaacgactcctagctgccttggggctataaaagggacccctaggcccatgaaggagtataccaagcattctttgagcattcttgatgattctcactccgactttgcgcactcgtttaacattcttagtgatttgagctccgttctagtggtgaactttgtgatactcatttgagctcaagtcttggctgtgtgtgtgcgtattgctatggatttgtgtgtgttgctcttcccactcttacatctatgcttctttgtgatcatctcattgtaagggcgagaggctccaagttgtggagattcctcacaaacgggaaagagtaaaggaaaaagaacaccgtggtattcaagttgatcattggatcacttgaaaggagttgagtgcaactctcgtccattgggacaccacaacgtggactaggcaagtgttgtacttggccgaaccacgagataaatctctgtgtctcttgtgcttgttctcactgtgtcaattgtggttcacaagagctctctttagccacttgatttcattgtgctaacacttaatcaagtttgtggctttaagtttcaagtttttacaggatcacctattcacccccctctaggtgctctcaatgggtatcagagccgttcttttcacgaaagggactaatcgcccgaagag

SEQ ID NO: 4425 - DNA, 668 bp, Zea mays
tgtgctatgtatccatcaagctctaagaaatgaaaattggcaaatcaattgtgtgcttgaagatttggcactagcaatggattctaagtttgataaatactaggagaagggcaagtataatatgacacttgtcatagccactatacttgacccatcaaagaagatggattttttggactttttttatgagaagacgtgtcaactgtttatcgacatccagataaacatgtccttggccaaacaatggttcaccaatttttttggtgaatatgcaaaaattgttcaaaaagatactacagtctcacctattgttgctacaaatactagtactttgggctcaccgattcttggaaaaagaaggttggataaagaattttctcagtggtcccaaacaagaggaagacgtcttgcaaagtctgagcttgacgcatacttagaagaagaatttgtgagaacagatgaaagatttgaaattctaagttggtggaggacaaatrcaaacaaatacccagtgctttcagctatggcgcgtgatttattagcaatacctttgagcactgttccttcggagtctgcttttagcgccggtggtcgcattcttgctgataatcgaagctcaatgacaccagaaacacttgaatgccttgtatgctgcaaggattggttgt

SEQ ID NO: 4426 - DNA, 742 bp, Zea mays
ggataattattttaatggttgagtaactaaaatttatattgatgaatcatttggttagtcttttggaagctcttgtacggcacctctgcaactttgacgacctcccataaattctactcttccaaataacacattgatgcattggattcgtccgaaacaatcttatgttgacaaaaatatatttcaaatccatgaatcaactttctgactcacggcaaaccatattgtgccacctgtcccgcctgcgcatacacatgccgtgaaaactgacgaccatgaacgacagcaagatgaaccagagcaaacacgctccacagtttaaggctggcctcctcttgcacacacttgttcccgtcgtctccctcttctgcgtttggtccttgacctcctcaacccccaaacgacgacaggagaacaaaccaccgtcaaagctcactcttttttctgcacaaaaaagaccttttatctcacagagaagcagacactaggtatctacactgctaattctccccatttcttgctccaaattaagcagacactaggatcagccagacatgtcaatcatacactgacgacgacgacgacagagatatatatctgcatctatctgggtgtagcaagatcatacaaattcatctctgctgctagtacagatcgatgcaacgttcgtgtttatacccaggtgggctgcagtttgcaagttaatctgtagcacgcaagcacacaggcgctgtcatcgtca

SEQ ID NO: 4427 - DNA, 1062 bp, Zea mays
ctgcagctctccgcacaagaaacgccatggactcgaagctttccaagcagaagcgcagctgctaaagtaacacaggccaactctacgcagcaatcgagaggcacgactgcgactacgagcgaccgtacgggctgcggaggacgagagttcagaggcggccggccgccgagaaacggcagaggtgggaggaatcttgcagaaaggagcgggaggagctggtaaaaggcggcgcttttttacgccggcatcggtgggaattcggaccggacctggcgagccataaactccgctcggatcctgagattctccctctgccctgttggttgggagtccagcagctagccagggcatgcacgacacgacgagcccatcatgtaacacgagtacgtagtgcgcacggctctggcccgtcggcgtgaccttcctccacattatgctgggcgataagtgaagagtcgggacatctcgctcatgtcacagggatttatgatactacttccgtcctcagggaatctaatgatgcgaattgagattcatgagcacaggacatccaagctaaaagacgcagctttttctcatacaaatattccaagtgccgctgaactgaaaacatgtacttagggaacaccctgccgcactggaatctaatccacgccaatgttctgttctggcctagaaaggcgcgcccagctactaggtttagtgatcacgctgtcaggtcactgtgagcgagagcactgattgaacaaacgaacagcggcacaatgcctgccgcactgcgatcgtgatcgttttgctaatcatttgcgctgcgctcctacatccttaattacttccttagacaagggaaatattataactcccctggcccctactatgcacaaggctagcaccactatcagttcaacaaaactagggcggcatggtgtcagttagctcccgcctcctattgaatatccaatagcaaaaagaccttcagctgactagttccgtcgagtagcaactgcctcgccagagattcgagatataccgaagttcctgtgcttcccgtctgccttgttg

SEQ ID NO: 4428 - DNA, 89 bp, Zea mays
ggtatgtatcagagtactcccatactggtccagcccgaagagaagcaaacaatttggttggtaagaatcgtgcagcagctccagcgagg

SEQ ID NO: 4429 - DNA, 1500 bp, Zea mays
ggaactaggatcgtattccaacagaattggctctctgtgaatgaatatctcaggatttaacggtgttgtgttcagtttatagtgagacgtctgtggtgatttcgtcaatctcgaagattcgctggtccactttaaaatcatattgtgatgattttgatcaagctgaagatttaccgatccagacttcagggataggatttacatatgtacatacgtatgcagtatgcttatagaagagactacgtgtattatgagcgtcatgctgtaaaaaacacaagcacccttcttcatctccaaacagattcccagccaaggtgccttctgttctgtggctcgccgtctcgctttttcttttgatttggcaaaaaaaaaaaagttagcgccgttttccgaacgaacagaagataatgtatataggtaaacgagtgatggcgtgagcagcgcgggtggagtgggcccagggcagtgtagccaaccaaagcagctacgaaagctggaggggtctccgagttcccgttcgcacgatgacaatcgcatggccacggcaaaccctagccgccgggccggtcagcacctccgcgcgggggcggcggcgcgtggcgcgcgctatgccatgccgctatatagccagccaatcatgagcccacctcgattccctcccaaccctgtcggttttctcctgttgacttccggtccctcatcgaggtaaggcgctactactagctcgattccatgctccgtcctccgatccgggcggggtgaagttgatttgttatcattcacggttctgattcaattgttactgctgcgtactggttcggtattgtctcaactcttttggttcttgtttcatttactactcttcaattttctctgaattgtcccttagcctttgtcctccacgcatatactactactagcaaataatatgatacttcctaaaatcttatgtgatggccgatcgcttctatatactacgtccgtttttgaatatttgtcgttagttagtttattttcgaactaaaccacgacaaataaaaaagaattttcgagggccactcgcttactgcggcaagtggcagccatgtctagagaggccattgcttgagtattttcagctttaagttgtggtttatgtgatggtgtcgtaggggtgtgttccttgcccagggctgtgtgtgtgagcatgtagtgagcggggaagttgggttgccccctttcaaacccgtactttgtattgctttccctcttgatgattggcagagctcctttgtaaaagacagggcggtataggttcgaacactattggctgcttcaattatagagtagtttcagcatctcaagtttaatttgctccacagtcagcaagcactcactattaaatctaattttaaaactcaaattgtagtatatcttaactgttgttttgcgtgactgcgtgctatataaatatatatcctttctgctgtttcttgtgaatcagctgcaccacccgttgcc

SEQ ID NO: 4430 - DNA, 450 bp, Zea mays
ctatcaacgcatgtgaattgaggtcatacagcgtaaagattctccgctccccggccgcaaatcccccactggccagtggccaccaccaccgcctcgattcgccacgtttggttctgctgaggtcgggatttggtgtgccgagctattccttgctcaattggatctcctccgcgcgattcgattcgattcgattcggttcggttcgttccaatcggggttttgctacttccgctgccaccggtgtgctccgagctgctcaagctgcgcgccggatacctggctgctcgatctgattcggtctccaacaccagccccctccgcggccgccgctccccgctgaccccggcgccatttcgacccgcgcggccgatccttggatggttccgatcaatcgggaccaagagacccaaggcttcatcagctcacccggcccccggcggcggtcgatcc

SEQ ID NO: 4431 - DNA, 1500 bp, Zea mays
ctagtttaaaatatttttggtccacttttaaggaaacggttggagaaaatattaaaatatacccctaatatttttttagatgtttctaaagatcagttttagaagtccttttatgggaaagttttggatattttctaaggttgatcgcaaaaagatgatgtatatggtcgtgtatattttgccatgtataccgtactgtgtatgacgtgtattttaaaataagagatgagattaaagagtctggtgcctaacagaatggcaaacttatttttaaatttattttaaatctacatgtcctgaagataggccgttctaataatcttttatagaataaaacaattttttttacgtggagctgttgaatgttaaacctatcgatggtatgttggtttgacttttgtctttgattttatcatctaaaaatcgaaagccaagttaaaggattgaatataggaagcaatatctttttctttctaaaaccgagtttttcacagtgtaaaattgaaagtacatgtgaacatacttttagttgttttcagatgaaccataaaaatatatatagaatttttttagtgattttattggttttcataaaaaaaagttttaactgctcgtaacctacaacagtttttttaccgctcacatttaaaaacatttttttatagctaaccaaacaagcaaacagactctccgggtgccctcgaacggctgtcgccgtcgtcttgactccacctctgtcagtcgctctcccaagtccacacaaccgcccactacaacggcagccaagagcatttattattttcagcacaactccgtttgatccgcgcctgcccacccatttcctcctccactggtttgcctggcgcttattaattgcagccgaatcaaacgcacaaagggcactggtgcgcctaccatgtccgtcaatgtctggatgactggatgagagagagagagagggcacgagaaagtacgagagagatagagagagagagagagatgcacagcaagcggagggaaagataaacaaatccgatccgcactgctgagcgcatcggagtcaaaaccaaccgtccctgtctttcttctgactttccccaccctcgtcctctttcggcgactctgcaatccagcgcggcccaaggatgacgaggtcgacgagatcttcctccatgcagcgctgcttgctcttcctctgaggcctgcccctgcccccctgcccctgcccctgtccttgtccgtctggatttcgctcaggcggggcctttcctctccttgggagtttctgcgacgactgctgctgctgctgctgcctgtctctgctagctctcgtcgtaacgtaaccgccgctcctgctcctggtgctcggtcgatgcacgcagcgtagcaaccggcggcgagaagaattgcctgcttccctccctcgcggcgctcgcggccgttcatgccctgcaggaaaagagccgcctccttcccggatcccgccgcctctcgccggag

SEQ ID NO: 4432 - DNA, 635 bp, Zea mays
gcattctttcttgtgatcaaacactcacttgtaattgaggcaagagacaccaattttgtggtggtccttgcgggaagtttgattcccaagtgatttgagaagagaagctcactcggtcggaaggaccgtttgagagagggaagggttgaaagagacccggcctttgtggcctcctcaacggggagtaggtttgcaagaaccgaacctcggtaaaacaaatccgcgtgtcacactcttcatttgcttgtgatatgttttgcgccctctctctcggacttattattatttctaacgctaacccggcttgtagttgtgtttatatttgtaaatttcagtttcgccctattcacccccctctaggcgactatcaattggtatcagagcccggtgcttcattagagcctaaccgctcgaagtgatgtcgggagatcacgccaagaaggagatggagaccagcgaaaagcccactacaagccacgggagcacttcatcggaagagtcccgcacaaagaggaaggagaagaagaaggactcctccaaagggaaggagaagaaatcttcttcacaccacaaagaaaagaaggaaaaatcctccttcccacaaaccgcatcggagcggggacaagaaaaagagg

SEQ ID NO: 4433 - DNA, 314 bp, Zea mays
ggtaaggttagcggagtacagttttgaggcgccaacaactagtttagaggtagaggtctattgtgtggcagtgaattcgtcaccgggattgaacacatgggactgggaggtggcttgccgtttggtacagcttagtatgctgacattttcaatattttgtactcggaatttcgtaacagtttatccttctcaatgtatattactattaatgcctgtttggatcacattaattgaaacaaatatctagaaattgtttctcattttattattaggttacttttcaactcctgagaaccaatcagggcattaatgta

SEQ ID NO: 4434 - DNA, 1329 bp, Zea mays
ctgcagcttgagcacctgctggaggaaggaatgtttgtgtgcaccaatctactcatacaaagtggagggacccatttagacctagagtccccctacttgagaaccattgaagcactaatatacctgacgaactacacaagacctgatattgtgttcgcagcaaagtttgtgtccgcagcaaatttgctggcaaattctatggtagtctctaggttccacaaatacattcgaggaattggcataagacaacttaattagaaagctacatgatgcaggggagagaaaaaccccttaactccatgtattccataattatgggcttgaagaccaatatgttctaaagacctaaagcctacaaatatgtgctgaagaatgatcaaaattgttctacattttttttttctcggtgagctttttctattgcgttttctcacacaaggtggttagggagacaccattttttttatcaaaacaacaggcacgacgtagcacatgcgtgcaatataacattctttttctcctgccttgttgccacatggttttaggataagttttttttttgacaaaacaagcacgtaacgcgatttgtattagggagagtatgtacgtgttatgaaatattctaaaatgggcaaatcattgtgcgataacgtgggacgtgggagtcggtgaatctccgtgccaactatgtgggtataatgggagcgagcatgccacatggttgggatgggaattgggataagtttttgacaaaaacatgcacgccgcgtgatctgtcttaggaagtgtcatgaaatattctgatgggcaaaacactgtgcaacaacgtgggaggtgggaggcatttgaatctctgtgccaaccatgtgagtacaaatgggaccgaaggggtcaacgcaaagcatttaataatttaagcaacgctctcccgctatggaaggaggccggtggtgagcccggccgcgtggagcatgaagtggttggttgctcctctctttgtaccaaaaaaggttatacatgtgctcactccctactagctctgtccccaataccgtgtctctctgtgcagagctagagtgcaagaccgattttctcaacaaaagaaatggaacaacgaaagagaccggactgtgaacgcactggactctgcagagttcagactgccccccgatccttcttgtgttctgtgctcgtgctcgctcgctacggcctatatatagagcctgttcagttcagactgaaccacaacgcacagttgcgtgcaggtgcagttagccagcgccagctgcacaagcttttgtcagcacaggaaggagaggagggtgagat

SEQ ID NO: 4435 - DNA, 381 bp, Zea mays
ggtaagcctgggttgattccgccgatttgtccctgacggtgctaatccaaatctttccttgccacccaattcaaattcaatctttgctgtgagattccgtcccggtcgtctcaagtctatacgcgtcccttatattcgggcccttaatctttgacagaaataacagaaaagaaatccctttcgagaatcgtatcctgcttaataattgttctgttcggcaaaataacctgcttgttaagaagacctgatctgttctttcctctctctccctctctctcttgactcaataactgcagcggagcaagttccgtcaatactgcttgtggtgttgcgccaatttaagttcctgctgtccgcaaaaggagagcttccgcagctcct

SEQ ID NO: 4436 - DNA, 1500 bp, Zea mays
gaaacaaaattctttagcttatacctttggcttaagatcttgcattttgtttttcttcttcctcttttcaatattgagcagttgatcatcccttttggccttcatcgtccttttcatggttgccaatcttgttcaaaacctgggtgtgaacttaacctatctcatatacaatactagagtaaaagttagtccaccgattgtctcagttgtcagaaccacacatggagctttcaccctcttggatcactctctgtcatcttcactatcgagctaccgaccaaaccactatggtcctcattactctgatatacagtggtggccacaccgcaaacatggttcatgtagtctctgaagactacaaacccctctaagtataataatgatgcacacaagcactgagtggtaagaggtatataaacctcactaaacactagacttaaatctagagcaaacacataaacgatggtctacctagcctaatcacttgagaaaacatctacactaatcactatatgtagcgctaaacattatacaagtggagagcactagaatggataaccaattctttttatatgtttcttagctctcacccacttcaaatgactgattggagtactatttatatgcctatccaaaactagttgtttgcaaaagctgcacactactgtactagacatgtccggtaataaacacagaacttctgataacccgtcgattaaaatttaaccactgtattgcttttcagtgagcatcgaaactttacacctgataggagcactagacgtagcacgtggttcaacgagagtcctcttgctatgatggtggattatcttaactgtcgactgtcgttggtcttgctgtagaaataaaaaagggctggaaccatagactgcaaaggatagagacagtgcagcttcactcacgtatagtggcctgaacgcggcttgtgctaacacgaaatgtgacgctgcagactgcagtggagtgtggcctccgtttatccgcggcgtctaatccagcatcaccgtcagggattatcccccctacatttttttttgtgattatcctcttcctctgtccccgcggaaggccaacacggcccgcccaagcccagcactcctgacgcgacgcgacgcagatacgagatatcttccccctcgtgcgcgggacccacctccatcacatgacccgcgggcccggcgccccacgccgaaatcctcaaaaaaaataatatttaatcagatttcgcttggttcccagccccccacgtgttccgcccccgccacgtcaccgtcccccacctactactacatgtagcgcatcaccaccatgctatgcgctgcgctgcctccctccactactacgccagccactctgccttccctcccccaccaccacaagaaccgcttcaccattgccgcgtccagctgagcctcctcttagccgcgtccagccaggagaaggcgggcgcgcacacctgctgcttggtgaccacgttcg

SEQ ID NO: 4437 - DNA, 498 bp, Zea mays
catctgattttgatggtgcgttaagtctaaatgtaatttgtttagtggatttagtagaggttacgagtgtttgatgatttggttgtatgagttctacaaagtttaaactagtggattatatagtggtgtagatagattagttgcaagagtacaggatttgaacacatgaatatttacgtgtacatttgtggatcaacccgtatttctgccgatctctgttgatggcgaattcagtatgatgacatatgggttagaagaaaggattaccctctcccttttcttgccatgtcagctcaggaaccttgccgtgcaccagatgacaaaaacttacacctaaacccaaacccctcacaagtcacaagtcacctatataaacgtcacaagcatcaatctgtcttgctaccacgctagccaaaaatcgattgaaaaaaggtaccccaagaacccaaagtcacaagacactttaggcacttcattcagcttcaagaaagcggagca

SEQ ID NO: 4438 - DNA, 209 bp, Zea mays
ggtactgaaatactgtttttcttatgacaaccattaacaactttatatttactacgaaataacaaatgtaatttttaaattaactactcaaccctgttgtcccgccaattcattctggtccttatggctctaatctacacttactcccagggctgcgtgaatatttttcccaaacagatgatattcatataactccaaggattcctgca

SEQ ID NO: 4439 - DNA, 275 bp, Zea mays
tggcacagtaacataaactaatgatagtatacagcaacatatatctactaagatcaacgatttatgttgcaacattgtactgaaaatagtttttttatgcatgatctgtagaaaaaaatatttgaagctctggttttctttccgcctttctgaatttggagctacttggtacaggtatgctatgactggccagctgacacaaaaaagtgatgtctacagctttggtgtggttcttttggaacttttgactggaaggaaacccagtagatcacaca

SEQ ID NO: 4440 - DNA, 761 bp, Zea mays
tttcgctgctcttgacgtttatttaataaggatgagacttcatgcacaacaatgcacaccatttttttttgaatttgtaggctacctattatgaactaacaaagaaatgtatacttcaagctcaaatgaatgaactgctaagttacatgcagttttagtaaagcctagaaggccagtagaaacaaatagcaactttcaagtgtttagggaactatcacatgataaattgtttctaaactaataagcattatttggagcaatacttctttgattagaaaccctgctcaggtatgggaacgattgttgtgcaagtagaccttaggtgtaagcgtgcatgcgaacctcctgaatctttagatcatggtccaaccgtagatgtaaccgtagtttgtcagtttttttttttaaaaaagctgcgtaagctggtggtgaagaggtttaagtgttaaatgtgacctacagttggattaagatttaaaggatcagaaagctcgcttgcatcgcagtcttgctagcacaacggtcgttcttctgaggtatataggaagcgcttcgtagagaagctgcacaaatggagtaaaacacagtcaaaataagtaggtttgacccatctactttttagcacaaatgggatggtgggactaagcgcagccagaataagttgcagaaaagcgtacagtttggccatgaacagcttataagctgtaccaaacaggccaccggaaaaagctaatgtgataactacctgtttctatttgcag

SEQ ID NO: 4441 - DNA, 376 bp, Zea mays
tggcaccttggcattgatccttcttgaggcagcccggagtgggcgctagatcccccgagaagttgaacagggtattatgtcatcggggatactggtggtgctcatggttggcatgttcctcattgtacgtgacacactcaaccttgatttcatcaaggagatcttgtgatacttcgcgtgaaaaatcaattgattgcagttgtagtaaaattgccagtgtcagaacttggttggcttggaaatgtgtagttgttgtgattcattttgcctttgatgggactgctctagcactccaggtctctggtttcttgctatactgatcgtaggttattgtattgctggttttggaatgaagcttgtgatattatagttaatc

SEQ ID NO: 4442 - DNA, 555 bp, Zea mays
aacttagcatcattcagggcatcggctacactatctttgtaaagtccgtttgcttgtaggttggctttaattagccccagctcctctgtgtgaactaggaggcgtacgtgccatcaaattctgtaaagtttgaagcatgctgcaggcagtatactcgtgaggatgacacaaaaaacacatatttagtgataccaatttaatggtgtaaataccaccgtctctttttgtataagtatattaactctaagtttagttaaataaaaaatagtttaatatatgacgactctgtatgctcatctcatctaggtatacattttgttaggacttctccaaattttgaactctgcattatgaacttttggattctggacacatgttttgtcgagtgcagagaattgacttgactgtcccccggccctcacatgtcagtctgagccagacacgcaaactggtggtaccgccataacgatctgaaaacatcctccattagtccgcctccggccaccccctttcattccgccgcaacgccaccgcccccaacgcaagtttccggcg

SEQ ID NO: 4443 - DNA, 1500 bp, Zea mays
tagattacagagttcagagtgctgcctttaattcgaaactcaggctgcgatgtttcgtacgtgaggttccatcctgtgtgatctgctcggattcgtgcagacgcggggccctcatatgcctgctgcgtcctgcatgacacataagacaagactgaccaatgaaacgttgcttgcataagaataaagacttgataatgcgattaatggtccaacagggctttggccatgcctgaactaacaagaaagatgccacaagaccatcttaaaataccctaatgcatgccaatttacagacatcaaacggcaaatggtaattggtcggaagctttacgtctgtgttgtttcgtgatcagaacgtaccatgccacaaggttagtcatgccatattttttacagttgtttagtttgttgccgtaactacatcgtactgtatttttttttatcactctattctacaggtgatatggttttttttgctaaactaattacaagtacacagttcgaccaatgtttgtcgtggcaaactaccgaagaggtgccggaatttttaaatttctactatttggtaggaaagacaaagcaggccgaatgcaacgccgaggtcgagccagacttacatgggcctggattttcctagggcctgcttgttttgatcgagcccagcgagagcagaggtccatgttgtattcgagagtgaattccacataccctatctcttccagtcttcctacgctcctgtcggcgcgtcctccgcatcccggtgaccggtgtgttctccgatttggggggcgtcccttgcacgctccggtctgctgttcctccgccctccggagtcctatccagaggagcgcgctacggcacagatcgcccgccgtccatccctttcccagctctccagagcctccgccgccgcgtccggtgagcacatttcgaccggtttccaggtagtcacgtaccgcacctgtgcctctctctatcctctcctcgccgtatgcctcttggcgatttctattagtttttcattgtcacttagtttaagtcagctgctggtctgttctcgctgtctttccataattctctggtaggtccatggcttcagctattagctctgaaatattctacatcacttcggtttggtgtccaacagttccaatatgcttgtcgaactgatgaactaagactagtctctgtggtggtttcacgagaggattatgggcattaaatatgttgatgtggcatattattaacgaagagagataaggtaaaaagttttatcgaatgaaatgagttccacgggcgatgaaacttatgtgcactgtttctaacatatcggagtcttgggaacattgacataaaatccccactgaaactggcctaataaataagctaatctgtgttgggtttgcgtcctgtactgctacatgatttcagtgccagactaaatactcagttcgattacttgtatgtgcagataactgcataaggccgagctcatgcaaa

SEQ ID NO: 4444 - DNA, 853 bp, Zea mays
tgtacgacttcttcataatcatggtgaatcgttggaccccatacaagtattggaggtatattactttattgttgcttgaatacccgcagattcttttgagaatcttatagcttgcatgctagtttgcaagatgttgccatgttggtgttcagtgttctggccttcactattctaggatgacatatcagtcatgtgaggactgagtaggtaattgttacctctggaaatgtggcgttgtgttattgttctgttgaaaagtgtgcaattaaaaaaaaacgggccatgtacacaattgttcccgcttcacaataggatatggccaatatctgaacaattttgacctgttttggtgaagtcttgctggcaattaaaataaaacaggtcatgcacacaattgttccctcttcacaataggatttggccaatatctgaacaattttattgacctgttttgctgctgaagtcttgccgataacattccagtatagatgatcactatcctgcagacatgggctgtatagttttctacgaagcaaacttgccatctaggaggtgattatagaataaataaaggtaataagataacctataatctcttagtactctggtattggaaaagaacaaatatgcaaaactgatgtccaacaattattgtattactgttgcacatgatcctatggtatgtgaggaatctcaaaaaagttactgcattgttgattcctaagtacaaggtactcattgcatctttaatgcacaattggtacatcctgtaacagctgctgtgctgcaatgtgcatttttgcctttatgttgtgccatacactagtttctggaaaaaagaatctaaaccata

SEQ ID NO: 4445 - DNA, 809 bp, Zea mays
ggcggcgaacgggacgctcaacatcggaccataaggtataacccatgttcctctatcactcaacctcttagaatttgatctaggctattaattcatcatttaaggctaattgaatagataattggggactcgttaaatcctaaaggatcttagaacctcaacaccaagaccttattaaacgacctattcatgagcttcgagcagctcgtatggcgagcttgtcatatgactacgagggcactatgtcctagtagcatgtgagtcacgtttcattattttagtttttcttttacttcctaaattaatatcgcatctatctaaactttgattctgttattttttattttaaatttatctaaaatcaactagtacgtccatattaatttcataacattcggagtttcagaagccgttcacaaaaataatatcctttcttggtgctatttcacgagaaattgagtaagaaaggataagagataatgacatgtgagttctatcccaaaacgaattaatctatttcaaccaaattctcattatatagatctgctttgtaagataaatagttgtacagttgattttagatgttgctaaactgtgcttcgacccaatttcctgacaagggttgagaactccagtgcacgcgcagaacataaagtgactggtgtcagagaccaacgtgcagccacgtcaagcacagtaacctagataaacccctgctcctcggctatatataaaacctcacctggcctggccaccccatcgcggcagatcatcgagatccgatcgggaaatacattactacagaaagc

SEQ ID NO: 4446 - DNA, 1201 bp, Zea mays
ggagaggattttagcccctccaatctcctccggttttgtgtctcccaaactagccctaaaggtgacaagactccgaagtccttcggatggaaggcagagtcaaaaagaaaatcacctagtaaaggtgacaagactacaaagtccttcagatgaaagatagagtcaaaagaaaaaaaactagtaaaggtgatagggctctgaagtccttcaggtcaaaagtaaagctagatctcaaagatcttcagacgaaggcaggatcgtttattttctgatgcaccttcgtcgtaatgtttatggcatcatacattttacatcatttcgtcatcatacacaatattgttcatattttcttatttgtatgagcgcaagaaaggaagatatttcctttgttttcaaatcgtgcgatacgcaggactagccatctaataatggtgacaaagagctcaacggtctacttatgcaagtcttgcctcgagcagaaaaggcaaagtttcattttttttagctgatatactacagacgaaggacgaagtggctcctcggttttcacagttgtgttaaagcgcttaatctttgtttcacttgtcagaatatagtgaaaggcgattttatgcctttgttatgcttgaaaagaagggaaggatagtacaaacacacaatgttgtttaaaacacacaaatgaatttacaaatgaaagtcaaatgattttcatctgaagaatgcctcaaacaagaacggaaaaaatgaacacgcataaatgtgtgtgcatttcctagcggggagtattagatacgcagtaaatattccattgcccaatgcaccgatagttacaaataaagaatatgttagctgtcattactcgtgagctgagttactgtctgtccattccgaatggaagagaacaaaaattgaaggcaaccctattcatccattccgaatggaagagagaaagaaaaatgaagggatgccctattcgctcgcttcacatttccttttgccaacagctacttacatagttggctatttcctcgcaaaataagacgcatcctaaaatcatccgaatttaaaggaaacaaattgtaaaactttgaaagggtcctcacgagaaaaggaaataagaagggtgggatttttcgggcagctacaaggatcggttgctgtatactacagaaccttgacgccactgggccgtttgccttcc

SEQ ID NO: 4447 - DNA, 93 bp, Zea mays
ggcgcgtctgctctagtgatttgagacggagatccgccagagattgaggagagggagggaggcgccggggccggggagcggcggcggcgaggg

SEQ ID NO: 4448 - DNA, 908 bp, Zea mays
taaaaaataaaacaaggtcagaataaaatatgtatacttttcagtattattttagaaagaccaaattataaatagtgttatagccagttagccacgttacatgaggttagaaaactcatgggcgctgccaacccaatccacgatttcctgtggaggctaggttggaaaccacatttttataaatgatttatatttttctaaaaagatagtatatttttgtcttgagaaaatagaaatttttggaaaatagagtttctaaattaatctttagagaatgattcgtcctcacatattgaaacgcaacaaaaataattaggtcgggtttcgtgggacgagaatgagaaatcatctccgtttcccgcgtactcacccccacaaacttattgtaatatagatttatctattactaaaaatagcactatgaagttgatgtctcttaaaattttaaatctagtttatttagtttatattgttttaatataattaatttaaatttatattaataaaatttaagattatctataacaacttgcttatctgtatctttatattaaaacttaccttacgaatagtgcagtatataatacaaaatagtgtgttgtgtgataatgtaggtgaactgctagagatggtataacgaagacgggttctttgtgggatgaggaatttttctatctaagatttttttttattgtcatcctaaaattgtactagtattatcgtatataccgtgcaaaatactagttgtgccatagacaacattactttagttattatcgtatatactgctacccgagataggataacctgcagtcgcccccaaatttccccgaaccaaatcactcccaccgtgtccacagcaaccagcacacatttccctttggcggatcgaaggaaggaaggaggag

SEQ ID NO: 4449 - DNA, 260 bp, Zea mays
agtcgtctgcgtctccagaacagagaaaccaacggcatggcctccatttcgtcgaatcccgtcccctcttcgtctacaatggcaattatctcctggtagtggtagtctggtagactggtagtagtagtagttggtttgttcakgcctcagggcaggggaccgcctcctcgaacaggccacagcccgcagcgcagggggtagcgaggagtgcgagaggaggcgagtgggtccaaacaccagagggaggggagggcaggcga

SEQ ID NO: 4450 - DNA, 374 bp, Zea mays
ttatttaaaaataatttcaaataatcttgtgacttttatcccatttttatagagcacggacgacggaccggaccgtgaccgtgacagcggacaggcatattccagcatctcggtgacctacaggtgggcccaagcgtaccctcttcagtctctctcccgctcttggcccgctcgcgactggcggagtccaaactccagtccaaaccaaaccaaaccagcgcagccctcaattcctcactctttttttatcccctcctctgccattccctccctctcccctcaacccagcgcccccctcccgccgccactagggtttctcctccccgcccacccccaaaccatccccgaagcttccagtgcgtcgcgccgcaacc

SEQ ID NO: 4451 - DNA, 129 bp, Zea mays
gtacttcttgctgtcctgcaaaacactgtcaaagctagtgccgcaggataagacaagaaaactcaaatgactagaccaccgaccaggtcgatgtaaacccctagagcgtcgggtccctgaactttcaga

SEQ ID NO: 4452 - DNA, 207 bp, Zea mays
cctgtagagcaactaatacacatatttgttaactcaagatttcaaatgcgaaccttttcctttgtgaactaacacatcaaagaatcattgcgcttctatcagacacacgactcgcttatcctgtgttcagcacacttcagactttgcatcgactacacaatatcctggatctttgtgaagatccattccttccatcactctcctcag

SEQ ID NO: 4453 - DNA, 106 bp, Zea mays
tatggggttgtatacccagctgaagatagcaaacaatagcagaagtattgctgtctatctgctttcctagatatgtgtggctgtgatttttggtctgttcgtgcta

SEQ ID NO: 4454 - DNA, 1500 bp, Zea mays
cataaggctcaggatctagaaagtgacggattcctactattacaacgactcaaccgattatgtgtttatgttgattttggatggtttttgccccaacgaattttatagaagctggctgaaaagctaagcgtttggcagtccgcagcagcttttggtggccagaagctgcgaaaagccgaaacaaacatgggcaatgtcccagagctcctgagcaatgggcaccgtggatgaggcaaatggcacaagaatgggatgccagagtcgcggagggaggcagatggtgcgcaccgctaagcaacacgatcgtccctctgatgaacgggtcgtcagagggaggcagagagcgcgggaatggtgttacccaggtagagggcaccgcgaggggcgcaggcgaggctcctgcgatgaatggggcgtcagagttgcggggggaggcagagggtgcgacaacaacatcgttacccagacagagggcgccgtggaggaagcatgggcgagaggctgtagctcgactgttgggcgcgcacatggcgacatggttgggttgggggaggtgacaacgcaagcctaggctggatctggagggacgacaagttcatttagatagaatataagagactttgtttttttgcaaaagcgacgacgatagaaccgttgaaccatgaaaactaatgttttataatagtagagattctctctatattttatatgcttgatgtttttgttgtgttaggtaacatgcaatcttatcattgtttggataaaaaaacactatgaatgaactagttactaagttgtgcaagatcattgctcgaaaaacggggcatatgtataacaactgtcgtagttaggttatagctttgtcatgctagatttaataaaattcaggtggagatgctctcctctcggcgacagttaaaaaatctaagttattcatgattttatttactttgtaccactggtccaccgccaaattgaaaatccaatttattaaattggaagatcatattgctacgagagtcttcaactaaaatatcttctctactagtacaaagtattagtttccaccatttttgttgtaagcttcgagcttacgtttatatcaacctaaccaacaacacatatctttttatactctatattcaaatataaatggaaccttactagcaaaagttctaataataactatacaatgtgctcaagcaacggcaggtaatcacaacaagtgaacacttcaacttttacaactctcataataggaagcgggctattggactccgcgcccacccgttgaacggccgagctgccaacgacggggagtagtacccgccggcgattccacctctctcgccaccacctcccctcgcgtgcgcgaggggaagcccggcgcccgttcgccgccagatcagctcctccgcaccaccctccccttccagatccttctagacctcgccagatcctccgagcgcgggcgcgcggggcggagatctcgccggagaa

SEQ ID NO: 4455 - DNA, 1500 bp, Zea mays
gagataaacaaccactaccgttcatcgcgtgctccatggatgtagacaagtcgtcaatgcgggaaaacaagggagctgcaattggatctgattcaacgtcgacacaggacacatcctcccatttcagaacggagttctccttcacctcgcatttgcattccatcctccaggtctaggttgaggctgatcattgcggtgtggttgaggctgtagattcaaagcagccgtctgtctcgactgggtttcaaagttctagccatcgactctgccgccgcctcctacacttgtgatgcctctcgcgccgccactctccattccttcctcggcacctgaatgaaaaataccgcgggaaaggactagtgaagcgcgcgcaaggatggattggggraagaccttgctcactgatatttgtgggagggcggaccacggatgcgggacgcaggtaatttaggggaaggaagggaggtctgttggactgagaaatttcgttattccacccctaaacgcatttatggattggttttagtattcttttggagatgctctaagtgtagtatatttgggtcattttgtggtgtgccgtatatttttgataaaaaatataaaataagatgtactattagagatactatatggatattaaataccaaaaaaatcttatcaacaaattaaaaaaacacacggggaaatcttttctagccaataccgataccgagagaatcccttcaaacacgcctctcgcatgtactccacgaaagctcaaatcaaatacgcacacaaaacaaacccaggagccaggtgggtcacgaggcccacatgtcggtcccagtggggatgccccgcgatacgtttccccgatggcgcgtagctatttttgcaaaccgaagccggatttgggcgaattgatagcgcgtctccgctgtccctttctccccgtcgtctacgtcccttccggccgcgtccttcccctcccaagatcaacccccccgcgcgcttgtctccttcccccggccatctccggcaccggatttttcgtcgccgccttgtcctggccccttccgcgaagacccattcccacacaccctttatgccaacttgccgcccccgcggattcgcgcgcaccgcggtcggtgtctaggcttgattggccctggcccaggagcacggcgaaaggcggcgtcttggtgtgaagcggccgcgctggattggttgccgccggtggtgctgatcgttgggcgtgtttgagagcgcgccgaaggctctgccttgtggggagcggtcgacaggcagggtcaaaggaggcggtctttcctcttgtcccgatcgcattgttgatctgacacggtttcttgggaaattcaggttagggataggcggggggagtggggtcgtcgtgaaggaggcagcagcggttcgcgtggatcgaggaagggattttattgcgttgggatttggtaggtggtggcgctgctcttgccgttcttggcatgagcgttggag

SEQ ID NO: 4456 - DNA, 547 bp, Zea mays
gttatgtaaattttatctctctaaatcataaatttaagaagttgctaaataactttagaaataaaaaaatgtgagtttccaataattctctaaatatatattgtagttttattttgtatttatccacataaaaaagttacaaatatcatcaattaactttattatctatataatggagtcaatatgtttatttaaggagttgctaaatgattgtcaaatatagaaagaaaataaggttatatgataaatttgttaaatttagaaagtttatttagagaacaattggagatgagtttttatgttaattaattatctaaattattaatctagcaagttttttaaagaaccgctgaacttgctctaaacaccagatctatacccacccaaccttcaccccaccccgcccaacaaaaaagcatatacgttaaataaaataaattagaaagctatctatccaggtggattagggtttttgcctcggctagcagtagtagctaatttggacgcaggagatacggagtagggcgaaccgcgaggagagcaagct

SEQ ID NO: 4457 - DNA, 1031 bp, Zea mays
ctataaagaaataaccaaaacaaaaatatacatctcgatgagttatacaactttatagttgaaaacttttacagctcaattattttttcttcaaaatttgatttgcatagtgtaaaaaaaacattcagcgaatgatttctctagctgtttgccgagtgttaaaaaacactcgccaaaatgtttctttgctgagtgttttttagtcgagcgttttttgtttgacaattagtaaagagttttttttttgttttgttgactgtggaaagaaaaacaataagcaaattatttaacgctcggcaaagggccagaattgtgaactatatatactgctccgtctcgaactaggccatcggagcttctgcgagacactgagaatccacgaatccagcagcctccatgcatgacctccaagctcaacgcagacgtgaagttcagggcagcactccacgatgtcccgttggggaagacctaataggaccgccagtagaaaacgtcactgtactagtacagtctccagccgatatacatgcagctgagccgctgtcatatcttgttctcttcctgttgttcgccaccgtctcacgagatcgagtccacctctctgcccagagttgcatcaacgaaaagaaaaaggaaaaaaaaccggcggttccaaaaaagactcggccacacacaggcacacgctcgctacgaggccacaataattcgcagaagcgaccaagctgcacttgcgctcgcggacaaggccacccatctaaaggattcagagagatctttgcgaggcttgtggtcgagatgccttcgccgttcgccacaaatactccccggagagcgagtacttactggctcgccatatggcaccaacagcaaaacagcgaaacagtgcagagacaagctacaacaacctaccctaacaggccattccttccactgcacttcattcgatcctgagctatagctggctgcctgagctcgctccaagaagtgtatctatagtatagacactaggcttcgtgtggcgtgctcgagat

SEQ ID NO: 4458 - DNA, 1431 bp, Zea mays
gataaccgtaaagattgatgtgtaccctcctttgcatcacatgtggtgtactcgacaccttgctgagaatcttctgtgcaaggatggtgtaatggataactacgatgaactacgatggtgtgaaggataactgctagatgctgagttctgaagacctgctcttccgatcgctgatgcatgtcggcgaccggaataaagagaactacgatggcggcgcaactgtgtgcagaggcaaaaacctaacttgtgtttgatgggtttggagttggctgtaaggcgctttatataggaccgtgaccgtgaaccgataagctcccgcgattcgatctgcatgttatccacgaatcgatagactcgcgctccgataacggcttagatccttatcacgatcaaatagggctctagacttaacacccaatcaaccaaaaaataaaacgacaaaaggaatttatgccctcgcaaggcgaggggccagattttggtggatcattcagacgaggcgagcaagcgagcgcgtgtggttctccacactctctctcatcattcatgacttggtgagcgagtgtagccttcatatttaaattatttttactctatttggactagcaatataagactatttgtttcaccattccctagacatgcatacccatacatgggtttttgagatttttttagaatttaattaaatttctcaattgagtctagcccataaatccaacacgatataagtctatctgtcgctggtagattgagagaggatgtgtgcatgtctgtaaataaaaaaagttgtttttacacataaattgcgctatgactttacatgaaataaattttctaaaatttaaaacttacataagtaaaaaaaaatataaagaaggaaagaaacacgacatggaaaaaatctctcgttgttttatatggatgcaacagctgcagtccccgtgcaagcgatgctcatccgttcccatggcgtgcacggcccagaaacgacacgcttcacctactttcttccctgccaccacacccaccgtccacccacaccacaccgcgcgccacgcgcccacggcacctcggctcagtgtcgtcgcatgtcgctcacgtactgtcgcagaactcacaccgtcacacggtgcctgctatctagctaatgctgctagcagccatgtcacaccgatataacccggccaccgcgcgccgcgccacgtcgccatgcacgcggccacgtcccccatcgatcgacgtcgtcctcctcatcctggctcctccggatccatccccgcgctcctataaatacctcgtctcatgctcggccatgtacatcgacccagccatctcctcaccctcgttcaccacacagtccgccactcctttagtagcttgtgatttgtacgtcgacgagatcactggtcgggtggcggacgacgacac

SEQ ID NO: 4459 - DNA, 477 bp, Zea mays
tgttattgcataaacttgtgaggttgtatctgtgtgagtgcttaccctactgctgtgtggtgtagcttttgaatctgaaagaactgatatcttggcagtagcatggagcaaatgtttcttgtgtttttttttttggtctcttgaccttagctggtacttcatgtttttcagctgttattactgagtaccaggatgattttcaacacttcattcagttcctaagttatatgcaaccaacattgcaggtctgcaaaagaagcagctccaaagaaactcgactcgacggtccccaaggagaagccaaaggaagatagtcactgattggagctgtttatatgaacggtataacccctatttgaagtattgcaagttccgttttctacagttgctgcgatacaaacttgtagctctcaagtaaggtgcacggcaagattatgtttccgtttgaacatcggcctctgtggaacagttagctga

SEQ ID NO: 4460 - DNA, 484 bp, Zea mays
tttttttccataattgagtcacgatatctgtatcaccaccatcctaaaaaacgttcatatagtcaccagctaactaataaaaacgtactattttgctacaaacaaggaagaaaaaaacgatagaaacaaacaaatcgcgcgataagctatgatttatctcttggtttgtgctcgtcatctcttcctattctctcgccccgctccacgcccccatcgaaacacagccaaaaagccaccccgtccaaaacacacacacatagctcccaatcccaacccccggccaccctccatctcctgctcctcgcatcgccggtgacctcgccgcctcgctctgtctcaaaaccctagccccggttctctccgccgcctcgccccgttcgctcggatcgcgccgcgggagccgctgcctctcctctctctccgccctccaccggaaaccctagctcactcccccgctcgctccttcggatcccgcgaggctccg

SEQ ID NO: 4461 - DNA, 1241 bp, Zea mays
agcttgcagttggtcgattatttagaaccgtgctctcatgtcaccctcagaacgatgtgtcccagtgggaaaaagaactctattctcgtaccggttggtgatgaactctgtaatattcaccgtgcaagtgcaacttaaaacatctgtgatacgagctctttttttttattgtgtgcggttgtgcttcccttatttagaactcacaaatcagatctcacgagtacgatcatgcacgcacgcacggtatggccctttaattaggagtctgtttggatcccaagagctgaagagaagtgactaaactttaatcactttagaaactaactaaagacctgaacaatatatttttactattttagttacttttagttatttctgtttggatttttaggtaactatactttagtcatttggttctacctcataggatcaaacatgtcctaccagaggggtagggatcgtacgctgcaaactccgctggtgaattgttagcttgtggtcgctgtaattggattcatgcaataggtcgcaatgtaaactcggtagggggtaggttggcagtttggtcagcggctgcgtgtcggcttgcctcgtgctccctarcgttgcggctgtcaggtctgtctttgaacttatataataatccgtttgtaaattgtttgatcacttagataaggaaggttgttttgttacaatggaggaatgaaacagggtagaatggtcccttagattagaatattacaatggcggaacttttctcatgactcttttttttttgcactcaaattcgagtgactagtatttgtgtgtttgcatacatgtgctgaactataaaagaatattgctccgtatcgataggaataaaattattggttaaagaaaagttcttcgattagatagtaaaaagttgtcatattatgaattcttcactggttatataatgtactcgcaaagtgtagagattgttggagaacgccagaatgcaaaggcacaataagtttgaagatttatatagtggcccaacacggctaaaggtcgtaaccaacaaccactcggcccacaggcctaattcggccggttttccatctagggttaggtcaaggcctccccgagcctctctatatgaacggagacaaggcagccgccgccgtccccattaacatcaccgagacctatcgccgcagaaccaccgaatccacggcatcggagagtgtagaggttagtactaggcggaggtcaag

SEQ ID NO: 4462 - DNA, 1500 bp, Zea mays
tttttattgtgtgcggttgtgcttcccttatttagaactcacaaatcagatctcacgagtacgatcatgcacgcacgcacggtatggccctttaattaggagtctgtttggatcccaagagctgaagagaagtgactaaactttaatcactttagaaactaactaaagacctgaacaatatatttttactattttagttacttttagttatttctgtttggatttttaggtaactatactttagtcatttggttctacctcataggatcaaacatgtcctaccagaggggtagggatcgtacgctgcaaactccgctggtgaattgttagcttgtggtcgctgtaattggattcatgcaataggtcgcaatgtaaactcggtagggggtaggttggcagtttggtcagcggctgcgtgtcggcttgcctcgtgctccctarcgttgcggctgtcaggtctgtctttgaacttatataataatccgtttgtaaattgtttgatcacttagataaggaaggttgttttgttacaatggaggaatgaaacagggtagaatggtcccttagattagaatattacaatggcggaacttttctcatgactcttttttttttgcactcaaattcgagtgactagtatttgtgtgtttgcatacatgtgctgaactataaaagaatattgctccgtatcgataggaataaaattattggttaaagaaaagttcttcgattagatagtaaaaagttgtcatattatgaattcttcactggttatataatgtactcgcaaagtgtagagattgttggagaacgccagaatgcaaaggcacaataagtttgaagatttatatagtggcccaacacggctaaaggtcgtaaccaacaaccactcggcccacaggcctaattcggccggttttccatctagggttaggtcaaggcctccccgagcctctctatatgaacggagacaaggcagccgccgccgtccccattaacatcaccgagacctatcgccgcagaaccaccgaatccacggcatcggagagtgtagaggttagtactaggcggaggtcaagatggtgtgcatccggcaggcgactatcgacgacctgctggcgatgcaggcgtgcaacttgatgtgcctgccggagaactaccagatgaagtactacctctaccacatgctgtcttggccgcagctcctcttcgtcgccgaggactacggcggccgcatcgtcggctacgtgctcgccaagatggaggaggacccctccgagccctgccacggccacatcacctccctcgcggtgctccgctcccaccgcaagctcgggctcgccaccaagctcatgtccgccgcgcaggcagccatggaccaggtcttcggcgccgagtacgtctccctccacgtccgccgatccaaccgcgccgccttcaacctctacacctccactctcgggtaccagatccacgacatcgaggccaagtactacgccg

SEQ ID NO: 4463 - DNA, 226 bp, Zea mays
tgtttgtgtactatatgcagcacggatacgactacgtgtatcagtatcaggcggatacagatacgtgaataagtgttttttttttctctaaaaaatccgatacgtggtaacagttttacattcttgctgaagaatgtaaaagctcttttagtaatttaaagccatgcaacttcttgtagtttttttttttggtttttgttctatatgctgacatgccaccttattc

SEQ ID NO: 4464 - DNA, 960 bp, Zea mays
ggtatgcgatacgcgcctctacctgacatacctggcagtatggtatggggatgcattgcactatatgcttacgtcaataaacgtattggaaacacagatggctagctaggggcagatcgatactgaagcatgcacacgtatattcagttctacagtatgtaatacaaacatgtctatccctgtgaatgtctgacatagattaggcactacaatggtggttagtacttcagtcgccgcggatgcctagacacgaatatggtggttgtaacttgtaactaacgccgtcacgataggtcctgctgtggagtaacagttaggtacgttcagaatgtgactctgataggtcgcaggtgtagtacgatatgttgtggttgcaaaggtatatgcgtcttcgcactatgcaggcctagtgcagtacgctctgatagatcgagcacgaccctgcttttgtttgggcggcctgctccgatctattgattggtatgccaattgccaaccaatatatatacaactgttagagcttccctcagcccatgcggtggggctcggtggtgaggtctggtcgaacacccgaataataaaaaactatggttatgcttactgcgaactggggtgtaagaacagagtaagcatcctgttgtcatcatcattagccgaaagcaggtaccttagagcaatgtggttactgcgtttgaataatatgccacgcaatgacgcagtactgttcatcatttagggtcgcatgtgcctgtcgttgtcacattgctttgcacccgcaccctccatgatcgataaatgagggaacagcagtacaactcacacctatcggttacgaacttgaacaattgccaaagttgcagtcaccaaacttgttgagcgtgcaattcaagcatgtcctacagtcgtgcatgccatgcatggtaatattgtgacaatttgatatattcatctccacctgtc

SEQ ID NO: 4465 - DNA, 699 bp, Zea mays
catttgtttgcagcatgtttgttttataatgtgatgagtgggacagtgttgcatgtggttacttgttcttctttaatggtgaaatgacacgcaggtcttgcatgtttaggttgaaaaaacattgtatgccaaaagatctgatatcatgagtatgatatgaattttgttgccacactgttcacatgaaggagatgttggtttggaaggtcaagtagtacacaggtcggataccttgcagtatttaagatcaatgatacagagcgatgaggatatcgacgaagatgttagccatgaaaccaaaggagggtggaggaagtggcaccaagcatctggagttctgtggcaaaaggatatcacagaagctaaaagacaagtcttataggacgacgattagacctgctatgttgtatggtgcaaaatgttggcctacaaaaaaaaactcatattaagcagataaggtgcagcggaaatgtgtatgttgtgttggatttatagccatacaggaagtgatcaagttcggaatggcctaagcttagtggttctcaggaagctgtgcaagaagcgtggaattctatcccagcaaataattgttccttctctactcttgacttaaaattaaaggctgcagcaaggaagcttcaaggttggagtcaaaagaaggttggtcatgttgtttctcagctagccctggccagagaa

SEQ ID NO: 4466 - DNA, 106 bp, Zea mays
gactctagatgatcctttgaagtttgtttgaggataggcgacagctttgcgagtccttcgtgttgaaggagaaattgtatctgaagtgaaaaaacagcagggaacg

SEQ ID NO: 4467 - DNA, 1500 bp, Zea mays
ccgccgcgatacggtgagcgctctttctgcttgttgcttcaccgggacctgttcgttctctgtatgctagcttgcttggattcggacaatcggtaccgtccctggaaggggtagcttggatttggatgaggactctgttgcttcgtcgatcggggattgagtgttcgatttcgagtccgcttgcttggtctggtccgccggtgttccagggagttcggcgtgtatgtgtgtgttggtcttggactgacaagtctgaactgtatatttttttcctcctctttgcggatacttcacgtttttattctgtgttgcgtagagcgtacgtgagtggtcttggtttgtttgattttgcccttgagcaggcggactcagttgctcaagtcttgattgcccccatctaatcaccggagcacagtggctttgcttgtatctgcagccagttcgtctggaaaggtttttttatctgtttttttaaggttgcttttgaatagtgatcgtatattcgcgctttgcttgcacgtggtattcttttctgttcttagccgcaactattcatcggtgtcgaacagagatcctttttcagcgtgaacttggctgtttttgagcgaagtatgtcgtgcatattttgagtggcgcaagtccgttggcttccacgcatagctggcatatgtgtgcaagcgactagtcagaggaaaaaaagtgagtgttagtgccttagtggtgcttaacgacctgtatctgttctaacggaagtttggcaagtgacaacttatgctatgctagtacaagctattaccggccatgtgcatggaaagtgtcggttagatatgccaaaatatgaacatgacacttaaaatgataaccagggagccatttgcactagaggtcgctaaagtttggctgcacttcatcctatttgtctctcacgcctatgtgctgatatgctgtgctaagctggcatgataggactctttggcttcttcaaagcattgatgccaattgcaataagcgtttctggctccaagttgactattcactctatcttttggtggtaccagatcagatgaattgttgtcgctctattcgaaggtcttttgaacttactggctatgctttacagcgattatatgctttggcaaaagtatagtatcatattacagtttgttctgtttcttaggaaaaatatttgcagttcgttctggttagaagtctgccttagattacacatctgtacttctattttgaaacttattgagttattgttatctataatgccctggtcggcagatctaggaaggatatctgaatctcaagttttctgtgagggagtggttctgtgttatcctaagattgttgctgtattgttactgactgtttcacttctatatgccagtatcgcataggattccactggattcagctgctgagcagggtactggaaggtggatttgatactagctctgaacagccagtagaatttctcaaatactgtccaggatc

SEQ ID NO: 4468 - DNA, 281 bp, Zea mays
atcgactggtttttattagttgaacagttgtgtggcgtcgtcgatcgaaccgtttggctggtggggcgcgagcgcgaggtgacgacggcgacgcttcagttgagtgcgggtgtagtgctcctgcgacttcggcctgtccactttttagggggtgccraggggcgtgggggtacgsccgtccgcacaataatctgcgctgcgcggaagaagggaaggggaaaagcagttaagcttgagcgcgcgcgacagggtcaagtcgagggccggggaatcgccggaga

SEQ ID NO: 4469 - DNA, 424 bp, Zea mays
taattagaacgtaattcatatcattaatacaaaatattatcacttatacacattgtcagatgtaagaaattattatgtatacatcaaaataaatatatttatataatgagtaatctttttaacaagataattatttatttttattattaactattatataaaaacatcagggtaaattttaacgggtctacatagagaacacggtaaatgcttccccatcccgtcatcgtttacccgttagggaagaagggaaaggccacgccagaaggaagccctctcagcctgcttcagccgaaagaagagagagaactcctcaagctgctcccccaaattccggtcctcctaaacccccgcccccacctcctcctcaccggcgcgaccccaattccgggacctccccgatccccatgaacccgatctaaac

SEQ ID NO: 4470 - DNA, 875 bp, Zea mays
ggacccacaaatcatagacacaaatagacccacaaaccagagacgtagatggcaaaatagcaaagtgtcaacacttggggtggcgaaattgcaaatatttctacacaaaccatgttcgtgctggcaccacatgccttttttgtggcctaagtatggcatgagcctcgtaccgaactagcacgagcctacgtgcctatttgtttcaacttttttttctgattctgaccatcaaaagctgctgtggactracaaacacctaatttttcagcatgcttatatgagaatcacttcggtaaaaattgtccaaaatcaacgatcaagccgtcatgatagtaggatcctgtcactttttagaccataaactttatgaatgtctttatcttacttcgcacgtaattctcataataattaaaatttcctcatatagttagattatcaaaatggttcgtcagaaaaagccgaaacaaacgtgacatacggctttcggcccatgccaggtttgggtcgggctttggtgggtcggtcacgggcagccagatgggtaacatgtatatccgcaaggcacccccgagcggctcatctcatcggcgactaccaaagagcaatggtgggacggaagccgatgcgccggcgccgaagtgaccggcaaccgccgccgcaatccttcggcgccacggctcgcccgagttccccacgctcgttcgactccacaaccgccgccgctgccgcagttgccaccgacctggacgagctgctgctgactgcgccgccgccgtccgcgtcggagccccggagcttctcctatgcggtgaaacagcagtgctgggagaaggcggagcgggtgcccggacgtgacccggagaggtggcgccgcg

SEQ ID NO: 4471 - DNA, 312 bp, Zea mays
caaaagacttcggcccaaataatataatgggccctatgcccgacttcctacaagaacaatgtggacatggaccccactcctccaccagcccaccaacgacgttgattccctcgaggccaagccaggcacaaaaaaaccaaaccaaaccaaaccgaaagctgtcgccaccgctcgccggagaaggagcaaacgttccccaacccaccggagctccctccaaaacccaccacaaggcttgcccaaggcttcccctcgcccatgccacgctcgcgcctccccccgactccacacccgcgggcatgatccgcggcg

SEQ ID NO: 4472 - DNA, 705 bp, Zea mays
tttttaagtatctcgattcaaagcaccatctcgccccattttagggcatgacaatttcgtatgtcttttctgtttctctttttgctttgactattatgaattttctatacatttcaaacatactgatgcaattttcatagcaaaatatatagttcctccgtgatcatttatctgtttattataggaaagacggaaagagcagcattccaagaaataaaagtaaataaataaatcattttatttgcttagaaatccccttttcattgtcaggctctgaaatccatccgttaattaatttgctccatagtattaacaatagacagagagattgggaggagatcctcttggtccaaaaagagaaaaggagatcctatttcggttatctccagcagtctctcttattctattttatattttaaaatttactcagtaatccgtgtctagagtttagaatgtaacatagtatttttgaacagtaatatacagggagcacagtcttaggcggcacagctatctcaatttctcagacccaatatggaagtccaggtcctcacctactcctccggctatatatgaaccgtgcacctcctccatttcttttcagctctactcgaagagcgttctaccaccacaccacaatctaactaaaacccaaacgaaataaaaggaagaggtcaaaaaataaaaggtgttgtgcaatcgatc

SEQ ID NO: 4473 - DNA, 153 bp, Zea mays
caaataacatggagattggtagtcgattatttctgctacatatcttgcgagccattttcttaattatttcctcatatcctgtttgtgtgcagggggatmmaaatataattaaatttgagggtgatcataattctccaagacctcaatcatatt

SEQ ID NO: 4474 - DNA, 1500 bp, Zea mays
taaaacttcttatttattcctaatttatttcctgaaataaattacagcaaaactcgggacgcaatttcatgaagaaagaaacgtagtaatcatgtttcacatataaatttgctcttctattttaataccggcatgaagtcatctttaaagtaactttagctttctagaaaagcagaaacgaactgcagtttcctaaagatatatacgtacatagtgctgaaaccgaaagctttttccccatttgaccactaggtcctaagacaccagtgtgaacttcataagagaatttgcttaataaaggctagtttagaaacatctttttgccaaaagattcctattcttctaaagaaaaaatgaactaatttttcttagtaaaatagaaattatatggaaaaatagggtttacaaactagctctaaaaggttttcacgggaaagaataatatccacaatttgttagaatattactataacagtagtttttagcaaaatggttctagcaaagttagagtggtgcatctgtaaaataagacagtgccatgaaacagacaatatatatatatattttttgcaattcattatgaagaatgcctaaacgctaatgcctacccacatttcacagcaaatttgcccttctatttgtatgtcaaaacaaagcaatctgtaaacaactctacctgagcacgactcatgataatttcataatagtatccactcagttgaaaccaagactccaagagcctttcccacttactaatattaatgataatatatatgtatataataataatactacattttgttttacgaattctataaaatccataatatatatactaatattaacgatgcatagtaagtatagttaaattaattatgacatatatttcatataataatcgtatttcaagatgtaatactattttctataaattttatacttaaaaagtttgacctacttaaaagccaaagcaagacatgcagttatttcggtggagaggggggatagagcatccgaggagaccactgtgaaaaaaaaaattgttttgaaagaaaaaaaaagagggccaaaccggaggtcatctcggtcatttcctactgagagcctaaaagccagcgcaggcccggacaaaaggaaacaaaaactaggcggggctggcggacgctgttaggcagaggcaccccgtcccacgccacgtcaccgatccgcgtgctcccccgtcctgcgccgcccgattctgccggcctgagaaatcctggccgttcgtccgcccgcccgcgtcccacatctgatcccgtctctcctcactctcctcccacagatgacagacccacacacacacactctctctcttcgcagacacaaccaaaagaccaagggggaaaaatagtaaagaaacggagcgaggctcctccgcatttcttatctatcctgatccaaaccctccgagggggaaacaattcattccgcacggcatccgggaaggtctgcgtcgtcgcc

SEQ ID NO: 4475 - DNA, 1024 bp, Zea mays
atgcgcggtgagaaacgtgagcggcgcgccacatcggacaatggcagacatcaaatcaaggcacatacaacacatgctagacctttagttctaagggctagtgtgaaactccatttttttaatggatttccattttccaagtgaaaataaactaatttttcttggaaattgaaaatcctcggaagaatgaggtttctaaactagccctaagaattagatataaaagcagatacttattaagatattaattttttagtttttttattgcaaatctacttgttatttgtttctgctgcaggtccatctattgtgatcttgtcatgttcttgtatcttcgcaatggacaaaagggggttggacagtagtacctaggattatgtgcgcttgtctttaattcaaaactgtttttataatattgtccctatcaattacaactgtagcatttcgaacagctgtctttaatctgaaacgaaaaacttagattcagaaggcctagatacaggaggatacaacgtcgaaaactagccatgtcattaaaattttgggtcggagtaaagttttcaaaactcaaaataccattgtatatataataccatagttttgaaaacatacttttttaaaaatacaatcaaacactttataacatttatgatgatattactaaaagtcttggtactacaaaaatattttatttccacaggctctcagtagttaactcagcaatggcgccgatctaacgggaagagaggcacgtcccacgccgcggaatcttctcgcctcgcctcgtctcctctgttctccagttctctcatagtcactcccccaactctgctgcttcccgtggccgtggttcaaaattcgaatccagaaagacttccccaagcattttccgtttctttaaaccgtcatcgtcctccctcgtgctagcctcgctcgttgcgcgttcaaatttcgaaccacctccgccttcgacgccccaaaccctagcccgacccctcctcctccacctgcgccaccgcccacc

SEQ ID NO: 4476 - DNA, 243 bp, Zea mays
ggtaatgttcccctgcgagtttacaccaggacaaggcatcggcacaagtctcaggaagaagtggatgttgctactcctgggttttcctatcttgaatgaacagattactacgaaaattcaggacgcctataggaagccatatttggatggactgttggataaggcgaggagatgcgctgtgcagacctgctggaatgcatttgatgtgtcctatgcttttggtcgttattttgcactgatccc

SEQ ID NO: 4477 - DNA, 1500 bp, Zea mays
ttgaaatctttgatcaatctcttttggaatgactctctttatgcttcaacatgtgtgtttgacttagagatagagatttgagtttgatttgcaaaaacaaaccaagtggtggcaaaggatgatccatatatgccaaaaatgaatcaaaataaatttgagttttatttgaagtgattttgcacttgttctagttgctttatgttgtgttggcataaatcaccaaaaagggggagattgaaagggaaatgtgcccttgggccatttctaagtattttggtgattgagtgccaacacaagtgcttaaatgtgaattcatgcttatggatggacaaagtgcaaaacaagagcaaaggtatgtttctaagtcttagtacattggttttgtgtactaatatacttgtctaagtattagaaacagaaagaagaagaaaagagaagagttggctgtgtacagccaaaaggctgtttcggtctggggcaccggactgtccggtggtgcaccggacagtgtccggtgcgccaggctgactcggcgcgaagtggccgctctcgggaattcgcccgacggcgtacggctaaaattcaccggactgtccggtgtgcaccggactgtccggtgagccaacggtcagccgggccaacggtcggccgcggaatctgcgcgcgacacgtggccgggccaacggtcggaagggggcaccggactgtccggtgtgcaccggacatgtccggtgcgccaacggctcccgcatctgcaacggtcggcttcgccatttaaggaaggaaatcgggcaccggacagtgtccggtgtgcaccggactgtccggtgcacccgacgacagaaggcaagattggccttccagatttgctctcaacggctcctagctgccttgggactataaaagggacccctaggcgcatggaggagtacaccaagcaaccttagagcattcttgatcatccacactcagtctttgcgcattcgtttgtcattctcagtgattcgagctccgttctagtgagaactttgagatagtcttttgagctcgattcttggccgtgtgtgtgcgcattttgctgtggatttgtgtgtgttgcttcccttccttactccgtgattctttgtgaacatcaaaagtgtaagggcgagaggctccaagttgtggagattcctcgcgaacgggataagaaaagaaaagcataacactgtggtattcaagttgatcattggatcacttgagaggagttgagtgcaactctcgtccgttgggacgccacaacgtggagtaggcaagttttgtacttggccgaaccacgggataaatcaatgtgtcttctctgcgttgaattctttgtgattatcgtattatgctaacacttaacaagtttttgtggctataagtttaagtttcacaggatcacctattcaccccccctctaggtgctctcaattggtatcaaagctgttctcttcaagaagggactaatcgcccgaagag

SEQ ID NO: 4478 - DNA, 412 bp, Zea mays
taacagttagccaaaagatcctttttgaggctgttagatttgtttacttgaatttgcaataattcttatttctgttatactacagtgcagtatattgcaccaaaagtccaaaccaactatgaattgcctcttattatgtccttcgttgaccatgctgttgcatttatttgcttagttttagcagtcagcataagcacatgtataactgccgtgtagcttatcagttatcaccaatattttacctatggttacaattacagcacgggaaaaacacatgatgattaaacagaagttttgtcccttttatgtgctgggtaggcttatctgtctgatgcatcgcttgttacaattgacaggaacttgctgactggcatttcgggacggttttgcagttaatcccaaagaattcctg

SEQ ID NO: 4479 - DNA, 437 bp, Zea mays
tggacttatagttgtatggtgatatgtatatgaatctgattatgtaatgtgaagctagacttgtattagattttgaattgtgacttacgtatgaatctggattatgtattgtaaatctagacttgtttcaggctattagacggctcggccttatctgacctatcgtactcacgggctcacggcacgaaaaagacttgattataccgaacctaagtcgaagagacgacacgacgtggcagaggcgcagaggcagagcacatcggctaagccccgccgcccgcagccaatcacactcctactaccaccagatcccggattgcagaggatcccatttcccattccatcctagggctcgcgagtcgcgtcccccaaagtgaatacagaaacctccagccccaggccaattcctcgaccgcatcgccacccaccccatctcc

SEQ ID NO: 4480 - DNA, 352 bp, Zea mays
gccaaggtttgtgtcgctactcgctagactagaattccgcgcggacctttgccggcggagccgttctacggcatctcggcggggacaaccatgcgaatttccttggcgtcgacgttgacgccacctgcgccaccaccggtgaaggcctgcaggccgctgacctccgagacaggggaggcgcccgagctccacaacggtcacgggcctcgacgactggactaaggccgagcgctcgtcgaagttggactgccgctgcgtcggcccccgcgatgagtgcatcgagtacagctcggcggcgccgaagctcgaggcgcgcgcgccactcgccggcgtgggcggcgcgccgtcgacc

SEQ ID NO: 4481 - DNA, 231 bp, Zea mays
ccttcggttcctggcagcggacacgctgtagaagctagtcgtcctcgcggggctggccgcgtgctcgcgcctgccctccagtgcatcatctggtacacactgctgttgttcctcttcaagttccgcgccgcacggacgctcatcgcggaccagttcctagacaccatggcggccatcgcgtcgctgcacgtggacccgaacgagttgccgctgtagggcgggcgcgccgag

SEQ ID NO: 4482 - DNA, 1303 bp, Zea mays
atactaggttcacgagttggcaacgcgcaaatccagatttacaagctcgccaaaatcacgagcgaagcggagctagcttgcgcgagctcatgagccgctcacgagctgacccaaacacccaacacaataggctgcttcgatcggtccaaacccaatagaaagctctatggaccaaaacccaaaatacacacaaaacctaagacgctaatccatctccatccaacaactagggttggaaacgagacgagctaaaccaggctcgactcggttcttcaacgagctataaataatggtccagctcgtctcatccgctcgcaagccgtctcgagcggactaccctaaaagaaatatgggacgaaaatggcttcgattttcctcaaatttttggttgttgtgatactcgaataaatgttctacatttaagcgcatacaaatcatactcccccgttctaaaataatagttattttagctctagatttttatgtctatattcatatagatgattataaacctaaatatatatagaacatatacattaattattgtatgatctaataaaaagatattttttaaaatttgggacgaaaagagtattgttttttgaatgtgccctaagactattttcagtgtaagtttcattgcacggtttctaaaattgatacatcaacttttatgaaactatgtatcctaaattttatcatggatgaaatcctctctctttctatgaaactctctccatctctcttattataaatacagtgacattcattaaatatgttgatgtgttacattagaatgaaactgtgatgaaattccatcgggaatggcctaattaccttccccaaaatcaatttggcagcccaactacagttgcatgcgtgacatggtcccacgttacatcctcccgtgacacaggctgatgacaggcacagccaggccggtctgaaactctgaatctgccaccgacaagtgggttcgtccaccgcaccttctcccttcttcgtctccgtctctcccagccccatatcaacgggggacggctctctcgccattctccatccgaaaaacccatagaaacttccctcgtttctctctcctcggccccgcgggagcgaaccattatcagtcgctctcgttggtccggagcagcgatgcgcaccgcctgcctccgccccaccattcgaataaaaccctcccctccgcctccctccttccgccactcctaggcccattcccacccgcgccagcctcggccgccgcggccgcaccacccacggtcccacctctctgtggcatgagaag

SEQ ID NO: 4483 - DNA, 745 bp, Zea mays
tgattcctaaaagctagatacttttccggagtgtgatgatgttatacagactgtgagcgaagaagggatgtcttatactcgggagtgagtctgttagaactagtttggtaagtatattttcttaagagatttttattttactaagagaaaataaactaattttttttaaaaaatattatttttttagaaaaaacggggtttccaagctaacctataaaatttggaagttgtaatgttccaacgacgtcaaacaatttgtttggcggtgtaataaattaggcacatgggtgaattaaactacattaggtagcagtatgaattaacggcgccggcatggtgacgtccacgagtcacgccctgcgagatcggaggcaccgaccaaccccaggtgtcccggtgtccccacgccctccgcctcctgatcctgatcctaagggctatgtcccttaaggagaatctgtcgcactctttagattggtcacatatactatatacaatattttgtaacatcccggtcgcccccacgcggcctctggcctctgccgcacgcgtgtccccgccgcaacacgtgtgcccaccactgagaagtgataattgagagcacacgctagggagggctgcctctacccccgtctcctgatccatccacgcgaaccctataaataaacgcaagcctgccattccagttaccaaattggcacttccgtaccccgaccccggccaccgtgtggaaacagaaacagca

SEQ ID NO: 4484 - DNA, 1500 bp, Zea mays
ttgcttttgatccaaaaagatttgtctactacagacacagtaaactcaatcagaacacactagcatgtacaaaatggcaagaacatgttacatgtggaatgcatcgaacgtatagaggaccagtgcctagaggctcaaatagcctacataatcgattgacgatggttgttacttgacgctgttggttggacaaatgggctgtagtggcaaatgagtaggtatgcaagacaagcaaaaaaaacaaaaatggtggtctgccagaaagagcgcctaggcctaggtggacctggagtgcagtggcccgttatccatccaccgttggaagcggacggtattcgctgctctgtgaaaccagcctcacgcattgcccgccgctctagaggctggttcgccatggccttcgccaaagctgtcacaacccaactaccaacttggaacgggcgggccgcagattgcagtaccaggcctgggccaagcgccacaattggcatccacaccactttattgcccccgctcgggttacaagcagtcgctagctgctcggcgagtgtggcactgaggaatagatttttaagctggtgtcttctcatgtgagcaagcggtgtggtgctaaatagcacaaatgtcatgcagatggcagagcttgttgttgatatgtgggccgaagagagtggggcctttccttttaatcatgtgttgtgtgacagcgtgaacagccaaaagcggcagcacgcagcagcgaaagagccggtacatcctaatttgaccctccgaaaattcaattcactctataagcgaaaatatagcatgatcaaacgatttttacatttatagtgataaacgatacttttatcgacagtgagacgtctataataacttcattaattccatctttaaacatcatcgacccagttttcgaaaatgtcgaccatgcatgcacatgttcatagaagtttataaactatacaggtgagcatgcgcgcgtcgaagcatccgagaataagcatttaaccggaataactcgtgacatccaaaggggtcaaggctgccttgcctacaggctggcgaactcaaattcgtacctgttctctaagactcgatacgtattgagcttgaagaagtgcttccaaatctggcaggcaaaaaaaatcctggcagagaaaccccagattgcgtagttcaatcaatcagctcgtggctctagctaagcagaactcgaacgccacacgccgcgggtagcagtagcactaacatctcgcaaagcttcccttgcgcttgtccacgatcttctggtctggtccgaaaagtccgagtagtcgtgataggaccgtagaaatagtagattagattagattgggttgtaacaaacctggaatccccttgagccggcactatatatatgcaatgccatatggagggttgttctccatccaaggtaggggctgcaggttccatctcgcacattagaaagatcatcgcgaggaagatatagctagcagc

SEQ ID NO: 4485 - DNA, 1500 bp, Zea mays
atcgactatcctgcccttttccttgatgacttggacgccctgggcaagccagcaacaaaccggcccagcaccggtttcagcccgcaaagcagcccatctaaaattaggcctagcttcagacaccttacaccgcagtctcagcttagatcaattttaacagaagagcactcaaatcaaaatccttactctttttttaaaaataggcagggaggaaaaagacaggataaaagggtttaaaacactcataataagatcccagtcacacagaccactggcccaaggaaaaaaaaacaaaagtggcccataatcaagaaagcatctaagaagaagataagggaactgtcagatgtctggcccctgccaggttctagctaggctgccgtcttatactttatttttgcaacgttttattaacaacaagaaaatctactatcaaaattctcgcatttctttccgttccaattgaccacatcaccatatttcccgtacaagcgcacgcatggcaacactggttcagcgattcgtcgaaggcctcgatgttgagggcgtcctctatcctgctgccctttttcttgctgacttcgacgccctgggctgaaagccaacaacaacccgacccagcaccggtttcagcccgcaaagcagcctaagccaaaattaggcctagcttcagacaccttacatagcaatctcagtttagtgcaatttcaacagaagtactcaaatcaaaatcatgtgagggcttcgtccacttttaaagacatcccttttgagttaagctccagcaaaaccttaaattagggaccttaaattcattgtaaggccccctttaacaaggctttagcttttcttaaagtaaatttgactcttgcttctgagtgcgagtagcttttctgtggaagccacgaccattataaacaattactccctccattcacaaatatatgacatcgttaactttttatttaaaaaaaactttgaccacttgttttattcaaacaataatgagttattatttattttttgtgatttgttttatcacttaaggtagtttgtgmttgacttaaaattttatatttttgaataaatattttaaataatacgagtgatcaaagtttttaaagaagtcaacgatgttatatatttgtgaacggatgtagtacaaaatgtaaaaaaaatgatgcccccatggattttatatakatgcagcgtgatggattttatatagatgcagcctgtacccaaacactttcaggctactcgtagcctgatacaaaattcctagaactggagcccttatgtgcaaaagtggcggtacgagaagaagtataaattttcgtatccttgtgcctgccatttctgccgcgcccgctgctcgctccccctgcttcctctttctccccctcctcgactcctcgtcaagctcccctgaatcgcggcagcagcaccggggcagtaaggcgaggattctcctgctccgaatctacccggctcggcccg

SEQ ID NO: 4486 - DNA, 131 bp, Zea mays
gtcgtcttttttccggacgtggtgataagccgatcgattatggttataaagcccatcacccgagcaggaacccacaccacaccaccgccgacacactctcgctcgctctcgctagctagcgggaaactact

SEQ ID NO: 4487 - DNA, 253 bp, Zea mays
tatatatatatatatatatatatatatatatatatatatatatatatatatatatatatatttttcgggataagatcatttgacgagacgctgtctcataatggccccctgctagctacctagagcgagcagccgagggccgagcactataaaatgtacctgctgctggctcacagagatggtactggcatgggcagggacaagtaattcattctgatacatataatcccaagctcctctatcatagggatat

SEQ ID NO: 4488 - DNA, 190 bp, Zea mays
acgcctcgccggccgatctagctagctatcgcagactccgccggcccggccctcatcgatctttcgtcgcggcaatggccatcacaccgcgcgctctccgatgattgatccactccggtcgccattcccgccgccatcagctcctactatatattagcccgacgatcccgttcatcttcctcttgacaca

SEQ ID NO: 4489 - DNA, 258 bp, Zea mays
gaatcggacatggactgggtcatgaaaacaggcctcgggccagatcaacggcgctggggcttcatgtataggaaaagaaaaggctcaagtggctcatattttttttacgaagtcttgtcgaggtcaataacaaatgccaggaaacaaaactttcccgccgccggccggcgtcaccatgaaacaaccccatcaaggtgggaggaccgtaccggaaaatatcgggagcaaaaaatcagaccagattttcccccgtgaggc

SEQ ID NO: 4490 - DNA, 1085 bp, Zea mays
cgattcgcccttgatcttgaggataaatctggaggtcaacaaatgagtttcatataaatctggatatcattgtgcacatcaaataaattaaacagagcatagaggactcagaagaaaatgacattcggagtggccacggtagtaccaccagctaaatccgaagcaaaacaagttacacaagtttcagatcctgttataaagtacatgatcaaatggattggtccatcttaactaaaacaaagtttgtgttaggattattatcatcgaatagtgaaattgtcctaaatcgaagaatttacgtttcaggtgaaacactttgattgcttcttcactgataccagatcttagaagcaaaccactttggcttcccgcagactaataaattaagaacaaaactttcctctgctgaacaaacccccttgtgccaggatttcattcttatgtattcccacataaaaaatccaaccaacaagtttatagtttacagtagtagattacgaataaataaagtcaaacataatttatataacaaaatattcagatctaagatatgtatgaaactaatgaagagaatataaaatagacagaaacaattgccaaatactcccttcattagtttacgacgaggaatagcaacgcttgggtacaacaaaagtctagcgtacaaaataaggagcaaccaacgacaggattcacaaatgattgaaaatgctgaccagaaccttggaagcgatcatggtgcaaactggctggaaattatttctgctggaccacagaaaaataaagctagcaaatgcacaacgggatacagattccagtgaggaagaaggcagtccaactcaacccacacctggctgggggctgtcgcgctgaagaaaacagtgcaggtctaggtccattcccccgtgccctctccagctctcccctctcacctctcacccttgttataaataccgctcggattcctcacgcccccacacggccacacctctcctctctctctctccctctgtccagcgcactctttctcctcactagctacccacctcagcgagccaaggccggcgaagcgcatccatcggtcc

SEQ ID NO: 4491 - DNA, 236 bp, Zea mays
ggtacctcaaggccgcgagggagctgctggacgaggtggtcaacgtccaggacgcgatcaagcggaagggggacaagagccagcagggcaaggattccggcggcggcggcggtggcggcgagggcaaggacgccgagacgagcgacgagaaggctggcgagcacgaggggaactcctccgcgccggagctgtcgccgtcggagaggcaggacctccagaacaaagtgtcggcactg

SEQ ID NO: 4492 - DNA, 962 bp, Zea mays
aagtccgaaacgaggaagaagatgaactgtgtcactgtcacccaaatgcgatggccagccgcaaccgcaatgcttgcttagatagttagatgtcaattcggctgtacatattctgttcgtaaagactaaagactcgtagatgctcttttttgtttatgcatgcatttggtacgggaccttggacatgaaagtcataataaattactagttcactttctaatatcaaatttgtaagattatctgattttaatcgctaaacaatgagaccaggtactccggttgtcaaaaaccggaaaaaactaaaccactttctaacaaagtaaaaatacaatttagtatcttaaaatccataactaatttactttagattataaaaaatatgaagatagtatcgattttctcttaagaaatgttgctgatctattcggagttatctaaatattatttattttaaataaatagctaacaaacgcgacaacgaacatcaaaagcattgggaaaaaataaatccaaatcacgctaaatagatcatatacagatttgatcatggaatcgaccaaatgggtcatagtcaacggggagtcgactattaaattgggctggcaccaacaccatgttactggttgaaaacataatttgagctccgaatcttgaccaaaccattgaaccaaacgagcccatttgctcttctcaactactcccgaattggtagctagcacagagtagacggggtaactcaaagaggcccatatttttgcaacggcccaacgcacgtctttgcagttgcagaagtttcctagggttttcgaggcgtcgcagataagagatccctcccgcacctccgagccgccactcccaagacacagagcgtcagagcccgatcccgatccagcgaggcggcgaccctccctcctccccttgcttcgctcgtccagccctgaccacccgcatccccgtcagtc

SEQ ID NO: 4493 - DNA, 676 bp, Zea mays
tgcacccattaacaaggttcagtgcttttcggtagttctcacccgccctaatggcaagcaaaccatatagattatggagaacacatcgatggttatattcatttagtgtttgagttcctgtcaatcaatgaatctgatggattttgagaactaggattcgtcctaaaagagtaatagaaccttctaacactgccattgaatgttccaagttgggcagtcagtgccattattcaaacacaaccaccggaaaagaaggacattttttaaattggatgtattgaaaaagggtcaaaatgtgtgggttcactatagtctccacaagtccagatacacgctccaaatgaaataaataaatgaataaactctctgcaaaatacactgaaattattattgttgttgagccgccggacggagggcccacgtccactcatctctgaggtctgacgtctgagcagtgagcaagcaatcacttgttgtcccgttattatatataacgagcgagcgagccagatcaccacgccctctcctctccattcaccaccgccgatcgtgttccagacttccagtgcagcagccagcaagtaagcagagcagccggccgtgcgtccgatcgagaagaagactcacgggagcaagccgtactgtaccgatggcaatgacggccggggcgccgtcc

SEQ ID NO: 4494 - DNA, 693 bp, Zea mays
ttcttgagcccttgaggcgacgaggtagggaagcaacgggggacgcgtgctgggcgagcacctagcgggatctaatttgcggggaggatccgagggggagggggttcggtggatctgcgcgacgaccgggaggtgggcgatccctcgacactcgacagtcgacaccaaatacccggaccgcgaacggccgcccgcttcgcggtcgcgcaaaatgccgccgaaacccgcgccccagctcttccagtacatctccaacaagtcgaggaaaccaccgccgccaccagtcgcgcgggatctccggatctggtggttgtgttagggttgggcgcgagaggcacgagcacgagcgttgccgcgatttgctcggggtaaaactcgcgctccaggcaagtgggctgctgctgctgctgagagggggaggcgggggcacccggacggtctacactaatgtcttaatagttagtagagataacaagtgcaaactgctgtcagtccccccaagcccggagacacgcgttgggcggacacacccggcgcgccttccacattcttctagagacccccatcccagccgccagttcccggacaccggattgctccccaagacaagcccaaatctgggaccataaacaaaccgcacccgagcggcccaaatcgggatctgacggcaattccccaattcgattccatccc

SEQ ID NO: 4495 - DNA, 1066 bp, Zea mays
tgtggaaaaagtatgttccagaaccttgctgatgataatcagtgcatttgaagtagttacatggaccaagcctcttctgttgattttaaaattaagattcaggtagatcatgctttggttgtagctcttgcattttctttatagctttttttgcatgcaaagttgcaaacttttattgtgagtgtgtttagcaggactggatgtaaagaagtctgtgtgctgacacttggttctttttgtttactgacgttcccttctgtcattcaaaatgtcttcatttttgtaagataagattccaagaaaaatctgttgaaatgtatgctttactttctctgcaaaaggaagctcgtgtagcaatttggcccgactactttatagtcaggcagttcctcgagaaatacagatgagtagctaacatttgtttatttcattttttgatggtgtagaccaagaacgcctggatttggataccaagaaactgcaaagctttgtcaaggagaaatcacttgtgattgcggagaaaggcgccctagcaggcagattcggtgctgacactgtaaaatctttggtcagccttacagacacaactaaatcaacacgggagggcggggaggtgaagtaccagttttgttgagtcgtcaactgttcagccacaatatatttcttggatatccggtgtttgttcggtatatcccctgccggaagggattgaaggggattggtgttgtttaactcaattacctgcagtccacaccaaactgaacaaggctatatgtatagattttctttgcttttgtttggaacaaaattttgcatggttgttagcaattgcgaaaaaattgttctcgattgatgtgtgtattcttatttgctgtgagattgtggcatagtcagtgtgtagttcctgatgatgagctgggtgtagtcaaaggttctcaatctgtagtagtcatgtttgaaactgaagtaaaggtgggtggcgtatgaatttattcattcagctattccctctgtcccagaatagttgatgttttagggttgtacatatgaatttataagtataaaa

SEQ ID NO: 4496 - DNA, 1500 bp, Zea mays
ggcctaacctgccacgcgcaccaagctggatgttcgatcagcgacaagccatgttaggtacggcgccaccatcagtccaccagcactgttcgaatctgacatcagttggcttaggcctatgtttcctccagctttttatcagttcagatatgaacagctaggaaagttttatttcacagtgtcatcgtcgatctcgccgattagtaaatgaataaatttgtgcatgctagtaattgctaaagacatgtttcgtcaacgaggagacctgtctggctgtccgcctgtccccgacgaaataatcacccggcgcggcgaccacacgaagaaatggcgaaactcagcagcagtttccgccaccgaatcgcgaaacatcctagcgctggtttccggcgttccacatgcaaacggccgcgaaaaaattatacacgagactgccgtggctagctactgtttcctgccgccggcgacgtgaaattcgcaccggcaccgaattctttcctcgcacgactttccgcggctagtggccgttcgcccgttcaccctcgacatggtgggagcgtgacgccgaatcacacaaccgccaggccaccagctccgactcgttgcagttggcagttgctggtgcagcaggccgcagcgcctttcccttccatttcgcctttgctccgcctccgtgttagttagtttcagagtttagttaagtctgcatctttcatttcagtgtctgtaaaataatagttggctgagtcagggagctgtcctgatcgccacggagtggaggtccgcgcaaagcgtgctcacgtgagagttcatgccggtcttctcgcccactgatggtgtgcgcggcgtggtagtcatggcgccaaatacggaagacgccagaagactggactgcatgtgttgcatcttataaatgaaaaaaaccaaaaaggcggcggctggtgcgatttgttctggccgtccaaaaaaaaacatcgtctgagtactctctgtttttcctcccagcgattttgttcgtcttcttcctcagttgttcgacgccagcgacagcgggtgttcgggaggcgatcgggacctgacactccgctcccctccggaatcgatgtcctcgtctcctgctcggtttggtactttggttggcgtacggcgacgtggaaagctcacccgtatagtagtagaataatgcaatgagatggaatggccctcctgtcatctcccccagtcacatctcgactgaattattcaattctcaatgctgctgagcagctgctgtgccgccgccgccgccttctcctaatccagctgctccaacctagctcacgtcgcttccaacagacgccaccagtcgtcgcccgccctcgccctcgtctcagtgtcaaagcaggaggcggcggtgccgcgcgccccgccaaccgttagctcccgagtcccgacggcgcggcggaatcggggcttgggactggggaggcgcgagtccccgggcgcttacttcatgcctcc

SEQ ID NO: 4497 - DNA, 1333 bp, Zea mays
  unsure (1)..(1333): unsure at all n locations
ctgcagttgtaatttatatagataaaacattatataagtagtagaagtcgttatggatcaaagtcaaacgaacatacatgaagacagaaaaagctggtgatctacaattctagacaccctttgctcagaatacagatttaaaaaaccagaggcaaacaattgtttctaagaatgtgaatctgaggctctatttagaaataaattttaagctccgacccactttagaatgcatacatatatttacagaaattagttcatttttacaggaaaaacataaaaacagcaaaaatcccgctttctatcgatggtggtcgtttttttaaccggtaaaaatagttaacccgtcgtttttttaaccggcgaacccgacggtttcctgcgaacctagcgatggtggtcgtctcgtctgcatccagcagtgcagcactacagttgtgcagcatgcgtccacggaccatccatgggtggcgtgtgtgcctgcctgctgtgggtgggccccgctggctctcgctgccactggtggtccacgcttgtacagtatacggagtacgcctaggcctagctatgaattttggtggagctgacgtcagcgctgtcttcttaatttttaaattttatgttatttttataccagctccaaattagaaaaagctagtgctagatgaaaatgatggcgagagggacactttttaaaacctttttatgttgcacgcatccggaggcaatggcagtagagagagaagaggccaccgagcaagcagagagagagagagagaggagggaggcctggagccctggagggagcgcatgagctgacagaagagagcacagaggcacttggagttggcacgcggtgctttgcttgcccccgcctcctccctgttctatactctcgcaggcccaggccaagcccctcccccgccctcagacgcaccgcggcaagaaatcctccactccatcccggtttccccggagagattatgtgggattaggtagatgagggcggcgctgttcggtgccgagcggaacggggctgcggacctcgtcggagacgggaagacgctgttctggccggaggggaaggcgaaggggctgttggagccgaggtccgtgctggactgcacgcggagcctnagccccaacaactcaacatcgacgttgtcgtcgtccgtgggtggcggcgctgcggactcgaccggcatggcggtggcttcggacagtagcgccgccgccgaagccaccaaatggggagcccccggcgagcacggcggcgagcgggaaggaggactgggctggcggctgtgagctgccaccgattcccaccggcctcgac

SEQ ID NO: 4498 - DNA, 182 bp, Zea mays
ccccccccccctgttttcaaaaaaaaatgataagctggtaatcaagaattaggagtctcctatcactgcaggagaggaagaagtagaagaccagaaataccatttcatgccccttatgctgaacctggtgaacacattcctcctttacatggtcaacacatacatcattgtgccaactgcag

SEQ ID NO: 4499 - DNA, 966 bp, Zea mays
aatgttttatttttgcaatgccagaaagccaacttttaaaaagatattgactggactaaaccttttagagggtgtttgaatgtgctagagctaatagttagttgactaaaaaatttgctagtagaattaactagctaacaaatagttagttaactagtagttaatttactaaaaatagctaatagctgaaatattagataggttgtttcgatgcctctagctaattttaaccactaattattagctctagtgtattcaaacacacttttagtttagtttggcttctgactttcgaggacaaccacgatcaaaattcaaaagccaaaccaaacacaaacagatgtcacgaagaaacggagctcacagcggcgtacttgttcctgggwacaaagcggcagcaggggcgcaaccaaaataaaaaatgaaaaagaaacagcgccagctgatacgatacgacgaagccggcagcgtttttattgggccgaggcccagcgtacggagggttgtgccacgaggcagtctggtgggaactgcaagttgacgcgcggacgtacgatccgtagcggacggagatcctacttcgactgctctttttctctagcctcgctagggggtcccggactcccggttccggcctagaggatctcgttcccggccgtctgccgctcggtcctcacccgtcgccgtcgcccccctcccggtcccggcctcccggccttccaaatcgtcagcgcagggcgcacacgcttgcccgcgccgcccagccagcggcacacgcctgcccgcgccgcccagccgctctcccatagccgtcgcgccgtcccggccctccaaggtaatgtgacacactagtcgctcctcagtcctcactgcccctctaacgatctccccgtgcattaatctggtctgaactttcttattgttttgtcaccgatggcagattcagattggtgttttgctggcacc

SEQ ID NO: 4500 - DNA, 1500 bp, Zea mays
cattgtaaccaccggatctttttaaatgacaagtgatctaaagttttaaacaacatcggatgtagctaaatgtacacatttagcaaccaaacaaaaatagaatgttgcctctctatatctatttgttttatattattgttttgccaatcaatcactagtcaaacatcaataacatttctatttctattaaattatgagtttccgttagtatttccgtttccgttcgttttcgcaattccgtttatcccgctcccgtttccgttcctgactattccagattcgatcctgtttccgatgataaaatgcggatacggaaacgagataggggttttttccgtccgttttcatccctagtcacgttgtcaatattttatttcctaccttttcatctcccgcatcgattccctattaattctccctttataccccactacaaccataaaatatcatttcctatacctactttttatccactatcaatttttttctactaacaattgaaggcaggcccacgtcaacagtgcaaggggaggggtcgggcacacgccacagtatgagggagagaagagggcgagcgcgtgggggacgtcgtagggggccacgttgcgggcgtccgcgcgcccttgtaaccgccatgcaacgggagggggtgggcgcgtggctgctgttgcgggtagtcttatgatgcttccgatgcctgacgccaagctgaaccacaacgtcccttcttcgttgtctggcctgccatgaaggcgagtgcttattcgctgcagcttgctgcgactgttgcttctacaatattttgtctctatagactgaagctataacagtccgaacagctacaacaactacgaccgtcagtcaaccgaacaattatgtttggtgcacatagagatcaaggggagttatagggttcgtacaagtgagcctcctgatatattagatatgatctaaccatatgttataattaacactttaactcttccaccatctaattccttgttgaattgcatcaactcctagaataaaagaaaaattttgaattgtggactaagcgagctcaaatggttaggcttttgtatattcaaatttgatcatccaaatagttagtacatgtggctatatttttttaaaaaaatataatgtcactacctctccaatggctgacgatatatagcgttattcatcaccattaaataaaacctgtcgatctagtgtttagtaggtgtttattagtaaagagataggcacctgcgtactaataagttaaatttatttagaacaggcgaaggatttataaagttacaattaattaaattctttcgaaaataattttcaaaaaaaataactgctacccagcatttttggcgtcgtccgtcttaaccccctcccctctctctctatattaactgccactctgcgcccatcgcggccactctatattatctctctttcgcccacctgatcaggcgtcgccgccatccaccggacgcggcagcc

SEQ ID NO: 4501 - DNA, 322 bp, Zea mays
ggtttctattatgtgtcacttgggtttgggcatctattagtcatctagtccatgacattggttactccttccgtccgaaaataaaatttgttttacctttatagttgatacatgcaataatgaatatatttgtcttacatatgtgtctagattcatcatcatccatttgaacatagacataaaatcaagtattaaaatgactaatattttgggattgagggagtatgtatgtagaaaagctaaacatcttataatctggaatgaagggtgtggatcctagatttctaatgtccatctttcactggaggttcactcagaaact

SEQ ID NO: 4502 - DNA, 393 bp, Zea mays
tctagaaacacataaatacacagtgcattcatatgagttatgcatgccctaaggcatacattggaccaatcaaacaaatagcattggaccaatcaaacatgaactgagtttcagtaatcccatggcaaataaaaaacaggaaattgttggatggtaaatgattgattgcatcaataaagaaaatgcgaaatcaaaattgttgactgaccagaaggcacatacctgtctatgcacctgtagtagttaagtcctccagtaaagcctgttttcgcaaatttttctgcatagtaagaaatatcttcctctgatagccatggaggacaagttccatctgaatcaagagagtcaaagaagctcttgtccttgggcagaataagaggagctggcttgcgc

SEQ ID NO: 4503 - DNA, 1500 bp, Zea mays
aacgggtagggtacccgaaacgggtaccagatacgggtactgattcgagaccattttttggatacagatacgagtatttttatattcgggacagatacgggtaatacctgaatagtacagcttcggattcgggtaggatacggaacgagtactacccggtaaatacccggatattcgggtcggatacgggtacccggaattcgggtacccggaattcgggtacccgttttttctttttctgcataataatatagttataaaatcataacttttacatatgaaatcggatgaagataaagtttatatgaatattgtagagctcgaagagatctataactttgtagtacaaaacatttttgtttaaacatatctttaggccaaaatcattgaaataatgtctaaatttatatcaaaataataggctttaacattttcatgtggggacttaagattatctccatgtgggaacttagaattatcattttataaactatttattaatattggtaatttattcgcaatttccggtcgacactacaatatttttatcaatttaattgtattttgatgattttctacaacaagaaattaataatacactaaatagcctaaaaaattcatgaatttttatggagacacaacatatatccacatatagttctaaaaaatatttggattataaaatccacaagatgttggtgtttcttccattccactcccacttattgtgtgagttacacgtgaaatcattttatgtatctaagtttcaacataatcaatatttcacttatcattttcatgtggggacttgaggttttatttgaatagaatgtttatttgttttggtaagttttttttgcaattttgggtcaaaactagtgtattttatgaattttaattatattttgatgattttatgtagaaagaaattaataatgtacaaatagcctcagaaatccatgaaattatacgaaggtacaacatatgaccacatatactcatcaagaataatgggaccataaaatccacagaatgtcaacatttcttctattttatttccacttattgcatgagttacacgtgaaatcactctaagtatccaagtttcaacataatcaatacttcactttaccatttttacgtgggaacttgagattatcttctattaaatgcttattagtattaatttacttgcaatttcgtggtcgaacaagaatattttttgataaccaattaatgcattatccgacaagtatccgatatccgatcaaataatatccgtatccgtcacttatccgcccggataaatatccggtccctgtatccgtatccgtcccgtttctaactatccgtatccgatcccgaatccgttttaaatacattagggtaggatacaggatgagctaatatccgtccgtatccgcccgttttcacccctaccaccgcaggtgatcctgtgactcgttcgcgctcttcgaaggcggcagcactgcgggggac

SEQ ID NO: 4504 - DNA, 78 bp, Zea mays
ctgaatactcaacatcctgaaaattaactgacgaacgccgggtcgctgcacgatcacggcctcgctatggagattgct

SEQ ID NO: 4505 - DNA, 546 bp, Zea mays
atggaggaactggagaaaagctctaggcgtggccctctaatggtttcagaatatgtgaattacgatggttgtaacatatatacgagtagaagaataagacgatgggagttattttgttatagatgtcaaaagtcaaccatgttctttttgcaatgtgctctgtcyatccctgtttactcctctatgccgtctaggcgaagtagataatgtatcttttgcatacaagcaacattagaaggtgtaacacatgattttttttttgataaaggaagattttattaataacttcaagcacattacatcgaggagatacacgcccttgaaatttcttccagcctctgcttaataagcacacagctttgtaaatgaaaaaaaaagtttataacccacacactctaatggtaatcaatccgaagactagaccgccacccatgtgcccgggaaaaaaagtccttggccacccgcaccaagtattgcgtagcctccacaaccataggtcgcaactccgccttctgtaaaacagcccatgtacgaaggcaatgggca

SEQ ID NO: 4506 - DNA, 423 bp, Zea mays
cctgcaatccgttggtcagctcacaatagcagatgagtccattggaggagttcgactagtctccaccgctgctgcgagattccgccaggtacaccgctgaatttccatttggtttgggcgtccaggtgtgatctgaggggggtggggatgctggattttggcctcctcctcacccttctccgttccaatcctgtctgaacctccgagaattgccgttctccggacgcggggagtgctgttcacggcattagtgctttgatctgtgaactttggcagacggaacctaccttttctctcttgcctttaccccgaaatctcgtgtcaactgtgggtcatagtgataccgctgcggttgtttagagttcttagacttatccacccctataccagccgttagctttgggtaatctgctgtactctcca

SEQ ID NO: 4507 - DNA, 361 bp, Zea mays
atcatttttttaatataaaattacaattaggctactgaataggggacgataaatattttttattttattattttgagcatgagactatgggaacagggccgttgccagttgggcaggttcagactcgctgcgccggagcccctgatcgtaattttccgtgggcgctagggcatattcgtaatgtggtcccatgggataaattcgattcccctcgaacggcaaatatctaccggagcgcgtctcggggaggagagagaaagtcagatccgtgttccgtgtccgcgtccagtgtgtccgctactccgctccccctcagtcctcagttcctcacctagcggtagcgtgcgcgcgggagacgtag

SEQ ID NO: 4508 - DNA, 1500 bp, Zea mays
gaggaaatctattcaatggcatccaaacttatactaattctttcaatactgttaaaatttatagcttccttttaataccattaaatttaaattttaataccttaaataccattatagaaaaattcctgttatgtcatcagattttatactcattctttatgtgctactgaatgacatgtaggtatatttttttgtgtgtatgacatgtggggccagtggcacacaagtaacgggtatattttctgatggcatacagagaattggccctatcattatcgttagttctattttgagcaaatttctctaatgccatcaaaatctatattaatttctttaatgccactagaaattggtttgatctatttggattttaaaaattcaagaataaaaaatatggactagatttttaaaatttcacgatttttttaaaacttcagtacatattttttgtaaacaccaaaaattactccactatatcaatttggtctatttgattcctaatgtttttttcaaactaacaacaaacactaatgatgacaaagggagctaattctaaaaatcaatgtggtatattcgcgtttcaaaaattttggattctaaaaatgtggattgaagttctaaaagtatttaaatatttttaaaaaaattcagtacatatttttttaggacccagaaaactatgtggttattcgtttataccaatttgatctattcagtttttcatatattttttcaaatttattaggaagcagatagattaaactaatatatcgaagtaattttggagttttaaaaagtatggactaaagtttttaaaaatcgtggaattttaaaaatttggtccatattttttattctgggatttttaaaatctaaatagattgaaccaatttctagtggcattaaagggattgatatatattttaatggcattgaagggatttgctttaaatggaactaatggagttagcttcaaattacggtgatgatatttagagggttaaaatttatttaagagattaaaatttaaatttaatggtattaaagagaagctataaattctgatggtattgaagggattggtataaatttagatgggatttttttttaaaaaaaaagcgtgaaccggaacaataacggcaccaaagaaacacacgctacgtcacctcaaccaacgagacctgtttcacttgggaattgggatccactgcaatcaattcgaagaccaccggatggtcagctgcatgcacgaaatttctccggctggttgcatgtgtccaccacaacttactgcctgctgagttcagcatagtttatttgtttcagaaagagatgcaaggtccaacaaggcacctttcatagccatgcatcgaagctcttgattgctttgctacagggaaggacattttcaaagccaccggtggctccggacattttgcggtcaaagcattcagcaccgaagcaaagaaagaagggctgaagcctgaagctcgcgcaggc

SEQ ID NO: 4509 - DNA, 85 bp, Zea mays
gagaatcctcagccgctaccctaccttgcatccaaagttccaaactgacacctcaaagactcgtctattcgaactgtccctcccc

SEQ ID NO: 4510 - DNA, 1131 bp, Zea mays
tgccatatgagcaagagattggttgttgcattgtgttgcgcgtggtggcttaaatggccagggtttgatcctcgcggccccgcttatttttgctgggcgggaattcgcaggggcgttgggcgggaattttggagatttcgcagggcgctgggcgggagttcgagtggcagaaccaaaagtggcaggctactcttagagccttaataagtagtaaagattactcatacatcgggtgtgtcaagtcggtagtatgttaaatgagtctctaaactatgtaaattttgtatatatatatatatgaatttcggctgcagtggtagagactcaactgttttaacgactgggttcgagttactatttttgctggacgtttgtccgttaaatataatagagatagagaagagacaaagaaaggtaaaggtaaatgggggcttcgtgggcttgacccaagaatgatattatgatacacatggacaccaacggaggacgacgcaaagggcctaaaactgcaggcctaaaaaagaagattagacaccgctcctcccgtccccgccgcccccgcccgaaccgaactcatctcctttccgtttgggcgccaaaacagcatccgccgcgcgacgcgtctcgtcagcgccgccagccccgtcagaatggtaagcgctgcttcacatccgccccctacacctacctactccaccccagcagctagatccgaggcccctggttggctgttcttcgattaaagcaccacttggtgcggccttcacaggaggccagattcgggacgggggatcgacccccagccggccggcttctcccttggagcagtcactctggttggctgtagggcttataatgtctgtttttttttctggctttgatcgagcatggcgctcgaagggcacatgtagataatggtgtatttttggatcgtttagggcttgtgttctttcccaccgtttgcttgcaatagactcactgaatcgctagtttgccttgtgccagtgagaaaactggtaccagttttgtgatgataggtttagaggaatcgagtcaattttgggtttctcgtgttacagcgctttcagcaatagtacctaccggtaggggtggtagtaggggtgataatgg

SEQ ID NO: 4511 - DNA, 231 bp, Zea mays
ggtccagcactccagcctccaggcggccgctcccggtcccggtcccgggcccttttgactgcaaggcgacagcccacaccgaaacgcgggtgccgttgcggcgcacgagcacgagaacgagcacgctttaaaaccccgcacgcccccacgccgcgcgcacatcacctcctgccctcctcctcccccagagccggcaggcaggcagacgcggagaggtatcgagccatggac

SEQ ID NO: 4512 - DNA, 226 bp, Zea mays
ggtaccatatgtccatatgatcctactttttttatccttttatactagaatagtgtgcctatcgaggatgcatggtttctatcctgctgaaaattccatttatgattcttcagttgcatgttgcatgttttaggcagcagaaaaggtgggacacaaaagctgcatcaccatttttgacagcagttgggttatctgtttcaaattatgccttttatgcacatgccat

SEQ ID NO: 4513 - DNA, 885 bp, Zea mays
gtgaggtgagagatagaaatagatcctatcactttccatgctctattgatactctacagtttctactatactgtttgatttgctcgactaaagaagaaatgcagtatcttctctatgtgaccaacaataacatacaagtatattcataacgatttagttaatttgtacataaattgtgattatccgaatatatcttaactgaaggacgcaaacagagccttggagagatggagaaataagatgttactatttattttgtcaacttggttaacttattgtttagcaaggaaattaaaaagaaatactcgcgaattctccgaagtattaatgtatttttgtattggcgtctgctaactttttatctaattgacaagtgctcggatgcatgtacgagtacaatgtgatttgtgaacgttgtagtagtatatcagtggctgcacgagcacagaaatgtacacagagatgatcagcgaagaagatcctacatgcaaaatgccacacgcggtagttgcgtcatcacttagtgcaggtgacgtggggcttttcgccgcacaagtcaaacaggccgcaatctgaacttgccgtgtggactgtggttggttggagccgaaagaacggcctgttacaacgaacctgcgtgaacgaaaagtggatgacggaaagggtgacgcaacgcgaaggggcacgaraacaatctagacactcactaagactgaaacaccacgcctggacctgctggagcgcccactccgacacgtataaatatacagcgacaccccttccgggagacgcagagcagaagcaaagcgagcaacagagcagaagcaaagcgcagagctagcaagtgaccgaccgagagcaaataggcaaggcaacgcaggcaag

SEQ ID NO: 4514 - DNA, 1500 bp, Zea mays
aaaataatcgcttcactcagcttcgtctcactcccatgggcccgcgtgcggccgctgtctgttttgccctagagcgggttggagtacgtataggcagcaccggcgagtcggcaacggcgcgcggcgtgtggtgcagcgttttgggcggagcagcgcggggaggtgggcacacggaggcagcaccaccaggcgtggccggacgagctcccaggcgcaggcgctagcggaatgggcaccaccgcaccagtgaccagaggttgaagacgcgcgcgtactcgtatcgtatgcggttacaaccgcgagcgatcagataaggtagaaaagggaaagacaaaagacaaaaaggaagaaaaaaaatatggatagcatatattctttactcttttttactaccgagaagaacatttgtcgaatgatcttagagcatcatcttcaacaagataatttaaaataatatcctaaaaattaaaatactatgttatttgaaatatttagagcactaaacacaaattgcgctttaacagtcaagctccaaatcatatattttagaaagtaaattacattattaaaaaatagtaaaaataatgtagaaaataaggataaggtactaatctaatctggaggtgtagtatatttggtcacttaaacaaagctgtaccggacgctccctcatttattaagttggactagtatatagcatagttcagttggtcatccagaacaatccaacagaccaccacaaattttcttctataattagcgacctttgcggttcctaaccttcttcccctcttctccccttccccagcttcttctttttccttctcgattactccagctggttcgcacggcgtcttccctgcaggcggaggcggagcagcacaagctcttctgacaccgcacacaagcacaacaagctccgtgcaggttcatcgccactcatgaattcttgtaggtgctagcttgtacttattacatggaactcatggattccagtaggggttacttattactcgtatcggtgtgtccttcgatcgtcctctagttacatgtaatagcatttttagatctcgattatcttcttgcattgaggtgtgtggtataggcatatagaacaagctacttacattatttcttgccatctcttcaagctccagatcatttctagctacatacaaaagatcggctacagttcgttacatagatctctgctcctaataatcctcccactgaaaatattccttgtacttgatggtcttctgtcttctccattctctccctttggttcccgaagttctaatggcatagggaaccacgtgtagggcgttcagcgcacatccctctatatatgctttagtacaagcaccaaatccgcacctcaaactgcgcaacgtcgtgtacgagagctctgccttctcgtgcttttcctaatccccgccgccgctagctggtctgttgccttctactacctcgccacgcgcctgcctcgggcccccctac

SEQ ID NO: 4515 - DNA, 65 bp, Zea mays
cttgagagaggttcgagagagaagttattaagctgcctccacactggtagcaagtgattgcatgc

SEQ ID NO: 4516 - DNA, 466 bp, Zea mays
gaggcaatggtgctgattactcggcccaaaggctgccacggtagtgccagtcgcagctgcatgccccacccatccaagtaagaataagttacttgtcggcgcttcaacgtttgaaacccagggtatttgttccctcaaggcctcaacgcgagccaccccctccgtcctcaatccatttccattcttccctttcctgtctcctgttgccaccgcataggtgaggtaaggattctggcagaccaacgcatgctgaggtgaggccttttaattttccatctccaaattatctgtgttgttacgacgcaatccgtccatgcccccaatactattattttcgtgaaaagacatgacatgcctagatatctgttcgggtgtgatatataaatccagtctaaactctttgtccctttcagttgcaggtgcagtagaaagtttgaactctgtgcgtgatcgagtagaaattaga

SEQ ID NO: 4517 - DNA, 418 bp, Zea mays
gattgacacatatggcgagaaggggtgggttgagattaagaagcagtacgccgtgttcgatgagaakgttctgagcaaagtaccaaggggtcccgcgaaagacaagaagcactagaagaagtgattcgaggtttgkctctcwgtagggaatggtagcaatcggtktgagtctcatcaggagacagcgcttgtgggtatgaagcgccaatttgccacctatgcatcgtgttgtgtatggctgctttttgtttgatatttgatgggagtagccgaattgctagctttacccttcatcagcgatgcatacacagcatacggtttttcggtagtgctgtttgattttgatctgtgttgtaagatgtcatgccaagactgtacctgagacactgtttttgataccgatgcagtttggaatttg

SEQ ID NO: 4518 - DNA, 1354 bp, Zea mays
ggtgagttaccgaaggagatttaggggaagaaaaacagggcacttataagtgatatattgtttatctcagatgtattgatcacttctctggtattggtgcaatgtattggggtaccgatcactgagtaatcacgcaatgtattggggtactaaatcctctctggtatcgattattcatgcaatgtattgacgattttaataagtgaatcgccaatgtatatgatatttccactggcggtgtacttaatacagccgccagtgtatatacatcatttccactgacggttcagttaagtgaaccgcaagtgtatatgacatttccactggcggtgtactttatagaaccgccagtgtatatacatcctttacactgacggttcagttaagtgaaccaccagtgtatatgatatttccactggcggtgtacttaatacagctgccagtgtatatacatcctttatactgacggttcagttaagtgaaccgacagtgtatatgatatttccactgccggtgtacttaatacagctgccagtgtatatacatcctttatactgacggttcagttaagtgaaccgccagtatatattatatttccactggcggtttacttaataaaaccgcaagtgtaaatacatcatttacactgacagttttgttaagtgaaccaccagcgtatatatatttacactgccggttcgttaagacgggcccgtctgtttttttcactggcgtgctgtaactgaaaccgccattataaatttctacgtgccgccaccttagagctcttttctactagtgttagtggggtatgtttttattttttgataaggttggacctttgtctagtgcttcggtcactgcattgacttaaacatcttgttattcttattatcaatatatcttggcagacctcctgccttaaaaaaaagagtaacacaaagaccggcttgactgatataggccccacatcatacgcttgcaataatgcgtcttttctaagcagtagtatttgtttcgccagacatatatccacttgtcggagtgatcagtcattttctgtccttgtagagcattatttaggagccagaacccgcttgtattgcacgcaaagttttaaatctccagctgtttttgaagggaaatagcttttgctttcgtacacaatttagccgctatctctcgctatagccctatttagctcgctattagctgtttgaggacaaaggacatcaagcactaaatactatagctggttatttaaaacactgattgcacgtctatataaagagataatgtagcccagattgcccacccatcccaaagagagaaagtagcagtatcagcgtatcat

SEQ ID NO: 4519 - DNA, 437 bp, Zea mays
ttcttgtctaaaaggaggatatggaacgatcgggttcgtgaagtaattcgtgtaattacaattggacgaattgtgtcatgtaggcgctaactactaagtattctgtagtttggggctttagcagatttattgatagaaatcaataattaggttccctcacagcttttcttttaaaaatcaataattaggttgagtgtgataataggagcctgcaatggcatttttctcatctcacctttgacattttgttaatctcaccttcgacattttgctgatctcctaaagatgaatttcatgctggctgattgtttcatcatttatattttgtttctcagttttcaattgcagttctgtacctcatggtcttccttgtgattgagttgtcataattaactcatttatatgcagctcagcttgttcctggggtctgatcagcc

SEQ ID NO: 4520 - DNA, 238 bp, Zea mays
ctaatttgttggctcagcgatttcgtgtaatactccatgacagccagttagctagaaaatccatgtgtacagcagtacgagaagaataaattacaggataagtatacatttcctggctggttgtaatactgaatgttgatgatgtctatggcaattggcaacgaactatgaagatgtagcagttgagcctgtttgtcttctgttgcccagtttttgctattgctgtaagcgagctcac

SEQ ID NO: 4521 - DNA, 1399 bp, Zea mays
gaggtgtgttggaccaaaacgggtgacgcttaggttttcgtttgttgacactatgatacactacgaataactagaatcatcgtgcattattaaataattcaactaataaaccaccaatacaatattatatacgaaataacattatcataagtgacaaatcatataaaatgaccttatttccgagggcataataattactctcggaaattaaaattttaaattatctaagcaccactaaataaactaaaatcagctaatttaattacataattaaattccgaccgtcagacagaacaaactaaataatatttaacatacaaatcatttaatactacgtaacttaactacaagcaaacaacacatgcatctataaaattgtttaaagtcaagaatactcacgtagcggcgagacaacatcgacgcgggcaagatggatggaggcacagggcgtgaggaaggatggggctagacgtcgggcgagggcactcgtcgaagaggacgacggtgtgtgcttcgaggcggccggcagtggtggctcctaggcgaccgttgggctgtcggcgggcgcgcctgggaggcctacgagggtgccggctaagccggggcagccctcggcgacgacaatggtggcggagcacggcggcgaggcgctctggtggcagcggtggcgaacagaacatagagaggcgcgcgagcgtatgcgtgtagaaaattaaaacgtagtccaacagctgtactgacagccgccggatgtaagtcttaggttcgacggctgtcagtagagtcgtcggatataatataacggccgacaatttcctacaaagccgtcggacattgaggggtcgtcggagctttctcgttttctgttgtgacacaaacgttgttttctgttgtagactgtataattcatagagaagtttaaatatgggtatagaaatgagtaatcgtctatgggagatagcctttgcatttttcacgaagaacatcttgattcacttgtgatagctagcccttcaatgaagcacataacgctaagacatgcgaaccgaaaagctgaagcattgccgcgaacaagaaaagcatgaatccgcgtggatcgcggcacgtcgttgagctcggcacactccgcagtccgctagctccaaccgatccatgagttcctgtacgttttccgtgcacgcatctggccgcgagctgagccgggtgccgcggcctcacgctttcagcaggcacccccatagctcgtcgcgcgtgcagcggcggcagcgccgcagcatgtatatatatagggcccaaaggagacgctatgcatcccatccatcgagctgcccgcgcgcggcagttaagctcacacatcagctagctcaccttggacggccgaccaggtacgttgcgagcg

SEQ ID NO: 4522 - DNA, 1500 bp, Zea mays
gacactgctgaagatagccttatagttatagctagctttgacataaaaaccaatacactttattagagagataagtgtcttacattattaatgaaaagctaacatatcacaactcctgccgtccgcctttgcgagaaagggagcaccgtaccagatggtgggcatggcgagagagagcgcccaggcccagcggaggaggcagggcatgagctccactcagttctgacgtgccaagccgagtgggtggtgacacaagcggacgagcaggacggagaatgaagtctcctccatctgtggactggacatggaggcacagtagcttgcacgcacctttcagcgacaaacttgcacggtaaaaaaggtggcgtcgggctgatggtgctgagcgccggctgggaaagtggctggcagaacgtggtgaccatctttcgcggcacacttcgcactctgtcagcagtaattatgaccagagaaatggagctgctgcaggtttttaccattgaaggaaagtactgacagaaaacgagctcgacttggtggataaaaagcaggcagacagcgacatgagttgccatgcttaggcatacgtggtgtgccgagactccccctcccccccggcaaatcaaaggcactgctctgttaccgtatatgatttgcgttgtcggagtcgtagtcttggcttcggtccgtcacaaataaatcggtcagcgtacttgggttcatgttaaagatccaggagaggagatcatcacaaataaacggtagcggattaggcttgattttcacatggccaagaaggtgagagagatttaccccgtgactagaaaagaccgcgcggaggactcgtgggtcgttcgtggcgcgccaccaaataggccagttgagttcggtgaggctgagaactttctgtcagcagtcagcaccttttctgctctcgcttcagaaattagacaggccaacgaccttttccctttccatcgtcagcacacgcaatgcaggacctgctgaccctgatcattggcaaaccaagcccaggcagcatgatcggtttcgttatgttatctactactggtcctagcagccccgacaggcccacacacacgcacagcacagagacgttggttcagccatgcctatcgccctcccactaaatctcatcgcgttcgcgacacctttctgcgaaaagatacggacatcatcaccgagcaccaagccaccatgttcgatgtttcccgtctatccaagaaactgcagaagcgcaattaggctagagattgcaggagaacagaattcaatcaggccgtcttccatctccaccttcctcgcctctctctctctctctctctctctctctctctctctaaccactgtactagaactatcattacctgagcaagattgcttctacctgtactgtgctgacattatacacctcttcccttcttgcccgtgccaatcgccattgccaggcaccacgtagagctgcattgcttcgaggcc

SEQ ID NO: 4523 - DNA, 1319 bp, Zea mays
ggtaggatcgggcggtatgaggaatggggaggattaacgagacacgtcctagagcaattagcgatgcggggagtagtggcaactggctaactgctcggcgctggtggtggactggtggtggtggtgactggtgcgactagggggagtaaccgtttcggtcatcggggagacgatgacctgcgcgagcgaactgccgggtgactgacggcgacgtcgcgcggaattccaggggagcaagggaagccggaagcggacgcggtttggactttcggaggagcgactgagggaggcggctggcaacgcgagtacgcgacgaatgggaagcccaaccaagttgcagaaacagccacggagagggttcggggttttcgtgttggggcggagcgcgaccggcgtccggcgtccggctggggcctgggagcgccgtgggcactttggacgcgaggatagctgcttggatatgacggaaatgccgagtggttgcttcggcgctggcgatttgcatttgctgcgctggatccagcgttcctcttccaacggcaacgcaaatatgatgatgacgggcgttttccctgccggttcacctgcacgctgcactgcacggctgtagtagcagcacacgagatgtgcgtgtgaatgtgtgattattgcactccagcttcgtgacatctcatctcatgccccttcaatcaaagccaacgcctaaaaaatgacgatgtctgaagctgaaatgtcatcaagggagccaacgaatgtttttaaggcaaagttttgtttaccctactttaatgttcttccgtggcacgtgacatacctctcaataacaaagcagctgtgataactctgtccaccatgaaatctgcaagttcaatcttttcgaaagtactcgtacaagtaatttgtggatatagtccgtcttattgattaaccacatcatcttgtcatatattgactttatttgagcgtttttttttggttgtttatatatcaaaagcgtagggcgcacgagtgaatgtaaaacaaattattgtaagatttttagttgcattcggttatatgctcagaacttcagtttccagctggccaggctcatgtacacgatacattcataggtgtgttattggatatgtatgtcgagaatcatgtgcacatgataaatagtgtataaattaaagtataattatttatcttaaatttaccgttattctgtttattttgcaaataacaccctaaaagcgtgataatctgcactgcttatcgcaggtccatccacaaatctctccagggaccaggggaacggttgtcccgaatcgccggcc

SEQ ID NO: 4524 - DNA, 1500 bp, Zea mays
attagaaaaatccacgtatcaaacttccttgagtttgtccttcttgtatgtatgatccaaatttgcaataaagatagtaaagcaagatggtacatcgattgaagacttgtctcgtctatcctacaccaaacatgtcacgctatcaaactttacacatatcggccaagcattaaaaaagaaacatcagctcattgttcttttagaattttaacatatatcttatcataatatgtttattaacttcatagcaacgcacacacatttacctagtaagcgtatataatgttataaataggctagaccacgtgaagtcccgaactagctaaatgctagtaggctgccagaaatgctcgtgcatttgtatagtgggcgttcgatatgcacgcacgagcgtattgttgcttccttaataagcgtaatataataatccgaactaaatatttggccgccagaaaattcacgcaaagagagagataggaaaaggattaggccggactactagaaggaacagtttgcgtcagccagtagcaacggagacttgctatttccaacccccacctaataaactttggagtttggaatgtagtactactacgtagtttcgcatgtgttgttgaacacatgcatatgcctcgtacccgcacaggcacagccacgaatcggtctgtgctacgacaaggattggactaggactagtagcggacacacgggctagcggccaagtagcccagcatgtgcgccgtgcgcgacggaattagccggaaaccgagcagaaacccccacgcgcacgcttctttcccgcacccctcggcagccccccactactggctcggtccacgccacgcgcacggcgcgcaccgcccacgcccagcaggccagcagtccgctccaccgctcccgatcgagacctagcaccgccgccagttcgccaaccaacgcccactcccacacgcgcctgcctgcctccatgcatgatcccagaaatgaagaggaagccagccccgcccagccaagaccaccgcgcgcgcccgggtgcagagcagagacgtgccggcatctctccgcgccccgtcgcgtcacccgctcgcctttcacgtgccgcaatgctttcccctcaccgcccggtgcccgcgcaagccacgaaattagcaagggctgccctatctatctatccggccatctaccttgtctctcgacgctcgagtgtcaatcaccaccgctccagctacgcacagctataaaaccaggggcagccaaacatggtactgctataccgcatgaccgcacctcgtatcgtcgtctagctccgtttcgtttccgggaagcaaccaaccttcgttcccgggcagccgacgacccttgcgccgtcttcgtctgtcaagagtacagtttgacgcgagcagctgccggttccttctctcgtgcgcctttgctagcttgggatcgatcaaagccggtgagcgaccgagcgagcgagtgaggatcggaacatctgccatc

SEQ ID NO: 4525 - DNA, 1433 bp, Zea mays
ggtagctatagatcccgaccgcgcaggcgcagacagccggtcgatcttccctcgccccttcctccgttcatgtatgtaataatctaccttctaacgtaaataattatttctataatatatataccgatcatttttccctagatttaattatattttactaaaaatattgatagtatttacatctctgataagtagttgattaagttaagaataatacatagagagaggaggtagacgaagcacctaggactaggagtactggtgctgcttttaggccctagctagctaaggtgtaggtgtaggtgtagggactaggggactatttgatttgctgtctaacttgtcatagtttacaatacctaaggttagataggtttgatcaaattagacatgtgtttggtttgaagccatagctgtggtaagatttttttttcctgctacatatgtcccactcgtcaataactgacaaaagtgtggcaaaattccattagacgtggtaaactgtggcgtataatttgagcgcctaaccttaaacatcttaagcaagtgtggcataaaattgtgtgcataggtataagaccaaacagctcctaggtcttttgagtgctccgcaactagacggagattcggaggtgagactgcccgcagcggctgccgctcgcgcgctccctccccttgcatgggggctacaggcgcacgcgacagcccgcagcgcggccctctaccgcgcaccccacgccgcggtgctcctctctccccccagctgcagcgcgcgctcccccttccactgttcctgtgggcccgccttcaattaatagtagaagaaaaattgatagtagatgaaaagtagttatagaaaataatattttatattgtagtggtgtatagggagagtatttagagggaaccactgcgggagatgaaaaagtaggggataaactattgatgatgtgacccagaaaagtgatataagggggaaaaatttagagggaaccgctgcggatagcctgatgcgaggagagagaagtagtgtgtgtatagtgtactcccgggctctattcaagtagaggtaaaaagcaccttgtgttcttgcgctttctagcttaggaagctctccttccttccgcgtagcctagacgaccactgtgcctgatcctgtccgcccaagctcatcaactccgctccactctcaaagagtaagcgtggcgtcgccgtcgccgtcggggcggcgcttcccgtcggacaccacggcgatcgcgagctggcttccgtcgcccgccggcgccggccggggggacgacctctcgctgggtttcaatgccggcgccgcctccgcctcgtctggcgcctcgctggcggcagggctctggggctccgcggcgtcgcgccaggccgccggctacggggcgataggcgccaccggtgacgtcggg

SEQ ID NO: 4526 - DNA, 145 bp, Zea mays
cattcaaattaaccctagctgaactgctcgcatgcatgcaatggcgtacttgtacatgcatgcatgctagctagctctcctctttgttatatctcctgcatgcattccgcgcttacacacgtttgctccaagttaagttaagttg

SEQ ID NO: 4527 - DNA, 1500 bp, Zea mays
aaggatatatggagacacttggagttgcaacgattatttcagcatacctaagtaattttacctcttaggttctaatgtatattattgactatagaagtttggttgcctaaggttttgttaggtactgcttagaggttttaagttaccatgttgtttgagtgagtttcagatctggaagtccataaaattgttcagttttctagatgaccaagtccctgtatcagattgggatgacacaggatgtgctgttttattcttgataggataaggggactgtgcaatgggtttgtttgatttcagtcatggaaggccttgatatcctggagtcctgaaaaaatgtttaaaatatgaattcatcttctaaaggaatttaagtagagaaataatcaatctgccaggctgccactttgcgcgatgtgtttagctattaagagcttgattgtttccagtggttcctctactagaatattttgttccacccagtcgttggtcagatgaaaaataaccattttggtgattattgaattgcactcacttcatcggttccttttttttttatgctatctatattgaattgcgctctcatcctcagtacttgaaagctcagttttcctttcacgtctttctttagagtactgtgaaaaatacgccaaaccaggggatgctggtgtcaccccagaagagcagtccagtgacgaagagctgagtgaagatgaagacgactcgggtgatgaggagataatgggcaaaccagacccatagtcaagttggcacctactatacctgtaatctgcacacgatgtttactgcagcaactgcaattaaacaccccatgaacatccgcgtgcagtctgagtgccatgtaaataaactgcaatttcaccaattggatttccagcataactatgtcttcgaatcatgagtgtagtgtaggttcgtgcgtttgaattggctgaaggtttcaatatttgtgcaatcattagcagaactgcagaagcaagttcctcaatacagtaattcagatgatgttggcgtagacctttttaagctagtgcatagctaatgcgcgatttaagatactgaggggatgcattctgctgatgcatgaactgaacctggagaatctcttcaaccgtgtggagattagtgcttcgtcattgtttgcattgtgaggattagtcctcttgtttaattgaaaagtactggcgcattaagggttggccttggtaatacataactaataatagtaacgcatgcaatgcagaccaacatgtcttccatgcaactcggggatcagaagccacgtggctactttgtgaacctcaaatcctctttgagattagaggtgattgagatagaaatgaactaatttattctctaatcccctttaatcccgaagtggattcgagtttccatactagcccggaaggtttctggtttggttagccacgcttggttcgttgggggtgcccagggcaagcaaaccgtctcctcactcac

SEQ ID NO: 4528 - DNA, 1500 bp, Zea mays
ggtatattttgaatatccacattaagatagaaaaaagcaatgtggctgatggatggattgtgatctttgggggatagaacacatgagcactaaggatctattttgttcagatgtatattcatgaaaaaactgattctagctgtgtgagatgtaaggaagttgatgcgagatgattgttgtggaaaaactaaaatatacgtggtcgaataatttacgatagtttcgtgtaatacggatgacactatatatagcacaaatttggaaaatctggggtagtggtgatttcgaattaaactacagaaatctatttagaaacctgttctgttgttgacttgttgtacccatttgattgcaattacaggtttttaacagtgaatttagtttaaaaaactgaaccaaacacgttttaaatagacggcttctctttgtatacgggtgggctggctcaaccagatgcatccaacttttctagactaatgggcttctaaggaacctatttagcccagtgagcttctaaagcggcgtttaggtatccagtttagccctattgctcacgggcctcagtatctttaccttctccgataaatactaatgtgggtgggctgtgaggaactccatccactgcgctttactacattttacgaaaaattgaacaggcctacgctacgcgctcacgacacgagtactactcctaagcctctactctagcagtggatcgggttttattaggaacggaacggaatgggccggagcgattcgctcgttggggtcggcacttcgaacaccgttgagacgctggcacccagtcgatcgtgttaagtaatactagttaatatgtgggtaaatactgttgagaaaccctaatgaagggttatgtgggcaaataccgaatatgcccctgagggcaatcacgtctctatatatagaacatgtacccctcatatggaatagagatcagaaagaggccagaggcccaaccctatatccagtgtctcgtgtgtttcctctgtcctgcttatggaaagggagacgagttctatacatcttcttgcgcctctactgctgacgggagggaagggagcggatctggtgatccgtggtaacgtagttctcaacagtcagtataggtggaaatagtagtcgaaaacctctgtttttttttttgctaggtacaaagcaccaatacatataagaacgttacatacatgtacacgatcaccatgtgatctagaggtgtaagctatgtatataaaaacttaaaaaggtttaaccttgattacgaattcccacacgcctcgccttattcaaaaatccaatcctctcgggaggctttttttttaactgactcaactagacactccactgtccttggatctttaaagttggtggcactggcgcctgtaacgtggtaccccaggacacaaacacggacaaagcagggagtgcagcaggagagcattctactacagcgcaggtgtgcagcataaagcggccggccgg

SEQ ID NO: 4529 - DNA, 1500 bp, Zea mays
gtaatcacgttttgtttggaaggcaacaaccgatcgtgcgggcccttggtccagcggcggcttcttcgtttgaccgagcggaatcatctagcgtgcttgtctgtggctacagagaggggtggggccgggtgggaggtgcagcataactcagccggctgccgctggggcaggggcgggggcgggggcggggcagatgccctttgaatctcctcttcttgtttgacaagaagcgaccggctttagctgaacctcggctggtgcctctagctactcagcgggcggcagatgcgaggaaaagcgctagctagctacaaaagtctgataggcggcggcggggaacgcgataccaggtccggtccaggtgtcttaattcctcacgcgcagctgccaccaactactcctagctagcgctacatctggaagccgatagaatgtgcaaacctgcagcgggcggagctactaggcatcatcatatcaggaacgtgtcaaattaagatcgaccaacagttgttggcctggggtgatggctgtggaggagaagctatagcccccgtcctcttctagctattagctgtgctgccgttcctcgaacttgtcgatcaaatggcatgcacgcatgcatgcgcaaacgacctgtcgatcgtcagccacggctccattagctaggagggataatcactcagctgctgtcacaggcggctcacagcctactcgatcatgtcatgcatgcatgtacatatacatcgttgacgatgtctccatttgttcttctcatcgtttgtgttttgcgttggggtgtcgagttggttgagggtcctctttctccgcttttttccaccctcattggttcaacaaatatatgtaacctcttttttttatgtattcatccgaccgatgcaatcatccatgacattacactactctcacttttcaacacgttgcactcgttgaacgggatacttatgtacgtactatgtatatatgcgacggcgggttgaaagttcttctcctgctatacattttgcatccggacgaataagacgctcgcgcgcgctcgttcgtcaggttctatccggctgcaggtgtttgattaatttccacctcacgatattgcccggctcgttcatgccagctgcgtacgtcactacgtctctcccccccccccccccccagcccccagggcccagggtcacacgcacgcctccccagtccgtcgtggcctatataagcctcgccacctcggaaccgataagaatgcagcaacgtaacatcgcggtcgatcgagcgcacaagctgtcaaaaaaaatctgaacacaagcagggccgggttcgcaggcgcgcgtcgccgttgacagcaactagcatatatagctagagctagctcgatcgatctgctgtgcttacaccaccagtccaccgcttctcttgctttgccggtgtcgtcggccagcgcgcgcgctagcgctatccgatccgatccggccggccggcgacctaccg

SEQ ID NO: 4530 - DNA, 102 bp, Zea mays
ggtggaggccctctctgccttgttcggctggaccctccctgccgacttggagagttagtgctcaggtcttctctgtctgtagttggttgctgaaggttgttg

SEQ ID NO: 4531 - DNA, 1500 bp, Zea mays
aaaatatactgttgctcatcttaactgtgaagaaggttttttctaacctatgtaattagtactacactaaaagtaataaacagttgtacaactaaacttctcgtctaatcgtcgtacgatcatattatcaaaggttataaaatttataataagtttattatttgtctgtcaatatatcaaaatttaattctaaaccatttaaaattaaaagatgaaaaaatgaaaatattcgtgattttttctcctttttatatgtcttgttatagtgtaaattagaaattgtaatttgatatattcatagaataaataataaagtatatataataataataataataatttccgatagtttgattatatgatgatcacatagaaaatttaattgtcaaatacttttttcaccactaaaaaataaattagccatgaaaaaaccacgctatctagtttttataataccttttgtgactttttattaaggttctgaacagtttattagaatatctattagaatgcgtgtgtatgctatattcgcacttcatattcagcagatgtttgcatagctggttttctttgcacccctaaaatagcaggtgttaccaatgaaaaatattatctctgtatccttgtgtaaatagaattacggatggaatgaactttcagccagaaacaatacaatattttcgaataaggcctagaccaacttcaataaaacgtataaatgttttgtattatagataatactgtttataaaatgaagtttgaattatggattattatagatgatattgtttataagatgaagtttgaaatagggattaagatagatagtgagataggtagtcaggagatagtgtaagagttatatgcatttctttcgattaaatggaaaatgatccttcgtggaccttattttagagcgacgcaaccatgctccatgggcattcaggctcagcatagcccaagttttccggagagaatgctcagaattcagaaatagaatggccacgacagttgttgttgtaacttgtaagtccgcacggcgtccacaccccacggtgcatgcacgtccaggtccaaacagagcgttgttttccggtccgctccggcactactcgtgtaatcgtgttaaacgatccgaacttacgaagcgctggacccaacaatctcacggcccacgatagcctccactcaagctcacctgtttccaccagcccaccaacacacgccacgccgtgggcccaaacaatccccatccgtcggatcacctccacaaaccctagccaccgaacccctcctacataaaccgctcttcccatttccctcgccctgcgccgcctgcgtccacctccgctcgccgctctccccgcgtatccctctcatacgcagctcgcccaggtaaggtaagccagcgcgccgcacgccattgccgccctcgttgtttacttcgcgtttggatctgtggctgaggagctgcgcgttggttggcctgtggccatgcag

SEQ ID NO: 4532 - DNA, 1500 bp, Zea mays
ccaacgcctaattattcaaattacccagatggtcggacgacgagaaaaaggaggagggataggtcaagaagggatcggacgtgattatttaaggcttgttcgcttatggtggaacaatataatgccagctgaaactattaattccggatgatcacttatcatataaattagacaatcaactcgacagagagaccaatatcgactccgcgtcaccgagatttctttaccgagtgtaacatttagtaaatctgttactgagtgtctggtacactcagcaaagaagtcatggtttcacaaagttcgtcccgaataaacggatggatggatgggcggggccctcagtcggtattaataatcccaatggatggattgatggattgatgcattctatgcgtgattggaaccgcactcgacagaggagaggtgtagccgaataatcgcagcactacacgtacacatacaagatcagcaggaagtgtagcctctagctagctagttgcacaaggcatgacaacagccttacctgtttttctcttcttgctcttaattagcttccagagtagtagtagcagcagtatatagctagtacgacaatgcaagttaataaggtgtgtcctaattaataccgtctacaccaaaagatgcgacctttttttcttgagcgaaagaaaatttagatgggaacacgaacacacatgatccacgcgaagctacatattagccacatgtgcagtgcagctagccctccgatcctcatcctcctaaagttgagagtactgcactttgcatgcatgccctccccaacttcctagttggtagagtagagagcagcctgcagggaacgcagcagagcaccctggccatcggtgcaactcttggtagctagctgtactgtaggcggcacctttaatttgctagctttggtttgttcctcttcttctcctctttggatgattccaaagcttcatcttaccttcctttcttaccggccggccggctcgatcgcgcacggctgtgcaattcacacccgcactttagttagtttcacctccatcggtccatccccggccgccccgccggcctcatcgtcatcagctacagttagctgctgccgtctgggtcgcctcctctctgcacgcggctagctagctgctagctctcaaggccggccggcaggcaggccgccttttccccttgccgttgtccccccggcttagctaagaaccctcgaaaagacgcctcaccatctcctttgtgtccttgctaactaactccccattagatccttcttcctccccgttgtgtccagttgcttcataagctacccatcgccaattcgccatatacacacatacccaacgacgacgcacgcgcgtgcgcaaaccaccaaccggagcgagcaccaagtaccaaccggccggcccgcccagcaagcaggcggctagccatcgacgaccgagcacatcgagctgcccccgccccccggccggtcatatatat

SEQ ID NO: 4533 - DNA, 1500 bp, Zea mays
ccatacgctcggctccatgcactccccgccacccaggcccacatccaatcgatctggtcccactgcgcagtacttataaaacctttctcctctgaagctgctcttctggccttcttttcccggccgagaggcgagagcccaaacccgcgcagacgcgcagtcaagatttctcgtcgtcgtcggcaatcggcaacggcaagacaagaactcgaaccccttcgccgcttcccctctcttcctgttgctccccgccgcgccgtcgtacgatctcctgagccgccgggcgctcacgtcgactacctttgcgcccgccaccgtgcaccgctgcctccagagcgtctcaggtttggcctcaagccccgctccgcccgtgcagaaattttgtgtttcttggttcttcatttcttggatggtgactccagcgttcttgttcctcacttccttgctttggggtttcatcgaattggctcgcggagtatggcaggcattttgttcttggtctcccaaatcccaatggcggagcgctagggttctcgcactgtttatttgggcattctttcttggtcaatgttgtttggactccacggaccggatagatatatattgtgggttcttggttcatttctgaaaaaaacaaaaggttcggcttttcttgcttttagtgttgaatcgctcgatgacaacaaatgtgattctcttttcctcagatagatcagtatttgttagccctttgtgccaatgtcaatccatcctagacaaaggcgtgagttcttcgcgcctctcccaaaaggcatttatctggtcaacattcgtttcccctgctcggtttgaagttttgaacaccaagcggatgtctcgtagttcattcgtaaataagcacaatggtcaatggattatgttgatttttttatccttcttagtcaactcctcactttggttaggattcggatcttttgagttcgtgttaagcctcgactatgaaacataaatagttcttccactttcggcttgctcagtcaagatggaagttttgacattaattggactgaactctccgaggtcagtgctgttggttgttattgcaacattccttagttattgcttattaggtaaattcatagtgttggccaggttcaccaggtagctgcttgcatcaaaatttcgttttactgttagataaaggtctggtcaattcttggtcgttgtcaagtatgtctgttaccgaattttggcaatgctgattattcactatgcaaaaaattggcacctctgaactctgatgtttccggcttcatggaatttccagcatagaactcagatacagccaattttaagttttttattattttacaagaattgtcaagaactttttttgttgccggaaagtttgggtaagataccattattatcttactattgcagctgccaaatcttcagtgacatatttgttactacctgctagactccaagaaagggttggttctttcagtgtggtttcca

SEQ ID NO: 4534 - DNA, 1475 bp, Zea mays
gtgtgctatagtagtgcaagctagccgagagaccagttgtacacgcctccacgagtccttccggagcactggatagggcacaggcggtggcagggcgcaaagcttgtgtgtcggctcgcagctatgcctcgacggaaccctggcacatctaatcactccggtctagggacgaaatgaatggaggagaggggagtgacagcttgggtttttattggcacgggataaggggaggttgttatggtccccagtttgagcgaatcatggcagtaggtggttacgacgccggtgcttgcgcccgcgtttaaagaaggggttgaccccccatgtccacccattggtgacacgagaaccgttgtggaggcagcgctgcccagtcgcgtgggcccatgtggcggtggcattgcgcaagaccgcactctctcgtgctggaggcctggcatgcgggccccgcctgttggcacaaagagcccaaggccagcgcgcgaaggaagttggactggggtttgctgggccgaggggggcgaatttaggcccaaagcgaggtctggcttctctttttttcctttttgttttcttttttcttccctatttgaatttctattctcaatttcaaatttgtttgtgagtttcgcacagagttcaagtgcacaagcaaaagtaccagtatcatgaaatattttattttagtttcttatttattaaggaatttatccatgttaacttgtatgtgtgtgtgtgtgtatatatatatatatatacacgctagctaaatgaaagaaagaaattcatgtaatatacattcaaaattctatgtcctttacttactataatttgatattacactcagccatgattttgacataattttaatctggaccacacaacatcggatcttaattttcacatgattattaaatcaaaccagtataaccatcattatattattagattaagctagacgcaaaaacaatgtcagatcaaactagatcaatccagcataaccatcaaaattttagattaatctagaacgtaagcacaacatcaaattattagattaatctcgattgcatagcataaaatcagattatcaaatcagatcaataccgcataatcatcagatttttagattaatccagaataattatcagactaatagattattagattaatccgatgtgcaacatgggattatcaaatcgatctgatataatgaccagatctttcctgtacgcgttggcttacaatgggcttacgaacgcgaagcgcatgatccggggatttgaaagacaagactgcagcgtagacaatatcggcggctagggccttttttttcgtcttgcttcgtgcgtacggcagctagggttccctttttctgtatggccggcggctatgcgcgaatttatatgaggcttttaaagaatagaggagggtacgtagccatggaagagcagcagctccgcgcccgcccaaacatg

SEQ ID NO: 4535 - DNA, 800 bp, Zea mays
ccttcctcgtcgtctttttatttcgtgcaaagacccttgtggtatctcgttttcgcaacggacgccccgctgcgctgcgttttctgatacaccacaccgcaccactttttttttttttcggaaggcgttgtgcgacatggaggagaggggcttttggctaaagagccagcagggcgccgggggcggccggcgaagcagcagaagggaacaggcgcaccacgggactgggagagagagagagagagagagagagaaagaaaaaaaaagcagcaggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcgtccgaccccgccacagaaggccttccagaaccctccgacccctcacctccgccccgctccactctcctcctcctcccgggccggccgactccg

SEQ ID NO: 4536 - DNA, 1500 bp, Zea mays
cggatagtccggtgcaccaccggacagtgaacagtgtgcgatctccttccttttctagcaaaaccaaccattgcagccacagtccccttggcacaccggatagtccagtgcgtcctggtgaccgttggtgcgggcctcacgtcgcccgctgattgtgctgccgaccgttggcacgggcgtggctggttcaccggacagtccggtacacaccggacagtacgatgcacactgggcagtcttgtgaattataaccgtggctcccccaacttttcccgagagcaacaagttcgttgcatgcgccagcctgggcaccggacagtccagtgcaccgcaggctagtgcaagtatggctggactttgccaaacttctccaatccaatctcatttgatttgacaaggttcctagcacttagaggaatatgttagtaccaaaaacaattcactaaggctagagtcataccttgattcttgatttgcatctctttgacacttagcgcatatcaaccaaaacaatatgtgtttgtcatctaataatcaaaacatttatagaaatgactcaaggacacattttattttcaccaagggattcctatttcccaagggaaaataaactaatatcccttgagaaaataaaaatctctcgggaaaatgaggttctcaaactagccctcggagataatttttttcctatttacactaagtggggaagaaacttccttatccccatcctctaggtcctgttcagttacatacggattggtgagaattaaattggactaaattctcttttagagcatgtttgttttaacccccattcatatagattgaaagagattgagtgagtttcaatccctagtaaaccaaaatctcttccatctatatcaatcaccttcaatccatatggattggttattcaaaattgattcatcacatagaattcaacacgtggaattggaggtcggattccacccctctctaaacaagtagaggaattcaattggaggtcggattttcattgccatctctaatcttgatgggaggcttaaacgaccaaattttttttttttggacaagagagtatttacgaatgaacttcctaaactcatctcgcccgctgcctggtcagggtcaaccattcggctacaccggcgcgcccgccacccaaccgaacccaccttccaccacacccactggcagcccagcccagcccagccgcgccgacgggccccgcgcgtcattctctcacagctagctcgtcccagcgtcggcgtcgcggaagaacgctatacctcgcttcgccgctagtccaccaccacctaacaccaactcctctccaacctcctcgtcccgtccccgtcgattcgattcggtcgaagcgggcgggcggaggaggaggaggaggctagggattccggatgggcgcggcgccgaggaggctctagaggcgccagccgagttggtggtccggggggagagggagcggcgggagggcgggcggcg

SEQ ID NO: 4537 - DNA, 111 bp, Zea mays
cacttataagacctctgtcagaattcaatgtcagttacataattcagtttatggtacgtactcctgagtaaagccttccgagttgacgccgccttggcaccctttgcttcc

SEQ ID NO: 4538 - DNA, 359 bp, Zea mays
cattctgtatgctaattctctaaaatgtgtatggctgaaatcgatatatttgcaacatacgaatgaccttttttaacaatttgatggagcagaatggaggataatctaccagttaatgtccgggaatatcaagaacttgctaagaaattaattctaaaaaaagtcattacacgctaagaaaaataatgtgcaagctactgaatttacaatcaagcaagggtcgaggagtgggagggagggtactgggccctaaaggagaagtaccgaaccgggctaaacccgcaggagaaggtgaagctagagaaggagcccatggggcagttcgtggatgacgacatcagggacctgccaagatctcc

SEQ ID NO: 4539 - DNA, 1473 bp, Zea mays
attacccggggaggaccggtaacaagtttctacaggactggtattaaaccaacgactcaacatgcatgcagccagagttaactatacaacgggcccatttgctgcctctaagtatatattcttggatggatatcttttggctctaacgatattattataataactcatgggtaaggttatgggtacaataatggaaacttggatggatatatctggatggatatatctacatatcaacgtctttttagattatctcatgtataatgacatgcaagttttttatatgatatggaggagagatatataagtgaaaggaaataaatgcgcataggtcattattgtttcatggaccaaccatcttgtgagtaagaatttagaactacgaggcaatgtttcactatattgtttggtttgagaaaccactccatccaaaataaggtggtgcagtatggatcaatgtatttctcaaatttggtgggaatgatctcattcctaatattagtactaactaactatgaggaatgaggttgtgatggatcaactcatgttattccataaaccaaacaaaaaaagtgaggagtaagaagatgatgaattagctcattctcaaaccaaacaccctatatataggtctcgtggttatgtgaatatatgaatcgtctgtatatgagacaacacaaatatacttgcatatgtacccttgaatttctgttatttgatttacaaatggcaaaaaaatctgccgggtgatgagatttatctgcggagaaaataatgccaaacattttttttaaaaaaaaagcaaagaaaacaatgcagaacatttcatgcagatagtgtttcacaagctgtatactagcaagagataaatataattcagttggaggatgtaatttgatgttaattaggtaagtctgtaagcactagagagagtttgtaatgcttatgcactgcctttccaaaacagctggatttgaactagggaacatgtagggatggcaacgggtttgaaacccgcgggtaaatggttttcaaacccgcctccgcgggtttaatattaaacccgcacccgtacccgttacccgcgacgggyacaatatgctacccatacccacgacccgcgggtgccacaaacccgggggcacataattatacacatatatttatacatatatcatctatatatacatatatttatacacacatataactatacatatacaaatatgtatatatataatatacacacatataaaattacatatatatatatatatatatatatatatatatatatatatatatatatatccattgcgggtacgcgggtttgcgggcacggatataacattttcatacccgcgagaaaaaacccgtcgggttgagaatcaaacccgcacccgtacccgcgggtacaaactcacacccaaacccgcaccctatagggtttttacccgcgggcacgcgggtaaa

SEQ ID NO: 4540 - DNA, 448 bp, Zea mays
caggtatgtgcagaagaaagctaagaaaaaaaatgaacgggatacacatcatccatatatataatttcacacaagtaagctaccagtagtctaccacgccatatatacacacacwagcgaagaagaagaagaagaaaactctcctttttgtttttttccaccacttctggtggtgttcttactgttggcaaactaatctgtccatgcgctggtgaatgaatcttttggtcaagtgctaggtgacaaacaaacggcatctacgtagcgcttggccgcaatggaacgaacgacaagtcacaaacaagacacgtgacactttcaccgtgcaccttcgcgcgcgcgcgcacacacacacacgacaaagaaaactaaccacacatcaccatgccgcaggcccgcaagaacatcgcaaaactaaccgctgtcaccgggcccccttgttttgcag

SEQ ID NO: 4541 - DNA, 1475 bp, Zea mays
gaccaagctaaggatggkcccgcatgtcagccacgtataccggagaagaagcattagtcatgtcatgtctgtagactgcagtcggcgcaacgcccttctctctagatccttgggaaaccacgtcggccggggccggctttcatcctctgttttttttttcctcacagcttcagactggtccggcttactctgtcatgagtcatgatgccgcttggtgcttctaaagcttcacagagaggagaaatggataaaaaaggctcttgagacttggctatcacacaaagaaaactgaaaggaaataacggccacgtctcggttgtggcgaccataaaatctgggattcaggatcgacgagtgaccaatgactttggccacaggacttcctccggatatacatgtgtatatatgacgatgtacgagttggatcagtgtaagctactcttactgctgatctcacgtcgcacgtcttgtgattagccagccacatgcttaatgcggctaatttgtgggagtgacgagcatggaccgggtacatctggccagaagaattcagacactccactcatcagtttcagcttagaagaggtttcatcgcgatcacgagctcatcatgtgggctagatgccacggaacctgaccagaagctcaccggagaaagcacaagattccatataacagaattcagtttgcgaattgccaatttctctccgatgcgccgattagcattcgccgttgagcctttttggcttttgctgtggcccccgacaaggcaccatgccaagcccctcgttgctttgcttcccccaggctgcaagatcctcctccgccgacctcgaggagaggaggggaacatgaaacacgcgcaattgctgctgagctacttactacacacaccgcagcggtgcacaccacgtccacagtccacacgcgcgcgcctaggcctagcgatggagtgacaggcatcgggttgcttccggcggtggccattgccaaccccgccccatctccttcgtcatgcgtacaagacatccccacatcgccgctcctccacctcctcctcgcctgacgtcatccccgcactggcactgcaccacaaatccatcccccctcccctcccggcccctgcattgcatccattcttcttgcttccccgaaacctcgcgcttggtctgactgacctgacgcaacgcgtcctcgatccctgagataaagctcgcggcattcgcttgttccgccaaattcagtcctgcttgaatttcctgagctgtcgaagtttttcttctggttcgattcttcggagaccccctggcatttgtgggttccgccattgctcgctggtttgatccgtcctagttgccgaagcgcctgttgatttggttctaaaatacatcgttcgtccttccaagttcaaaaggggggaaaaggctcttctttttttggatcctgatttgagtgtgtcacctttgcttccggca

SEQ ID NO: 4542 - DNA, 97 bp, Zea mays
tcgtctgcgctcgcttctcctgggctgtgctgtgtctggctctgcttcgagttcccaaaaatctgcgctccgagttgatggatgatgtgggataaga

SEQ ID NO: 4543 - DNA, 558 bp, Zea mays
acagatacaggcggtcgtcgtgttggcctgttgggagttggaacgcaactatacaaaagtagcacgtacgtacgatcccgtccaactgagcaacaaataataaaacacatcacttctcacttctcagacagtctaaccgccctaccacactccctaccgataagaacggagccggcttcgtccaccagtcgttggcgcgtccccatcggctccggcaggctgcgcacatcagccatatgatgatacgtttcaccgagctttcgcccgctcgctaactaaaccaaccccgattcactctcctaattggatcacccagccgaattagcgattaacctcccaaagtcaaaaaggcgacgccttcacccaccggccacctccaagccacgccacgcccgctcaaaccgcatgccttttataaacgcaaccaccgcgcggtgcctccgtgcccgtgccctcagctccacctcgccagcgaccgacaccctctctagctccaagtccaaggctccccttcgccgctgctagcttagctccccgaggctgctaactaagagcgtc

SEQ ID NO: 4544 - DNA, 969 bp, Zea mays
ctcgagtaaatgttgcaaggagctttttatttcatgcatgctcaagcatgcttgcgttgcaagtttactctgtgctcgcctctgaaaagaactagtacccggcccgctgtcgtcttcctttccctccttttctggttccacgaaggagagggaacactaggaaaccaagccagcatctgatctttattagctgcttctctgttcctagctcctcccatatgggagtacttcgccaaggcaacacacggggcaaacaggcattgcgaggtaagaagtccagcatcgattggtcttatatgcactccgtctgggtggatttaatttctgtttgtatatccgattcggttgcgccgctgttcttgttttctcgccaatttataactttgatctaccaagaggcactcgtcatattttactagtttacccccatatccagactctgggtcaagctcgccgcattttgtctatgtatcagatctaccctaccgccaacccatgcgttgcaatcgcaagtagtagacgtgagacaggacttgatcgtccaaagacctaccctttcttcttgcttgggattgcactggactagactccattgtttgaccgcggacgatgcagatgtttctgatggagatggacagacaggatttggaccatggatgccctgtcggcccaactcccttttcagcattcaatctgtcaacccacagcggagctagggacagttggtctgcgcaaaccaaagtagacttgaaccaaggacctactttgatgatgatttattagagttttctaaacagaaggtcgtatatctctggttcctgtgattttgatagttgctaataaaataaatacgtaatcaataaataaaacatgatgtgattttgacttgtgtgaactgtgaactgattgtcagaactcagaagctgctctgctataatggctctgctataaggtggagaagagaagccg

SEQ ID NO: 4545 - DNA, 580 bp, Zea mays
tctcccttggcttccccccctccactttgctcgctgcttgttcgcttgcgtgcgcgctttttactgttccgcagtcagtcgccaccacatccattctccgtcttcttcctcgcccgccgacccctgaccctgaggccctgaccaccgccgctgcgcccgctgacatttgtctccccggtcgccgaagaggcgaacgtttacgttgctggattcgcgtttatcttcccccgcattacttaccgttgccccacgtcagaggatctcgttccgctcctggagcctgcttggcttctcttgacttgggctttcgcagcgctgctggctgttgctacgtcccctcgctcttcctctcctctgctctgctctcagggtcgcttccttcctctgcccagattgattgttctcgaggtacgcacgcacgatgctgcctgcctgctgcgcttgattaccctttcccgtttccccctctcacttccagaaaccgagcctctccaccaggttcagatcttggacttggaccctttcgtcggctactcagagttccagaacccgtcccgcgcttgttccagcagattcagag

SEQ ID NO: 4546 - DNA, 197 bp, Zea mays
tgtaagtaatatgcaagtgagctctttttcttgtgttacttcttgcaaggaaggttcattgcttatgttcattttgttactaccaaactgtcacttttgcaagcagattgcaaccacaaatgattcactagctctgttttttctattgtatcttttaggttgttcaagttgtgctggaaaactacaaaccttagagg

SEQ ID NO: 4547 - DNA, 1500 bp, Zea mays
ttggacggagtgagtacatcttaatggaataatggttaacagcaatatatagtagcaaggtttggtaaaataataatcaccgttgtttcaaacccactaaggccttgttcgtttgtgccggattggtgggtcggaacgattcctaaccggattgcttctctaatttatataaactttgattagctggaacgattccgggtgcaatccgacataaacgaacaaggcctaagggtactaggcaatagccccgctgctagaaataccttgatgatttggctttggcagaattggggtccctcatgagaagagtgggggtaccacctatattgctcttcttccactcagtgccaagcaaagaaagaacctctaccatactcacattacatttcgttaagtcactctaagggtattgagggacccaatcacccccattaaaatgatacttggatagagaaatcccttttggtttggttcaccaaaagggccatagaaaaacccttctgagtgcaggagaaaactaatcgtgacaaaccgcataattcctcttcgaaggtacaaaaatggaccctctggtgcaattttaaaaaaaaagagaagatgggctccatcgtgagctcaagtgctactaaattccaggatttagccctaaaagaactcttccaagagccgattcttgtctccttcagggggatggaaaccatcggacctcaagatctgaattcaatgcaatctatgatcgccaaagaagccattctaagggcaactaggactctcctttaaagaaaatctctcatcccaaaaagcttgaggactggattctagtctgcactaaaaggatcaaaccaatgaaggatcaagggataatttttgaagacgttagagtccgacttaggccccgtttcaatctcatgggatcgataaactttagcttcctgctaaactttagctatatgaattgaagtgctaaagtttagtttcaattaccaccattagctctcatgtttagattataaatggctaaaagtagctaaaaaatagctgctaaagtttatctcgcgagattggaacagggccttagatatactgtgtatgtgttccatgagcacatgatacgttcccgtgtataaatacatagcaaaactatctggaaaaatggaggaatagcatagatcaaacacgtggttataactcgtcctaagcatcgacatcatgctgataacacctccccctttgattcagtcaaaaataaattccaacccaatgatatcctggaaccaccctgctgccagatttccagtcctccctgttgactccttgctctactactactagtagcacagtagtgttaagaagctacgtcacggatccgtcttgtccaccactgcggccgcactagtctacaactaccagcggtgcctgcaggccaccgccggcgcccgcgcgcggaggaagtgcatgcagccaggagagagctagcatagcagctaggagaagctaacc

SEQ ID NO: 4548 - DNA, 531 bp, Zea mays
ctaattttttttttacccaaaaaatattatggttttggtaaaaccatagttcaaaatacaaagtttttatatgtgcttgaaacacatctgatctaaaataccataatatactcaaataccatgatattgtctagtaatgtgttgccaaagaggccctacctaagtttacgactgcagaggtcggccagctcgaaggaacgaaaccatataacgacccacaagccacaatagcccgacttaatcacaatccaaaaacctgagcccatagaacagaaatggcctggaaaggagaatgaaacaatctcagcccagcctactatcatccagccgcgacgccgtctccgcgccgcctatataaagaccccactccactagggtttctcgtcggtagccgtcggttcacttctccaggtaaggtaagccagccccgcgccgccgccgccgccgccgcgatctgaaacctactttctctccttgcgtatgccctcatcctcgcttctttgtttggcgcacaggaaagggttcgtactc

SEQ ID NO: 4549 - DNA, 1139 bp, Zea mays
ggtaattttagtgaactcatgcaatttattttattacaagttccaggtgtaaatttaagtcattttaggatgtgcactggtttgattgagcttttttgtttggccacaaatacatgacaaattatgtagattaagaacacataattgatattactttattcatcactaaacagaatgacttctgcagccatatgatcatcccctattgagcagggagtgtatatgcatgtagcaataataaatgtttcttgattgcttgcctcacacagtggtcccggatagttatcagattcagatcatagttagatgaatacaaaatcttctgcatacattatttattctttgctacacaaattttctttccttggatatttcttggaaatgagaccttttctttttggacaactgcagtataataatatattggtacagaacatgtttcagtttcatgtaatgtgttatctattctgaactatgaaacttccagaactcggtatagatccatggtccttgtggattagttgtaggatgcttaataacctgatccatactcttggggacaaatagtaggttggtaatggcactggcagttgaggtgctagatctcatgcttacaccagagaacctgtcacactcaaggtttagtataagtcagctttgtgggtttaatgagattgaatcccattcccttaaatattagctcaagatattgtcatttcactcagtaatcttttcactggtagctgcaaaaccaaatttctcgtgtataagcatagtggagtcatgaacccacgatggaacgtgtccttgtcttcctgaattaaactaatctgcactgcctgttgatctggtgtttgtatcaaacacattatagttatagtacaagactacgatacctaacataggagtgaagtatcgttgtaattcatattacttggtgtaggccaaatccagatagagatgcatcatgcatgtgcatcgttataaaatcaaatacagttttgtggcgcagtttatcatggttgggccatttctgaatatgcaaactttataaactgggtgataggttcttttccttcttcaaacattaacatttgggatgttttcattatgaggttgacaggttgttaaactttatc

SEQ ID NO: 4550 - DNA, 1500 bp, Zea mays
tctaatatggggcctcttttagagcccgcgtaaaaaataggctctccaaaattagtttaggacttcttttagagcatgtgtaaaaaattgtctctcaaaaatgaggagaagcctccaaaacaaaagtagcggccctgattgaacgtatcttgctcgagttggtctaagttctctagatttgatggtggaattgtaagaaacacaatttataattcctgccaaaggaatgtagcataccaacacaaagatgtcgaatagtctctatcttactatatagaagcaacaatgagtagaccagttctaattctttctagctaggggtggtaatggatcacgatccatataattcttcactatttgtttgaactcttaattaattttagttcaaaaagaatagaaatagaacttgatcctaatttgatctagtccttaaattttatagtgtgaatttagagtccattaccacccctacttctagctaagttatagtttgttggtctcattcctttttaagaaacgacatggtgtgtttatattttcaaagaacgtttcatctctcaaatttcagtggaaaattgagctaaatatggaagaacgatccttactcaaagaccaagtggtcatttcatttacaaccgtacaacatgcactaatttggtcacatatggtggtcatgtcttgaaagggtcacaaattatattattttatataatatatgaaaacatgatatgcttttgatttttgaagggcacgtcattgtccactttcttatatattaagccacattatcttaacaacaaaacaatagacttcagttttttaccattggaaatatttgccactgaatatatgaatatatcagctgtgattaataactacctgtcaacaacgattgatttactgtgtgcctgcaaggaaataatgtctctacttattgattatatatgtataagcatttatgtcacattttgtactacatataatctggacacacctcagtagccactacgctattaaagacagctacagttgtaatacataaatgttacagttgtaatacatggaggcaaaaatattgtaaaagcagtagaagccggtacgaattaaagccaaacgaacatttaattagggtttctttgaggaagaattagcaagagcattaatttctttttttggaagaattagcacacatacaaataggggtttcattttttgtggcagtgtagtgccagtcataacatggctgtcttccgccagaccgttgtgatcctaaattccagtaagtacgtgctaaacatttatagatgccatccaaagataactggaatccagctgtaaaatagcctgccgtaagctaaactggctcggaattttatataggcaattcaaatctatgaagatcttgggcggtttgcactttgatcctatatatgttcgtgtgcctatataaacgctcgcgtcaacatacattactcatcgatcgactctcatatattagca

SEQ ID NO: 4551 - DNA, 571 bp, Zea mays
ctttgtgttctaacaatcattaccgaggatgccaagcgcgccaagctgatgaatgacctccccgtgctacccatcgtcgagtgggacggaaacccatcgaccagcaagacgatggcctggaagatggagagctgttgcgcccactcgtcgtagccatgggcacaccgaccaccagggagttggtgagcatggacagcgagaagccgacgacatattcgacccagctgctggcagccgtaggcgatcacaccgacgatgatggccatgtttggtgaaataagcttgcatgacggagatgtgtggagaagaaaggagacaggggcacgataggaagaacacatccacaaacgacgattagaaaaagtgatgtcaaatcttcaaaccgtgtgtgattgtaatgccaatatggcaattgaaactcgacgaaggtgatgccaaatatgaaaaaaaaaatctcctcgaaaaatgactccctagcattttgggctggctggctccccctccctccctgggatttctccttgcgtgcctccctcgctagggtttagggttctacagccagatagccacc

SEQ ID NO: 4552 - DNA, 442 bp, Zea mays
ttttttttctttcttatcgaaacagcacagaccagtgaaagagggagcgaattagcgaaaagaagaagacaatataaaaaataaataaataaataactacaccgaatgcagcgagcgaggtggaggtgggggaaaaagggcgaggtgacaccgtgacagagagaaggcgagggagggatcacgaggtgtgcttcctcctccgcccaatcctgcccaaccaaatccgccagcgccgcctcctttacactcccacctctgtcccggagcaaaaaaaggagggagaggctcgcttcttggatcgcggggtcacgggacgcgcgccgcgggccggtacgctgctgctggcggactgctcgacccttgcctaccagctgctgcctgctgctgcttccttggctggcgccggcgagagacggaggcgaggcgaggcgaggcgacgacg

SEQ ID NO: 4553 - DNA, 1192 bp, Zea mays
tttattcatgtgtctcaactatgttgtattgtttctattgggttttgactctagcatattccaattgattggcatggaacaaaaatgtttttctgttgttgtggtgtatgtaaggccctgtttgttttggattataatctctccacattatataatccagcgcaaataatccaacaggtaaaaaaacacctagattatggattcagattatataatttaaagcccatattatgataatctcataatctcctcaatagtagcttatttgagattatttttggcaaaagacctactacacatggtcatgtaaatagaaattacaatatatgtcatccttctttcctcacctcaaataaacaaacaatggtactattgtctttgtgaataatctacatttgtataatctgaactaccaaacagctacatagattataatctggattatataatttagattataatccaaattatttaatttataagctgaaacaaacaggcctaatatatgttgagattattgctaggtctagataacagtactaatgtgagagacacaagcatataataaatatacataccgtcactccataaacatacatcatcgtcgactaccagagatgatcctccagttagtcttcaattctgtccattattgtggattataatttatatgtgatattgcagaaaataaatgcacatatgagtcgtattaagagtagtgcactagtgcatatattactagtgcatagcagctcttcccaagctagctagcgcttgctttgagagcaatcgagcgatccctaaaaagcgatcctcgggatcgttatcggcgcggcgtagaaaagtgcagctgaccgctgggcgatcgacctcagctccctccgcgcgcgcgcgccctcatggccgtgccttgcgtcctacgcgaccaactttatccccgtccaccgccgtggcggccggcttcaacgctcccccaccgccctagctccgaacctctcctgctgctgcctacagcctgcagctagctgcctgcagtgctgacgatgcacctgcgacctgcccatgccatggagggaggtcggccgcgcgtgtgtgtatatatacgcgctacaggcctctctcccgcgtcaaaattgaaggcttgatttgggagcttaataattactgattgattgaattgcgaagcatatat

SEQ ID NO: 4554 - DNA, 1500 bp, Zea mays
gccgccgtttcttcaatctcctcgcagcactggtgctccatcttcgctcccttttttacctgcgatcggcacgcaggcggcggcggcgctcaggctcgggctctgcgactgcgtcagcggcttcctctccggcctccgtcctcccgccagtcactgcgcgccctcgccctcggtcctctgcacagtggccggtgaccctgcgtgcttgcctttctctctcctcccgcctccggtggatcgtcaacggcgcctggcccgggcggcagcgcggcgcgcgtctcgagggcagcgggagccagcagccgctgctccaacaaggcggaagcaaagcgttacccttccttttagcgcttcagcgcgctgacgtgtgcgcttagttccgccttttggaaccctaaaccctggtaagagatatccttgcgctttattttttttagcttatttgcttttctaaattcccttcagataattgttgtgaaggcaatcgtgagattagattgcaattacagtagaaaacaagtagttacttttcatttcagaagtgtttgagcaatgtatttttctaattagatcttttggcaagttttaatcgtttgaacatgagtgtatgtacttattttgttcaaaataaaccccgacatatgacctatatgtagtttgatccaggtggtatttgaattattggcgcagctgtaagctatctgttcattgagaagaaaataaatacagtaataaattatagacagcaaccttgcagtgtttcttgccacggaaccattccgtatcaatccaagtcatcccagataagtaacttcatcagtggttttaaacccccaggtggaagggaattgggtgggagggagggaccagcgacacttgggtaatttctcctctagaacataacccccacatggcaaatgaaaccttgagggtttttctctctctctctctctagctgattgtaatgttcacgcatggggtcaggtcaatcctttttcttcctataaaaaacagttgatgactagatgtgcaacatttcttaatgctagcattatctgcttggtactgatgggtgctaggtaatcagcaacctgaagcccgcaatcagtttgctgggttatccaaacattggatgttgaacataaatgtacaaaccagaactttagcaggtcgtaggagaaaactttgccactgttaatgccatcaggttaataaatgtctctgtatgtttcagataccacagctaaggaaaattcacaaatttactatttcgtttctcggttgtaggtagggcttatattttctcacttatatcctcaaatttcccatttgcactttgaaatagcaatgcaattagtaagtcactttatcaagaataatcagatggtaatttactacggagatacacaataaatttagttgttccatttctaccattggacaatctgaaatctctctggtttttattcagggctttaagaagacactactgctgcaacc

SEQ ID NO: 4555 - DNA, 364 bp, Zea mays
gggcatcctttagagttcgacctgcagaccacggggggatctgttttgccccccctccccccttcagttcagtgaaacgaatttgggactttccagtttgacttcgtaccaaatgtagttctgataattaacaaaaagatgctcccaaaatcggggagcatctgtttacttcttagtaagttcttttaatcgattgttttctgctttgatttcttttcctttggagtctcagaagagtaataagcaacccgactgttgttcgcctcgcttgtctttttttttctttctttttgggatgttctttgcgttaatttgtggcgattttttacgggtggattaatttgggacggtccaaacaaaacag

SEQ ID NO: 4556 - DNA, 684 bp, Zea mays
gccgcggatggcgaccgaggcgcgtggggaagggcggtgattgcgcggtgaggaagggcggtgacggtggcggaggtctgcgctgcagggatggagcggagggcagcgctgatggcgttgggtgaggaggcgagatttgcggggagggggagggcgaaagcggagggccgcggacgcgctgcagagaggagagcgggcgacgacagaaccgtgcaccaaaaaaatatggacgcctacactaatgtcttaagtagtagtagagattatcattaatccatgtggattgaatagtactgagctagtttaaatacataataagtcaaatttcattataatccatttcaatacacaccaatctacatgaaattggaataaccgaacaagacttaaatgagtcgtatcttacttcgatacatcaggttgtatggagggatttcttacwtgtatgtagtgtttggagaacagtatctatgttttacgtaccctaacactgctggtgctcttcacttgggtttaatccaaagtccaaaaccacatcacacccttctaatcccaatcgcggcacgactcacgagctcctcgcgccgctgcagtgggctctgcgcctttcctctcgccggagtcctaaaaaaaccctagggactagggagcgtgcggctgctgctgctgcggccggacgagggg

SEQ ID NO: 4557 - DNA, 473 bp, Zea mays
ggccactggcacagggaaaaaaggtaaattccctgtgtggaaatggactgccaaactagcccttatagtcgtatcttatgcttagagattcgatttagaggctcctgaaaaagagactaatcaagcgaatactagaaaacgagaactaataaaagggtaaaaataaaaaagaaaaaaatcccaatccgacggcacgtgctagttcccgagatatataggacgctccagataccttaccattccatcgtctgctggcatcgttccattctcctctaaaccctagccgcctagcgcctcgatctgagcagcctgtctcgcggaggtgagcctgagtcgccatcccttcccgtccggtcttgtcgggacgcgattcgcgctgttgcgctgcgcggatcgctgcggaatttcggttttcctgatgggatcttcccgccgctttgccgtgcaggtagttctggttgatttggtcctag

SEQ ID NO: 4558 - DNA, 362 bp, Zea mays
tatggggttgtatacccagctgaagatagcaaacaatagcagaagtattgctgtctatctgctttcctagatatgtgtggctgtgatttttggtctgttcgtgctaatgtcctatgctcgagacaagtatgccgcaaagcagcacctttactaccgggttgttcaaactgctgtcatcactcttgtagtgctagtgctggttttgtttctgaagttcacggaatttcaaatcattgacatcttcactagtcttttggcatttattcctactggttggggcttgatttcgatcgctcaagtaattcggccattcatcgaatccactgtggtctgggacagtattatttctgtggctcgtttgt

SEQ ID NO: 4559 - DNA, 116 bp, Zea mays
taccgaagactctgattccagactcgatccacgcggcgcgccacctgttcgaggtaattccctcccagatacaacctgccatcgccgcctcctagtgctccggcccggcgccggcc

SEQ ID NO: 4560 - DNA, 1500 bp, Zea mays
ccatcaaagaagcggggggaaattgcacggtagcctgaaacaggttacattctttcgcaaccaaggtctacacgcattgggagccttggcctacgcatgccacgctgctgaatgtgagatttcaccctctgaaagcgatctagtagatacgagtttttatagctagctgtgatttatccacggcgattgttttactccgtgtccattcagctggcaagctgcacctcttccgaacaatctaaccttattcattcttctcgacgtagactagctcccatgcaggcatgcagcgcatctgttcttctgtacagacagcgacgttgccttgacgaaagcagcgggatggcaaaatcattggacgtgttcggctggctacaagccgacactgttgcagctgtttggactgctgcagctgcaatccatagagagaaaaatactgtagaagccgcagccgcagccggattgcagccgcagcaagccgcagcgaacaagctgaccaatgcagtggaattttcctttcgactggggtggaatggaagtggcttcgtgtatagtattgtctactttgcaacttctgttttgatagggactgcttttctacgatagcatggcccaagggtacctcctggctcctgcgcacatgagggagcaaactgttctttttttttctgaaaagagagaaaagagcgccctggtagcttgcactgcaccactagccaggtcaaaagaaaagaaaaggatggggaaaaaatgagaacacacacagccaattagtacagaacaaaagttgagacgtgaatatgcagtaccgaaaatagataggccaagaagaccaacgaaactctcgagatcctaatatcgcaatttctcttttcttgtgaaatctggcgacaaaaagaaaaaagaaaaagctgattcaaacggctacaggtaggcaggttatcatgatgtttcctcttctgcccttctcctcctgcccagattaaaaagcctcaccaaaccaagggcagaagtaggaatactcatcttaaaaactactggctgcgaaagaccacagacatgcggaaggacgagagaaagaaacatcgtaaaatattgggggcttctattcggccggatctctctcttctctctctcccaaccaagacgtgttgagctgtttcccagtccttcgtcgctttccctccgctcaggcctcagcagcatcagctccccaccccaccccacgcctcccctcctcttccttcataagctcactctcaaacggaggtggagcggagctagcttctgcagggtaccactagtaccagtaacctctggggattttcctgtgagaagagggattggcattggactggactggagcttgggggggagccaaaagcaaaaagaagcccaggattagcgtgtggcggattgcgtggctatttcgggaggcgagagaacgagaggcgtggggcctaggccgggggaggcggaggctccttggaccggccatag

SEQ ID NO: 4561 - DNA, 78 bp, Zea mays
gcagccgcgcacctcgccagctgacggcgcagctaccgtagcgtaaacagtgctatcgtgtgagctgtgacgacgaac

SEQ ID NO: 4562 - DNA, 112 bp, Zea mays
ggtcagttagtgcctattcttccacctatcttccttttttctttctcgattgcttactactacttggaatgcatttcgaattgactcacggatttcctcatcctctcctgcc

SEQ ID NO: 4563 - DNA, 1500 bp, Zea mays
ccctggcgcggcaaacttcgtgaatttttcagggaattttgtggattctggtggaatttgtcattttcttgaaatatagcttcgattttgatggagtcccggtcttccagcgagcccttcccctttcttctccgctaggatcatccatccaccgagggcttctcctccgccgcgtctgagcgtctccctccctgcctcatgaccccaaccgctctccgcgcaagggcgttcgtgcggaatcgggtgctctcctctccgcgctgcgcgtgcgcctgctcgcttgtctcttcccctgtcgggttctcggtaccgaataagcttggcgaagaccgtacctactacctagccttgtcctaccgcgtatcttcttcccgttcgtcgtttctggccgctctagctgtcaactgtccagcaaattcgaacaattccttcgcttctgtttgtgtttggtcacctaactcttccttcaggtgccaaatcgagattcttgtttgtttgattgttttcgttttattagcctccgtcgtccacccccacccctttctttccttcttttaactacctctgccgccgtcgagtttaggtgtaacgaaaagatgattagttggttttctgatctggggatgagttctcgtgcgcattttgggttggtcgtcgcccacattcgggtgtagcgaaaagaagattagttgacgttctcacatggagtctgagtagcgtggcttcaaatggcgatggtttgacacccatttttagtgtagttttgggcaagaaatggcatcccctttctgccacaagcaaaaagaagttgccggtgcccctgtttcgcttagctgaacattttttgcttataaagaaataaaatagaaagcaagcggagaacaaggggagagacgccgccttgccatgtgtaagcaacggccaacggcaatgctttgtttgcttgcaaagcctcgtgtgaaagggaggaatccgggagaacgatggtacggccgttgcttgtggcgttcaatcaggataaaggttgccaactttgcgtgtttccctcctgcgttccttcttaatttacgcaccccgtttcctccctttgtgccacctcttcctagtataagtgccgcatcctctatttttgcaacaccttcatttggtgagagctaacacagcgctcctgcgtgttacatgggtggtttttttgtcatggttaggctttcttggcaccggtcggatgttctggcttgacaattcgggtagacaagtttgaaattgattcttgtttgatttggttcatttctgtggctgcacctgtcccctggtttagacttttgataggctgagtaacctaatttgtgcccaactttcctctgcaggtacctagtattccagaggtgatttctcctcattgacagagagcaaatctggttcgtgatccctagtaccagagagggacacggttttcctatcgatgtgttagagtcaagtactcaagcttttgtggttcca

SEQ ID NO: 4564 - DNA, 1500 bp, Zea mays
gtgcctgcgtctgctactgcgcgctaggcgctactagcaacctgcacttgctgctggtagtagcgtgtgagctttgaattgaaatgatctttggcacacacgatccattctcccaaaatgtgtgctatttattttattttattttatttttccgaacgacgctttcctaaaaaaattacttgtacttcatttggtaatattttcttttcatgacatttatgccatgctactacagtttgtaccctaaaataagatgtcaaatcattcaaaaaaatgttttaaattattatagaagaccgagggtagagtgacattatcattaatgcatgcatgtggcattgtgaccaacttaaatcaggggccgcagctgtttccactaattccctagctgaaaagagctactacaatgacaaactgacgtagtgacgtcgcatatatcatggtcatgcgtagccatgacgataccatcccggccacgtggaatatttcggtccctgtgaggaataggctagaaaaccgaaagcacactacaatttggggggccctgggcccatgcgttgcaggttcgtcttcaccccgatcggcccgggcgcctctccgtccgtcgtcgtcggtcatcctattctaaataaaaatatacatactacgtagtacagaatttcacctggactacggcggtctaggtacgtgtatgtatggcgccgggcgggcggtggtatgtatggtctcggggcggggccgttcaaaagcatgctttcggaggttcgaaaggcatgtagtagcaaagaagagacaaggatagcagagccgaagcatctctccctttcctgattcaaaattttgtcccgcttttgcgctttagcttggccttttgcgagctcgccgtccgcaagcaaggtatccattcgcattccctactagtgctagctcgctcgccagatcagtcatcctctgcggccactggtcgtcgtcgtcggtcgacttgttgtctctggttctggccaccagatgcatgcatgggctcgtcgcgcatgcccgtcgccgtcaggcgtttcggcgctctccttcgatcctgcttgctggtgtcaccacggcctcatgatatgaatatatggtctgtgtacgtacggtgcttgcatcgcgtttccacactgctcttgcactgttgtccggtgtggatgcaagttgctgttcgttcgtggatgcgtgtgctgtgtcccgatgcctcatgcctgtgagtttagtttatgcgaaaaaacatgcgttggcagagctacgcccacatcacacgtactgcagctgtaagtgctaatgttaaaatatttatttgtttgtgtcttaatgctagctgtattgctttggatctgcaaaaggagacatagaaacaagtgaagtcagagtcatagaagtcaactaaaacgttcagtcaatggaggaacagtgtaactatggcctgaaagggttctgattttgagccatggcgatgtctatcgagatgca

SEQ ID NO: 4565 - DNA, 672 bp, Zea mays
ggtaattggcgctcaccttgctgctgggttcatctgtggaccatttggttaaagtccgagatgaatgattcaatcatctagtgtttgattattagttggtggccatgaaagaaataaaatccatctgccttgaacaagacatgcccatgttaggtcgaggtcacctaattgctttaaaattgtctctttcatatcgctttactcaagattattttctctggaaagaatgattctgttgtcaccctgcaagctgcaactgttacacaccatacccctgacctagtttacttcgatccagactatatatttagcaacttttacagtacgatagtccttcagtgccccaccactgaatcatgctcccttgtttttctcaaagactatcctgccacttcctgtgaagcacttttaatggtatacaactttgatgtgtttctgtgaggccttttggaaagacgtgctttggtaatatagcggcgtgagctatcctccactaattaataattatcatttcaactccatgaatcatctgcctttgtactggtgactaattatcgtttcctggcctcagggtatcttcactggaagctgtggaacagcgctggaccatggtgtcacggccgtcggctacgggacagagaacggcaaggactactggatcgtgaagaactc

SEQ ID NO: 4566 - DNA, 414 bp, Zea mays
tctgacacaagcacaccagttataacacgctctactgctatactacgatcaacactacactatgcatttcatcgttgggtatcaataggtgatgtatcgcggtggtggatcggagcgcagccaaaccagacattttaaaagaaatttcaaaaagaaaagaaaaaaaaaaggagataagaaatggtgagcaggcaagcatggagtggagtgcttttaaatttgggtgtcgctgtcgttgaaagcgatgggtggctagttttacagacagacagcagcacctgctcctccgtctggactgactgactagtgactcagctccacccacatcccccttcgtcgtcttctccctccctgctagctgacctccaatccacgataaggcaagataagctagctaggaaggcaagggatccg

SEQ ID NO: 4567 - DNA, 1083 bp, Zea mays
agtatagagctgatcgatgcaaaaggccacacttttaccagcaacatgtcatgcaactattcctgccgcgcgctggttactttttttcttgatcagtcgcttaggcttaaccttgccatgcttacatataaataactacgccgatctagtttatgttatcatgcactcatgaatgcttgtgctaggacgaagctttkkttccctgcagcgccgcagctttgggcaagagtgacggcctgagcctggcatttgcaattcttaaagttagcaaaaaggaggggatagcgttaggagagtccaaccccttgcttccaccctttctgaaaaaaaggcctttttaggcagacaagcatatggctaggctgtatctttgtccatccaaaatcttttttctccacttgggtgaagttcttatgataccctgcatgcatgcacgcacaatcttctctgatcccttcccccccccaaaaactatgctccaggaaaatcagatcagatcaggtgagaatatcatcatgtcccagtgcccctcaaaacaccatgtcgtcctgttcctgtccttgtcatacacgtactgatgtgcatagcacagtctactacagtgatggctggtaccagagactagaggtcgcaaatgcaattactgtgcactgcagtgcagttcaggtcacgtatagtcctgctgtaactcagcaggagcagagtacgccgatacttttgccaggacccccgaatccaaattcgattcagaattgatagcccctgctggcctgcttttaccttggtgacgaccttacttacacttggcgctgcatgcatgcattcatgtgggatgcaatgcaatgcgatgctgctccctgcactgcaccctgtagctttcaggaaagcgaccgacgcattatcttcctttttttattagtttagatttatatttaccaacaacgaattagcgatccagatcaatgtaaatttgttgtttacctattggtgcttaccccccaaaaaaacaaatcgaaattttgatgacggcatgacgtggcgcgtccactcgcgcctcaggtcacttggctcgcgtgcggcggc

SEQ ID NO: 4568 - DNA, 1500 bp, Zea mays
taatgatttggccttgatgtgtcactttgtcaaaggatggaacaaataaagtaaagaacaagaaagtcaggaacaaatgaaaaatgttaaatatgtccttgggctcggtcaaaggatcgtcttgagaacgaaattgcggactcgtcggaggcacaatcgtatcatatggttgtagcccccggctcacatgtgctacataaatcgatgaaggggctggtcatgaagccaacacatcctctgtttccaccaaaccctagccatcacaaacatctagccgagacctaatctctctgtagagcctaatgatcgaaatcgtctaactgaaaaatcgccatggcatccgtagcgaccaatggtcctacgtcgtcggtgccaccggctctcaaccaaggccctactttgctaagatgagaagaaccaaactaggatggaggagctcaacacccacatacatcctacaacgactttgagcccttgtttgaaagcaagtggaatgaagggaattgaaggggctagaatccctcactatttaaaattgaatagtgagggatttgagtctcctcaattctctccattagtcttactcccaaacaagcccttaatgacacctgctgtagggacttagggtatgggtgtaagctaatgataacgtgaaaggcgcttggcggctgggcagcagtcgttcccgctcgggctcgggctcgctctggtagtcatatattcattaggcaactgatatcgataccgtatatccatacccgcgaaatatatacacgtgcatacaaaaatctaccatatatatacccaattaataattacttgcgtatctatacacgttgccatcctaggtgcggattagaataagataccgcttgattggatggatgtgcgcagtgcaggtatctgttcatataggtagtgtttggttggatgcgtgctaacagccatgcacggcgtgtgcgttgactttaagtaagcacatgtttggatggctgcatacgagcgagcaggcctgtatatgctggtgcaacatagaccaatttgtgtctctcagcctgcacgcgcagaaacatgggaagattgtctcccgtgagccaagctcggacaagcctgcatgtgcgtatgcagacaagcaatcatgaggatagttacgtctctcgcatgcaaacattcaaacaagagcttaaacaatacaagatgaaagcaaccgattatcaatgtcgacgccagagaggtgcgccgtggataatttagctcagccctcgctggccggcagtgaggtgcgcctggagaaggtggcccccgtagagcctggttacttcggcccggcccattatgtcatcaaacagatccgagccgtccgattcaggttattcctcgcgacacatccatttatacccctgccgccgccactcccattcttctctttctcttagactatctgccgctccagcctttcgctagggtttatccaccggcggcgcgcgcgacggcggcaag

SEQ ID NO: 4569 - DNA, 92 bp, Zea mays
cttcagatgagaaatgtcactggtgataacacctctttttcatcatcttggcagggcatcttgctagtcttcttccagattgcttcctaata

SEQ ID NO: 4570 - DNA, 1500 bp, Zea mays
tctccggctgaggtttctgtgtttgatttgatttgaatagtagaagcttgtttcataggataggattcgatttgcaggcaggcatgctccgggaaagtgccggttattctcatgttccggatctctttcttggtcttgggtaaggcggcaggctcagcaggggtatatgatttcgaatagaaccagtgatcagtttccgtttcgatccacaaaggatgccatgccggttagaatatagccagtgatgaaccagatctggatctagatgagttaccttgcttcaggactggcaggtttcttgaatcatagcttacctatcccatattccgccgcttgaagggtttaggtagggtttcctaaatgaagcagcagaagatggcctagctttagaaaaatcaagtacggaagtccgcctcggagtccgaagagaagaacaagtgctgctcacttagctggaaaaaaagtactacctgcattcctgcactaaagactatttgcgtatcataattcagtgaatcttgtttttttctccgatccagcctgcaaccgggaaactgatacacactcgagactgttcatttcacgagctggcacacttacttcaccacgacacgacggatcccaacagaaatgatctactgcgtatgatcctggtttcgtaccaatcctgactactgattcatatcatacaagtcaacctgtgccactagattcacctcacttcgcatcccatctgcgagttcttcttcttcggctatttcctccactgcagagaattcgataccgatacgaccaatagcagtagcagcattccgtttgtgtagcttgactcgaacgaatacgcctttcctcgaactcggcaatccagagacagagaagagaatgagatcgatcaagagcaggcagcttttccctcaacttatagctagaaagaaagccaacctggaaacggaagaagtccaaatccggattcccatttcactaagaaaatctgcttgaggacaaaaaacacggtaaaatggaaatgcagaagtcgctccaacccaggcccgtagcttaagatcggcttcaagtccattggatgccggtggatggatagatagttggaggtgagcgagtagcggcagtaaagaaagtatcggtcagtgagtaactagactagagcatgtgtccagcgcctaacgcgcttatcctctgttggaatcgatggccctaatggtaacgggacatcatgaggcgtctgtctaaattgacttggtttctgagagagtggagcgggaatagcggatccgctaaaacaagatctttaaaagtgttcagtgcatccaaatctgaacctgcgaaacctttctatctttgttcttcccactttcgcgctttcgaactactggttatgtcatcacctttctttgatgtttactctttttggttagaagatcagctgctaacctattttcatttctaacttaccacctgtatctccggaaacgaaaaccagaa

SEQ ID NO: 4571 - DNA, 95 bp, Zea mays
tggcttttttcctgatctaaagcacctctgctttgcttgtcatttacgcatgcagtcgacgcttgtataatgtcgtatccattcacgcgaaaata

SEQ ID NO: 4572 - DNA, 1500 bp, Zea mays
catctcttttactttgttacaaacatttgtacttttgttgctttcaggtaattttaaggcatgcgatcttcgaatatgtggtggtgcytttattctggagtaaaacaaaattctctccatcttaggagatagctatttcatgttgttttagatatttaaatgcatacctacactatgtaggagaaaatgttgaacttggactgcctaaaacaagccttgctattatacctaggtatggaaatatataacctacacaagctacactgtgttgtacttctatagttttatatacggattttgaagaaaacgtcaagatgctctaaaacaaattgccgcaatcagacattcatagtcgtgagtaccatcaactttcccttttgcttatgttagccagcctgactcctattgtccacccccttgtctgtttggtggacacgtagatggccaaaccagagtaccatgctatggagatcggacgggggtatatttagatatttcatctctttattcatctctttaaccaccaatttcttatcagtaggacatgatggcaggctgatcaattatgctctcacagcctccaaaagaataggaacatagagtaccactaatttgtaaacatacatcaataaaagaaacatgtgtgttactcttaataaagctttgaattttaggtgtgaactttgtttatgttatttgctttttctcttctaaggtctgttgtcatggttactaacaaacatgtaacattgttatggtagtgagttaccgagaagtagtagagttacccctctatagccttaggtcatgaatatctgcatcataaaaggtaaatgaaatgttaagtgtcatcccattcatgcttctccttatccttttactcagtgtttgacattcttcctgacttatctttgttataatgatatctaaagatttgttgctaccattcttcaatcatatattgttatctttttaaaaagaaaggacatgycgttgtttttagtaaagctaccaaagcgccatatattatgcacaatcttttccaggaatccaggttgagagaccatgccttcaagtcggtagcagaaaattatgtttagtagcacaaggagcacttgtgtagctgaaaggatttgccttcaatagagcttgaagtcgttctgactatatgtaattgtagttaaaacattttatcacacaactagatgcactgcaggttataactgcttggctctcaggaatcgaggtggctgaagtactttgtacaaacattatcttaatgtgaaggagagaaaaattgagataagtgtttttgatataaactcacatgtgattttacaacgtctgatatacatttgcatggtagagcgcccgatagggcgccttttttctagttaaagtataagggcatcatgctctactcgrtgctatatgtaagcgctgacgaaaaaccaaatgcatctacgcaacacaaggtaggatcaatcaatcaagtccatc

SEQ ID NO: 4573 - DNA, 100 bp, Zea mays
tgatattgaatcaccagctaccgctccgttcttgtacgatggttcctgaggatgcaaaatggtgagttgaatttgattcacctgcgtgctgttttgctgc

SEQ ID NO: 4574 - DNA, 765 bp, Zea mays
ccagtattacggtctatttaactttatctgtaatagtgcaaacagtatttgcaaggtagtggccttatatattagttaaatataatttcgagaaggcgaaatttattttaatttaaaaagtgtcaccgccaccggacgaggttccttaaggactctactgcaagcagtaattaatgagttcaccagcaatgcatatctgccacagctcatttatctccaaagattgcttgattcagtacagattgcattttccagcgaaaggcaaatctgggatatctgtacattagttttattttcccgtagatgagatccaaatctatctaccgatgctgcaaaatccaaaatacagccaaacaattttgtggagtcgccattaaatgcttggattgggacccccctgcttttaattccgtgcagacgagttggtgtgctccaataactcccttccgcttcctcctcctcctcctcgtctgtcctctctctctccccttcggcccttgcttcctcttcctttcactcctccgcctgtccccttctctctctgctctgttccttgatccagattccgcagcggtgagggcacccagcccgatcgtccgtctccgtcgatccctcgaagccctaggagagacccttgtccgcgtcgaattcgatcgcgggctgatttgatcccgagaattcgcgagggggccatcggcggcggtggggaatcggatgttgtaggaaaggtcccggatttctgcgcgggcaggcgggcgggcggcc

SEQ ID NO: 4575 - DNA, 876 bp, Zea mays
caccaacaataagaataaaaaatttactatccccgtctcaatttataatgtgcttgatttttttactaaatttgattggttcgtcttaataaagaagtctataaaaaataaaaaatccaatggcgtacttaaagttaaataatatcgcaataaaaattaataataattataaatttttttaataagatgtaccgatcaaacatatgataaaaaatatcaaagaacacatagattggtcccgatatcgagggtaacaagtggtattgtgggtatttttattaaacttgaacttggtaaagtatactttggaatgatctattaatttgttgaatatagagtatagatttagcggattagttaaaatctcaatctgattccgtgtaccaagatctggtcaaacgggcccatgaacccaccgttagccgaccgcgacactgatgcacccaaccatcccacattcccacgtcggggaagagcggggcaatgccgtcatttccgcgggcgaacgttgtggataagactagaggcccaagcccatgcgcccatgccgtcacacctcctactctgacctccgggtcgccccgtccgtgtccgttccttcttcctcgccgctcagacacgcacacgcatatccagcttgccatatttgtaccacctgtcctccttccgtgcccgagacccacctcggcgttcttatccccagaaacttcggcaaaagtgatcgatccgtctcccactcccaccccgaccgaccgaccgccgaacgaacccgacacacctcgtcgcgtcgcggcgcttctcttctcttcatgcgctatcgccgccgtttccacctctgcgacgcccacagataggcaggaggaggacgaggaggcg

SEQ ID NO: 4576 - DNA, 243 bp, Zea mays
cgtgagttgcaactcgcatagcactcacacacctggacacctgcttccccgtaccccgtctcgtgctgatgaaccgcctggtccatgcacatacctttctcatcagttcaaaatcttgttggaacttaaatctcgctttcctataatgtttctcattttcatattttacaggttgcaacaatcgcttggtttgaagcagattctatttgtggcagtcattcagtggcgattccgcttgttctc

SEQ ID NO: 4577 - DNA, 1500 bp, Zea mays
aatggaaaaacttgatcgcacgctaaccactagaatactagtatatactcctcgtacatatgctaagtctatgtcatatcgcatcacagagcacacatatattagactgtcttgagccggtagtgtaaaatagaggatataaaattgtagatcacactttttagagtgaaatttaaaatataagatatgatagaggatctattaaagacagccgtgggccacgccgtgctgaatactctaatccatctagaaaagcccaaagagcattttttttttacaacgcctcacatctatcatcttattatctggaggcctacataaataaaagaaaaacaaattataaagatgttaagttacaaattttgatttatttttttgggtatatggatggtgagtgtgagagactytaaagaagcgcgtttgcatatgggggtgttgataatttttttccaaacaatcagtcagtcacaagaaaggaacaacatgaaagtgatctccatgttggaaacctaaaaacaagggagagaaaaaaaaaactcgcatcgcgtccttggttcctcgcattagccacccactggattttcttgccaacgagcttcgactacaccaacgccgcttcgtcccagtgcttgctaatcatcggctcctcttaattgcagcaaccaccacgcttcgtgttttcagatcaaagaagtgggggaacaacacagatttggagcggcacgccagcaatacggaccgggggtgacctgaggcgtggagatttttggccgctgcctgcatctccacgtcgcggtcccaatcaagatcattatttctttctcccttccttgtccccgcccaaatcgcaaggcttcgttgcgaatcgcccttggcgtggccccaggattcgacgccccagcgccctcgctggaatcgtgggcgctgtggaggaggactcgaggcggccgtcgcgcttgtctcgtctctcatcaatctcactctctctctggtctctctctttttttaactgcggggattcgccctgatttagaggagcgagttgctggtctcggcgccgtctagctcgtcccggaccgacgatttggggcagggcaggtccaaaggtgcgttcttgtgattttccccaaacaattctgcatccttcaaccctcgatttttggtttatgtgaaaaagtctatttcgttccaattgtttggaggaggagtcgttgccatttggcagcattatgctggacttttcaagtcaacctgttgcgttcctagcttttttgttgttgttttcgccgctaaaatcaggtctttcttgccgttagcttgagagatcatccacttccgcatgcctcagttgggcctgtctcgtgatcttcctgtaatgcggtttgcggcaggcagcagcatcatggaagattgagaaaatttggaggcatctactacaaggttttcctgtgtgccctcaagacagggcgctgtgccgtgtgggcctcctcttgggcatcc

SEQ ID NO: 4578 - DNA, 908 bp, Zea mays
ctcatcaactagtagcggtattttatcgttttctcttcgaagcacttttgactgacatgttgatccacaggcaaggggtcgccacgtagcttcatcatcgtactaaattcggacttctctctgggacgatcacacgctacctatctgcagttgaattcacggacgtctgggcccgtatcatgcggggtattcatgtcagtgagagaggaagaatgagggtgggagacgggagtgatccgcgtggccttcggttgcttcgcgtacctccctccggttcggcgttagagtacgggacgggaaagcgaaaccctcacggcgccggaaccccaccagtcctccaccaccacctcccaattccggaagcgaataaacgccactagattccggccgcggtccctcctccagcgccggcgtcccctcgattggctgcgaaccttgcggcttcgttcgcgccatcgcagatcggggctggtttgtctagatagaggtgctctgttgcgtaggagagggtgggggcgtcagagctgccggcgttttattttggtcctttttcagccggtgagctgcggctttctcgctaattactcggcgcggcagcagacttgggctgcacaagcttgctatctctggttcaattggcccagcttgcgctctgattgccccccaaaactgcgtgcgtgtctcgcagcgtgctggaatcgctcatctgttcgtctggcgaagcaattggctagccgattacatctccggctcaccttcatctcactgcagtctgctgaaatcgcccgtctctgcgggccattgccgctcgcttcattcgtgggttgctgagggcgccttgggggcctggggcctgaatttgcgtggggcagtcttgggaaagcgcaagggaacctttactcgtgacc

SEQ ID NO: 4579 - DNA, 77 bp, Zea mays
ggtacaagcaattgattatggtttatattcagttggctattgcttttaacacagtgacttagttcttttaaattcta

SEQ ID NO: 4580 - DNA, 592 bp, Zea mays
atttctcattagttttccctcaatgcactttgtagttatgcatttttgtttgttgcccacatattctgcttatctgagacttgtaaagtttgatttcttatttgaaatattttatcaacagctgatgactcagaataagattaaaaaatcgaaatagttgaactaatatgttctacttcatgcccgtgttagcgcatgtggatatttccaggttgtgattaatacacgcagttgctgctacatagttttggtcacttaaagatactgggtattgtgtagataatctgagtttatctactgacagtttgtgactatagtaaaatttcttctgttgcagctaagcagtacatgcagtgaacaactaattgaagcaaggatttcttgtattcttcctctgacctcattggaatgctaaccatttctttatttgttttatttacttacattactgcaaatgttgttgactattttggatccttactagaaatatgttaagctattaattttgctggccagaatatgggtgtccagtgttcctttgctattattttgggggtctgaattcccagccaatttgccaactttgttgctg

SEQ ID NO: 4581 - DNA, 1500 bp, Zea mays
ataagttaaaaatcatactttactccctttttgtcagcctattgatgactacaaaattaaagtttagtcacgacactttagtcaccatatttatttttttagaggctaaaaataactaaactttagtcactccaactaaacgaaacggggccttagttattttctcgtcaataatgtcagccacgtccaaaagtatcaattcattactagctatgtacgtggtgcttgattgcgactgatctcttcacggccggtttcagcgcgcggcagacgacgaggcatgtgtccggtaccgggaccgcacgcgtgcaaggaaacctgcagggtcgtcgtcgtcgcgcgcgcgtgcaaggatgtcgagatgggcgtcggcatcggcgtgcgcactcggcggcaactagtgccggccgttcgttcctccgccataacggcatgcgcaccggccggctgtttgagcgccgagacagaccatacgcgcatggagactgatgatctacatgctcacgtacgtacgtgcgtgttacgagcaacatccggtccgtgcgggttcctcgtggaatcaacagggtataatgtctgtgcattatcacatgaaacgatgacaatctcgatcgagtctatacgtgcatgcatgagaaggagctcgatatttttgtataactcactcggtggcttgtccttcttcagatagcgagaaaggcgatactatatagaagcgctgcactccgctcatattgagtttggatagtttcttacgtcacggcccaactatgatataacgtcttatacgtaggcacaaaactagcgtttttaaaaagagtaaagatgatgagtcactagttgagataaaaaaacacacttagagcatctccaagagcttatataaaaatcctagctaaatctcaagtttacagagcacacttcgctaaaggaagctatctacaaagcataggttccaacaaactatctaaaggaaacggtaaacttggctttttttgcatgtttgactttttcttggcttttttgcatgtttgaatttttccaacctgcagacctgcagaacgctctgaagaatcggacgtcgccaacctgcagaccgctctcaacgctcggcttttggatccgatttgaatagttctgcatgtgcaatctgatctgcatgacgttctggtgtgccaatccacgggccaggacttagtgtgcgatgaagtatttgacttctccaacctgaagaatcggacgccggaaaccttcagatttagatgcggcaacctacaaccttaaatagacacctgcggtgaacattggagagcgctcgacgcctgccaactgaactcaacatcaacggtgaatagtgggtaggagtcaacgcccgcaacctgaagattgtcacactactgcgacagccaggtggtgtacggtgctgtcgataatcggatgtctagaagctgaaagctgctgccgcgacttcgacgtcttgtacgggaccacttcgacggt

SEQ ID NO: 4582 - DNA, 235 bp, Zea mays
ctaatttgttggctcagcgactgcgtgcaaaactccatgacagccagttacctagaaaatccatgtgtacagcagtacgagaagaatgaagtgcacgatagatatacatatacatttcctggcttgtaatactgaatgttcacattatgcctatggcaattggcaacgaagatagcagttgtgcctgcttgtcttctgtttgcccagtttttgctaatgttgtaagccagctcac

SEQ ID NO: 4583 - DNA, 189 bp, Zea mays
gctctccttctaccagcctgctccggtcctcttggagttgggcctgcccacctcccggccggtccgccgcgcggttccagtttcgcctctcgtcgccggtcctggcgagccccgcctccttgatctccgaccagcagcttccccactgcccactccccagccccggacgtgcccttcgccggtgctgtc

SEQ ID NO: 4584 - DNA, 174 bp, Zea mays
ggtaatgcgccgcccatggcaaggctgcgcccgcggccgcttccaaagtttctgatttggctcgatcgctcgatcacgcctgacgctccgtggccggacggaattctgcgggttctcgcctctgcaggtggcgaaggggatcgatttgtctacggcggcgggagcgtcgggctc

SEQ ID NO: 4585 - DNA, 375 bp, Zea mays
gtgcggatagcctgagctgcaaaactcgccttttcgactgcgcgcgcctgcaccttgacgaagaaagtctgacaaggtgggacccggaactcgctcggccgtgtctttccccggcttggtgctcccactggccactgctccgtgctcgtctgggtttcaaaatttgaaccgcgcccgaacggctcccccgggactcgtaaccgaagcacgcacaaggcacaacggccaaggcacggcgccaagcctcacgtctcccacgacctccccccatttgcccatttgtccgtttcgcctcgtcgtcgtgggggcagtgcacgctcttcgcaggagggagagaggcaggagaaatttcgggggtttcgcgttgcggcgtgg

SEQ ID NO: 4586 - DNA, 497 bp, Zea mays
accttttagtccataaaggtctgagtcaatgttgtaaacttttatgaggggcataattgtaattcctcacaggctgtgttctgtgcctataaatagtgaacaatatccctttattgttcacggattcttgtaattgcaatcgcatcattcaggaatcaacctttgccaaggcagaggtataactgtattcaatgattcaatatattgattaaatataatttgattcgtttatgattcatttacctttgataccctttattttatattatcttatacaatctattgaaattcgattacgaagactcaaccttcgtaatcgtgttctcgtcaaccttcgtccaaggttcattatcctcaagggaataatgcttcatggacgaaggacgttwacatttaacattctatgttgccttgttcttaattcatagcattttgagaacaagtccccaacattgggcgcccacctccggtgaactcacttccacttttttgagaca

SEQ ID NO: 4587 - DNA, 398 bp, Zea mays
agttagtttagagcccactggacctaaccttcggattaactaggcccctgtgtgacatgatgcaagggtcaccatgccggacaactgtgggtgaattccgagttgtgtctaagcatatcggtaatagagatttggtgtaggaatacttagccaatagagtatttccaacgttaaaggaatggaatatgccgaagcttaaagaagaaaagaaaaagaatgaacttgttcgactgccttatcacttcaatttcaagaaacatttcaaagagccttgtcaagaatggttggatatgattgaagctatggacaatgaaattttgggcaattatactaagaaagaagatcaattgatgaccacgaccttcggtacccgaccaaaatgaaggctgaaccgagtg

SEQ ID NO: 4588 - DNA, 271 bp, Zea mays
gtcaccatctcttacaagtcagtggcaaggggaaaaaaatttatcagtgacacgacaacgctgactttcctactgctgtgttgtcctgttgattaaaaaaaagtccaacaaacctgaaaagactagtcaaccgggcaaatgcaattgcctcttttccctttccaccttctttctcctctctttctatgctgcagatccgatccctctaatcatctctacactatttccggtgctgtggcaccatctccattaattgggcaaacaagctagc

SEQ ID NO: 4589 - DNA, 1061 bp, Zea mays
cggacagggacccttcggacttgagtcaaaatcgctgtatgaagaaacacaaggagaacgaaggatgaaacaaagccgaagttgtgcgcaagagagcttcggcatgttggcaggaaaaaggaaaccgacttaaagaggaaaaggctatctagaccccgataaattactatagagttgttatcaaatgcaaagggcctggatgtaattttgcatgggctgcgacccgtgcctataaatagatgaacagtactcccgtactgttcacgctgacttggcatttgcttttgcgtcacgcttgtattctttatcttccttcaagctgaagctgaagcatttgagagcaagtccccaacacgaagattgtaggaaaatatgtgccaaagaccgaaactctgaggagttgggatatccgcggttcaaatgttaggttgaaccgtgtttttgagttgaattgtctgccgtatgctggctacccgggggacgactatgccaatgttgttgtccgccgagggaaaaaggcgatgacaacggccgacgagggcccttcacggggaacagcgccgggtgcggccaccaaaaagaggaaattaggtacaacagctgaggtgccgagggcttccgatcgttttgctgcggatttgctggagacctaagcggttcccggggagacgatgtcttcgacctcgcttcgggaaacttccgcgtgaatgctgaaggttaccaggggtcgctggcctaggaaagttctgattcctcgggcggccggcgaggacatgtttacatctcgattagctcgtgagatgaaaattttcccttacggacggaatgttggtgctgttatatcggtagtgatggagaaggatcgctaagacgtgccacagaaacgccgggtgttcgccaggttggggggtccgaggcgcgaggcaaaggtggcgcgggcgagcgcgaagcctgccgcctccggcgctagtatgcctccacctgccgcgcccacgcacgagcgaaggcctccctcaccaacgcgcgctgctgaggcggtagtggcgggcgtcgaagtctcc

SEQ ID NO: 4590 - DNA, 226 bp, Zea mays
gacagatcgagccgtccagctccattcgcctccaggctccgctgaatccttacagtaattgtcatgctttcttttgctccatgtgtttgttagctttggcttcgacgcgcgtgtactccggtggttttattttagaaatcagcagtgaagcaaaataattgtcttcggatatgttaaactggctgagccattcaaaatccacgaagcgcgagtgaggtgcatctga

SEQ ID NO: 4591 - DNA, 1500 bp, Zea mays
tcaagaatcaaggtatgtatctagccttagtgaattgtttttggtactaacatatycccctaagtggtaggaaccttgttaattcaactgggattggattggagaagtctggctaaaagaatccagagatgcaccatcctatggtgcaccggactgtccggtgcccaggctagcccgacgacgaactcgtcgctctcgggaattttgaaagggaaatgtgcccttgggccatttctaagtattttggtgatttagtgcccaacacaagtgcctaagtgtaaaaaggtggacaaagtacaaatcaaggataaaggtatgtttctcagacttagtacattgttttatggactaatgtattgtgtctaagtgctggaaacaggaaaaatccaattggaaatgtcttggctcgagcagccaagaatctgctgagtctgggagcaccggactgtccggtggtgcaccggactgtccggtgcgccaggctggatcgagcgaagtggtcgctctcgggaattcaccggcgacgtacgactataattcaccggactgtccggtgtgcaccggactgtccggtgagccaacggtcggccgggccaacggtcggccgcgcgatctgcgcgggacacgtggccgagccaacggctagaagggggcaccggactgtccggtgtgcaccggacatgtccggtgcgccaacggctctctggctgccaacggtcggctgcgccagacaaggaaagaaatcgggcaccggacagtgtccggtgtgcaccggactgtccggtgcgccagtcgacagaaggcaagatcagccttcctagattgctctcaacggctcctagctgccttggggctataaaagggacccctaggcgcatggaggagtacaccaagcattcctacaacattcctaagcaccaagacatcgattccgcgcctttgattcattgtgttagcatatagagctctagtggagttgtgaactcattgagttgtgttgcgagctcttgttgcaacttgtgtgcgtgttgttgctctgatttttgagtcttgtgtgcgttgctaatccctcccttgctccgtgcttctttgtgaatttcaagtgtaagggcgagaggctccaagttgtggagattcctcgcaaacgggattgagaaaaagcaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatttattgtggttattgtgttttgactcctctctagccacttggcaattattgtgctaacgattaaccaagttttgtggcttaagttttcaagttttcacaggatcacctattcacccccccccctctaggtgctctcaattggtatcggagccgttctcttcaagaagggactaatcgcccgaagag

SEQ ID NO: 4592 - DNA, 281 bp, Zea mays
aaaaatcaagttagacatgtctttgtatgcccatttgttttttatactagaaactggaattgattactatgactctacctttttgaaatcatgctgtactcatcacagggatgcttaaatttccatacatggtcaatatgtaatgtccagatctgttattattattttttgcttcattgcatgcgaaactcgttccaagttgaaccatatatataaatctttcatgatacataatcatatatgtttattctgcatggggccataatttctttatttttgtc

SEQ ID NO: 4593 - DNA, 1047 bp, Zea mays
attgttttatttaatctaaacaataattaggatgcttagtattttatattgagagatataccactactggctgatagcttgagctagcagacaggaggcttatatgagaggtgactggacgcgtaaggggcctcaggggcttacccgccaggggcgaagcctggatccaaagttaggggggccaaattagattaggggggctggtagaagcattttttacactatttgcatgagaattagcttaaaaaactaacatctcctatagaattatgtgagcattaggagggacattgccccctgtgcccccctgccgtcacccctgttacccgctaggtatagatggtcaaacgggccgtgctaaatgagccgacactaagcacgacatgacccatagtacttcggcatggtacgtgcacgattcatatagtgccagtgcgggcatgacacgagtctagtgctgtgcttgggccgccatcccgacacgatgagctggcacgagcacgacacgattaactggtcggcggttaggcacgacttagaccaacatgtggtttatagatgtgattgtgatatgtgcacgtggttgtacattgttatttgttatgatttacacataatgaattcactttataatgatataaatactcaagttttaaaattatatatataatcttaaagatcttctatattttttgaacttttaaaatgaaatagtgcttaggctggcactgacactattaggctggcacgacaagattagacactatagtgtagtgcctgggccgctggttaggcactagtgccggcacggcacgacacgattactaatagtgcctaatagtgccgtgcctaatagtgcttagtgccgtgccgggccgggcggcccgtttggccatctatatagctagctattattacagtactagcacttcagcaggcggcagagaagaagaagaataagcccccgggcctgggcatcctgcgtgcgacacttgcgagcagaacaggccaacacagctagctagcaggccgtccggccggcaaggc

SEQ ID NO: 4594 - DNA, 479 bp, Zea mays
tgctctgcctcatagggttgctcgatagggagttggtcagccgctctgcctcgcagggttgctcgacaaggaattggtcgaccaccccgtctcgcagggttgctcggtaaggacttggtcggccgctccgccacgtagagttgcttagtgaaagcttggttggtggatgagacgttaagaatcttgggcctactttaggcacgcggttcctcggtacccgacaaacaaaaaaagctatatgtttttttagcttttagctaatgagatgctaactagaagctcaaataatcaggaccttcctaaacacagcaacagaaacatataaattcgttaaacttgaggaccctgccggcaaaaaatctccctctcagtaggggccggaataaaaatctcctcgccttcctctcctacgccgcctgacctctgctgtccgcctcaacggtccaaccctccggttcgacgtaggcgccggcggcgaa

SEQ ID NO: 4595 - DNA, 524 bp, Zea mays
ggtacctccactttcttcccagccctttagagatgatatgaccatcttcgttcggccattttcccagcactggtctataccgcaggtcgatgcataaacaactgccttagaaaaacatagttttgaaggatacaactgaagattaggaatgacaacttaaacagtcatcatagctaacaactgaagatgtaactgtgttgatccaaactgttttacatctgattaaatctacaaaaaaatattcttcttctttggacgggagagagtgtattttgtagtcactctaagcttacaactgtcttcgatccatcacattgaattgtcgttcaagattctgccaggataaacagtggccctgcctttttaactataataataatgtcggttggtacatttgactcttgtgccttgtcccctgccgacgctgcagtgctttgctagattagtaaagattactcttaccaccagatgtggagcctaaccggttggtagggataccaatggtgctcctctgatagtccatc

SEQ ID NO: 4596 - DNA, 1154 bp, Zea mays
ctcagcaacattccctaaaatgagttctttatatctacatttttaccaaatttcacaacatacaccttttctaaaaaatcgttcgtatatcgtgaaattaaaatatgctacagaatatatattcattttatggtgaaattactcttcttcatatttagccaaataagctaccagacatttgtattgtaaatattttccttatcggacacgcaaacaaaaaacatccatgtgcagtcgaaattgaattatggacggatgaaaataattacattatgtaatcgaatttagtaatctttctttctgaagaaattgctatctaagtatgttttgtaaaagaaattcttattggacaaaaaaaaaacatagttgatctctctattttgctttagagacatttcgtcgaacaggggagctgctgtcttgatatcggttgccgagcggcatggctcgtcggagagagagcgcaggagtacgttcgccggagaaggagcgcaggaggaaggtcgctgccctgcgcacggcggtggccagcgtcgaacgtcgcggagttggtggcgaagctgcgtcggctcggcgactccacgtcttcttctaccttcggttgcgcgggagtgaacagaaggacgcgcgccgagtgaaacagtgtattgcgatcgcttaccagtcccccaggtttgctggacgagaaattttagcgaacgatttagcggattttgttgtagtcacatcggacgtctatgtcctctatatttagactacataatcatttacagttcttgttggagacagcctgagatggacttcttccgcactacagctacagagaaatgctccgtagaatataaaatttttccaaaccccgtcataactcataagtcataagcgcgttcagatttcagaaataacggctacgcgacgcgtacgcaacataggctatatcaatgtgctaactgctgactcttctcacaacggccggcgactttttctattcgggtggcaattcggcatcaacatttttctataagattgctgttgtccaaacatgcttcttcactcaaccatgcccttaaaggtcatcatcttctattcgacctcagcttgtctgtctctctagttagctagctagcgcgagcttcaagcctccacctccagcc

SEQ ID NO: 4597 - DNA, 687 bp, Zea mays
atgcacgagatggtgaaacaaacacaagatttattatgacaaaaatacgcacaagacttgtgaaagaaatttgtgcacgcaagatttgtgagtataaattacgtgtaaacagatttgtggaaaaaacatacgcacttgagatttgtgaacataagatcctagatcagatcagaagaagagaaaacgttaaaaaaaaactgaagagtacaaaaaggaaaaaaaaagcacggcagcgtactgcgctctgcagctagccagtacaggaatgagaaaggagaacgggctgagatatcacaaggcacaagccatgctgagaaagtgagacgagcgttcgctcaggacgaatgaccgctgaactggatttgggctgttttgctcacttaaagagcccaacttcacccagatggcccatgagaaccagcccaytcttctcctcccgcagcctctctgtctctcgctcattccaatacactgacacgacggtcccatcactcatcggacggttcaaaccagccgtgaacctcatctccaccatccgccgtagggtaaccctccccaaaccctcacgacgcactatataatgctctctcttctctctcgtccaacgctagccgcaccgcgctcacttccgcaccctcttcccgccgcgccgccgccgccgccgcttcctccccgccgccgggcaag

SEQ ID NO: 4598 - DNA, 1500 bp, Zea mays
caccgtggcggtgtaggtgtagcgggtggcggagccgccacgctgggggagaatggatcggtggttgcgacattgaggagggatgcatggtggcgtgcgcacaaaacgcataggcgtagttgcatatctgttttctcacactgtgtgttgatttttaaagaaatgtaagagattttttgtaaaattatgacacaggacgattgtcgaaactgttgaaattagtattttattatagtagagatagagattgttcaatgcaattgtttctatgtgtgtgtgcgcgcgcttgcttacaccaacatgaagttaaaaagcaacgacatccttgttacccatgttatcgaaattatgtgtgttttgcaccagattcaccgtttagcaatgaactacttaaggtatttaataagcgtgccaattacttttgtgtatggcacatatgtgtatgggccagagcaatcttgcttgttggattgctttacttccaggttacatctcccagatcatgtgttgcagataataagatcaatttgactatgaccatggaatgatttatgttggagcaaagttattatgcaagataatctttccaatgttttattacttttacttagtcgaacttctgtctgtcacaaaatattatttcttttagctcttgattttttacgtctatatttaaatggatagaaataaatctagacatatattttaaaaaacacatagtattgtgtaaacctattaattatcaaaaatgaactttaatttaggacagaggaagtatgtaatcctaatacaattgaatatttttggtacaaagcgcttcaaaaattttctatatatatggttggaaaaatatggaagatgagctagtggatgtaaacttttgagaagatactataaaagacagttttgataaaatttagcggagtctaatgcattggtctatcaaatcaccacagcacagcaccgagctcttaaaytcgaacatgttgctcttttgtcaaactaatctcttgtagacatcaccatactgcccagtgccctctcagcagtcagcgctaatgaagtttcgacggaaaccatgtattgccaacgttccagcaactcagaaattacacgatcccacgcaaagagacaaccgctcaacaattctacaaaggccaaaataaaacgaagcaagggaggcatatccaatacagtaccattttaacacaaaaatatccaaagtaaacatctttaggcataatgcaaaatcctgacagcgaccacaaaaactgagacaatgtttcaccatagtacgaggcaacaacacatccgttctgaaacacatgtcctttaacaatctwaagcacagtagacagataaacaacgacaataactctaggtggccttgtcagccttggcagcagtagcagcagcttggcccctaagacgaccagttctccttgcggcaataagaccaaccttctggccaggaggagcatcacggcggacagtggaggc

SEQ ID NO: 4599 - DNA, 1500 bp, Zea mays
aatgggcaatgggacagacggtgagtcaatgttaaggatcgcaaaatttcctacaggaacgaggcctatggggaacctctccgttcgagacggggacatgactagtttctcatttgtgaggctagtcgagcggggcccgtaaataaacacggcagggatggggaataattttccccttgggaacccgaatagccatgaaatcaaggttcaacctaactatatttatagacacacacaattacatgtcttttatttttgtcttgttgttgcctcttaataattgatataactataattgttatgatgcagtgatacccttattgtccctgtattagagaacaatttttggggtgcagtgttctccacgggacagagatggggatggatttgtccctgttaaggcttccgaggcaggacaaagaattggttttcgagaacgggacattctctgctcgtcctgctccattgccatccttattcattgatgtttagtgactacatgaggaatgaggaattgtagccccgatgctcgttgaatggtttgcgcctaggccatcggactctaactttgaataatagaggactctggattataactttttctttaaatagatcttaaagataaaaataagaaaatatatgcatagaaataaaaccgaattaatccagtaaaataaatttttagtgtcaatagtgttaatagagttagtcatgtgtaacaaatactcgctcctttctaacttataattcatttgactcttgtcttattaaaaaatcataaatactttttattattacggtggtatcatttagcatataatatacttgaatatttttattttcgcgtttttttgaattgcaacgaattataaattggaactgagggagtatcttgtacgttgtattgctttcttgatggtattgaagggaataaattggctatatagatgtcaatgaaggaaatagaatagaacctgcctatgcaacactggttgcaacgagagaacaaaaaaaactaaatgaatgataatgagataaatgtatagttttagatattaacaaagagatttttatagattttggttggcaaaaggagcaatttgctcttggatctcaaactcagttttcgggcacttccacaacacttgtgtcaattttcggcatcaactccgagcgatcaatcacatctggacagttgacaagtgtgatcgttcccttccacgcggcggctcacacagtcacactagcctttctatacacaataatcacacggagtagttgtatcgtgaggccaccaagaatccacgccggttagccggccggccggctctttctagaagatcgttacggcttattattccctccgatccaaccgagtcgcgcgggtcagctgtttacaaaaatctcgctgtagcggccgactcgtccgacgtgaccacacgtcagtgcaactgaagcccaactccgccgctaagcctcaagcgaccgcgacgcagagcc

SEQ ID NO: 4600 - DNA, 163 bp, Zea mays
gatctaaacgtgaatttttttccgaaaaatggctaaaatacaaaaaattcggacatgtgtggtctgtataaaagggcggcggcacaaaacctgtctcccagacaagcgaagccccccaggccatactccgatccccaagcagaattaaacctcacctaacccc

SEQ ID NO: 4601 - DNA, 751 bp, Zea mays
gtttcgggtacccattgccatccctagtgccaacgctgtttttattaaaaaaaatgatcactcgtcttattcaaaaagtaatgagttattatcttcttgtgatttattttatcacttcaaatagtttgtgtctgacttaaaatttttatattttgaataaatattttgaaaagagaattgatcaaagttttcgaaaaaaaatcaatagggtcatattcatcaacgggtgtagtatagcagcggcctgactgactgatgagtgagtggctcacatcacatggcagcagctatcagcttcgtctccgatgtcacgcagaaattttatacaaggaaaatatcccaggccatgtgttgctgttgcattccatctccatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagcc

SEQ ID NO: 4602 - DNA, 517 bp, Zea mays
gtttcgggtacccattgccatccctagtgccaacgctgtttttattaaaaaaaatgatcactcgtcttattcaaaaagtaatgagttattatcttcttgtgatttattttatcacttcaaatagtttgtgtctgacttaaaatttttatattttgaataaatattttgaaaagagaattgatcaaagttttcgaaaaaaaatcaatagggtcatattcatcaacgggtgtagtatagcagcggcctgactgactgatgagtgagtggctcacatcacatggcagcagctatcagcttcgtctccgatgtcacgcagaaattttatacaaggaaaatatcccaggccatgtgttgctgttgcattccatctccatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttgg

SEQ ID NO: 4603 - DNA, 246 bp, Zea mays
tttttgcaggtctccttagggtgattggttgctggtgtgacttggccttcatccctgccaccgggatagatggtcgagtgggttactgcttccgcaggaggggaccaggaggagtagcgtggccaggcttcgccatgttactcggttttcttcgttagttatttctgctgcatcaaaatttatggttattatttctgaaactccgataatgtagtcactaatggtacttcttaaatttgtggtatt

SEQ ID NO: 4604 - DNA, 1500 bp, Zea mays
attatcaaaacttcttcacaagtatactaatgatttcctcgtttgacaacatttttatttatctatttcctattttataatataaatttattctataaacaagagtatttatgttgtttttatcagccacttacttgatatagttaccgacaatgttatttacaggaaaaaaatttaagtcgataccgaatatagaagtttacatttttagcaccttagaaagaaatgaagtctgatttatttgaatgttagataaatgaaattttagcaccttttargggctagtttgaaactccattttctcaagagatttctatttttttctaagagaaaataaactattttttcttaggaaaattgaaatctctcgagataatgaggttttcaaactagccttagaagaaaagaaaggttggcttccttcagtgttagatagataattctctcgtagaaataaattgaatctctgacaccacaaaaaattaaatatcatggtgcaataagaggcaattgtagtgttagccctattttgcatgtcaattataattttgttcctactttattagccttgatatatctcccagctttttgaaactaaaaaaacaagtttatccctagtcgttatgagcgccaaacggtgccagttctactttagaagaacatactgggtagaatttgcagtatttcttatccagtcaaacttttagaaaactcgcatgtgcattcaagtagacgttgttcttttgacttatccttcctaaactcgtgcaagtatgagtccaaattgtgttaaaaacagacaataccttaaaattataagcacaaattttgttacataataagaacgaagcaacaaactaagcataaagcaggacggagcggcagcggtaaaactggccggtgagtcagcggccaggccagcagtggcccttgccttgcctcctccccggctcccgtctcttcctcaaagtgtagcaaaaaaatagcccggatacgcggagtcacgttgcaaaatcaaacagaaccggagtgtcagattcagaaacaataggcagcagctagagcaagcagcatcgcagcatcgcagcagacgccaccgtcacgccaccgcgccgagagagaaaagccgagcggtggcaggcgaggggacgcctgccgcggtgggttggtgggtgccgcctccgcatccggtgccgctgctctgttcctcagtccgcccccatttacctcgcatggattcctgcttgcttctccccaactccacgcgccgatcctccaacctccaggagagcgcgacgcgatccaattgaggtccaggaggtggagggtgcctgcgctgtccgtgtgttcccctttgtttccatcccaagcctggccgcgccgccgctggacgccatcgcgcgcctgcacagcgtcttggtgaggtggtcgaagcagcggcggcggccgcagctcgggagacccggcgcgaggaagcggtggccgagccggcggagcgcg

SEQ ID NO: 4605 - DNA, 573 bp, Zea mays
gtttcttcatggatatcttggccttagtggcatggaacatttggaagcatagaattgattgcatctccaggaatattgctccatctttgccttcttggcagtgctgcaaatcttttagataaatactcgaaaatccccttacagatgcaaaaaattgcaattggctttatggctaaattctctatagcttctcccaaaccccctcttttctttgcttctttattttgtcgctcatgttactatcctctaaaataaataaaatcgtggtgtagtggtttaccctacatcattttccagtaaaaaaacgagcagcaaacgacgtcgagtgctggaagatgtctcgaccttctacaggcagtggccatttttcaggcaagaagcaagcaggaagtttgtaaatttttatcaacgcccaaattaaccagacttcctcaaatctctcggcgccattgtttctcggcatgcaaacgagggcatctccctccactcggctgccctttctgcgtcctctctgcctttccccaggtaagggcagagggagagaagaaagaggaaggggaaaaaccgtcgacc

SEQ ID NO: 4606 - DNA, 1046 bp, Zea mays
tttaaaaattattttagtttgcatttattgtgtctctttawtaatatattaaacttgataagcagtaaaggtagactctaagttgttttaaaatttgtagtataaaatgttgccttttcaagtagtaacagagaaattggatctctttggttcatattcttatttttcaaagcaaaatcagattttaaagggtgaactatatgagccttgaaacaacttgaagttgaagccaaggggaagagagagaatgcatgatgctaaactagggcaatagtaaaatgattcactgaatcattttttgctaatccttaatgtgttcctggataccaaaagatttagttgatcaatggcatattctcattttgatttttttcacatgtggtaggtgctaacttttatccttctctaattttcccgcggtacgtcctctgtccagccatgtaaatttccaatccagtgaacaagaaatataaaggtcacaccccgtcgtaaacattcaatgaactgtctaaaatataaaattttggatagatataaaatagtctgctgaatttcatatccaatatcgagtgtcttcttcttgaaggcagctgccgtgtagtgaaatgggagcactgcactttttaagggatccaccacccctctcccctaccgttccttttctccaccattgaaacactctctgaccctcactcgctccctgtcacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtccgtccatcatggaggaaacgcccagcccgcagctctagccgccgtcaatctcgtctcgtatcggagtcgaaggaagtaagaggcgggatggcatgaagcgacctaccaagaatgagaggctgggcaacccccggcacaagtaggaggaagaacccgagcaaccgagccacagggaggaggaggag

SEQ ID NO: 4607 - DNA, 159 bp, Zea mays
gtacaaatatgaataaaatattacatacattgttttatgtattatttgctccctacaacacaaaaagttgaaaaaattaccgaatttatttccgaatccataccgaagtttatatctattatttgagaaaatataggatgaatttgaggtttacctttt

SEQ ID NO: 4608 - DNA, 1500 bp, Zea mays
caccgcggcgctttgttcaaggtgtggccgccgccagtcgcctgcgtcgttgaagcagttgctgttgaggttgaggtcctcctgggggagacgcgcgacgcagccgaggcgcagcgcggtcaggttcgggtatggcctgcatagctactcccagaacttcgacgatggcgttgcctagtcagcccggcggccacggctagcttcttcagtacgtgtagctagctaggagtctaggatattcgtgtaactagctatggccaggatattagtgtggctttaattagtgctttttgtcctgatcactgagatttcagtccagtgtaaacttccgatgattatctgtgctctctagctggttcatccagttatattgtataaagaaattacttcatcttataattaggtttgcacaggaaagcaattattctatgcttgccatagatcaacgataagcagactgtgatttggtacgtcagctgttggaatggatggcttcgttgattttccagctgctcgatcgatctgcgtgttgacagatctgttgttgcaaaatgttgctttgttggaacagcagcctttcaacctatacatagtttgctttagtccgtagtaatttgctttagtccttattacttgtacttttcaatctatacatggtttgctttaattctgtttttatattcagcttatatctgacaacaagtytatattatttagttctacaatgagtatctcattgcgggatcgtattagaaagaggagggaagaagaagaagaagatgacatgatgatatttattgggaagcaaagtattggaaaaaactgcatttagttgatgatccactagaagtttaagctatgtcccactcgagtctttatacagtggtgatgtctcttgttatgctatgttcactgcatgatttttgtttttggcatgtctacaactggttcagctgttcagctgctcattgtggttgcagtcaaccataagattgttgtcttagcacctttgatatgtcttagcaaaaactcccagttcactctttgatatgtctagattgaaccagttcactctttaatatgtcttagcattgaacttgttttagattcaacaaatattcttgtcayggtgccagcaatatattaaatctacattgtgtaatatattgtcaaacaaggcttgggttgctagctttaactgcatggaatggaattagtccaggctgaaacgaacgaactttagtggccaccaggtttcatttcagagccggatctataacagaccaggttccagtgaaccacccggatccactctatatggaccagaaataaatacatgtctgttttcaaaccaaagcaaacgaacgcggccttaaagttcttcaggccctggtgtagcagctgaactacctagtttgatggtgaagaaagagctctaggtgatctaaagatggtgatgagataaaagcaccaaaaagtgtacagtgggatagcaaggat

SEQ ID NO: 4609 - DNA, 238 bp, Zea mays
ccttcagatctagtttgagtactttgagtttagagtgctttggagagattggagagtgtgtaaatcctcaatatatcaaatactccttcaatatatctcaattcactctaatacgactcattactagaatacctacactaggcctcagtagtcgtactggccagactgttccacatgcacctactgctgcagctatgtactcgcctcacaggatgagagagctagcaccttttgctta

SEQ ID NO: 4610 - DNA, 273 bp, Zea mays
gaacctcctattgtagctcagccacccagttccagttagccgggccttcaggttgcgcatcaaatgtaagttcatcgtctgactcgagaagtcaatcgtcatatccctcgaagtcatcctcagatcgggcgtgcgagggtcttgcttctaggttgtgggagggtcctacctctaatgacgatggtggaaacactccggtgctggaaagaggaaacactccggtgctgatacagatgttccctcaagtgctcttctggacagtcaaacgggtgc

SEQ ID NO: 4611 - DNA, 1046 bp, Zea mays
ttataaatatatatatgtttatatgtagctccataaaagacaacccactatcaacagttgaaagcagcaattggccgtatttcacccccggcccccggccctttgcttgtcataaaaagcttcctttactttacatgcatgttcactcattcacagtaaaaaggacacacacataaaacacaatatttcatacatgtaaaaagaaatctagttcaatatttacacatagtaaagtttacttggtggcggataatatatatatgtatgtatagttgaggtcgttactaatagctaacagtttctttttggcatgttggctaaaggaaaacactatggaacacaatgaagagtctcacaaccaacgtagttaaaatagaggtcacttgatttacacattgatagatatgcatgcctctaaaagagaaaacagtttatgaaatggatgatcttttttttttaaaaaaaagaagaggaaaaaaaatatagtcgagacaaagatgcatactgtcaagtcaacctttcttctggatgcctcaccattataatgcacaagatgacccaccaacaaaagaacagttttacctcttaaaatgtcccagacaacgcccccccggcgccgcatgctacaacaactggagtaggcaactcaccaagatccatgcatactcttgtgatgacgatgcatcactctgcatgcatgcatttgcgtgatctctctctaatcggctctgctaattaaaaggctcagaggatgatagagggccaaacggattatctcaccatcatcatcatctcctgtaatgtggatatgaataacaacatgtaattaattagttctaaagcttacaaggagagatagtcgtagagcagcagccgctccggccagcttgtgtcaatggtagccatgcggggagaacaaagaaggcgggcccccttgccctctgcccccgccgtcatcaccgtcgccgccgtcgtccatcttgccgaactgcgcgtccatccctaggttcagatacaccatcctgttgtccaggctgaggttcacc

SEQ ID NO: 4612 - DNA, 1500 bp, Zea mays
tctcgggtttcgtcggcggcgtacgactataaatcaccggactgtccggtgagccagcagtcggccgggccaacggtcggccgcgtaatccgcgcgcgacgcgtggcagagccaacggtcagaagggggcaccggactgtccggtgtgcaccgggcagtgtccggtgcgccaacggctccgaatctccaacggtcggcttcgccaaagaaggaaagaaatccgcaccggacagtgtccagtggtgcaccggacagtgtctggtgcgccaggcgacagaaggcaagaattgccttcctggaatgctctcaacggctcctagctgccttggggctataaaagggacccctaggcgcatggaggagtacaccaagcattctctaagcattcctaagcaccaagactccaattccgcgcatttgattctttgtggtagcaactagagctctatttgagtagaaaactctttgggttgtgttgtgagctcgagttgtgacttgtgtgcgtgttgtgctttgattttgtgtcttgtgtgcgttgctcatcccatccttacttccgtgctttttgtgaacatcaaagtgtaagggcgagaggctccaagttgtggagattcctcgcaagcgggatatagtgaaacaaagcaaaacaccgtggtattcaagtgagtctttggactgcttgagaggggttgattgcaaccctcgtccgttgggacgccacaacgtggagtaggcaagttttgtacttggccgaaccacgggataaaccactgtgtctatctgtgttgatcctcttgtggttgttgtgttttacaagaactcctctctagccacttggccttattgtgctaacgcttaatcaagtttttgtggctttaagtttaagtttttacaggatcacctattcactccctcccctctaggtgctctcaaatgtcctcctcttgaggtggctcatcctcttgatcttcattttcatcatcttgagcttgatcctcatcttgggttggtgaagatgcttgtgtggaagatgaaggttgttgatcttatgcttgtggaggctcttcggattccttaggacacacatccccaatggacatgttccttagcgtaatgcacggagcctcttcatcatctagctgatcaagatcaacttgctctacttgagagccattagtctcatcaaacacaatatcacaagaaacttcaaatagtccagtggacttgttaaagactatatacgcccttgtgtttgaatcataaccaagtaaaaagccttctacaaccttaggagcaaatttatattttctacctcttttaacaagaataaagcatttgctaccaaagactctaaaatatgaaacattgggctttttaccggtgaggagttcatatgatgtcttcttgaggattcggtgtagatataaccggttgatggtgtagcaagcggtgttgaccgcctcggtccaaaaccgatccgaagtcttgtactcatcaagc

SEQ ID NO: 4613 - DNA, 791 bp, Zea mays
gaagctacttaaagtttggttaaagattgactcatggtttgcacatttgcttattctctcccccctctcaaccatggctttgggagatagggttcaagaggggtctagggtttactctcctcttgtccaaggtagtgagtgcacaaaagcttgagtgatgcccttaggtcattaacaatcttgattaacacatggtctccaaggttcttatgttctccttaagtttctaccacatgtgatcacagtccttagtaccaaggtgtgctctagccatggtaacacctgaggtattacagactagcacatgttggaatgaagaatcttcacaagcttctaaagggagaacacattttgggactaacaaatgttcattttgagaaagacaggaggcagggaagcaagttggtgttcatcatccacataagaacatcatgacgactgacaggccactcgagctcctacatatggacctattcggcccgatagattacataagcatcagcgggagtaagtactgtctagttattgtggatgactattctcgcttcacttgggtgttctttttgcaggaaaaatcccatacccaagagactttaaagggattcttgagacgagctcaaaatgagttcggcttgaggatcaagaaaataagaagcagcaacaggacggagttcaagaactctcaaaatgaaggctttcttgaggaggagggcatcaagcatgagttctcttctccctacacgccataacaaaatggtgtagtggagaggaagaatagaactctattggac

SEQ ID NO: 4614 - DNA, 620 bp, Zea mays
cgctagatgttaaagagtactcttctacaagatattgcctcgtagcacgaggatatcatggctgccagagaaactgtcataacacagcatgtgatgaaaaccacagcgtgcaaagcaaagcaaagcaaatcaagccatctcgtcgacgcccgagcaatgacagctcgacaggtgggggggctccgcgaggatcacatgcgctgtactcggtagctctccgacgagagacgattgctctgtttcgcggccacggcgactcgccggctcggcctcatctgaacccagcagacatatcgacgcgggcgttttcgctaggaaacaaacccgagaggtctctcccagcaccggacgtggccaaccaccacagcgcgcccccgctccacgcctccacagaaaataaaatccccagccgtcgtcgccaaagacaagctcttcaccacaaactgacaaacacgacccaggccttcttcctgcgagtttcatttcatttcatcctaccttacctttttactcctccagtccagtcagagaacaccataagtggccgctacacctgctcactccattgcaccactagcaagtagcaacaggagcgcaggcagaactagagcggtcttggt

SEQ ID NO: 4615 - DNA, 298 bp, Zea mays
tatatgaaactaatttgagtgtattatgcaccaaaaagaaaaatgaaacttggttgctcttacactacaaaatgtagtttttctgacctctttatttcacctaggaatagactgttaaatttgcaaactgaaataaagaaattaaccacattactggaagctagcgttaaatgtgcgcttcagaatgcaatcaatcacttggtttgatatgtgaacctcataaatgaagtacttaacatttcttacatattttacctgaatatagtatataatacttttgtagggttcccttatagaa

SEQ ID NO: 4616 - DNA, 1500 bp, Zea mays
tctcggcgccgatcatgacagcccccgctggccgcggcctttgctagtttgcatctaacaatttttataactactgtttttccattttcttagttgtgaagactagtattcttttgaggaatatatgagtctgcgtgaaggtaaaggtatttaagactagtgttattctaccgcaccattattatgttcttgttgaatctgaactcttagtttcatacgagtgtatatctaatctattgcaacttattgaaagaaaatgctgtctttcttggagtgtgttcaggctcttgcttacatgattaagcaacatttgttattgaaaaaaaaactgttggagcgttaagtacatctaactaactaggctatacaaaatcattaaatcattatacgttatgcgaacaatagttttttttttccatacatgtcgacgccagctcaaatggaaatggtaaaccaaacatcttagagccattacgtgttaacctgacgtcatgatctacgacgtcgactttaatctctcgagaatctgaacgtgattttttttaaaaaaaggttaaaataaaaaaaaaaccgttcggtttttacgcgctttgtttcgtcaccgcgatggctcgtcgtcgtcgcgcacggagcgatcgccgtccgggccctgcctacctagcgtcccactagtcgcagcagcagcagcagcgcccgcagcgtctgagactctgagtggacgttcgtcggggaggcgggcggccacgcttccaaccaagttggtgccgccccgatcgcgacccctcgctggctgcggacgtgcgcgcgtcgtgtctgcccgcggtcatcaattcatcctcttgcttggacgctgcgtccgataccgagattcttctcaacttttttccacgttccggatgctctgtgaatccgtcagtacgtatagtgctcctctgagtactaactttggtgcttatcatggtgtttaaatagttgagatggtcgatgcgtagcggattttccggaggacactgtcttgtgacgatccactgtgctgtgctcttggtactatagctcgacagaccggtttggatcggcctgaataattggattcccctgcgccgcgcctggcctcacgaaccgcacgcattattgggcaaagcggcgggcatattattgggcgccacgaacctacgcatgtggcatgtctcccgccgatcggacggccaggcgcgctcggccgcgcggatccaacggcagaggaaggaaggaggcaccagccgtcagcggctagcggctccccgagcaagatatagccagccgccgcatctataaaacgcgcgctacccgccccacccaccgctccccctcctccactcgcctgtgtgtgtctgtctgtccatccatccatccatcccgctgccagtcctcgcgccggccaccccgaaataatcggaaattgcaacccggtccacgggtcggatcccccaaaccgacgaaccctcccgagctcgcccggcg

SEQ ID NO: 4617 - DNA, 754 bp, Zea mays
ggcttcgctaaatagtcgaagctcggactcgaaagttaaatccacatgccagcaggcccaaacaaaacaaagtcaagttcaaacgtgggttgccggtgaacctgccagaagtgggcccacacgtcagcagccaatggggcgaacgacacctaaccctggcagccaaccaaaaccccgtccaaatcaaagagaccccacccgcgtgctcgtctcccgccatatttgacctcctccaaccaccaatctctgaccgaccgcagcttcttcatcactgaccgatcgccttccttccacacccataccacgcccttaaacaaggaacggggctgctgcctgaggctaccgcgccgtttctctttcttgacccgatcgcctgcttcctaccaccggtgacgctagcggcaggcccatttaacctctcgatcgagcacctgtgcctgcacggcagatatatatacatatataggcgagaccagtcctgccaggaaccatccatatatacatgctccggtgagctttgctcgacgacagtcatcatgcatggcgcgcggcgagtgaagtgaatcggagcagtttgggtgccggtgagttcttcgtgtcaccctgctctgtttctttctagtcagacaggcgagcttaaaacctgatcaactaactcatcgtcctcccttgcagatttactcaatctgttcttgccggaaccaagccaagatctcgatcgacctggtccactccagtccagaccagaccagaa

SEQ ID NO: 4618 - DNA, 139 bp, Zea mays
acggggcaaaaaacaaaaaaggcgttttgccgccgtcacacagaccgggtgtcgccctctgttttttcttttttttgcctgcaactacaagaaaccctatgatttttccttgctggctcctcctatacaatccatatga

SEQ ID NO: 4619 - DNA, 713 bp, Zea mays
ggtcagcttgctagtgcccttttattgtgtcgccctgccgaccgttgacgctcgaatgtcgacccctcccgaataacaggctactgctgcgtttctctcgaccacgaccacctcgactttggctacctcgtcattcaggggctatcgtcttctcggagtcaacaccgatctctatcccaatcgcattgccgggggttgttagactgtgtgtatgggctggtatgggctggtatgggctggcaccacttttaggctgtctgcccattagggttggggttaagtctatatatgtaccccttctctatgcaatatatcaagacttcacagtccaatacttatcaacgtgaaaagtcagaagctcaaagaagcaaccggcttttttatttagcttgtgaaaagtctggtactctgttttgtgcgttgtacgtagcttcattagtttaggaagtaatagcatcatctaaaagctaccattgtcttctcatgatcaaaaggcttttcaaaaaaagctctagatattgcagcttaaacaagcaggcctttagtcctctcaaagacgttctcttttttacttttactttgcatgggtttttgtctaaattgtggttacatgctgaactatgagtggtaatagctggagttccttgtttcactaacaggagctgattgagaaactgagcaagggtgaattacctctaaaagagtacccatct

SEQ ID NO: 4620 - DNA, 252 bp, Zea mays
tgtcaaggccattattccagcccaaccccatcgtcttctatagttacatctacactacacctagggcccaggaaaaaagcccacacccacagcatagggcacaggtccacagcggtccaagcgagtgctaggctgttagcaaatatcaaactccactgctaccactaatacacatcgcccccgcacatatcgatctcgtcgtcgtctcccccggtggcatgctccgctcccgctagatccgatctattatct

SEQ ID NO: 4621 - DNA, 1500 bp, Zea mays
tgcggatcccagaaccacgttgtactcgcgatgccgcacgttccgtcacgaggcgtcggccggctcggtgagtgaggtcatcaacaagcaattaacacttgtgacactgccagtctgacataggcgattgtttatctggcacttttaaactaatcgtgtacagtagcacgttcaattcttgtgcacgctggcagcaaacgccgactctggctgttggctcgtattacgaggaaggagtaagtcacactcacagatgaaatgaagggataatccagatggcatctcgaccggagaaaaaaagctgcgaatattctcaaatggaaattcgcattgctccgaaaggytactagcatggtactccttggccgacgactatggccccgggttcggtcaacactatggtgaggagagccccgtcaaccctttagccgcgcctcaagtcctgaagcaagtcacgacgcttttatcccaagactccaattgattgcacagccaacttcctgaaatacgtatgactccctaaagttgaagcaagtgatacaaattacaaaaaataaaatccatccgttagagcaactccagtaattctctaaaagacttttactaaatcaataatttaggtagttaatatgaaaactattctccaacagttctctaaatgaaatttctaaatttaacaacttgtcatctaacctcattttctctctacatttggcaaccatttaacaactccctaaacaaaaatattggctgcattatatagtttttgtgacttattttttatgtggataaatacaaaacaaaattacaacctatatttagagaactattgggagaactcacatttttttactctaaaagccatttagcaacttcttaaatatgtgatttagagagctaaaatttacataactattggagttgctcttagttaaaaactcttctttgacgaatgatacccatcgttggttttcagttgcttgcgagcgaacgggtctctggattgcgaacgggtcaatctaattaatctggagttggatcttcgtctagtttgcatgcagctttgatttgcatcccgatccgaattctgggtaatggcaaccctggccgcagcaccgcagctagtagtgtaggacccactttcacgccgataactgcctcagaggtcaggcaccgcaccggcgtacggtacacgagctgagcgatccctaacctgcatgtgcactatgactgagtaatccattccaccatgattagctttcggtacggtggccatgtggatctcgtacctctaaacacggcatgtccgatgtggcgacgactattggtgccgcgaactgctcatactctatccctgcttgcccggcggccgactataaatacacaggcaatctcgtccctttcgaccatctaaattaacacaagcagtcaaacgcatgcacacacaaggttgttgttagcaattttctgctgctgctatacatacacgagctgcgcgcg

SEQ ID NO: 4622 - DNA, 263 bp, Zea mays
attaaaaaaaatcagcagtgaagccaacaaagtttgtgaatccgagttctttgcatcctaaaaaaaacagaaagaaaagcacccaacagaatcaaaccgctgaggacaagggatacagtgcctttgttccaatgtagagttgatcagttgaggcagaatcatcatgcctctgttcttgctccataagcttccagtacttgaggaatctcttcctggtgcttatcaacgtacctttccttgaacttcttttccggcattgtcag

SEQ ID NO: 4623 - DNA, 1500 bp, Zea mays
agaaatacaagatcactccctcttgactttccaaggcaccaatcactaatgatcacttctcacaattatggcacttggaggagctttggatgtgtcttggagtgatgtgcttctcttgtattgaatgtgaatgaatgaaatacttggatatatgaatggaggtggttggggttatatttatagccaccaaccacttactagctgttgccaactatctgccatacgcggacggtccacgctcttagcccggatggtccgcccctgcacatcaatgactgaaatcataacggttagcagtaacggctatatcaacgactataagtgcattgatgtgttgtcagatgtcagataaagcagtcgcggacggtccagccgtgcaccccgaacggtccatgaggacgctaaaaatgaattttaccgaacccgacatctttggggttttttggttttcaaagggcggacggtccacgcctgagagccggacgatgctcttctttccttcggacagttcatagtagaaagatggttttcaataaggttcctgtccgaggtgtatctaggtgtcgcagacggtccgccagaagggcccatgcataggagatttttccaaaaaactctcctattcgaagtaatctacgttattctagacaatcgacttagaattgagatggatggacttatgcacatgtgaatcaaacacctaggtaaactagttagtccatgaggttgtgatggttatcaagcaccaaaatcaattagagaaaatggttaagtccatttccctttcaagaatactccacactatttgtaagtattattttagaagtccataactattgttatgggtactaacactgtcagtagtgcctgccgcgagccgctccctcctcttgccctgtttaggtataacgtcgctcttttggtgcaacgactagctctaaactctcctctacgcggtacagtggtagggtacaacacaggaggccgttgtgctgccaccttgtctctaaggtcgtgcacaccattatttgttaattgaggaaaatgataatggacagtgaaaatgtttggaaaataatattttattattttaataggtatataagaagaatttagaggaaactgtggtgggagagaagtgaatgggtgaaatctaggtgacgtgactgcatgtagtgactatatataggagaaaaattgaagaacaattgttgcatatagtctaacaatagaaaaaaaatactattttgccaccctcatattagctctatgctatcacgttccggatctataacttatagaattactgtgtatatgatttgtgagttggatagtaagctagccaagccactgcccaccacaaataatagtgggtaaaattgcgaatggctcctccggaccagaggacggctggaaagggtaacttcgcctcctgatttcctcccccgcccgcgctcacccggtgaccgcatctcgggcgcagccacctcccaatctccg

SEQ ID NO: 4624 - DNA, 1500 bp, Zea mays
gattacgatatgtagaggcggacctggccaacctcatatatatgttttatagtccataaacggaacctggaacaagcccgcccgaagaagtgggccacgatacgttgccgccagtgcatgtgcctacctatatatgcttttcggatcctgcattccaaaggatagattttagttcgcgcaggagcatgggttgatacactggttaaaaagaatcagcattctatgtaaaaaaagaaaaacatctaaggaaaccaaccaccaaaccattaaacatgagctaaagaaaaatcttcagaattcagtgagatacgatggatggtaaccacgatccaaatgtttcttcgtaataaattaagtcccttaaaaattttagtttaaaaatcttcagaatttttttgtttttgtttttttatcgcatcatcgtactcaccacatgcctctcgagtaatttagcgcataagattcctgctacgcatcagactactactgaagcccgtgtcagccacgcgcctcggattaatttagtactaagagtgccatcacatgagctggatacagctaacttggtcactcctcttttaacctagtagatagtggcactaattaatccatccttgaccgggaaaagcttctctcctcattggcaaatgctgggcagtccagatggattaggtaggaggtttccgccaagtgctgtgattataaatagccgagcccatagatgtgtcccatttcagaacacagaaacctttcagaacgagggggaagcgagctagcgtcggagtcgcgtacccttggtgtcagagagtaaaaggttagcactcaaagtagcataagaagcacacatattttgaggtgttcaagctttggtttccttgttgaccttttgtttttcatatcacaagtgtttgctgcgtcaaaaaccagcataaacggcatatgtacgtatgtatatatttgagttgtctgtttttttttttggtttttcataccacaatcattcaagaaactgtattttgatttgggaaaagtaatggttcggtaaatctgatctgctgccaaattctgagccttgctgtggaatatgtcgattatctgccgttttgcttccgtctgattcagtggcatttatcatctcgttgtcaaatttgagaaattgaagaatctagttcgcattctcagatactgtcagtatttatactaccagcagcataggactagaaagtgtactaatcatctaacgagctttcagattaactgaaatctgctgctcgttttggattaaatccgaatggtacagctataatccatagaggcaaaaacactgtagaagtaataaaagtccattaaagctaagcgaacagatataagcatgcagtatcaaaatcctgatgccttgcaagatgaaaacagcagttctattaacatctgatatcacccaatgcaggcatcacaaggacagtaacagaaacctaataaggtcttcggcagcggcacacc

SEQ ID NO: 4625 - DNA, 55 bp, Zea mays
ggaggcgaggcccgcccgccattcctgccctgcactgtcattgtggagttgagcg

SEQ ID NO: 4626 - DNA, 358 bp, Zea mays
tggtatggtgtaagccaaacggtgaatcaaatgactagttagttaaatacttgtccttggattggaacggtataagcgaattctatcctgctaacggggcccacatggcagcgtggcttatgccgacgcgacgcaacgcagcggcccaacggctctctctctccgctattcgtcttgttgctctggctgagccgtgtagctggctggccgttccccacttcacactccacccaccagatcgctggtcaaaaccctagtcaaacctcgccgtttgatccccggcatccaatccagcctccaattgacctcctttctagcccaaggatccaatccaagcacctaattccatcccatccgg

SEQ ID NO: 4627 - DNA, 341 bp, Zea mays
ggtacacgctcccagctccccatggccccatttgattttgtctatttacacgttctgttgttattgagcaatttcagagcactgtcagttattgggctaggggaaaagtcagaaatgcctctaccgcatatccaatttcatagcgtgagcaggcaccagtggccaagcttctgcagccttccacattgctgtgagctacactatctcggcactttattctgcacctcaacaacattgaacaaccaaggtattttttagtaatttattaacttatacttgtaattagctttattatctacgaacatacttgttaatttatgtttctttgcatgcttgtttag

SEQ ID NO: 4628 - DNA, 263 bp, Zea mays
tatttggcgggtaacagtgttactgtttgtgttatccatgataaaaaaaatatagattgattgttctatctcgatctttttttctcttccagggacttatccagtaatacattgagtggatctgttccgcattctcttgataagttgtccaaacttacatcattgtaagtgttcattatttgggtagatccatctaattgttatgaaaagttggtggctcagataaaaatcatttacctgcaaccttgtgcagcaatgtttcc

SEQ ID NO: 4629 - DNA, 1500 bp, Zea mays
acaatcaaacccagagtaagggaggaagaaataacacacacacaagagcaaattatagcaacaaacgcaagagatgcaaagacatgagcgcaagaacacagtgacagagttacaactcaaaaacaacgctcaaatctctctagaatcaataggaggcatggtcgcagtgtatcgaaatgttgtggagctcttgaggtgcttggttactgcaacaaggctcttaattgttccaacaaatctccatttgtgtttagcaattgaaatcacatctcatataacttgtgaaatcataaatttcttgtcactgatgcaccaaaactcacttcggtcttgttcggttattcttcaatccatatgaattggatagtattgagttggtttaaacccatagcaagtcaaaatccaccccaaatctactcagaccactctaatccatgtgaaattgtaataatcgaacaagcctttaataggatagtggacttcgtcagacgctggggtatagattggatataatttatagggaaatttggatccataccattaaaagatcaccactttggatccataccattactatctcacttacatgtgggtccacatgagtcaatgacatgtggggtccatggtatatatctaaagtttggatcttttaatggtatagatccaattgttccataaaataaataatatttgaatttaatttgtcgtaaattttagtttgtttttttaaaatatggttaaacctaatgttctgtttggatgttgatattgaagggtatgaaattgaattggatttaataccgaatcatttatgatattgaaataagatgtaattctaattctattttatcgatgaattggagtttggaattttgtgatctaattttatgcaatacagaggggcgactcttggtactgggagaaggagtttatagttatagtccaaatgcagagaattaggtctctgatttcaaatataaattctgtgtacaagagttggtcaaattcttaattctgtgctccaatattaatatctaaacgggtattatataaattgatttaaaataaaattaaaatatacactttacaaaactgcgacttggcaagaaatgaatggaggcggacaggcgggcggctaaaactctttcatttattgggtttcggttcctgtttcctcctttctctctcgcaattcgcacacagcctcctcttctgctccttgtctccctgtcaagctagtagaccagtagtagtacagctcctcagccctcagtgcaagattcaacctgctacagttctccttgcttccgcagttatcctgcacagaggttcgttgttcctgttgttggcaggccctattgtggttgctttccgtaaacagcacctcgatctgctcctctgccagtgccagtcgagagattcgattgatgtggtgtgctcttggagccaggggctgtaattttgtcaacagcttcccgtactcccccattcccgactttg

SEQ ID NO: 4630 - DNA, 228 bp, Zea mays
ccctgcctgacctgaacatgcgggtcccatcgccgctggccagcaacgcctctgccttcttccctcggcctccgccctctgcttctagtctgccagcttcgaaacctccgccccgtcgcataaacccctcctcgcctcctccgcccgagcctgcctcctcatcgacttatacgcctccttctcttaactcgacgcactagcctcagccaattgtcgcatttcgtcgct

SEQ ID NO: 4631 - DNA, 219 bp, Zea mays
aataataggacacatatataattcattcccacatgattatattcatgggttaacttaatttaaaagtagccatccgtttattttcttcttgttttcttgataatacctgactgtattaaagcctttgcaaaacaatacaaggaagcttatagagcaggtaagcctcctcctacactacataggatgacaggaagggaacactcagattacgtacacccc

SEQ ID NO: 4632 - DNA, 222 bp, Zea mays
aacgcgctcttcggcggcgggggcttcatgccctcacagtccacggtggtcccggagaacagcggcctctctaaggtccttcctaattcccctttgttttgcttcctttcgtccatttgttctccatcctatgctgacccgtcatgggcgctcccgatcgaccgatgtggtgggcagggtcggagcgcgcagacgctgctcccgctcaccgtgaaatagacc

SEQ ID NO: 4633 - DNA, 741 bp, Zea mays
tttaaaatgaaatagcgagcgacaaatattcgagaacggagttaatattagcgaatttgctaaaagtgactaatagttgaactattaactagactgtttggatgtttctaactaattttaataactaattattagttatagtacatttaaacacctctttagttatctatttgttagttagctaatttcactaagtccccgtttgtttgtttcgttggaattgaattccattttaataattataatttagaaaaaaaaactaattaagttcatatatttatatatataatatatttatatgttatcctaaatcatatgagagagataattatatagtacatttatgttatagcgaagcaagtagaagagtgtgatataagttgtacatcagaaaaatagtatgtaaatctatagaatcaatttctatctttcacactataaatttgagatagatttatatgataactttagaaaatggtgaaatgtcacgttctaaaaaaattgcctatttcattaataagatttcaattcataaaaataaaagaaaacagacgggacctaataattttatagccaactgtctatcagtgtgttaataattttaacccacggtccaccggaaggcttccctctttgatttcgcattttggtgctccccggcagctgcgagcgccgccgccatttactccctgcctcggggcggactcatttctctgagggctccttccttccttgttggcg

SEQ ID NO: 4634 - DNA, 238 bp, Zea mays
cccaacggatgcaccatggggacgcaccttgcacatcctgaacagtagcgcgcggagaagacggagccctggccagggagctttacgccttttctttttcgccatccatcgaccactaatattacttgacaatgacataactgccacatcgccgatcgcttcgtcttcgggatcgggagtggcgccctgacggttaccgcggcgcaagaagcaaaactcgtcgcggtggaacggggtg

SEQ ID NO: 4635 - DNA, 622 bp, Zea mays
ctccatggcgcaccggacactgtccggtgtacaccggacagtccggtgaattatagcgcgagtacctctagaaattcccgaaggtgacgagtttgtggtggagtcctctggtgcaccggacatgtccggtggtgcaccggacactgtccggtggcacaccggacagtccggtgcgccaaaccaggaggtgccttcgattgcccctttgctcctttgttgaatccaaaacttggtctttttattggctgagtgtgaaccttttacacctgtataatctatacacttgggcaaactagttagttcaaagatttgtgttgggcaattcaaccaccaaaattaattagggactaggtgtaagcctaattccctttcaatctccccctttttggtaattgatgccaacacaaaccaaagcaaatatagaagtgcataattgaactagtttgcataatgtaagtgtaaaggttgcttggaattgagccaatataactacttacaagatatgcatggaatgtttctttcttatataacattttggaccacgcttgcaccacatgttttgtttttgcaaattctttttgtaaatccatttcaaagatcttttgcaaataatcaaaggtaa

SEQ ID NO: 4636 - DNA, 706 bp, Zea mays
gagtaagctgctgaacgtgctaagtgctaacttgcgtcgcctgaaatagataacaattgtgtgaatggcatgccactatgccagtgctggtgtggtaccgtgttgtgaattgtgatccttcctgccactatgccagtgctggtgtggtaccgtgttgtgaattgtgatccttcccagacaagcggggctgcgggggtccccattgctgctgcgttgtcctgtcccgttcggcgcatgggcaagctaggctgatccgaagcgttttgcatccttgaaattttcggcacgagggtctgcgttccgtccgtgaccccaccaaattcaccggcctgcgacctgcgtgcaaagtcccggatctctaattttcgccgggcaaacggtctcgatcgtttctactaccatgcagatgcagaacactagattccgggcaatgcacaagcacaaccgacaaggacaaaacgcagccgcgtagagtcgtatatgcaggctaccagcgattgaaatggggccgcggtttcggcgtcgttattagctcgttttttctcttggcacgcgtgctcgacagactgactccatctgaccgggacacgtatagccgtgccagttgccgtccgttgcccaaactgtatccagccctctcggtctcggatagacagcgacggagaggagagcggcgggcggagagaagtggaggaagaagacgagg

SEQ ID NO: 4637 - DNA, 1248 bp, Zea mays
gtttatctaagtgcttgagacatggccaagaaaagagacaaagggttgaagaagaagtggccgtgaccagccaaaccagcaccagcctggcacaccggactgtccggtggtgcaccggacagtgtccggtgcctaggctggcccggtggcgaagtggctgctcatgggaatcggcggggcgacgtggctataaatcaccggactgtccggtggtgccccagaccgtccggtgagtcgttagcgcccacgcccaagcactttggcgacgaactcgttgctcctgggaaaaggagaaggcgtcgcagctaaagttcaccggactgtccggtgagctaacggcgcccgcggtcaacagtcatctgcgcgatcaacgggcgacatgtggctgagccaacggtcggatggtcacaccggactgtccggtgcaccaacaggaccaaagatccatcggtcggcttcaccagaaaaggaaggagatcgagcaccagacaggtactgttgatgtctggtggtgcaccggactgtccggtgtgctacccgacagaaggcaagaattcccttccaagttgatctcaaacggttcctagctgccttggggctataaaaggaccccctaggcgcatggagcaatacaccaagcattctctaaacatcttaagactcctagattttgcctccatgcatttggattgttgtgttagtgatttgagctccatttgagttgtgaactccctgcgtcgtgttttgagctcaagtcttggcttgtgtgcgtgagtgtgtgctgtggatttgagtcttgcgtgtgttgctttcccttccttacttctgtgcttcttgtgtgatcaacattgtaagggcgagaggctgcaacttgtggagattcctcgcaaacgggaagagaacttttaaaagaaaagactgtggtattcaagttgatcattggatcacttgaaagtggttgagtgcaaccctcgtccattgggatgccacaacgtggaagtaggcaagtgttacttggccgaactacgggataaaaacagagtgtctcttgtgttgcttttctgtgtgattgattccatctcaagaactcactttataaccacttggtttaatctaattaacatattataaaccaagtttgtgttatgagtattgaatattgcaggatcacctattcacccccctctaggtgctctcaattggtatcatagtcgtactcttcttctaagggactaaccgcccgaagag

SEQ ID NO: 4638 - DNA, 1500 bp, Zea mays
ggatacaggtcaatgacgtgatcaagcagcaggtgaacgcgtatttgcagcaaactacggcgcggttcttctttcttaacatccttttctgagttttgacgactgcctctttttttcacttctgttctacgtgtccggtggattctgtgtcgtcgcttttggtcagcccgtgttctcggttctcgcgacctacgacggcttaaaatgcattgtttttacagtacagaacagagaccgctgtgctgcaatgaatatatttgtagtaacgggattcacactcaccggaaaggctacctaggaggaaacttgcagtgcttgcgattgggcacgtcagtagcgtgcttgtgagacgaaaggaacatgagatcggctgtgtatatccatcctctgaccactatgtatgatctatgcagtgtgatgtgatcaggtggtttggtgaataaagtagcacctctttgagactttgaccctgccttttccgcactactttgttacctacacactacactaaccatccaccagagcgagtccaaatatccacttggaaaaaaagaaaatccttccacgaaggacttcatggcacacactgacacacagggttacaccaaagcgagcaacgaaatggccctgaattatgcgctcatgtaactccccgttctcaaaattagagacattctaacctcactggaaatcaaatattttttaaaaaaactttgatcagagatgtaaaaaagtaatattaaagccttaggcctcaaaaccgagctaaaatgcttaaaattttctagagctttaaaatttatcaaggaaatcaagacaagcccttagtactacggagggaatgaaaggagatattctacgtacgtctacggtctatcgcgtacacgtgcgtgttattgcgctccagaaaggcgtgcaagtccaccacacgcagcgcaggcgcgcaccgcacgttcgcgtaccgttcgtcccccgagctccgcggccggccgcgtgtctggctggaccggcgcccgcgcaggcgcacacggctctcccaaccgcctcgctcggccgcgcccgcgcgcgaactacaagatgccggaccgacacgtcgcgctccccccggggcccgctctcccgtcctcctcccaggcgcgaccgcgcgagacgcctgcccgagtgtaaccgtcgccgtcgagcccccatccgcattgcgtttttcgggcgcgttcaggcgggacgcatgatgcgctgctagcgtgttcaggccttcaaaacgcagcacacaccggtccgttgcttgccggcccaccgctggcggcgcgcggatcctctcccaccgcgtatctttccgtttggatccccgagtcggagctcgatcagatcggtgcctctgcctgcgtgcgtctgctctggtctactatatatgaccacgggcgcgggctgacgctccatcgcccacacgtcgaagcaggtgattggcgatccttgtccgtcctcgctcgctagctgatcgac

SEQ ID NO: 4639 - DNA, 761 bp, Zea mays
aataaactttagtcaggggaaccaaacactgtttctgcgtgtttttgttgtcacatgctatatatatatttatatatattgtgtttgggtctttgggagggcttgctagttcctagctaattgtgtctgcatgttacaacatcggagtcgacgataatctttgcttctttacaaggaatcatatttacagaggcatctgaagtcttgtatcaaatcttaatattgcgaattaataaagtaggacttaatctagcctccagaaatgcatgtgcattttgtggaggtcttgcaatcgaacttggaactaggattgtgccataggggctagtcataatatggggggggtacctgtttcaattatgtggtgatatgctagacatcaaacccaacaaggaccataaaaaagattatacggaagtaaaaggttattaatagtgccaacaatactaaaaggagaacgttatcctagatcatggttcagcacatgtattctatcatagttatcacaagctaggagcacatgcaaagatcgtgagttaactatatgtttggatgcaattaagaaatactaagaactgtatcctcctttgctttgggtgcattataattttgtgtcttgactggatgccaccaatccagtctaattgttgggctgttagcatcgcttcaatgttaggtatggtctgagtactaaatgctagtgagtaaccttaatttatatctacaggatgtagctcttcccaagagcaaatacgaagagg

SEQ ID NO: 4640 - DNA, 597 bp, Zea mays
ccgcgcgcagtgaccctactgccccctgcagtacgtcagaggaaccggctccgccttagccacgtttcgtacgagacgcggcttttctcatccccgcgccgcctccctgctcccttcgtgcctccgtggcaactgaaggcccctacaggctacagctgcggccgccgctgcaaccgcatgtacggcaggcacgaacctgtcccttcttcagtctcaaattccctcccttcccttccgatgccgcggtgacgcgtgggcgtggtgcgtgcgcgcgcgcgctcctttccccctgccttgcctggagcctgccccatcctctccctccctctctctctctctctctcttgatcggttccagttaacactcgcagcctccccttctcgagtcgccagtggccacgccgggacgggcgcgcttttcccctgccgcgccaaagcaggaaacaaagcaacggccaggaaggagtcacgcgcgaggcgaaaagcgggcgggtggaagaagcgtgggcgcctgggttaacgctcccgcagcgagtgatctgagagcggtagaggccggccggaaccgcggaagaggagaggccgggggatccgacg

SEQ ID NO: 4641 - DNA, 154 bp, Zea mays
ctcgcagcggacagcggccctccgccccctccaaatagcagcgaaacccctcgcgtttaaactattccctgatccaacccctcctcaaactctgacgacgcctccttccgtgcccgtccgtcctctataagggcgccgccgaggagagagaacg

SEQ ID NO: 4642 - DNA, 199 bp, Zea mays
gattaggatcgttagcccttcactgagttgcagtttatggtggccatacattgctatcattgggtactttgttgttggcagtacttgaggattaatttcaatgaaaccagatctacctaacatgtagttcaacattggcgcattcaaatgttcaactttgtgtagttagaatttctaatttaatatatgtaattcttct

SEQ ID NO: 4643 - DNA, 1500 bp, Zea mays
atagcctttatgaattagagttctaaatggactatttggttgaaaaagttggagacttgcatgggctagagttcttatttcgggaacagggtgagttgtgaaatctattgcttctcgaaagacactagtagtacaagtgcttttggttcatgacctccaccaaaaggagggggcatgtgttgaacaacaaatttggcacttggatagtcggatggtccggccttgtggcccgaacggtctatgccctggacgattcgcaggagtagttcggaaggtacgcgattagattagttcaggctggagtccttatcccatgcgtggttatcctaacaaactcggacggaactattggatctcgcctaggaatgggtccaaacccccctatatacatgataggtacgaccaaatgagaatacaagatcaaatcgaaaccaatttattacattatttatcttcatgccttaggaatagatgtagtgtagctctagttgtagtttcccaaactcaaccttgacctctttagctctacgtcatctagaggtgctttaggtggcttgttgatatcaaaacaaccctatgatctcttctccccgacggggtcctcgagagacgatatttaggttctacacaaaaccctctacggcatcgtggatggtccaccacctacaagtggacggtccacgcgcctgcagagaagagcatagttatttgctccatggtgacctacacgcgaacggtccagtgacctatcacgaaccgttcagcaccttgcagagaggtctccaaggtctcgactactcatgagcggaatctagtgattattggtgtttagcgcaaaaacggcgccaacagtagggtttacgtgcgaagtaagatggagggtcatagagtttaagatatagaaattgacagattcctcctattgttggataactcggcggattttgttcagattgatttagaccattttcacacactatcagatgccgatcctagctaatggccagaatctgagaaacaaacaccccgaaacgtacagcggtgggcgaggtggttaggtcactgttcaccgagttttgataagtttctgtccgcgtcagcgccagctacgcgcgctggaaaatgctgactattttggctgcaagcatgggataaccatggattttttttcctgcagtgttgctatctgttctttgtttcgtagtggctgtttatcctcgtgtgcctcgcgtgcgtatatacacacacgtcctgcctgcacgcaacgcagctctataaatacctcatcaccggtgcactcgcttaatatatatccaacaaccagcagtgcaacaagcaagatttacctgcccgtgagtgtgcctttcaataatataatgtcttattttattattatgtttttgcagtgatagtagtctgtaataaatctctcctttcaatatatataattcacatgccagatcgatcatatcgtcaactggtccggcagttcgcgacacc

SEQ ID NO: 4644 - DNA, 1500 bp, Zea mays
tcgtgagcatcagagttcactgattcaccccatcctgtaaaatgcgcacaacaaaacctctccccacgccatagggcatagctgttgattcctgctcgccttgtcctactaatcaccattcacagccggacgacatgctgcgctgtgcacgaaaagcaacccctagacgaggaccaaccgacaccaaaaccccgatcggatcatcagattgaagatgaactgctcaaaagcgagcagatatctaagcaggcggttgccggtccgtggttccaaggacacaacctgcggcgtcggggacaaaacccccgaccccaaccgacacatgtaggcagcagcaaacccaaatccaacgaggcaggagagcggaggatgcgggagatcacctgcggaggatgacggcacggcgaggcggctattccctgagcggtccccgttgggagcagaggccgccggcacttctcctcctcctgtccctccctcgacgccgcagccgctctcctcgccaaccatttatacacgacaggccgcccgaccgaccgtcggcccgcggacagacgccgcgtcggctgcttctggacaagcgctgcgggggagcctctggatccacgcctccgtgaatatgcttgctcgttccggcgggcctcacgtttttggtggggagagccggagagggagaacgaattggaattcactggccatgcaccacggcggaaagcgaagagacgagcgagcaaagcaaagtgggcgatgcgatgcgccgatgcctcgacctcgctggcgctggccgctgactgcctactccttcgctgtgattttcttttccgtttttatttatttattatataaaaaatgttttcctttgttatttttataaaaatcactcgttccgtgcataaatgttagtaaaacattcttaaatttgactagatttatacaatatataagcaatatttatattatcgaataattttactacaaaaatatattcaaagatctatctaacgatactaattatgtattataaatattaatattttcttatataaacataatcaaagttaaaaatatttgacttctagaaaattaagacaactaacatttgtggacaaaaagagtattatccaacagcatttgcacaacaacaaaaaaataaactaatttctcataaaattcctatttttttaaaaaactaaatttttagaaaataaaaattctgttaaaaagatggtagcccaacacaaaactagcccaacaggacagaaacaaacagaaaaacagcaaacataaaaccctgcactcggccgctgacaggtgggtccgacgacggagagggtttggtgtgttgtgggggtaggtggcaagagccggagcagacgaaatttggcagtcgatcggatttgtggctcgcggagctggaccagccgccgcggttttaaaaggagggaccgcaaccaaccacctcgccatcgacctcctcgatccagacagcaggcagcagcc

SEQ ID NO: 4645 - DNA, 556 bp, Zea mays
actgaacaatgcaatctttagttttattatcaacaaatgcagtgaaataagttgggatgaatctgccacctctattcctcatgtcaaccaacaccccagttagacaggaaatgtatcatcttacagatcacagtttctgatattcatttctgctcttttttggttgatgatcgtgtcatatatcaattatatgcaataaaagtgcatagtttcttgcaaaactaccagtaaggacaatatttaacaactacacagtctcgtttccccaatagcaagcgctactgcaacaataggcagaaattgcgtagcggacaacctaactaagttgtgacaagtcactgaggaagttttggagccgcccgtaactaaggaccaaaactgatccaaagtgaaaccattcaatatcaagaattgccatactccgaaagccagatagcccagaaccaaaacattgattaaggcagccgcttccgcctcggaatcttaatggctcaccttgtgctcgttcttgttgacaccgtatccgctgcggtacatctggccgacgagcacctgc

SEQ ID NO: 4646 - DNA, 966 bp, Zea mays
ctatgttattttttatttgtcacgttttaatttaaaaattaactagcgagcgataaatattcgaaaatggaggtagttttttagaagcggtggccgctagagatgcatagctggaggctaaaaaaagttttagatttaacttttacaaaaaaaattacattcaatcaattaaaggctcaaaatgataaaatgtcaactaatttatatagaatcagaagagcgtcacctctatatttacacaagctagagcccccaatcaagaaacggagctctctgtaacgggggtttgtaccgctgttgtagataaaaaaacgaacatcgtctgactagtgtgactgccgccgtctcccgacgcgttaaacaacaggtcgccatagtagaagccgccaaggcgtcaacccagaagcaaagccgacgcgacgccaattcgcacacacggctttctctcgttcgtatgcgacagcagcatccacccggacacgcttttaccaacaccagcgtgtggcgttagactgccgttgccgtggcgataaaaatcaatcaaacattccctagctaatggcataaagaaatggataagtaaaccgcatcgattccacctcgaacagcaccagcatatacggagaacgcgcattttctatagcaaccaaccaatctgatgctaccagtggcatcctacgcggcagaggaatagccacgccaccacgtcccccgcgcccgccgacccacccgcaaacgcaacgcaataataataggctaggcagccagcagccaccatccccaccagcccagcaccaggaaggaaatagcggcgagcaagagctggcggaaagaagaggaaagccaggcacgccgctcacccaccgcgccaccaaccgcagatcctaaatccgatctctctctccctccctccctccctcccgctcgaggttttcggtttcgatccggcaagcgggcgagatcttc

SEQ ID NO: 4647 - DNA, 1224 bp, Zea mays
gtattgttctatactaagtttaaatatagatatggagccgagatagtctatctcactttactagacggagatagtaaaggttttggcgccaaaagtatgcggcaattacaggttcgcggtgcctttggcgccattcgcatttcataagggcactctggtaatatcgccttcgccgattttgaatatactcgggttctcggcaaaaccccacaccggcgccgcctcttcctctcggttaagtccagcccactccgccgccgccgaccgcgagaggagttctcttcgccgcctcaaggacggtaaggctggccgaaatgttcgatcctcttccttctttgattcgtggtagtagttccggggatttgggggcgggatcgagaccgtgacttcttcaggcaccccagttttgctagggttttgtctccatggacgagcattgctggggggtgggttggatccctagcccaaatcccgaactaatgattggtgccgccatcaccgcggaagaaagaggtgggagcggggttggacgtagggaagccagacggtgcggattggtccatcaacgagtgagtgcaggttgttaaaaatcaaaactccccaggctccttggagttcgctgtctgagatatttttactgagatctacaaatcggcgcctcgtatttctgtttctgatactaatcttacatgcgggatatggagaaactgtcttagaaagtgttctagtgtttcgtcttagccatgcacagtacaagtgactgatactcgccagcgacccagcgtgcatacactcattatgcgtcttactcatgctttttacctagccacatactgtatctcgaccagcatatgttcttgtacaaatatgtcctgcagtcatttcacaaattatgttggcagaatctctggaggctgtttcttgagaattattaggcattccaaatattatgtatcacatccataaattggccaaaattattatctcaagttgaatgtatattgtaacctgtcaagtcacaatgccaacaaaactctattacatgttttgcagtagaggtcctctccaagctcttattcaatcatcatactgcaatctttgatatggtgtttttttgtgatagcgattagaagatgtgtgcaatttatttgctttgctgtttgctagatggttctactgaattgcattgaatgatctgaaagtctgaatcctcactttacagag

SEQ ID NO: 4648 - DNA, 160 bp, Zea mays
agtaagtatatgattgtgctaacgccatggcagtatcagaacttgatggtgcttgtagacagatgctatcggcagtatcagaacttgatggtgcttgtagactgttcatggtgcttgtagggatgatgtatgtttgtggcttactgagctccaaccaact

SEQ ID NO: 4649 - DNA, 88 bp, Zea mays
ggtgagtgtggcaaacctggtcttgtgtagctttcagattgcttaattctgcgagatcttctgaaagatctctgctttactgttattg

SEQ ID NO: 4650 - DNA, 87 bp, Zea mays
gtctgctccctctcgcggaggcctcgctctggttggaaggtttggagaaactccccggctcgaggagatcgtgacattgagaggacg

SEQ ID NO: 4651 - DNA, 1052 bp, Zea mays
tctctataccctttctttgttaaagatttctgggtcagttcccgcgcattttactttgctcgcgaccgtacaagattttattatattattagtaatacggagtattagctagcgactcatgatgcacctggaacatgaagggatcacgacgcaaggtgggtacggcaccccacaccggcgttcgtgattttccttcccagaaattgcagcggcgaatcatagtggagaagaagacacacacacgactcacgatttcctttcgagaaggagtattttctttctcataaaggtagcacataattaaccattcaaaatttggttttatctgaggtgatcagattcttggtttctaagaaaccaggaaactagttttaaaaactgaataaaattttggtctctttggaaaccaatttctaacaaacctgatggattcaaacgggatttaataggttgtatgatataactttgatcttttagataataaatacagttaaaatataatatgtattgagagtcatgcaaaagcaaattttttcagaaaagcctgtgtcttgtttttaattaattttcgtaaaaatattaaatgaggtttatatgccgttatatgaaacggagggagctcgtaatcaaaataggatcgttttggatccccatagagccaaaagtcaatgaagtcgttgcgactggtgctgagtggtcgtgtccacctcaccgaatcaccgctcaaccgtcattcctacaggctacagtcctacgtacagccatctggaccagagttctcaactactgccgccggccacctcctccgcccgccgccagcgtctccggctccgatcacctcccccgcccgcttacggccatctccccgcccacctacggccaccgccgcccgcgaaggcgtctccggatccggccacctcctccgcccagcgtgtttaccggacacgtctgccacccgtcaggccctgcccgacgctagggttgggcgacggcgtccaccggctgacgcccggggagatctcgcccgctctgctccatccaggtgcgaagta

SEQ ID NO: 4652 - DNA, 284 bp, Zea mays
tgcagcggcgtgaagtagagatccagggggacttggatcgttttatccgttcctaggtacgtgtaaaaagcttatcccgccctgttgcagtttgtccattcgtccgtcagatctagtagtttgtttctctccgttcagttattcgcggattcgtttgctgtcatctaatccgacccatccaccccacccatggatccattaggtccttcttcctattcccagcgcacaaggctatcttatccgagctgctgggggttgagtgcgaggtcccgttgacggtggag

SEQ ID NO: 4653 - DNA, 1500 bp, Zea mays
gttgcggggcaacaaactggaggcgatgagtcatttgccggtgactagctcgcgcacctctcatctgacggagacggagacagagactgcacgttcctgttcggtaaaggacacacggacacggaggagagaggcgggcgcaagcgcaagtagtaacacggattccgttccgccgtacacaattttgtcctacctttgccagatccgatccgcctgtcgtacaactataaatcctccgctgtcatctcggccgatctcaagcccttcactttgaattttaggtctgttttagcttcttttatccaaattcatctccataaatttaagcttcaaaaaaacctgaaacaaaaaaccagtttatgaaaatttctaagatattttaaaaacactgttttcatacctcatcattaagttgcgcaaaaattacctacctacaatatcattgcttacatggccttaaaaatgcggtggtttccgctatctcaaccattattaaatgacattttagaaaaaaaataaaggagttatataagcaaaccaacacggcagcagtgacaactgacaaacagaaacagcagcgtttcggatcaacgtaatgacgaaactgaaatgctgtaatgattggagtttagcgagaaacgtacaacaacctcgcgaagctggaacagcgaaagctcccggtgtgttcgctgtatgtaagaactttagccaatcatcatcatcgtcatattcgctaagctaggtcgtctattagacaaaactccaagcatattctagctaaattttgctagctaattatttataggttaattattagccactgacaagaggctccaaacagggccttatattaatcacccttcattagagcaagagactcctttcaataggttctttaattagacatgttaatataaagtatcttctatttcgttctttattgtcgaagttggaaagctatgataattttattgcgcataagatattgaaaaactgttaaaagattttaaaaaattaaacgatgattttataaataaagggtgtttaagacttttagctgcccatccgctctctctctctctctgccagctccagcttcttccaccgcggggccacacgcacacccacaccacaccacgacctccgcgacgctcgcggccgtgtttctctcgcctcgctccctcggatcgcccgttcgcccccgcccatcgctcgctcatcagaaggagggcctagccttccgcagcagcgctcgtcagactccgccgcccgcaattccccccttgccccggcttttaatgggctttccctcccaccgaaatggccggcgatccctgcacccgcgccgccggtgaccgccccaccgccaccacctcctccgtcgccttcttctccgccgggggcgggctcggcctcggcccctccagcctgctgctccacctgctcctcctccactccctcttatagcctccagcctcccctcgcctcccgccaccccct

SEQ ID NO: 4654 - DNA, 281 bp, Zea mays
tagggggtggcgggaggcgaggggaggctggaggctataagagggagtggaggaggagcaggtggagcagcaggctggaggggccgaggccgagcccgcccccggcggagaagaaggcgacggaggaggtggtggcggtggggcggtcaccggcggcgcgggtgcagggatcgccggccatttcggtgggagggaaagcccattaaaagccggggcaaggggggaattgcgggcggcggagtctgacgagcgctgctgcggaaggctaggccctccttctg

SEQ ID NO: 4655 - DNA, 1500 bp, Zea mays; identical to SEQ ID NO: 4653

SEQ ID NO: 4656 - DNA, 1164 bp, Zea mays
tctgtgcatttttgttcatattccatgtctgaagactgagatagcttcatctcagaggtgatctgtagtgaactcttctcaggacagttacggaagtaatgaccttcacgtccacattgatagcaagcttttcttgaagttatttcttgactttttccatgtttccctttttgtttcttggacctgatgcgacgacgaggctgaaactgtgtgcaagtaatagtccatccatcaatgtaacactcatgtgtttcttcttggggctgggcatccttgtgatgtttcctttttggaatactttgcaattcatcaactgacagtgcattaggtatgagagaatctgctattagttgttcttggggagacatctgtctgtttatgccagaaaataaaatccgattcttttgttttgtagtttcactttcgtttgtactgatctggcgacaaggaattccatagtacttacaacaacaacatgttttgttggcgtttcgaacacggggggtccctggaccgacgagtaaattgtcgccgcgtgccccagctcaaatgggtcggcgcaagacggagcacgaaggggggaagaagccggagggaggcaggcgtgagaggtgaaacccgcggccttcgtgtttgtcccgcgcccaggtcgggtgcgcttccagtagggggttacaagcgtccacgcgggagggagcgagcggcctcatgcgagcgcctgtcccatcctttccccgcgcggccaaccctctataagagggccctagtccttccttttataggcgcaaggagaggatccaggtgtacaataggggtgtagcagtgtgctaacgtgtctagcggaggagagctagcgccctaagtacatgccatcgtggcagccggagaggtcttggcacccggttcgtgtggtgtcgtggccgtcggaggagcgctggagcctggcggaaggacagctgtcggggtggtcgagtccttgctgacgtcctcttgcttccgtaagggggctgagagccgctgtcgtcatagggtccttgctgacgtcctcttgcttccgtaagggggctgagagccgctgtccatcattacttatctggcagagcgagccagatgggatgccggtcttgttccccgtagcctaagtcagcttggggtagggtaatg

SEQ ID NO: 4657 - DNA, 1500 bp, Zea mays
cggatacgaccaaggagagagagagagagagagagagagaaaggtaacggcaccgaatttcagggacggcgtccagatgggatgggtgggacacgtgacgcctgcaagccggcggcggctagacgttcgcattgcgatcctttctcttttcttttttctctccttgtcttgggtccattcggcgatgtgtaaaaaataacattaaaaaaaagatggagagaaagattcgatgtgttgtgtgaatacgaacgatcgatcgtccatggcatggctacgccatctcgtcgtcgtatacctacatagtctagtcactggtctactagatatactaggatctcctccgatacagcggggaggaatcgtcatccatcctcctgcattttctcgtctctgatgatgtccagagaagatccaccagcagcagtacgtgacagcaaccagaaggaatcgtcacctctacgccgcgcaaaaaaaatacataaaaaataatactcctagataggtttctgcccgtcatacgggccccacctctcgcttgcacgtgggcccgcgcgagcggcgcgcgacacgtactccacacggccatctcaccgtgcgtcgtcacgtcctgatgcctggatgtatgtagtagtagatgagtgggaatgtgggatgaatgaatgatggactcctgctgcttcgttccgagttccaaaacggtgccacatcgatgtggtggccgcgcttctagctttcagccgggtaaatttgctgctgctgctgcagcagcagcacacagtgtggtatcgaaagattcgtctcgtgttcatgctaagtacgcttagcttgactcgttttatcgattgaactgctattcaacgctttcctatctgcacgcccgagatccaattcgtgcgcatcatgtgcgaccacgcaggcagagccaaccacacatcttacggaaacaacatctgctatatctactttactccataatactatgtacgtgataaaccacggcacaaataatccggcgcggtatacctgctaaatcaaaacatataaaaataaaaaacaaacttcttttcaaaaggcctcggattatttgccttttttatcgttatttccggcagcagccagcgccataaatacgagcgccgctccctattttgcgtccaagactccaagcccgccctccctcctttgtcgccacctccgcgagcctcttccccgaggcgagaggctgctgtgacgtcccaggcagcgccacccgcgtcgccatctccaccaggcacccaccaccacgccttggccgccgggccctccatgcttggcttggcattcgctcgtcgacacaggacaggaggatatatattgccgtgctcgcccgccttcttcttttaggaatcgtacgtactcctacataagagaggacgcggacgcatcttcttcttccctcccggaacctgagggcaagggcgttgccgcccagccgtgccacccacgatcgggtgcgtagcc

SEQ ID NO: 4658 - DNA, 1500 bp, Zea mays
taaaatagagaaggtggcatgataaatgatattgtttaacacagttttgaagagttaagttttaaaataaagaatatttgtagagtgaagtttaaaatacgagatgtgatataggatgagaggctggagattgcctgaggctaagaataagttcatgatagattctgatcattggatttaaattagatggattctgtttgccgactgaaaataaagcaaaaaccagaggcctgcagtttagcaaatcctttatttatattttttacagtttataatgcaaagtccaattctgcgccagcatttctctgacatatggccgtagacaattctgctggcgtgtactacacatgtctgcactagatgcttctcgagcctctgattcttcttcttagaaataaaacaatacgttctcaaatggctcccaaaaatccgtgcgtggagataagataagatatacatatactatatccaataatatatatagtactcctgagcagcaggagccaaaccatcaacgacgactcgtcatggactcatggacaaggaaggctagcctttgcatcggcacgcacttccatgcaacctttttctctagagaatgctgaaagcagcaactgtttttcttgaccgcagacctccgtcctacgataaaattcgttctaacaaattacttagattcaaactacacttaatgtatatgtgtttgtaaatatgtctagacttattatcatttatttaaatatagacataaaaatatatatgtaattttttgaatagtgatacaaatttagaagctttactattgatttttagctgataactactaggttaaaggttttcaaacagaacctataatctggcaatgtttgttttcccttttcaacttgtgggcaccaaaagaaaggtgttgcagaccgtcaaatggtccagctttccaatcgaatcaccatgatggtagaaattcgtcgctttttagatcctcaactctttagaccacttcatctttattcgcacgtgatctatatgatattttaaaaaagaaccaaacaaacactctcgtcgtcgtcgccgtcgccgaccactgcatcctcgtcaccgagaatatatctttattaacccaaatcaagcagattggtagccaggaaattgagtgcactgacgaaatgaagagagtacatgtgggcggtgaggaatcaggttcctcctcttccgtctctcctcccacgacaaaatgaatcggttrctgggcctgggtgggatggatggtgaggtcagcgagaccgtcacttgtcaacaaagagagcagagcgccatcttctccgcgcggccggccaggccaggtataaattccctacgcttctcccccaactcctcgccacccgatccactccaagcgcaatggctcctccttgcttacctaggtacctctgcagctagccgccatagcaagctaggccgaagcagaggatctaacagagcggggaaaagaaaagaggagta

SEQ ID NO: 4659 - DNA, 699 bp, Zea mays
atctcttcatgtttaaactcccagttttatgttatgcaaggaatgcaatgtggatgtccacaatgctatgtttgtacatatgcataatagcaatagagatcatgcatgatgcatggcagatagcacaaatatgaatgactactcaggtggttcagatagcaccccaaactgtaaagcattgaggatgacctttttgacataatttcactatcaacttttgagacaaaaaggtgcaaggaaaatgaacgaaaaatcaagctgctatcaattacagtatcctacttatctctaggttgtccctagtttgttataggcacgagttttgtgcccaaaaaccaaacgcacatatgggatatggcatatctgctatgttcagtgtcatatggcatgtctgctatatataggctggtctatgtctctttctgacatgccatgttcttgttttagttttccatgctctacatattgtatcaaattgttgcatgaatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtca

SEQ ID NO: 4660 - DNA, 461 bp, Zea mays
aacaataatataaacctattaagcctaattaatccatgatttgacatgctgcaataaatattcatctatgtaattattgtggtatcgttttacgtaaatttgtggattgattaggcttaataaattcgtagatgataagtatttgctaattatgattaattagacttaataaatctgtggtatcgtttaacattcatctatgtaattagtttttaaattgcccaaacaccgctgaagagagactgtggactgtggagagagcttccactggactgcaagctgctgctgcccctctcgttgaagagatctcgtcgaaagccctctcggtctctcccgcggtcccgccccgtgccgtgcccgtgccctttctcccaatggccgcctcctccgacgaaccgtagcgccgcggacaaccagcaggtcgcttggttccagatccccactcagacacgtcacatcgc

SEQ ID NO: 4661 - DNA, 930 bp, Zea mays
atatatatcatctggatatagatataaaaaccaagagataaaataaatattaatttaagatggaaggagtattagctctagtgcatttaaataggtctaaacattatagagatccaaacatgctcttagtttttctctcctactatgtgagatctttcctaaagctcggagccatttcccaatcttggatggagtcagcaccagccaaataaaaaagcccaaytcttccaaytgcatcccytcgttcgtacggtgctctattccgtcgttccagacgatctttaattattgacgtcaactcttccaacatggttttaaaatagtattgtcctctcgttgacctggaagtcgtcgcccacaggccacagattcagctacagcactgcggcagggtacgggatttgaagtgtccatactggaacaaggacgacgctccacggctgaagaaggtgtgtctctggtaatttcctcgttctttttgttgtttccctctgctgattcttcagaaatgtgcttgctgattcttcacgaattgttcagaatgtcggacgagaacaaaagacactcttgatgtggatataaaggcagtgtcttgaggtatggatatatccctatagatatggatgtatccctagagaatgtgcatcaaggggtcaggggtatttcgaaatcttgtaggaatatgagattgatttgcccatctgtgtttctgaaaacaaactcgaaagattaccttttttttttgctctgcttgcgcctgaacttctctgtcgtctaaaattcacacaagcgcatgctgattgatttcttctttattaagtatatatctgtaaatctgttcaaggatgttatatccttagcatgctttagagacgattcatttctcctgttcattttacagaaggatctgaacaagagagaagaaacgaa

SEQ ID NO: 4662 - DNA, 1500 bp, Zea mays
aataggcaggttcaagaggaaaatgttgtgtatgtgaagcatgatatctaggttgcaaattagatagatccagaaaataaaaaattcacatgtgaagctatatatctagacacactatattcagatgtatgacttacttaatctgaaaatgtcggaatggcttataaatcttttgaaaggagagtattgtatgcatggcatcctccttggtttctgttctcacgtgtcccggattagtaggcctgcagaagaagcctctgtctatgttcagtgtgaggtaaagagcagcactctgaagcgaagaaaactaactgcctggcatgtgaagaggtgcagtgcatgtttcacagaacagaggtccaggagccaaatacatccgcctggcttgagtcctaagctgcaggagaaaccgagggcgggcttatctcaacggattctataatcccatcctccagctttcagtttcgggtgcattactcgctgaaaaagaccttgtggcctttgacctctataagagccctgtttcggaacatatattatatggcgccaatggcgatgactgaaagtgaactcagaaaagaatcaagtcacacagaaaaatattatctttgaaggaacgactttaccatgtgcttactgcttacacaacagacatttttttttcaactgctgaattcacattttttttgtttgcggtggacttcaacctttcagcctgttcgttcctttaatctataccggcttctactgtttctatagtgtttttgtctctatggattgcagcggtagcaatctaaacagccggctttgtctacatgaattggctgccacgattcaattcaaatgtgagttgtgaattcagataaaaagaggcttgttccttctgcagctactaactgtggtgattgaatgaactaaccagatatttgtacccccaccccactgcatgcttatcaagactctaatgaaacccagaagcccaaatcaaggcaccaactgagacgccttttgccataaacaatctgttccagtaatgaagatatgctgcctcttttcacctagtggcaggactgattgccacaccagttgtacttaactaatgcggttatcttaaccatgccggtttgccactttatgcccaagcactcccccccactcactaacgcaccacaaactaaccctcaaaatctaccaaattggcctatgctttcccgtcaaaagtcggtcaaaaactgctttctcgcgctcagctgatcgccaccacaaacagatgtgaccagcgaacaagaaactgcaggttgttcgaaacaagggcatcgtgtttgtttcacagttctgaatttaaactgtttcttgtgaaattcactcctagccttgttagttgcacattggatgtgccacctcgttatatatgtatggatatacatatatatatatatatacacacacatgccggtagtggcagctgcgaacgggacaaggcaagggcgcaaggccagc

SEQ ID NO: 4663 - DNA, 57 bp, Zea mays
cattcgttcacagaaactggcgggaggccccaaacaatgagcgagtattgaggatcc

SEQ ID NO: 4664 - DNA, 629 bp, Zea mays
ataaaaaagaagaaggtttgtggttgtgattggcaacatgtgtaaaaaaagagtgaaccatatatactactccgcacgcatgttttagtgtaaaaattccaatttgaaccaactgcacatcagaacaggcatgccgtatcatcaatcgatgaagctaaacctattcatcaaatcggtgtcatgctacggcgggctgacgctacagtacatgatgagacgactggatggcaaagaagaggaggctggcttctccagtgatcgatcgataagctgcaatatcaatcaccggccttgtaaagtggtcctcagagttttcaagtcgtttttcgtctctttagactttgggcaccgtctccatcccacctgcatttgaatgccagactttggatctcaacaccagctgaacccaactgttcaggcgacggtttagtttagtttatgatctaatcaaagagaggtttttttattaggatccacctttttccagcgcaagatgtagttgttcgggtgtactctaggatctcagaggcatctattgatagaagttctcatatacacctgcaaggcttctcgttccatcacaacatattggttgcctgctaggaaaaggtggatccattatttcagag

SEQ ID NO: 4665 - DNA, 1500 bp, Zea mays
gcagccaccagtcaagcgttgcgtctctactctcagctgcgctgcgccacgccgccacgagaaagaggcgggtttcactgaaaccgtgtcccgtagaggttggcgtagacacgcgcacacgtggagtggagagcggcgcatcggctgacgggccgaggagaccgcccgccgacggcccgcacagcggcgtgtcgcactcgccattagctggcagcctggcacgtggacgggttgtctagttcgctgactggcatgtggaccgtaagcggcgggcccatcgtgtcagtgttgtagcggtggagcgcacgtgtggcggcgtgaccgacgggatgccggtgcggtggggccgcgcagttctacttacgtaggcccggtgtgtcagaatccattcctgcacatatccgggctgcgtcagcatgccattgtgtactctgaagcgtacggtgctccgttttcggcaccgagaaaataacgcatctgaaagttaggtcatgttcatttacttccagagttatataatacagattatataatgatttgtttatagattatggccctgtttgtttcggcttctggcagcttcttgccatcaaaagctgctgcggactgccaaacgctcagcttttcagccagcttctataaaaattcgttggagcaaaaaccatccaaaataaacataaacatataatcggttgagtcgttgtaatagtaggaattcgtcactttctagatcctaagctctatgaacaactttatcttcctccacatgtaatcgtaatgatactcagattcttcccatagccagattctcctcacagccagattttcagaaaaattggtcagaaaaaagctgaactaaacagtcactgtatcattggtataagcgaccagtttttcttctcagctcagacatctttggattgatcagctgtcgattgataagctgacggattgggaactttgtagtgcacgctgcacaaaaactctcagcgagaaaaagaagacacctgccagtctatctatagtacgctagctggtgtcaattctgctttgtcagaaacgcagtgtcgtcaacacaacactagcctgtatggaatctggagatccttaggagaaaaaaaagtttattccgttcattcattcatatatcgaatgcgcagacagcaatttcgatcgcaactggccgagactgctcaatcactgggaaaggctggtgtggatctctcggacggacacaccacattgcctgaaccagtgcgtcgctgcggtcaattcgactctcgtcctcccgacgcgatttgtcactgtcgcagtcgtgccgcagatgctattgatttgctgtccattgccagacccagttttccatgagagaatgatgcgatcctcctcgccctctataaaaattggcacgagaagcatcggttgggcaccgcaccggcaccaccaagactctaggcgcagcagctcctccacgcttcgctgccgggtcaagctcctatc

SEQ ID NO: 4666 - DNA, 360 bp, Zea mays
ggtgagctttttgttccctttttactgcttcttctttcttggcgaaaaattgcggtcctttctgcgtggaagagctttaactcgtgtatagaggcggcgcggtgtgacgcgcggaaccgacggccaccggcagcgggggcgggggcgaggcccggccgcgagctcgtgagggaagaagataggataaggattaaggaacaagaaaaaagggggggaaaggagaagggaaagaagaaaaattaaaaaatatgtctcaaaactaaattaaaaaaagggaaatttggattcataccattaaaagatcaccactttggatccataccattactatctcatttacatgtgggtccacatgagtca

SEQ ID NO: 4667 - DNA, 106 bp, Zea mays; identical to SEQ ID NO: 4453

SEQ ID NO: 4668 - DNA, 323 bp, Zea mays
ctgcagcggctgcgactccggtcagaaagccagccgaatttcccccgtccgatccctttcctttccaaacggtttatatatacacagccagcccacacatccccatcctttccactactctcgtcagcttgctcagctcagctcagctagctagctttcccccccccccccccccccccaagcttgcccaacccaataagctaagcaagcagccaagcactcatcacacactctctacttgctagctatccgcccttcttattagcttcgcacgcgacatctatcatcggccaagaaacggagcatatcggtcggccgccgac

SEQ ID NO: 4669 - DNA, 345 bp, Zea mays
tctggttcggttcagaagtagcgctcgtgagtcttcagacagagctcgtttgtcgccgccgccgagtctgtttgtttgttctttctactccatgctatctcgcatggttagtgttctgtttatggcttcgtcaagtaataacatatcaattaacatagtttactagtgtggtgggtgtgaaaagcaaaatcttttaaaaaaaaagagagagagatagcctcgcatgtagcaccggtacacagatgaacaattgcgaaagggaaatttggatccataccattaaaagatcaccactttggatccatacccttactatctcacttacatgtgggtccacatgagtca

SEQ ID NO: 4670 - DNA, 360 bp, Zea mays; identical to SEQ ID NO: 4666

SEQ ID NO: 4671 - DNA, 594 bp, Zea mays
tgcttggcaagttctatctaaaaggatagcagaaaactgaacgaggaaaattgtaaaactggttgtttttgcgaatacagtttttcattacttgaaatgtatttccatttcttgatcactgttattacaaataacgttagcaatctgtgcatttctttgtgatatgtgcgttttgaagatgtacactgactgttcagcttccctttatactggatgcccattttctgacatgttggtcaagttggtcctaattaaagggtaggaaattttgggtgactttattttttgcttatcaaattagtctctaccttccctataaataggactgtaggatcctatcagattaacattaaaagtaatactggttcaaacagtatgtaaaacattaaaagtaatactggttcaaacagtatgtaaatagagcatcatatattattactgagtcttgctagcaaaatgtgtaagctctctaacagatatgtttgctggagtgctggccatgatagcccaagcatgcatcaaaatttgttgcctaatgtatacattatttctcttgccattttgcagttgacttggacagccagaactttggaa

SEQ ID NO: 4672 - DNA, 1500 bp, Zea mays
gaagagacaatctcccaacaaaatttccgagctctttggaatggagaacgaattcagagcagtctggataatcctccaggtgaaagtggccacctgtcactcgaatagaatgtgaggagtagcctcagcaaagacatttatcagagccagaccaatttcttttctttaggttgtctttagagagtaatctgtttttttttaaaccaaccacaggaacactttgattctttggggaatatgctgacgaaggacgtctgtgacgaccatgaagaggtagggcgaaatggggtccccttgtctcagcccactgttcttgcaggagatccaagggccgggagtcccattgaggagcacagaggatttgccagaaataaggacgtcgagcatccccttgctgttaatacagctactttcaaccccttgctgttattttctctttttattgggtcggttatatatatgtatatatgaatcaactagatatctggatcgcaggactctacaatctattgttgttgttggaatataatataagtgagttcctcacatcttatcagcttaattttttgtttgaactagttggtacatgtaatttaatagttgtgtctcaatgaacggcaacaatgtttgctggtcgtttactcaacgagcttttaaagtttcctttgtatatgcagtggatggattggctgtccataaaattctagcccccatatgttctagatagaaaagcacatgatttagatcaaccaattcacacaccaattcaacaatgatctagaagataataaattaaccgaaaggttcccgtcctttttaaagtaagtatgcccaagtacttccggccggtcttgtcaaatctcttgtgtgtactaagctagctcaacagtatcattatatgtgaaaacaatcattaaattcttgcaataaatagctctgactattattctttttatgtactacacatcaaagccggactagtggccaagtagagctcttacctcttctatctatatcaaattaaatcgataacacgtgatccagtaaaataaaacacaccattactagagaagtctagaatgccaatcacgcttagctacttttcggaaaaagtcaaaaatattcagcaaactaataaggcttgtacgaaaactgaacacatctgattcagactaacctgagtttgaggctgaggcgaaggcagcaacatacgccacagaagatccgatccgatccgctcggcttgtccacgtcggtagccagtcctcgcgtccatactccaggcccacgcatgttactcatcagttaatcactcggcaccaacagcattccattgacttgacacgctataaaatcccttgatccccagcctccatggccgcaaaaccagcagctgcggcatcatcgttccaccttactctccaggctccagctccgaccccggcgagccgctagagcaacgagaacgaatcagctagtagccgcccgcgtatctccatc

SEQ ID NO: 4673 - DNA, 1243 bp, Zea mays
acttttgatctaatctatgtattcccgtattgatgtgttatagctatggatgctgcgtaggttgcggtgtaggctgtagttctgacacagaagctcggtattgtagttgggtaaattatggtgtaatgttgaccccaggctgctaactgtgcaatcacataagctctgactgtacaaccgtagcccttctgtgaactatgcaacacaggaaccgtaatcatcgtgaggtgaagaatatcatactatggccgattgtcacgggaaccaattttggcctgtaccaactggaacttacgatttgtatgaaaatatatttaacacttagtccacaaatattacttatcatgttcgactgaatacttttgaaatgtactaatattataatgtgttataaagtatcattagactaaacatatactataatatgtaagagcatttccaacaggagtcctaaacgagattctattttaaaatatagaacttaaacatcaaaaacatgctcaaggatcctattttataaaaaattataaaaaatcatctaacgattatagtgttcattattttgggttctaaatatagtatagtaccttactagatgagtgtccgtgcgttgcaacggagacatataatatataagttaccgtgatattatatgtccccgctgcaacgcatgtgcactcacctatatgtacataagttattatatggttccgtcgcaacgtacgggcacccacctagttgacttactaagaattaaaaccccttaatccatacagattaggatagaaccgaataagccctcacgaattcaggcacaggaacagccgaaaaagtcggagcggccgaggcccccagccaaacgcaagacgcgtcccacgactacacgagatgccctagcacgcagcgcccgccgcccccaactgactgaacggggcgtggggctcccacgcttcccgcccacgcgccgcccacgtttccttattctccaagccacggaaaccttctcgaacctcccctttccccattctaccccttctccaccactcggccctcagcccttttcaggggcagttccgtacttgcgcgagctccacgcgcccacgcctggttctagtggtctacagaacaaccggggtccctccctgcgaattcgccgcaagtccaaaggcaaagggcaaagcagaagttgcggttggcctcgtcctcctcttctccgtcgcggctcagatctctgcgtgcggcg

SEQ ID NO: 4674 - DNA, 542 bp, Zea mays
ggtaatcgacagagtgccatatgtctgtcttgcaggctggtacgagcatcgctgacatagcctcaatcacttccttgtctagatagtttgttttgtatcattttgtcaagtatttagaattaactccagtgaaatgtaaagactgattaactcttgttctatcaaacccaacgccaagaaatgagcataggaactgaggatttattaggagttcggtagacaattatactcaactaggagttccctgtatctaccaaatcttgcatctatattaggttattagcaaatggtttctcttaaaaagacttggaacatttttttgttaggtttgcttggaaatgctgagctttgctaattactctggagacactgatagcaaaattgttcgagaagtttaggctagactccttgatcaggcacttactaaagggggtgttgcagaagcttgttttgttgtaaaaagagtaggctcgaaacttgatcttgcagatggagcttgtttacctttagatatcatatgccttcaccttgagaaggctgca

SEQ ID NO: 4675 - DNA, 1500 bp, Zea mays
gatgtttcatgagcaatacattcgtccgagttgagcgttaaccggtacatctgacacaataagtatatattgaccgttatgccttaagaagcatgaccccaatgcttggcgtgatccgacactcacaggttttgcccagatttactaaaccgactagttggctagttgggggttatgtccattttatctctttcccattctaacatctaaagaaaaccatttcaagtgtaagaaagagctactaagcacttaattagcagccttactagcgcagtgagaaactagcgtgcactcaagtgagagtagtgtactccggctccgtgcggcagggtcctgcctccacgggcgttgccgtgttagggaccattctgtaatttatttcttctaaaaatacaagtagttaggcatctagttttttttggaaccaggtatataattgaaatttaaaatacttttaaatataaaaaacagaaggagttaataagacacagaggcccatgggctttctcgagcccgctcggtactccaggccgatatgtggcattcacggcacgggacaaggcagcgaaagtgaacgactgaacgcctccagtcccttgcaatggcagcctccgtcgagtcttttgctattataacactcatttaaacaggtttctatcttatagtatctacaaatttaacttctctaaaatagtatatataagttaatctcttctctaaaatagaattaagtgtctttttactcattttttttcttcatattcattttccagccgtgaatgatatgcttcaatttattttgtcaccatgtacgcaggagcctaaacgttgtgctgacggccgaactctgacatgttgtttctgttcacgttcaccatcaagctgcaataaaaatttgcacagccatgaatctggaaccatacagctcattgttcaaatatgaagttccatgcaactcactgttcaaatctgaaagggacgggaaccaatctgcttcctgatatcttttgttgatctaaacttgctttctgcatgaaccagctgcttcaacttacttcagtactgcaatatgaatttcttgagaataaagtttatactctgcatcttggtagcaatatttccgaacgtaaaataaaaccgctcggatgttcggtcacatatagcaatgtgggagcattatgatctacaaacaaaatctttaggaatatttcgatattttactgctaggaaaataagaaaggagagtaaaaaggtacttaatactattatagagaagagattaagttataggtaccattttagagaagtaaatttgtagatactagaagagagaagcttgtttaaatgactgttataatagcaaaagactcgcctccgtctctctccatccccaatctcgggccttgactccttgagcacagcacaccgagtccaagccccgaagcctcctgaccttggttactgggtagcttctgcttggtactccatgcgaggacgaca

SEQ ID NO: 4676 - DNA, 457 bp, Zea mays
cttccaccggagataactttataatatgtgtagaaagtgcatgaaaatgagtagtataatgcacagtcacttctataaaagagatattactcggaaaataaaattaagggctaatttggaaactacatgttttcaatttttttattttttcgagaaattagtttaatttttcttaaaaatataaatctctcggaaaaaacggagttaaaaaaatagcctaaaaaaatttaacgggagaacatgcagcaggtggccaggtgcggcgccagcttggctggcctaccaccgtaccgtgcccccccgtctcactcacaatccagatcccgagatccatcgtctcatcatctccatccccaaatccgcaattcgtcgttctctctatctcctccttccgaaccctcgccctcccagcccccaaaccccaatctgtctcttccgctaggtttagcgtaattcc

SEQ ID NO: 4677 - DNA, 805 bp, Zea mays
accgttacttggtccgtgacggtgacttttctttgccgagtgcccgacaaaaagtactcggcaaagaagctgttgccgatgtacagttcgccgagcgttctttgccgagtgttacacttcggcaaagccctttgccgagtgtaaagtagcctttgccgtgtgtttagaacacacggcaaagggagctgattccggtagtgccatgggtttttaaaacccgccttaaaatcaacattccttataaatatgtctcataatattattaattgaatatgttctaattgaaataaactttatgtaacaaaatttaggctaaaattagttaccacttgctccttttatgctagcttattaatgtattgattgtcatttacataatgaattattttttatgttgatgttagtgggtatgggaaacccgttgggtacccgaaacccgcatgggtatgggtttgggcaaaattttatacccgtcatgggtatgggttttttagcgggcgtattttttcttcgcgggtacgggtttgggcaagtaatacccagcgggtttttacccattgccatctctaggtgtgacacgtaaaaatttcattgctggctcagcttgcgccataccgcgtcgtgcggagttcttctctccttccgctcgaagagaagagaaaaaagaacggtccgtgctcggctgccgtgaatctctctcacctccccgaagcaagcgagcggggcagcgcgccaggaaggatcggaggagacgccatcaatcagcacttgcacgcgcgcggtcggccgcaggtggaggaagaag

SEQ ID NO: 4678 - DNA, 190 bp, Zea mays
gattgttagcagagcagcagtagatctggacatgtgttgtcgccatcgctgtagtacgtgagaacagttaggccgaccgtgcagttaatgagtgacaacccccgaccccgacctaggagggtttcaacaagctgccgttgatcacactactaaagtagcgatagcttcaatattatcatgtagcacgcag

SEQ ID NO: 4679 - DNA, 1500 bp, Zea mays
aatagaatttccaaaacatttgcaaaaacaaacaagtggtgcaagtgtggtccaaaatgttaaaattagaagaaagcaatccatgcatatcttatgaaacgtatattggtttaattccaagtaacctttgcacttaccttttgcaaactagttcaattctgcacttatatattttctttggtttgtgttggcatcaatcaccaaaaagggggagattgaaagggaaataggctcacaccttttcctaaatgattttggtggttgaattgcccaacacaaagtattggactaactagtttgctctagattataagttctacaggtgccaaaggttcaacacaaaccaataaaaagtccaagaaagggttcaaataaaaaggagcaaaagacaaccgaaggctgccctggtctggcgcaccgaactgtccggtgtgccaccggacagtgtccagtgcaccagggtggatcaactccaacttgctagcttcggggttttggggagccactccgctataattcactggactggccggtgtagcaccggactggcaggtgtagcaccggactgtccggtgtgccatgcggagtaacggctacaacgccaacggtcgactgcaaaagtgtacagtaacagtgaccagtgcggactgcgcgcgcagaagtcagagcatgcgccagaagacgcaccggacagtgaacagtgactatccggtgcaccaccggattatccgatggccccacatgtcagagctccaacggtcgaaccctaacggttgggtgatgtggatggcgcaccgaacagtgtccggtggcgcaccggactgtccggtgcgcccatcgatagacagcctccccaacggccactttggtggttggggctataaatacccctcaaccaccacacttcaaggcatccaagttttcagccaacacattcaatacaagagctagtgcattcaatacaagacacaattagagtgaatcaaaatttctccaagtcccaataccactcaaagcaatagtgactagaagagagttttgccatgttcttttgagctcttgcacttggatcgcttttcttgttccccatttcttgttcccaagatctttgtaatcaaagcaagagacaccaattgtgtggtggtccttgtggggactaagtgtcccaattgattgaggagaaaagctcactcggtctaagtgaccgtttgagagagggaaagggttgaaagagacccggtctttgtgaccacctcaacggggagtaggtttgcaagaaccaaacctcggtaaaacaaatcattgtgtcactctcgctatttgcttgtgattgtttttcgccctctctttcggacttgattatatttctaacgctaaccccggcttgtagttgtgcttaaagtttataaatttcagatttgcctattcacctcccctctaggtgactttcaattggtatcagagctacggtacttcattagagcctaaccgctcgtagtg

SEQ ID NO: 4680 - DNA, 823 bp, Zea mays
tcgtgactgtttttactctatttactgctggctgctattacggtgatcgatcactggctgttcctgagctttcacggccggccggccattggagtgagatcgatcgatgggctgcatgcatgattggacggagtgtgattcgttcgatcccgagggaacgagctgcttgattgagggaatcattccgtgtgcgcggggcgaagacatgggtcgctctcatcattagcctcagccgccgccgccgctgctggaccgcattggcatctgggtctctcccgtccgtccgtccagtactctttgacgcttgcgagaaagagattgggtggagttccagcgagggattgactagatttttcatatccatatccatctatatatcttgcatttactagatttttccacacccacatatctaaaatgttgaacatcaaagacccgttcaatattctttcttgctcctgcctgcacgaaagtcgagcgcccgacaggacgcttcgctttagtagtaaagtttgtggctgctcttcaaaaatttccaacgaacgaagatctgggcccatgtaacagaaaaaaggccatgaaatgagaatgaaacaatctcagcccagcccactatcctccggctgtgaagccacctccgcggctcttatataaaggatccattccgctagggtttctcctcggtagcagctggctcacttctccaggtaaggcaagtccccattcccgcgccgccgccgtcgccgtcgctgatctgaaacccagcgtatctcctgcttatcctcggttgtttgtccccgcgcacaggaaagtgttcgtcctc

SEQ ID NO: 4681 - DNA, 1438 bp, Zea mays
gaggtagtggggtatagaggattgatttagagtgaactgttgtagaggatacataatatagagggagatagaacgatgacgtggcgcgtgattaggatataaagagaagaaaatagagtgaacaactaaaggtagtcttacgtgccgcggccgtggctgtagccccggtcgtaaatccgccacttcgtgttgctgtgttgagtgagagtgacgggcggatctgcgcgaccgcgacccagcgtacactttggatgtgtcaactcgacgrtagcggacgatcaagattggattgcccgctggctaaaactttatctcgacacctacaaacctacaataaaatttgtgaatgtaatttataaaagactatccacactcacattactctaaattcgtattctagaaataatattataacctcgtcaacaagattatctactctacaccataatcttcgcagttatatttatttcatatatcccctctgttgcagaggtcatggagtactttatgtgactagcaagtgctttcttccatatgtgattgacatttccaactaataccttgttcggttatttctattatatatagattggatgagattggaaaaaaattagaagaactttgatttgtttatgatttaaatccaccaacttccactcaatytatatggattaagagccctaactggtctaatattaaatagagatgagattttgatccatcctgtattggaccgctgatgctttggtgggctggcccctggtggcgactggcgagtacyccggattgcatccgagcgagtagcggacggccaggatttggattggaaggagagggaagggaagaaaagcccctttctctcactgctctccccactccccaccccactattcctttctgctgagctcaggaaatcccctctggtctccccgtcccccattccacccgccgccgccgacgcgccgcgcctgttcaaggtgagtccaccaccgaggcccctcttytccgcgtaccctgttgtagctgcctccctcgcgaggtccgcggtttcttttggccttttgctccgtttactaggctacggtagtgtagggtagggtagggtttggtccgctgctgatgccagcgaggctccatcggttcatttgcattgctcgattgcttggtgtcggtatcgccgttcgccgttgtgttggctgcgctttcaatctgtgccgcgctgcgctttctcccgttgtttcgtggcctatgctagactaggctagatttagtttatccctccggcgaccacaagcccgccctgcctgtctggcgtttcggtggactcgagcgcgaacaatccacctacactgggtttctggattcgcatggttgtgtcctcgccagtgacgtactgcctgtgtgtgtggctcctttgactctttttcccctcacgcag

SEQ ID NO: 4682 - DNA, 1185 bp, Zea mays
atgacaaacatatctttggtctttagcttccttatacggcaatcgcatgcatctgtataattgtgggtttccggaacgttgcacgttccgtcagaataataataaactgttatgtacaataaaatagtaacaataaggctttgttcggttattcccattatacatggattggacgagattggaaaaaatttaaaagaagtttgacttgtttgagatttaaactcacccaatctcactcaatctatatggattgagagctaactaaacaacctaatggatatctatatagattgagagctacccgaacaagcctaatggatatcttatcctgcagagtgcagatacgagagatctgggatcgtgacagttcgcgctgtgtgtctgtcggtcacctcgtgaatcggactgagaagttccacgttccggtttctgaatagtacatacctaatgtcaatgcaaatctgccaaaaatactgataaatgcaaaactgaagagcacctatctgaaccaaaactaaaagtaaactttagcgataattaaatgtcaaatggctatgagatgtagttacaccaatgctatgggcagtacggtgtaaatagtttcctcaaaactgaacagcacaggagcgtagctcgttagcacatataggacctgtttgcaacagactggagaatttctgaatcatacaatctatcattttaaaattcactctacggtgtaaagaagggttttgcaaggctgtgctcgatctgcaggccattgtcttagattagttgtttataacttgcagtatcagcccattagtcagcactcagcaatggcgctgtttgtttcagcttttttgctgattctggccgtcaaaagctattacgtactattaaatgtccagcttttcagcatatttctatgagaatcgctttgatgaaaaccgttcaaaattaacatgaatatataatcgacacaatcgtcccgatagtaagaatccgtcactttatagatcctaaagcttatgaatcccttcatctatctctgcacgtaatctctatgatatttagattctacgtataaccagattttctttacgcccagattctctgaaaaaacagacccaatatagcgtgcctgacaaaaaaaaagttcaccaaaattccaaaaaaccaatgggctgaaagagaccctgaact

SEQ ID NO: 4683 - DNA, 820 bp, Zea mays
tgctcacagaaaatcatgggtgcatcacccacgcaacaaaaagccggaataggaacagcactgtacagtggcaacctacagatcaaccatatatccagtacaacataagtcaaacgagtaccagaaaatactcaattgcaagggtcgtacagacaatactatcacaaaacaaggattcagcttttatggctgcatttacttgctcgctctgaaaattcaacaaaagtaggtggagaagaagatttttttaaaaaaaaaaatgcaacttacaaccaagacttaacagcacactaccaaactacaatcgaactacagagtgcttagcggtagactatgagtatcgaactgtttctgatagaaggaccgatgatgatgtacattgtggaatatatatggaaggagggagatgctccataacccactcttgcattctatctgatgctgtcagtttgtcaatgaaaggcatgtagtaatatttagcaatactggaaagcactgaaaacagctaatgttaaccacacaagggaacggacacataatagctgctaatccaccaaagattttttttattagggactaaaaggaagcgttatttgagtcatttgacgcaagatcgaacgacgagatccaagaaacccagaaaaaggtggaaagagaagcattagatgatgcacgcatacagacatcaagctgaccactagcgtcatcaagttgaccggaaaaaagcgacgcggatggcaaagttcatacccgatccgcatccgcggtgggcgccctccgcccgcggcgtcggatccgtcggcccgcgccggtggcccgg

SEQ ID NO: 4684 - DNA, 695 bp, Zea mays
catttaccattgagtaatataagtaaattattatgttttaatttttatttatctttgtattttaacatatcaattcttttgtccttgactatagaaataattgtaaaattgttagttgcctttgtaccgacacaaactagatctttttaaattttagaaccaaactttatggattgtgtctacagaaattgtaaccaacttaaactataacttcaatatataaaatatatgtaataaccaccgtcagaattgaaactaaaatgcaggctgaaagggttcattcttacgtgtagttttgtgtttatacaatataggtttatggagaggcgaggggcctaaatcgaaaacatccatggttggatggtcttcaattttctctgttttacccgccaccggcctccgtcgtcgtcgtgtccatcactccatccatatgagagaggagaatatgcgccatgctcccggagtccctgtagcacaatactgtcagtacatactcctatatagatatgcaggcttccccgtaagacaagccgctcttcacctcggattgcgccttcaattcgttcgtccttccatgtcgattgattcttgattgattgggagtgggggaaaaggagagccggggagggaaaggcaaagcagagcccgtagcgtccttgtcacagacagacagacagatagatagattgttggct

SEQ ID NO: 4685 - DNA, 159 bp, Zea mays
gtcatgacaatgataccactctttgtcggcaatatctgcaaaacatggacaaaagaacatgtatgacacttgcgatttgttttcatgattttcatttgcttctttgctgaagaaataacttgttttggcttttgcagttgaaggataaactgaagagtt

SEQ ID NO: 4686 - DNA, 619 bp, Zea mays
cgaaggagttcaccacaacgtaaagtaggagagggagtagtaaagtcttattatatttatttactcctcatatagttagatggttttctgaaatattttatttgttaagaaagttatataggcataagcattactagatatacagtaataataataataaaaagcagggctcgtaagcgcaaagcctagagaacttggcccacaaatccatgtccaaccctcaaacggcccaacgaaacacagccccaacttgccaaaattcaaatcatgccgcccgtgtaataatcacccattttccttctccacaaaaggaaggcaataatataataaccccctctgctcgacccgcttccaggacaactggtcagtctctgccgcagcagcaggacgcgtcgctcgcagtcgcaggctcgcaagtcgcagcggccgcaacgccccaacctggcctcctcccaacatttttatagccagccgcccctcgccgcctatttccaacgtctctccagctcgtctcgcattcccttcgcctcctctccgatcctgacaactgttggcgatctagggttttcccaccggtctccggtgactccgaccggccgcaggcctccgcgctgcaccc

SEQ ID NO: 4687 - DNA, 551 bp, Zea mays
tcttcttcctccacctgcggccgaccgcgcgcgtgcaagtgctgattgatggcgtctcctccgatccttcctggcgcgctgccccgctcgcttgcttcggggaggtgagagagattcacggcagccgagcacggaccgttcttttttctcttctcttcgagcggaaggagagaagaactccgcacgacgcggtatggcgcaagctgagccagcaatgaaatttttacgtgtcacacctagagatggcaatgggtaaaaacccgctgggtattacttgcccaaacccgtacccgcgaagaaaaaatacgcccgctaaaaaacccatacccatgacgggtataaaattttgcccaaacccatacccatgcgggtttcgggtacccaacgggtttcccatacccactaacatcaacataaaaaataattcattatgtaaatgacaatcaatacattaataagctagcataaaaggagcaagtggtaactaattttagcctaaattttgttacataaagtttatttcaattagaacatattcaattaataatatt

SEQ ID NO: 4688 - DNA, 1500 bp, Zea mays
ggctgtagtgtagcgtacgatgccgatgcgtgggcggcgccgatatttttctcggcgctcaacaaccatgtgattcgcacgcgcgccgattcacagaaccggaaaaataaaatggttgttggctatcgtccggtactggccgcaaccgaggggggggggggactggtctggtggcgcgtccgccgcggcacatgcggccgtgtcggcgccgtgcctccgggacggcgacgctgataacccgtggagcttgcatgtgtaaacgtctggcgtggctagatttccatcctcgtatgcgatgcgatgcgtggcggaccttcggaggggggccgggtcacgacactgcatgcgtgtcggactgatcctacaccgacgaagggctggctaactgcacgatgacgttcacggcacgacggcgaccgtcggcactcgtcacgcccgggatggaggctctcagttgccattatatatgtccaacgggccgaccagccatgggcacagctggggccgacacgaggtttatgagtcctgcacggttaagtatcgtgctaggttaacctggcctatgggctgcctgacacggtctagattcggtacgtttattcttacacgaggcgtgtcggatcggaggtacgacaggctcgtcgtattggactccggcccctaaaccaataaaacactctaaagttcaggatttaaaagcaataattaaacttattttagatttaattaattatatttataatttcagatatataattagacaatcaattttggatacacatataaatatatatatcacaatttaaaatgctctcgtataataatagaatcatcagctaaaaatagactggttgttacaaaaccagtcaatcaaacaggttgttatcgtatctaccctttaaacgggctacgctcgtgtctacaccgtggaccagacgactggtccaagcgtgacatgactatcgggtcggatcggcccagcacgcttctagtcgggtagagccatcctcgtgtcggaccaccatcgtgtagttgccatgggtactaggcgcagcgagtgctctagcagacggagaacacgggcggcgccgccagcggcaatcaacataacctggtcggcagccgactgctggaaagcttgggttctccaggctgccagattattaaccacgcggcatttttacgagctggggatgaaggtgatcacgtgttgtccctgtcgttttcgctcgcgaaaaccacaactcggacctggctcctgtagtactacatacaacagcgaatggtcacggctccattacgacactccgacaaaccaatgtggtttggttcggccgttcagtcaatctagtactcctataatattgcaaagacgcctccctgggtgcctataaaaggagcggcaaaacgaagcatgctatcagccagcactaaactacagctaacactgcagccccaagatcgatcgagcgtccacagccccaaggaacatagtataac

SEQ ID NO: 4689 - DNA, 175 bp, Zea mays
gggttcggtcgtcggcccacctagttccttatccgtcgtctcctacgcctccatccacactccacagccacgccacagtcgttgcccaccacccagagcacgcggcggcttgtcgccgtgcgcgccgccaccatcaccacacgaggcgccggagaaagacatcaagcgcacgccc

SEQ ID NO: 4690 - DNA, 1500 bp, Zea mays
  unsure (1)..(1500): unsure at all n locations
gttttttctcaacgtagagaaggcgatgcctaggttctagaataatatagtaacatataggaccgagtcgttcattcctgttataggaaagaaaatgtgaagcatctttgaccattggaacgtgatcgtgcggccaggaaaaagatccaagcgccgcctctccctcccacagctattgatccaaacgcgctcggcctctggaagcatcgcgacgtcgacgtgcggagttgccgagaggctatacaggataatgtccactcgatgttcatcgtttgggtgcmaaaaaatagcgacgtggatactctagccggcgagctttgctcctggctgtaatatataggaatgtggtattaggactatgggattttcgctgagggcacaattctatgcaattgttatgggtccagaacatatatccatgcatggactgcatggttgctaggcacagccatgtctgcttgccttactttgggcagtgtctgtatcattgttacattatgccatgacaaagtgccttctttttttggttatggatggtgttcggatcgatgctaaactatgccacaaaatacctcttttttttggttttggatagtttctctacgtagatggatgttgcatttggaaagggagcaaagtctgaattctatcattttttggccaatcctttgtattgttatgtagtattgggactatgaaattgtctcaaagggaacaatcgtatgaaatggttctgagtccaggacatatatccatgcatggactgctgaatggttgttgggcacaaccacatcttcttgccttacgtatgatgtaaagtatttcccctgatgattgggggttagtgtgctgatgctttcttccagttctttgcgtttttgggggaatttcaaggactcagtcaatagcactgaactctcatgatcatggccaattcgttgtgcatgttttacttggtgacattcattgggattctggatatgctgcgtttagtttatttactcattttatttttctttgtatatgaatgttgcaacaaggtccgttgcccagtgtccacatcactgccagattgtgccatcagtggcggacncaggatttgaggacagcctaggcaagattaagttgttatcctctatgcctgtgcttgcttgcttctctccattgccgtaggattaagcgtatggtgcttgcttgcttctctccattgccgtaggcaaagcagcccaggccaccgcctgtggtgcctaggtggtgagtctgccactgtgtgccatgacagagtgcctttttttaactatgaatggtgttcgaatctgttgaatgatgcaaaccctaaccctaacaggggttgggtgatatattaataggctgagtaaactgggctaggcccattacagaggggtgagatggtcattacacggggaagaccccaaaccctaaacgggtattctaccagtattataacaccccccgcagtcacaactctatcctgtacag

SEQ ID NO: 4691 - DNA, 204 bp, Zea mays
cacccacgtctttcttttttttctcccgacgatgggtcccataacagagcgggacatttgggaaaggcccacgacaacggcccgctccacctacttccaaacgaacaaaccctctcgaaaaccctctctcatattcaccccgccgccgcctcctcttccccttttcaacttcgccgaaaccctaaccctcccggcgaagtcgcc

SEQ ID NO: 4692 - DNA, 1500 bp, Zea mays
gtaactggcccatttagtttaagttaaatctatcaagtctttttattggatttatcgacagtcggattaatgaatactyttgtttcaattagttatgaaatttactttcgcaaaacttattgttggatccgtctgttttgttgccactacgaatgtagcttgtattagctcagcttgcattgctgcctgaacatgcaccttgcagttgaatttagcacgtaccatttaagttctgaacagtacgctgtccacatatgtaccaaaatggatgtccacaatacacatgtaatgttggtggaagatgcattactgatgttcttagactttactgcgatgctaaaccaaactttaagtgaaatctgttctcagacttcactgcattgctaaaccaggctacatggttttattattggccatcgagagcacatgccttttggacttttcgtttcgaactaaaaccaattgtttggactactacaaccataatccatagatacaaaaacattgtagaagcagtagatgtcggtacggaatgaagtcaagtgtttattttcccaccctgattagtgacccatttggagtttccaattactcagtacttgtgacgtaatctccttacacaattacttggtacttgtgactgaatgtgcttacatgtgcaggtactagatgcttgcatctggaaagacagaaagttccactaggtgcttcaatatggaaagaaagtgtctttgcttttcttagtttggtggaccagtaatagtgtgtcacgtctaccagtttgcttgtcttagtgtgctacttgtcttagtaatagttctatctatttgttaattgtctcaataatagttctgtcaatttgttacttgtctcagtaacaatcacttctaccggtttgcattgacgctttcagaaagaaagaaagcatacatgttgccaacggcgcacgaaatgctggaggcgcaggggccattcagtctatgatagctgctagcccatgttggctgtttcaaaaattttaaggtgaaggttttagcagactgccttggcggtggaatgttttaagtattttttttacaactgcccctaatctgaggtttttgcaacaatttgttagggttctctaggaggtgttctaacgggtatatagccgttgcctttcctccaccacagatctttgcaaaactgggctttcttggggagttttccacgagcatcggacgaaaccaagctcacggcccacctcacttcgttggtgcaggcccggcatcagggttactgacaaatactagaacacaactaccgtcaaagagatagccggaaagcccgcaaaaacccttgtctgccaactgctgtctcgcaagtcgcaacggctgagtgcgcgcccatcagtcccgggttcccgccacacccctcccatccccctctcaatcctgtccccaaatctctctcttctctctagcggcgaggcgaggcggtgaagacgagcgagcggcgagg

SEQ ID NO: 4693 - DNA, 333 bp, Zea mays
ggtaaaaaagaggttttcaattttgcacactcttcgcttaggaatgtgatcgaaagaagctttggagtcttgaagaataagtggcggattttattacatttacctagttatcctatgcctaaacaaagcaagattataattgcgtgcatggcacttcataattttattagagaaaattcaacgacagatgatgattttgatttatgtgatgatgatgagaactatgttcccattaccttctgaaggaccatctacgcaggggaacaaatgagttgacaaccacaacagttgatgaagacataaatatgaaccattttagagattcgatagctg

SEQ ID NO: 4694 - DNA, 402 bp, Zea mays
ttgctttcccttggagccgctggcagctaaactggtgccctcggccgcctttgtgcgttcctcgccactgcgcccggggtagctgaggtctgaagacggaggtgtcgcccgcctcacggctcctgcaccayggtttttctttctcgcatcgccagagcaacaactgccccccgccgttggtcagtcctgcgagctctagatagttacaaacagtacgtatttttctggagaatctcagtaatctgcatcctttcttgatcttgtgtcaagtcaattcacttgggttaaaagtttggtttttccctcatgctttacatatcatgtcatcatgtcgtcgcgttattattaccaccgtgctgaaaatgttgcactctcatttgagcagtttgtcctgtgctcaaa

SEQ ID NO: 4695 - DNA, 148 bp, Zea mays
ggccgattattcctgtcccacatgaattggatgagattagagaaaattataarggattttgatttatttggaattgagagggaattaagtttggcttgtacataatttaaattaaacgacgcttattctaggatggcgtatctatgtc

SEQ ID NO: 4696 - DNA, 353 bp, Zea mays
tcggggttagttcatctcattctttgccgggcgtgctttttgttcttacgactttggcctctccactcgctgcgactcgagagaattctagctccagatcgtgaaccgtctcccttcaggcatgagcgtctcggtctgtctcagtcgcacttgctgagttgctggtgtgttttgaatcgaacagttcaagttcggaaatggatgctgagcatgcatgccccctcccctctatatacggatcgaatcgagtcctgctggtcggaatcccactcggtctgattggttgcctgcttctcgccaacctggttctgcgcatgcgttgactatgccatagcttttgattgaatgcttgc

SEQ ID NO: 4697 - DNA, 903 bp, Zea mays
gagcaatgtctccatcagttacccacttaatagccgctcgctgcttccaataaattttctgaatgttaagcagttcggccactttttgttgcagaatatctctgaaattccattcctcaatagaaagatcctgatgctcttccatgttgtcaataagctcaattagcagcttgatgtttttcactgttttatcaatttttggtaatgatctctgccaatcctttagatccttccttgcaatcttaaacttggctgttaagtttttcgctttatcaggcagacttgggaggccaagccatgaactttgaaagatattcatgaatccttcatattccagccaaaagttttcaaacctaaaaatcttaggtttaggaaccttggacttaaatgaaaccagacaaggcacatgatcggagatgtcacgtggcatcgttttttgcacgagtatccggataaacgatcgaccattcttgtgagatgaaaacccaatctaatctctggagaaggggttcccgctgtctattcgaccaggtgtacgataaaccatgaagtggaatttcaaccaaatctaggttacttattgcttcattaaacttcaacattaaattaatatcgcccccaggtttattcctatcttctgaccgccggattaaattgaaatcaccaacaagaagccaaagcttatctgatggcatagaaatgttatagagccagttgaggaaatctattttcccttgaggagtacatggcgcataaatgttcgtaataatccaagagcacgccgataatttggatatgaattccactgattgagcataatcattttgaaaaatgacattgcttgtaaattttgaacttttccaaatgataattgagcccccccgagttccccaccgaaggaac

SEQ ID NO: 4698 - DNA, 1117 bp, Zea mays
agcttagatcggagatatccttttggcttgattctttatactcttccctccctctctctcttccctgctagtccgtccctccctcgttttctttctttattgctgtttcgctctcttgtatagtgttgttttttgttttgattgaataaaaagttttcagctgtaggggcttcccctaccgttttcccggtaaaaaagaaaagccggccgtgtttgctgctgcaatggtgagcgaacttggtttctgaaatctgaaggcatggtgagaacgtattttgcgtaaccggggtcattggctgatcatcttggaggatgctaatggattagcggccttcctggctttcttggtcagcaataatatctaactctttggactatgaagtgtcctgatgcggctgactggctgagtgttctcttaccgattgccacacatacgagtaacagacaaggatgaatggtttgccatcttcgttggactgcgaggaaacttggattctgaaggctccacgagaacatgtctgcaacgtcagaggcattgacagatgattttgaagcctggcattcatcatggcggtttgttgaccgacaatgttcttgatgggctttgtgctccctgaaaacaacttctgtcagccggtgaaatgccatccggtgcacttacctactgtagctgtgcattccggcgttcacaggctcacagttgttgtttgaatagaacttgttgttctataactcatctgataatatttgattagtgattattaatttatgatacgatagggcctaattttcaaccatcttcaatgatgcttgaagtcaggttctgcatactaggtgttatacttgagaagcaagaaaccgtgggtgtgagtgtgacaaccagaatgaagtcagcaatgtcctcatttcaacacacaaacattatctatctctattattcatagacagtcatggcaccgaggctgcggttgccatcttgttcacgtcactgccttcacaagcccttgatacttttttcagatctaaatctgaagcaacggccagaggaactcaggttggattggacagtggtccgttccattgggattgggtgggtctggggacctaggcagaccag

SEQ ID NO: 4699 - DNA, 1500 bp, Zea mays
caaagccggacgcaaaaacaaacaatctctatgaatccattttgtgaaaagtgtggctcaaaagcgaagattggaccatagattagtagtcaagacggacaggactaagccaggtgagtcagctttccacaagaggacatctgcttggataaaacgttgaggcgaaacaaaatctccccaattctttggtgtcgctttagccccctttagacgaagacactacatccttcggttgtttctcacttcagataaagctgtttgctccactcagagtattatcttatgattcgcaagtctatcttagagttagagccatacataagtacataatactgtacattatctatttcctaatttttttataaccaaatagtgtgccttttagaattgcagcaccacacatacagatagcagcttgtccatttaacccgtagtgctgccaaaaaaataatttatactactcggttactacttctcgctccattttaaaatagtctttattcttgttttttttaagttaaccatttttttacttttatcaaacatatataagaatgcattaatgtttgtagtatattattagtatcatcagataactctttaaacctattttatagtagatttacttaataatataggcattgataataccttttttatgaatgtaggtaaaacattaaaatatttgatcgatctaaacaatatagcgacagccaaaaagggaaaacctgaacatgactttcatttccgcccaggtaaattctccccgcagataaacccctgtaacaaaactgaacatggctttgatttcagcccgcgtaaattctcccggcagataaacccctgtgcctgttgcagagtgtagtgcaggcgatgaggcgataggccgatagggatgccagccacgcacagcacactcgccgcgccgcgcagtcaattgaaattggaaagggagacgctcggtctgccccaaagacacaggcaggaaataaagaaggcaaaagaaaagaaaaaagcgtgtggccctgcttcctcccggggcggcgggtcccgctgccatccccaatgaacaagtagagctgcgctgcatcaggttggtcgtccaagcgcgcgcgggttccaaagccgcgcgagccgaaaccggaaaccacgtggcggccttatcctctccagaccctcgtcataaaagtttaatgaggaaaacctgcgagaaatagctgtgcgggaccgtggcggcacggcacggcacggcacgtcatgccggacaggggggagatgatgataatgccgaatccatcgcataaataaaccgggctctcctctcctttttatctccacccctcgcgcgtgtccgctgactctcgcctcccgtcgcgttcttatccatccaccccgtccggcacccatttatatcctgtcgtccctccctccctccttcggccacaccgtgtcacaccgctgcttgcttgcttgcgatcgggtttggatttggggagcatc

SEQ ID NO: 4700 - DNA, 918 bp, Zea mays
tttttatgaagctaaaactacagttcatataattttgggaatacctaaactcaaacccgttttttggcaatgtaaaatccacaacaattttcgggtaacaattcttagaatatgaaattttaattatctgaatcacctactccaaatttttcgagtaacccgaacgcccaaccctacatggtggtggtggtgggggttgcagaatggatcagggatggagttgcgatcactgcccatcgaatgcagataagaggaggcaatgaagcaagcgaatgttgaccgaaacgatgtgcgtgcacgttgctgcgagtgagcctggaaaagaagacgtgtcagagaggagggagcgaccagatgtagagaacacgatattacttcacgtcgctatagaaaatacacaaaacctatttttttaagaagtagagatatgtggatgcttgttttattgcctaatgcgtcacaacatgcttaatttttctatccaagctttgggccctgtttggttcgtggctaatcgtgccacactttatctgcggttagtcgtccgaattgaagactaactttagtcataaaaattaagtaaagtatagtaagttagatagcgaatcaaatatgtccctttaattccagtgattaaagttaagcagagtgtgaggtaggaaataaaaaggcgcatgctcatatagaaaagatggcaagtgtaccctgctactgctagtgtggaactcaggcccataagaagcccagaaggtgaagacatcaaggtgccggtgcctggcccatatgtttgcaggatttgcaacccatttctctcctcgactcccacaacacggtccgtacgggaaagagagagaaggtgggagtggaatcgacaggggaaaaccaagcctgtgtttcagagacaactcaggcgacgcg

SEQ ID NO: 4701 - DNA, 1500 bp, Zea mays
rcaccttcgaaagacgaaggccccaacatactcctcctcgttactttaccaacagtgcaagctaaagttctaggcaacaacacttttgagtgtcaatatgtgttcaactgaatttgtgcttgaaaatatgcacctagatctgcatatctgaccgaaaatgacacatgtctgcagatattgtaaagtatacgtgggagcctggaaggaggaggaacccctaggcgtctctccttttctatcttgatcaagttgactcggtatccctatccatcccaccagccccaaagcagcacattcgggttccgacgtcatcgccgtcacggcttgcacaagcaaaggcgagcaagaactcggctcccgtcccatctcgccatgaaagaaagaaagaaagaccacctaaaaagaacagaacaggtggtcagcttccttccagtgcaccgtacctgtgacagcaacagtctaaagcaccaggaaaaaaaaaggaggcagaaaatctgatgcctgatgcggaagttagcagaaagaacagcatgtggccacagcgcatctgcagtacaaaaaaacaactcaattatttggatcccaaagaaagagatagctgttactacttctctcgtcacccattgctgctgtcgcctgttgatccggatcatcgtgagtcctgacctaaccattaaccagcatcctttcagtgcaagcaagcaagcaagcaattggtttccagagaagctaggcacgctgccactggaattgatgaaaaaggcttgtgctggactgtgtgtgtcatcagcagtgcacaccgcacaaatgcccaagcaatgaagcaacagtggcgcacaagacaggacaaggtgcctgtcgcaggagggattccctgttgtggcctgacctaacagtcgcccctagagtctgaagctgccggcgttcctcataataatcccaacaaggctcatgactcttgtcaatggcaggtcgctttcggtagctactatagcatcccctgcagggtggccggatggcacctgcatggatggatggagagcataaaaacctttgccatgagctgtattgtcactccgttttcttttgggaaaaaaaggaagaggaacagcggcgcgcgcacgtcgagaagtgagatggggcgggtgatccaggaaatcaaatcgccatcgccatgggggtcgtccatggcaagtggagtgataaaagatttatcatttatatatgcatgggccagagcccagggatgggagatagataagcaacttgatagatatccactgaaaactccagacaaagttcttcacctccagattcctcacagagacaagccctcaattattacccccttccccccaaaaaaattcaatgatgctagtcgtacctcgtcctcctttataaagcaacaaactgcaagctgcttctgatgcaccatccagccatccaggggctgcaagcctgcaacctaaagcaagaacaagcagagcaagagagagagat

SEQ ID NO: 4702 - DNA, 1500 bp, Zea mays
ctggaattggcagccatagtgcatgccttaaagatatggaggcattacctaatcggaaataaatgccatattttcaccgatcacaagagtctgaggtacatattcactcaacctgatctcaacctccgtcagcgaagatggttagagctgatcaaggattatgacctcgaaattcactatcaccccgggaaggccaatgtggtagccgacgctctcagtcgaaagccattcggaataaaagggactaactttctagaagactggaaggaagaatcgacacaactaaatgcctgtctgggaaacaacgacagtctcgaagtcaagccaatgctagaagacctcatctgcaaagctcaacatctagacccagagacggcaaggcttgtggagaaagcccgcaaggaacaactcccggacctcaggacagatgaccaaggagtcctttggttcaaacaccgtctgtgtgtaccaaaaggggaggcccgagaagtcctactcaaggaagctcacgactcggcctactccatccaccccggaactaccaagatgtacctggacctcaagaccagatactggtggaaggggatgaagaaagaaatagctcagtatgtggcccgatgtgacatctgccaacggacgaaggccgaacaccaaaaacctgctggcctactgcaacccctcccgatacctgaatggaagtgggaagaaataggcatggacttcgtgaccggactaccccggacgcagaaagggaatgactccatctgggtaataatagatcgcctcaccaaggtagcccatttcattccagtgaaaactacctttggaggagccacccttgcccggatctacctcaaggagatagtcagactccatggcatcccaaggaagatagtatcagacagaggaacccagttcacatccaaattctggacaagccttcagaaagctatgggcaccaagctagatttcagcaccgcgtaccaccctcagacagatgggcagacagaaagggtcaacaaagtccttgaagatctgttaagagcatgtgttttagcttttgatagaagttgggagtccagtctaccttacgcagagttctcctacaacaatagctatcagtccagcatcaagatgtcaccattcgaagctctgtacggacgaaaatgccagacccctctcatgtggtccaacgtgggggaaaaagcactagaaggacctgcttttgtcaaggaggcagaggagaaagttgcactgatccgcagaaggttgcttgaagctcagagtcgacagaagagttacgcagacacaggcggagggaactccgatttgaggaaggagacttcgtctaccttaaggtttctccaatgcgtggtgtcagaaggttccaagtcaaagggaagctagccccacgttttgtaggtccctatcccatcattggcaaggtaggacccgccgcataccgcctggaactaccagaatttatgtccgacatccaca

SEQ ID NO: 4703 - DNA, 654 bp, Zea mays
cactataggttcatactaactgaccccagccttctgattccctcttattgtcatgctgacccaagtctgattgacgcagttgatcccttcccctcaatgttcctcatctgcgtgtcgctgtgccgcgctgccattgatcgagaccttatcatccgtatggcacaagagctaatgtagcagtacccatgacaccttatcacttacacttaaggatatagaaatctatttttaaagtttgtaaacctaattaacatacacttacaaagtcgacggtcttaactctacactagagtaatatacagtaggtagtccatgtgtgctggatcataagctagatttgagtaaatgctttatactgatagtattattgacaacacaagagcaacatatcactgatttagataaacttcagttactccactaaacacagtatgtcatgttcatgtcatggtctgagtgtctgaccatgggtggtcccctacaaaacaaaacaaaagcggccagcacgaccacaggaggggccagcgaggagtggcacctgggcgtgccacgcgtgcactcggcatctccatagccccaagtcaccaatgggaggagactccttatccgatgctcttatcctgcgttctgtggcctctgctcagctgctcgtag

SEQ ID NO: 4704 - DNA, 310 bp, Zea mays
atgaactagcagtttagaacggaggtagtacaaatttagacataaaatatagtctacagtctattctgatcatatgttagataggacaaaacaggccactgcattaggtacatggctagtgacccgagcaacaccaccgaatcttccttttatcgaaatggaaaatgggccaacactggtaaatggcccaagtaatcttttcccgagcaaaggtaaagcccgcgagagcccagccacatgtagcatcccaatgccccgccgaaacatccgttcaactgttgacccatcatacggagtagaaccggacagg

SEQ ID NO: 4705 - DNA, 961 bp, Zea mays
ctgagcgatcctcgaagtagaaagttcaacgtcacgagcgcccacctccaacgaagcgcagcagaacggagaagaaagatactagtactagtagtggccggaaacccgtcgatcggagaccgggtagtgtaaacacgatcttcgaggtggatcctgagagcgacatcggtctccccagaaatggcatgtgctgaattcaacgtcgacgtcgtggactcttccaagttccaaccacgcagtgcagacagacaccgatcgatggaacggaatcgccggcgcccgcctccatctccgtcggtgcgttgcgtggtcctcgatccatcttgtccgcggcttccgacgaagcttccctgcgccgggtcgacctgctgccgccgccacatgctccgcgagagagaagggaccagcgtgcgcacggccgcctgcgaagtggacggacgtactggccgtgggatgcatgcggcagctgaaatccccatccggaattaaagacgcctcgccgtgctgccgcagcgacgggacagcccgccgccccgccccgccccgccccgaggtagccgcgggccggctgccaaccccggctgcacccggcgggcgacgacgacgtggcggccccggaaggccgcagcccgcagcgcagtggcgcgggccacgtgccgctgctgtgtgggcctgggccgccgccgccacggcgccacctattccgcacgcgggcgagcgggccaacgacgcttctcggaaggtgggggagcgaccgtgacacgttatcgaatcttgggcgttgactggaggagcacgccgatccaacggatggcagcgtctggtggcccgctggctgggtcactataaatgactgagccccgcggccgtgtccaattcctcttccgacacacacacacataacaacgagcagcacagctcacgctcggctacgacctacgactacgatccgcgcgcgtcg

SEQ ID NO: 4706 - DNA, 92 bp, Zea mays
agtaagctatcttgttcaatgcacctatttaagaagcatcactttccacgtaggttttaaatttgtctgaatggttttaacttactgctcag

SEQ ID NO: 4707 - DNA, 1500 bp, Zea mays
tattttatataccgttgcaaagcacgagcatctaactataacaatataacacacatatatacataagttatcgtgttattatacggttccgttgcaacgcacgggcactcatctagtcataatttagtttataaatgaactagggggacaaatattcgagaatggaggttagaaaataaagtgtgactgtcacacaaccgcgagaaccagcccactaccaaatcaatctgccggcggccggctgttgtccgagcgaccggcgcatggcagccaccgtgcgtctctgtccggtgggccgcggcccgcggcccgcaaaccaatgcccgagcacctcccctcgcctctacccgagcacctcccctcaagagcgcctccctcgccggagtcagacacgcctcccccgccgcgcgcatctctgcctaagcgccgctccgcccctcccctacgagagcactttcgcccaaggttgcaggctgcagccaccaggcctctacggtggaggagaagaatggaggatgctgccaaacggtaggcttttgccggcttctacagttctacttattcaggaaacctacttgttacaaaagctcctgatattttaagccgttccatgaaactatctaggtcactgcgcagtgcgcacgtatttctttgatcgcttaactgcgagctctgctgctatacggctagacagacgcatcagtgccctactttcaggaagcagtgctagactgcgcagtgctcacccatccattgaaccatttatccctcagatccctgatttaacacaacccaccctcacattgcctatgcttcaggcaaagaaataagcatagagaatggagcaaccagctccagctattccgctcacagcgctccacatagcgatcgcgaactctagcctcagctccctggcattcatttcaaatgaaggaaattggaattttgtgtttagtactcatcaatttgtgattattgaagctccacaacttaaatatgataacaacttatggtgaaaataattgagttccaattcaaccacatgctaaaaactgtgaagcagcccttaacagataaccatagttttggtttcagtctgaatgttcattgaatggtgagagtcttttcttttagtctgaagtatggccttctggcatcggtggagaaattttgtatgctaaatttgcatgtatatcatggttcttagtgacaaatgccggttacaatctgttgttcaaatcttcattagagaacatgagctgtaccaaattctactatttacttatatgacattaacaagtggtgcttagatagccatattctagttttgatttatgtttttatgacccaagcatactgttctgaagttcctgtacactcgctcatctgattttgattcagtgaccctaagcaaactgttttggaccaggttgagatgagactccgcttcacaagacagtctccacggtttctctgcaatgggtagctcactgcagtctg

SEQ ID NO: 4708 - DNA, 939 bp, Zea mays
acatcactggtcgtagtacactataaactttatgcgcttctttttcttgatgtccttcttagtattgccgaacctggagtcgacagtctatgcttcctagccgtcgaggaggatctctttctggtccgtcacttttcccttgccttctgaatcaatctcttcgaacggtaacttaagtcgatcagtcagcaatggcgactactatttcgtgtggttgggggaagtcgccatatattgttgctgtgttcttcccgtggttgtgggggatgcgtggctcgaccttgtggtcgaggcgttcctttgcctggtcgctgaagatagcttcggccgtctctttgtcaaatgcgtggtagctggcgatcaccgtcagtttgatgatggtcttgggcctgctatagaccagcttgtgcattacgctctgtttgcaatgccatagatgaacgacatgagtacatggcgatcggagtcgatgacaagtgcatatgtttgatagtatatgttatatagattgaatttattatcgttttcaccgcaagtgcatatgtttgctacactattcctatttttttaacgaagcctgcattttgttagcgatttattagcaggtaataaaggttcaagcttatatagaagcccccccacaatctcgaagccagcctgtccaccccagcccaccccagcccatgaataacaggcctattttcgaagaccccccttactccgccaaccgctcaggctcaaccctagctcccggcagcaacgaccagctcccctcctcccgccaaaggttccgccgttttcccgccaaatccctcctctgacctctattacgcccttcccaccacacttgacccatcgccgtcatcccagtccacgcccacgcccacgcccacgcccacgccgacccacccgcatccctccctcgcctccaccgcagcg

SEQ ID NO: 4709 - DNA, 117 bp, Zea mays
ggtcttacatccctccgcaagaagatactatagatgttgttggtctaggcgataggtccttagaaaggagtcctattgtggaggggaacatgtccattggatctgtgcttgcttcag

SEQ ID NO: 4710 - DNA, 154 bp, Zea mays
tgaaattccacaatgacttctgccctccttttgaacttgatgcaataatgccaaacatgattatcctttttagtcctgcctcatctcctgacaaacttatttggattggtgcagggttgatcagtgaggaccggaaacaaatttagtggtttga

SEQ ID NO: 4711 - DNA, 355 bp, Zea mays
ggtaacttgtttgatccttaattatgaattagaaagattcaggttgtgtgcacactataaacaattaaatcatttctatatttcaagaggctgattttgtgctaaacgtcacaaaattaaggcaagatctgttcattacttagcatgaacttttttttggccacaagtaataaggttgttcattgagttatactcctcacttgggtggcgctacctcgtctgccattcccatctggtggcgctgtgagtgccaccgttttgttacacatacaattctaactaaatatgcataaagctgcgcgccagcacctcatattttattctcatcgtttctacttcgttaattcattgaccc

SEQ ID NO: 4712 - DNA, 542 bp, Zea mays
gaccctcctgaaaatttagagttggtgaaacaaatcattagatgctccagaaaattatgaagctgagctgtaaacatttataaggcatttagatgagtcattttgtttattatttacattaaaagtattctttttaaaactatttaaatttatattataaattgtatacgagacaatacttatttaacagagtctttataattattaaatattttaaatacgctaaacccatatgctcaccagcaagccgtccatgggttgttagttaggttgtccaaatgctcaccagcaagctgttcatggctccaccgggtggccagagtagtccacccaaccaatccaaagctcatccgcccagtcaccatttcgagctgaagcttgcgaattgctacatccatatgaccagagcttctaagctgcaacattttcccaaccaaatgaatggccctgtgaatatataactgcgcccagaaaaccgtcgcaacgaccgcgtctcttgcgttctagtaggaagctagaatagcaggtagcgcctggtggcc

SEQ ID NO: 4713 - DNA, 268 bp, Zea mays
gcctaatgcccatggccaaagttgacatgtggatacccggctgggacaattctgttttcccttcagtcctatctggcagcttgtgctttctgggccaaggatcctcgtgcgcttaagtttcagcttgtagagaagaaggcagactttccttgttaatattattttttagcctaaataaacaagcagaatgttgccggttatgtttctcatttggtatatttgcatgcatgctctgtaattttttctgcgggctatgtgatggaaatat

SEQ ID NO: 4714 - DNA, 302 bp, Zea mays
ggtatttagtatacatatataattatttataccacaaattaaatttagaaatgattaggaacttcactgtgctaccaaactagtgatttcacatgcatgttgtgagatagtatatcatgaataactcctcccagttcaaacaagtctaaacattctctggcatgtttctttttattttctatactactttcttgcaagaacagttactcatcccaataagcagaagctctatttgctgactggttacatccatacctgtaaacttgcagtactaccagcaggagtcctccaagctgcgacag

SEQ ID NO: 4715 - DNA, 475 bp, Zea mays
caccagcagatgcaaagacggtcccttttctcccctttcccgccaacgccagggatgatgacggcgcgggcagctgggcggacgaagcagagccgtcgtcagtgggggagagcccccggccccgaccccgccgccgcctttgtcacattccacacaccccacttgcacaagctagcgcggccgccgcctgtttaagctttacggagaatattagttaggtcggctgcctggatatggtccttgttgaagaacccaatgcccatttgaccgtgtccagaaggctcgattctttcggcagtgcacaacagcggcaagattctccctttgctgcccgcgtgcgtgcgtgtgtatataggtgtagacaggcagagagagagagagggagagagaggccctgcgctgcaaatcctcggtggttttgcagcttccagagcttgagattgagaccagcgcggcagttctttcttggtcgtcg

SEQ ID NO: 4716 - DNA, 797 bp, Zea mays
tgcgggtgtgatggtgagggaggagaacgacaacacgcttcatacgtggcttctcccgatggcgtcacattgagatcgtggagggtcgtccgtccaacggaggcgacgacgtaagtgcgatgatgatggctagggctgttaaaaggttatcatctttagcgaccaaacaagaggagagatatcgcgacacgcaccggaagggaaggctcgagagatcgggagtaatgacatagaggtgggaggatgaaccaagggagaaatggatggatgtagggataaacttctactttatatttatattagtagagatatagatagtttgaaagaaaatatagatttggaaatcgtgaaaaaacagctatcactcttacaagttggagtgagactgatcatacgcttcttcgcgtgtaacctcaacggctcaacctcaccgtgctcccattctagtctcctctccacttcattacacatccccgcgaaatcccggacccgacgcgaccaaccaccttgttcagtgaccccctcccccgcgcgatccaccgccggcgcgcgtgtaccctaaccaccgtgcggatctgggagcagctggcggcgctccctcaaatggtccccggcggcgaggggccccccggaaggcagaacagctgagatgctgacgcgacgcggtgccgccacccaccgccccctcagcctcctcctcgtcatccctcttcagcggcggcggcggcgagcggctgttcgagtctgggcccagcccgctcgtcttccttcccctgctcctgatccagggcggtggc

SEQ ID NO: 4717 - DNA, 1500 bp, Zea mays
cgaagatcaaagatgattgacctcatcaaatcaaggaaggataagctttaagccagaccttcaagggaatcaagatccacaatcaggatggataagattcaaaccagatcctcagatgtgtcaccgtccaagatgaagtctttcctttccctactctctcttacccaaacatatccatgctttaaagacatccattatcctacatattaggtggctatatatctctgcttacctaatcaccatcacaattgtgttaaagacatgaaaaaaaaatctgttggtattaaaaccaaataaaaagctaagctacaaaccaaactatctacatcccttttcttattaatctcgaggacgagattatttttaagagggtaggatttgtaaagcccaaaatttgtgaaaaaaataatgatgatgatataaataaatagatataattatgtagtgttttgagattatggaaccttgggagatcattgatttacttttctttgtgcatattcaattaatagggttatattggtcaaataacaaataaataaataaagaaatatgcatctcatgctgatgttatttttgtgatgcattctatttgaataaaggaatcataacttaaattaacctcaaattataaataatggaaataacatgcactaacgaaattatatatatatcacttcatacttacacttttatttgtgcacttcatctctgtatgaaatccacaaacaaatttgaaatcgaacattagattttgaaaaacaaggaatgaggtgtgtattgcatattggatatattttcataaataaatagataaagtaaatagtatagaaataaaatttagttgcatctcatgtcttatttgttttgatctatgcatttgaacttaagtttgcaaactcaatacataattgaaatttgtgattgaaatccaaaaggaattgataagaaaataaaaaaagagaaagcttcccatgggcagattcccccacccgctcggcccagcctcgcccctctgccctgggcctaatgggccaaatatacaaccgcgcgacccacttaagctgctcgcctagctcagcatcagacgactgtcgtggtgtgtcaccgccaggcgggacccaccgtcagaccgccctcacacgcgtcacccacacctctgctattgggccccacccgccaggaccttcctctacctaaagtcgatctccaatggaatcgcacctaactcgtcctcaattgtggcggaaccgcccgaattattccaacttaagtgtccaagtcctaccttagaggctagactacacttaaatgggaataaaacgtcagtccctcggatctagtccgacaaggccactaacaggatcaagtaccacatactcactcgaaggtgaggcacagagcaaatacaataaagcataaagccatacattaaggagtatcaaatttattacatcatcatcatcggagttttagcaaaagtagtgatcattgttcgga

SEQ ID NO: 4718 - DNA, 181 bp, Zea mays
agcgaaagcattcgttagagtctatacatacaaacatagatgtaaatacagtagtacacactacacaggaggaaggaaaaacatgcaagctagtgtcaactcaacaactagcatgagggccagtttttttttttttttttgaagtagctacaaatgatgtacattatttggaaggaaaagg

SEQ ID NO: 4719 - DNA, 1500 bp, Zea mays
agagcgggcaaatgcagctrgtggtggcgtgcgtttccgagtcgcggcgcgcgcgcatcycgcattcaatgccaccgcaaacgcgtccccgcacgagcgatcgagcgatggattgatatgcatgcattgcgtcggtgatgactcagcgagccccgtcgccgagtagctggagaacagcaccaattcctccacattaattccagctgtgagaacagatctcagcttattcggtggatcagagagaattaaattaatttctattcaatttcctaacggaacaaactctaaataggaagtgatttaatccctctcaatcctcaaccgaacaagatctaaggacttggtcgattgaaggggattaaagtggattaaatctcttcctatccaaaattaaatagaaagggactccaggcttgtttggtttgatgcttaacttgccacactttgcctaacttttctgtctaaagttagttcttcaaatcgaacgactaaccttagtcaaagtgtgtcacatttagccacgaaccaaacaacccctcaatctccttcgattttcttaaaaacgtaacaaggcctacaagggcgtttgattccaccaaagtaaagtttagttcctgtaacgtcgaatatttgrataataattatggatattaaatatagtctaattataaaactaattacacaaatagagactaaaacatgagacatatttattaaacctagttaagcatatatttaatactcgtaattgatatttaaatatttgatgtgacacaagctaaagtttagtaagagaaaccacatattcacttaatcatgttgtgtagtgtcactggacatgacaacacttgtggtactgacactatcagtactgaagacaagatctcaagcaatatagaaccaaattaaactttatatcacaaaacaggtagtctctatcacattaaacgtttaaaataataattacaatattaaatatattctaattgaaaaattagttacacatatgaagactaaaatgtgagacgaatttattaaatttatatttaatatttataattgatttttaaatatttaatatgatataaactaaacttttatgagaatcaaatacaccataagttttattggtattttctagagctgagaacttttgacagtattttttagagacggcgaactttggtggctatagaaccaattttccctttataagagatgaggcaaaatacacttcctacgagaccatgaaccatgatcgctcgccccctacggtctctcctctgattggtccttgccttctcacacggatcgctgagccccatccaacagctcgtatcaaccgaaaccaatgccacgcaacgctccagattgcagtaccgccctccacacaacgaaaacacaaacgcacacaagcacacgacgcaagggtgacgactgacgagagggagagagagagaggcgaggaaggagggagagagcacgggggattgatcgaag

SEQ ID NO: 4720 - DNA, 1500 bp, Zea mays
agtgtttagataagagtcatacgaggactgagataaacagcagaacaattttttgtggtagtatggtctcaaaaaattgaaagaccgttgtcgtctcgtctcagcttactttgacatcaaatcaaatatattctataatgttactgctttacttgtcagcaactaagtcacggcatgacaattacctcaaaccgactgcttcccattccgatccctcgcgctttgctcttgcagcaggtgccacagtgccagccacatttcctcacgtcacatcttctctgaacctcgacgcttcatttttctcgactgctactgctactagcaggtagttcctgattatctctggcttggttaacatggtagcatttaggtacagtttggttaacatgggatttcaagcatcctgatagaacaaaaatctcggaatcttagaaccccatccaaatatgctagggattctagtgaattttgtcatacattcatataattcaacaaaacactttagttttcttatccagattcttaaaacccactggcgtctaaacggtatcttaaccaaatcgttagcttgaccactattgccgtccattctaatgacctaggtctgcatattatcagtgccttctctctttcttcagcgtgcttgacgccgctactacagcggcctagttctcacagtggccgcggcccgtgggcaacatgacgagtttatggatgatcacaatggccatccaattcagccaaactggcctcttttgcaggttgcagcccaaaagacagggtataaaaatactcactcccctcctaaaaaaccgtaaaaccgtatatttatttacgaaatatatgcagtactaatatttatggttgtaatagtgtcattattttttacgcaatatatatatatatatttctgaatcttgtatttttctgtgttttaactaatttctgtgaaattcatatatcattttcgtgacattcctacgttcaaaaggagccctaattagtaggctagtagtagaggaagccagcaactttgcctgcggtgttgttgggcagtggtgaagcatccctgagctgggcagatctctggcagttgcaccgtcgtgatgctccgacagtgctgcacccactgggacgcaacacaatcaagcttgtggagccggaaactcacgaggcacaacacaggacaacgagccgagctgcacgacgacgcggccgccgccgccgatcggccggcgagtagattggcatggaaatgggcatccgttggtggcgccggcagcaaggcctttcccgtgtcccgtcaaacaggcaccaaaattgctgtgccagggccaccaccaaacattgcgggcacatcctactgacaaaccggtcccactagctgctgatgcgcatccatccggcaactactcacgctcaggtcgccgtcgcgactcgcgccgcctctcggctcgctagccgctacgctatctacgccgccccggcacctcccatgag

SEQ ID NO: 4721 - DNA, 1500 bp, Zea mays
agcctaaacaaaccctaacgccatggatccgctgtgccataccgtacacgcgccgcccccatatacccgcacggcgcacgatcatccgattcaaccgcttgccgaacccgccgttcggtgttcgacaatccgcaccggatccgcgtttgcgggcgaatcgaaacaaccagcatcagcatggaaccaccgccatgtgggccaccgcgcgggggagacgcggatccaccggccccgcccgatcggatggccagcacgcgcgcgattataggcgttgtggttacgcgcggcggcggcgcagcggagataaaaaggcatcccccaggaaagcatcgcccccctctcactcgcctcgacgcgcctctgaaagttcggagccgccggcccgtccgcctccctctccgcctcccgtccccaagggtgagtcttgcgtcccaccaggcttctctcccgtcctctgtccccgatttaaggcccatgctctcgttcctatttgtggcgattggtccggcatgcgtgctgtttgtggtagatagatctgctctgcacgtctgcgttcgtcacgtataggttggattgttcgtgtggtagcctcggccgttggtgctcattcagatcggtgcttcctgcgtcgggtaagggctattgagattcttctagtggatcgttcgtctatacttgagatctactccgtttctccgtaggtgtgtgtgcatcgcagtggattttatgttccgtttggcttgccttgtagatcttcgtgtaatctttgtagatcgcgaggttatggttattggttagtcagtcgggtaagtgagttttgaccgctgtttcgtgatagtgacggtgccgctttagatctgtttgtgttcttggccgtggatggcgatctgacggcagacgcccgtcccaaaaatattggttcaagtgtttgaactgtttagactatatgcacatatatcatgtgaaggtcttgattaccatgctccctgcacaagatctgcttcattctgttcgtgcacacctatacccttggcatgctatcatcttaatggttttggtgtaattgaattttggggatcatgatgattttcatatgttataaaatctgtgaacgttaaaattaatgaactgtttgaacatgctaaaatgtacggtatttaaaactaattgattcgtttttatgcatctgttctattcttatgattgctatcaaaactagagttatggaacatgaaaactgtaaatatcaatgtctgtataattgcacttttatctgtcattgacttaatgtttatacacaggctctctacttcaattaactgtgttgagctttggcttttactctgttgaaacacagaaaataatgtttgtttctgtagctttgttactatataatatgcatcttttttacacagttagacgtggagatctgttattctttatgcactatcctaagttgtgtcttgatattatgttgcagctaatagttttcaagtggca

SEQ ID NO: 4722 - DNA, 604 bp, Zea mays
tttcatataaactcccgtgcaaaccaactaacatatgtcaaaagaaaataaaaagatatacttcattgtctactataccattgtataaaatttcaagtttaaaatttcttcttctttgtatctcttaacatatratgaattttaacttgaaattttatacagtgctatagtaggcaaagaagtacatatataattttctttagaattttttgtgacatttgttagttggtttgtacgaaatttgcacaataatttggtttgcatatgatacgttggcgtttagattatgtacttctttaaagaaagaaaaaagagaaggaatttagaagttgttattactcctataaaataaaagaatttagtactgggactggactgagcggcccactacaagctttgggctcgttcgggcctcgccggaagttcccaaccgagtggaaccgggcttcttctccgcaacctacgtgccagttttgtactgccgaaggaattttcgtctgggtgcgtttgcgtcggctcccaggccccagcttctccgtggcgatatgccgatatccgataaaccccgcacatcctgactgcaactctgaacagcgaagcaccc

SEQ ID NO: 4723 - DNA, 172 bp, Zea mays
ggtacgccctcctgacctccatcacaaatcccgtgctgcttctttttcgtgactggagtcggatccttccttccggggtacagccaaggtcggcgtggtggagttcttgaacggcgtcgggaagggggtggaagcgcacgccgcgaagctggaggaggctgtgggcggcgac

SEQ ID NO: 4724 - DNA, 106 bp, Zea mays
ggtgcgtttatgccacccgacgtacaatttcctttggaattcggtgtttgcggcaattcgctgtgtgaccacaggccttactcatgaattatgatcctcaactacc

SEQ ID NO: 4725 - DNA, 1500 bp, Zea mays
caacactagtttctgaatctgattgtacatgcatacctttcttgaaggcctagagcctgttttggctggaggattttccagctgccacagagaataatgaagtaagttggagaaacacgattcatgagctaacaacaaaaatatactagaaagtaaaaaaaatagtggcaagctcaaaaagcagaatctgtggatgtagttaaatattctgcaatgataacaagccaaatatactttccacattatgcaaaggggctcacggcaagtggcaataactttctgcaattgttccttctttctgtcaagttatttcaattgtcttatgcaatgattctgcaattattctgcaattgtttctgcaagtggcatatatgtggatgtagttaaatattctgcaatgataacaagccaaatataactttctgcaaaggggctcatgagcaattgtcttaactttctgtcaagttcaattcacctattcctcattaaatttcacagacatctgaaatcagtgtagaagccggctcaactccttaagccatgggatgatcctgtcattggtgtcacacagtcgatgtaagatgtttacatgcatgctgcaccaattcatgatcaaccctattacacgatctattctctattacagtggacaaactccacctctttaagctcaatgccaagcagttcagcctcggttaaaccaattgtcttttttttattttagagcttagttcactgatcattgttttgttttttctctgaaaaattagagaaattaataacttattttcctgtccctacaacttaataaagtttcattaccaaacttacaatccatataataaataacaacaacaacaagtactccctttattccaatttataaaccgtttgactttttatcctaagtttgaccggctcattttattaaaaaaatctaattattattaacatttactatatcatttagcatataatatactttaagtattgctttaatttttttattttttctaaaatatttgaataagacgagttagttaaaattggtaaaaagtcaaataaattataaactgggactgagagagtattattattatattcaaactctaccactgcttattactgatcgttttgcagggtgcagccaccgtttgttatctggcattgcatcctcaggttgctggagtcaccggcaaatactttgtggatttcaatgctgttgaactaaaaccgcctgcaactgacaaggagttgtccaaaaagctctgggattttagtgtcagcctactccagtgatataactgccgattagttctcctacgccagctggtaaataaaggtygatctgaatgagagatcatgtttcagtaatagaacaaggtgatccagcagtgtaatatctactactacttattgtttgactagatatggatgccatatgtttgtaatttgaataaattgattggatacatttctgcacttgtttgaattgtggca

SEQ ID NO: 4726 - DNA, 1500 bp, Zea mays
atttttgaacagagagtagctaatttgataaaaatagctaatagttgaactattagctagactatttggatgtattcagttaattttagcagctaattattagctctaatgtatttaaacacccctagtctctttaagtgatgcattagccgtgaagtaagctgctgcttacaaaatgtggtaggccaaggaggtaaggctaacgatagaggattatgtgccagcggtgtctaggatgatcaacgtcatccgaatcagttctgagattcaggtggaggtttcgttttaacgaaagcaatggagctagagatgtgtggaggattggtcttcttccgtatgtatgaccaacccctaaacaacaatacatgagcgttttagctttgctgcacaaatattaagggcagacatcaacagaccttgcgcccggacaggaccctcaggtgcgtgcagtgcagtgcagacgtgcagtagtcctcctggaagctcgcacagtcaacgtaggaatggaacctggatcatcgtagacactgggctgctctgactctgagagaggagatacttttgttgttaaggaaagccgtagagtatgctttgtccaaatgaaactcagttcgtggcaattggtaggaatatatagaaacgacacagacagtcttcttgctctaatataatggatgtcagcattccgcgtcattgacagatttcagagatgcttgcattgtgtcttcacgaacggggagagcaaacgacgtgagtacaattttttttccctagggtctctgcaggcgatagataggcgttgcccacgtgcgttatgcgagtctagagtcttgacacaagggaggtcacggtcacctgaaaggatatataccgtttgatcactgcgagcgcatcaccctatataatctaattattctaagctaaagaaaaagaatgtgtggtgtggagtttattgtacatattaaattattatcatctatcttattttacgcctttcgttgtttattatatttataaataacaccttttatcactataatctaccatttctaccatttcagatgatgtttttttttgcaaaatatatagaacaaacagaggtgaaatctgagatgaatagtgatgatttaatatgtatatcatgtacaccaaacttatttatgcaccaaatatgttctaattaagaaacataaatatatctgaccaccagcgaagcgaaagcgagcagatattacgacatgcacgtatttccataaataattcttagaatgttctattctaaccttaagtactagtttgatgacaagaaaaattgaatggatctatggacggatcgatgggcgatgtcgatggagagcccagagagccgggcatgtatcttctccatcgccgagttaataacacaacatgagtctcgaccgatcgacccgcaagccgttgtgcacacgcgcgcgcgcgtgccgaccgatccagcccaactagacaccggcagcgggcacc

SEQ ID NO: 4727 - DNA, 271 bp, Zea mays
tgtcataaattatataataataatatatatattactattattaaaaaaataagacatggctctgtctggaacgcttgccaacctacgtgccccacggcaaaccacaatcattcacgtgcacccagtataaaacaattgtgtgttttttaatcaatcgtccactgcctgctccctacgcagctacgctttactcccttcccctgcttcgtcctcgtttctcctcgaacccacccagcagcgccttcttccttcttcccgcccaacctcggcc

SEQ ID NO: 4728 - DNA, 226 bp, Zea mays
cgtgaccttcgtgtcctggccgcgccacaccgccgtcaccgcgttcccgtgaacgcccgccggcgacgacagcttccactacttcaagaaggtgttcgacgtgcaccggattcggtccacggccggcgcgctcgacttcagcggcatcggccagggctacttctgggaggcgctcttcaccttcctctacgtcgacatcctcgacacaaccggcagcctatacacc

SEQ ID NO: 4729 - DNA, 819 bp, Zea mays
tgtatgctctttccctattttttctcaaacttcttagagttttaaccacacataagttagtcgcgatatttactcagaggagtgttaagaaaccccataaaaatttacatagactaataccaaacatatctctaaaagaatctgttttcatataaataaacttgtactccctctatcccaaattaaaatttgctttaaaaaattaataaaatcatatgatacttggtgtatgtgatttatcatcatctatttaactgtagatataaaaattaaaaactacgaagggagtcttaaccaaatctgaaatatgtgctcaaaacggctgttacaatcaaacgagactgagtggcgtagaaggcacgttagctttttctagtggcgaggacagaatttcgatctttttttagtggcttacgatgaactggctttgattagaagaggcccgatggggccggtcatatcctttcatcttgttttgttagcagaagtggccaattggcgagtgggccttagccccaccatgcgtcgtcttgctgtctcttcgcgcgcacgggttgcgggtccatcggcgcgcagccaattggggcaccttcgggcttcggcctctcgtctcccgtcccgttccatggaacgggccccggaagcccgagatgcggcctgagactgggagtctcgtcccgaaaggtgtcgggtgtggaacttatcctctaattcccttcattctcttgctttgaagggtggggggctagggcgggccgcactgcgcaccgagcgggcgccgggcggacgacgaagcggcgaggcagtgactggggagag

SEQ ID NO: 4730 - DNA, 181 bp, Zea mays
gcctggagggatcggaaacggcgactgacgacatcgaggggctaccccggcggtgacggcgcggcgcggtggtagtgtgtgtgtctgtgcgcgcgcgcgtcgcggacgccgagccggagacacgcggtcaattttatgaataggttttttttgtccccttcccacatgagaatctgagact

SEQ ID NO: 4731 - DNA, 159 bp, Zea mays
acccctggtttgaacggctacatggcaattgtgaccaaccttaacagtccggtaaacaaatggaaatgtgctgctgctcccattattgtatacatgaattaacttttcagaattcaggttaaattctaagaagagtaaatatttccttgttaccggtct

SEQ ID NO: 4732 - DNA, 146 bp, Zea mays
ggtgagcttttggatctcttctcttgccactgtaactgctgacggaaacatgggtaaatgtttggtgggttttaatggatgtgctactttttgcttgcaggcgtgtcctaattttccccaaggggaacaatgtggatcacttctcg

SEQ ID NO: 4733 - DNA, 290 bp, Zea mays
tgtaagtaggtttcagttttgcttatgtattttcttttccaaaaaatggtttagattcaaatgttcgttgccttgttgactgtaaactcttctcagtagtggattgttagcctccgggctccccatcttttttttcttcttctttcgcaagggttttccttgttaaattagcatttctcgtgtccttgattaccgtccctatatttctatatgaatactccctaacagcattcctattttgatccagggatttgtcatctaacaatctagaaggagacataccattctcc

SEQ ID NO: 4734 - DNA, 816 bp, Zea mays
ggtcaacgaggaggcgctggcgcacctccctctcttccgtgccgcggaggcccagagctgcgccgtcgtgttcaacagcgtcgctgctgctcgacgccgacttcgccgcgtactaccgtagccagctcccggggacgcccaaggaagtgttcctcgtcggccccacggtctctccatctccactcgccgtcgccagcgccggtacggagcgggacccgattctgcagtggctcgatggccgggacgaggggtcggtggtgtacgtgtgcttcgggagcacgtgctcgctgggggagacccagcttcgtgagctggccaccgggctgcgcgcgtcgggccggccgttcgtctgggtggtctcgacgacgcctcgcggggacggcggctgcgcggagcgggaggcgcgcgcgtccagcaacggcatggtggtggccgggcggtgggcgccacaggcggagatcctggcgcaccgcgcggtgggaggcttcgtcacccactgcggctggaactcggtgctggaggccgtgtccgccggagtgccgctcgcgacgtggccgctccgcgcggagcagttcctgaacgagctgttcctcgtggaggtgctccgcgtgggcgtgcgggtacgcgagtcggacttggaggctgtggtgccggctgatgcggtggtgcgcgccgtggggaggctcatgggtgatgaccagcaggacgaggaggtgttagcggcgaggaaagccagatctcgggagctcggggccgcggcgcgcgccgccgtggcggagggtggctcgtcttccggtgactgggcacggctggtat

SEQ ID NO: 4735 - DNA, 408 bp, Zea mays
cgaaccttttttttttcgtcacatcgatagcacagcggtcttgtggattaaaggctactgctgtgtttgtcttaaattttgcttatgttgctggttgtgtgttctaaacagaagctggaagttgtatggagattttgtatcatcttaatgtattgttttttatatctataaaatgcttcttttctttcatcgaaaaaaggtgacaaagcgaggcagcgagcgattggacttctccatgcaggggttgagctacccaatttgtcgctccaaccacctgaaaactaacaaagaatatatgcggcaggggagctagcaacacacctgccggccgacacttgccactgtttcaggcaaggccatagaaattaaagcggcggcgaagcaaagggacccggccggccggcgtcc

SEQ ID NO: 4736 - DNA, 364 bp, Zea mays
gataacgtaagaggaccgttgaaactgatgctttaagtatagtagagatattagaataagtaagctactacaaataatctaatcataaattagttatacataaaaaaatgtctcatcatttagtctttatttatataattattttctataattaaactatatttaaaactttttcttaatattaaaaaaacattcgatgtaagggcaggaccaattagaaagtacaaactcgcctataatatagacggaggagcaccaacggcattattggtttcgccaaaaacctcaccggctccattcgaccattccatcctttccttatcccctcccgcttcgtctcccttcctggcttcctttcttcgcc

SEQ ID NO: 4737 - DNA, 506 bp, Zea mays
ggtattaggagaggaggaggcctccggcgtctcggattgccgacgttgctgcggcggcggccgcgggtggggttcaattctggtgccaccagacggcagacgcggccgcggatcgggtgactttgagtcgggtcgggtgggagttacgtgagttccgagttccaggcccagacttcacttggagcgggacccacacaaattccttgtttgtggctgtagaccgacgatcctgggcggccgtggcccgtggggaagaggatgattcatcacctctttgggcagtcatttacaaacttatttagggcttgtttggttggtggctaactgtgtcacacttagcctaagattagtcgtctaaattgaagaactaaccttagacagaaaagttagacaaaatgtggcaagttaggcagcaaaccaaacatacctttagtattccttagtttggcactctggccttatgtgcattcagcattgttggttgttctatatacccttaacacttg

SEQ ID NO: 4738 - DNA, 127 bp, Zea mays
agtgatctatcatgtcaaaaaaatgttatcctcacctgacaaggtgaggcattcaatcgaatcgctacccttgtaaatgtattaatcctactgtctcagtaaatgcgctggcttggaaataaagtaa

SEQ ID NO: 4739 - DNA, 583 bp, Zea mays
agtgttaagggtatatagaacaaccaacaatgctgaatgcacataaggccagagtgccaaactaaggaatactaaaggtatgtttggtttgctgcctaacttgccacattttgtctaacttttctgtctaaggttagttcttcaatttagacgactaatcttaggctaagtgtgacacagttagccaccaaccaaacaagccctaaataagtttgtaaatgactgcccaaagaggtgatgaatcatcctcttccccacgggccacggccgcccaggatcgtcggtctacagccacaaacaaggaatttgtgtgggtcccgctccaagtgaagtctgggcctggaactcggaactcacgtaactcccacccgacccgactcaaagtcacccgatccgcggccgcgtctgccgtctggtggcaccagaattgaaccccacccgcggccgccgccgcagcaacgtcggcaatccgagacgccggaggcctcctcctctcctaataccgccccccctcgggaccgggagggagtccgccgcggtgcggatcgcggccacggccacggaaaacaccggggcgcggctc

SEQ ID NO: 4740 - DNA, 201 bp, Zea mays
agtatgcttctgattgcttataatcttttacgtagactgccatataacatgtgattctcttatccattctccattgtagcatgttcgtatgtgcagatccttataattctactgaatgtacagtaaactcataattggacttgtgattctttttagtaatttgaggcttcttatagcagtgcttggaccttagttttgcaa

SEQ ID NO: 4741 - DNA, 1500 bp, Zea mays
agcctggagtccctttctatttaattttggataggaagagatttaatccactttaatccccttcaatcgaccaagtccttagatcttgttcggttgaggattgagagggattaaatcacttcctatttagagtttgttccgttaggaaattgaatagaaattaatttaattctctctgatccaccgaataagctgagatctgttctcacagctggaattaatgtggaggaattggtgctgttctccagctactcggcgacggggctcgctgagtcatcaccgacgcaatgcatgcatatcaatccatcgctcgatcgctcgtgcggggacgcgtttgcggtggcattgaatgcgrgatgcgcgcgcgccgcgactcggaaacgcacgccaccacyagctgcatttgcccgctctgcctctgctgtctgccggccagcctgagccagtccatcgatccgccgcggactggagttggatgtctctgcatcgatcattcgatcgtctccgacccacgtcgatctcggccgtctgatcgggaggtcccgcgaccgcaagctgggctggacgcctggctaggttcaatgaatgaacgcactctctcgccatgcacgcatccccatccctatactatatatgcgtagtcgaatatccgcatctcaccgcaaaaaaaataaaaatctgcggcatccgtccaaagtccaaagtttaaaaatcacctttcaatatattcctatattcaaacagacatccgtccaaagtccattgtcgggtcatagtcagaatttaggctgtacagataatctctctatattcttagtcaaacagacagacatccgaccccgtacggtcgtaccataatatagtagtatagtactagtataaaaattagtactagtagactctcacgcgtaacatcctccaatccattaaaaaaatgtgcgttatatctaggtaaagacaagaaatatatttttttagcgtgtatatatgcagatgcatcagcagaaatgaagtattaatattggaacgaagggaatgtactagaattgtataccaataataccatgcattccctggtgctggtgtacacagacagcacccagtacagcccgtacaaacccggtggcggctaaccctccagccaatctgcacccgccctcttcctctccccttttgcagcgtgcggacgcggcagctggctggcgaccaccaccatcaccacagcacctgacctgatcacgatctcacctggccagggccaggccaggcagcaaggcaargcgaactggaagcggcttcttttctccactgacgtccccgccccccgccactagcccactccccctttctatatatatatatatacctcccctctcaacaccagtcgccattccacccaagatctcagaaagcaagccaatagctagaggttccttcgctgtgctgctagtgctagacgacgacatatagaagaaatatatatagagaaagagagaaaag

SEQ ID NO: 4742 - DNA, 482 bp, Zea mays
tggccggcgaatagccaaatcccgccagcgcgcacgaaactcaactccgactggttccaaacytagaacacacagtaaagaaagggtaggaagggttctcaccgcgattcgccagcacaagaggactgcccacgacaccaggtggtccacggtggtgcccagactacgacaaggaatcaccatggattcgtggcctcccatgctgatttgcgggtagccaaagcttcaccctcgccctgcagagccccgcacccacaccatgggagcccaaccgcgactccggcaagaatagccctggcggcatcctccattctctcacctccccatttttccccattcggctctgctctctcttgtccgcgccccgacggctttctggtgatgggcaggggcggcggccgggttttataaagggcgagctgagcggactcggcggaaatcccacgcgcgaagaacgacggatctgttcgcccaggcctacg

SEQ ID NO: 4743 - DNA, 250 bp, Zea mays
gcatgcacgtacgacagcgcctggcatcggtcgttcagatgtctagctctagcttgtggaagtcactggatcagtgacggtcgtgcctacactacactggagtacacaagatactttttgggaataagcgtaagcaaaacatgtgtgtgctgggtataacattatatacacatatatatagagagaaagatagtattggtaggagttttgagatagggattctcttcatcttttctttctgcctgcctgc

SEQ ID NO: 4744 - DNA, 497 bp, Zea mays
cccgtggcttctctcgctgccgccctcccgcaataaaccgctgccagcccgagcggctccatcgccccgctcgcgcttttcggagtgccaaaggccgtgattccagcgctgctttttttggaattcccgaccttcttcctctcctcgtcgtctcattgccattggagctagcgtctcttgcacagagacaggtgagagttcagtcctcttctcccttctacactcctccatgtggcttctcagttaatttgtctgatccgatctctcaaaagtttctttattattattttgtcgccgggatgattagatctcctcctcttgtcgcccaggaacgatcccacaacgttgcctcgttgtttcctcggaattcttgcttctcctgccccttgttcctcgggattaatcttgcttcttctgcctctgctctgtgaaattcgaggtttttgatcaatcccggtgctctggtgtcgttgtttttcaggcccagggaggccgcg

SEQ ID NO: 4745 - DNA, 292 bp, Zea mays
tctagcggggaggagctagtgccctgagtacatgccgtcgtggcagccggagaggttttggcaccctgttcgtgtgatgtcgtggcagtcggaagagcgctggagcctggcggaaggacagctgtcggggctgtcgagtccttgctgacgtctccttgcttccgtaagggggctgggagccgccgtcgtcatagagcgtgcggggtgccatcattacttgtctggcggagcgagccagatgggacgccggtcttgttccccgtagtctgagtcagcttggggtagggtaatg

SEQ ID NO: 4746 - DNA, 537 bp, Zea mays
ggttagacttaagattattattataatgctgcagtagcattatattatttcaacgcacggacaatcgactagtaattataataggttagacttaagattattattataatgctgcagtagcattacattatttctcgaggaagggagtacgctggacgcctatctacacctgcaaacggctgaccaattaaacacgacaaaaagaatttaaaatttaaattcccctcgattacatccgcttcattaacgttctaatcattcgttcgctcgtccacatccatcgcccccctccctctcgctcctttccccccgccttcccctcccggatccccttgggcagccggatccggcgaggcagaaggcgcggctcccacagatccgaggcgcctccgctggggactcgtccggtttcggtgggctcgaccttacaggcggggggcgtaattctgacaggacgacggagccgggtggtgcatgagcgctgagaggccccgccgccgctctgcgtaggagcacggtgcgccgccgtgaggcgcc

SEQ ID NO: 4747 - DNA, 168 bp, Zea mays
tgcagccgcggcccgccagcaaccagtccgatccccgccgcggctacctgccggttcccctctcccttcccggcgtgcggccgcgcgcgtgtttgatcgatcggagccagacagagcgcggaaacggcctgagaattctgttggagcagcagcactgccacagctagc

SEQ ID NO: 4748 - DNA, 51 bp, Zea mays
caggtcgctagctcccggctaaactagtaggcagccatgatttcggtggga

SEQ ID NO: 4749 - DNA, 222 bp, Zea mays
ctgcagcaccctcaggcctcaccgcctcagctgccaccctcaccctgcatccgagagagagagaggagagttgccgccggagggaggaggtcgccgcggaggggaggggctcgccggtaggggacatcgccggcgcctggagagctcgtggaggggacagccaccgtcaccgccaggagacaagcgccgccgccgctaggaatcaggagacaagcgagcgcg

SEQ ID NO: 4750 - DNA, 1500 bp, Zea mays
aggcaagctcggtttggcgtcgacaacggcatcgatggagggggcagagctggggaagagaggagatggagcgcagtcgagacttggagacgacgaacaatcggtacctcaccgacatacgcttcttcgtctccacgagtgatatctgggatcggtggtagccatgcgcggagcgaggaggcaatgcgctgcggtgtgtgcgcaggagaaagtgggtaaaggagaaacaaacgaaaaagtaaccacaggaaacatactgcccatttaaggccgaaatcaaggatcggatgacaaaaaatgatcctggttaactgttttcttaattaacatatatgatgacaaaattgttatttttttttaaaaaaatattgagtagatttttacattatgtatgaacattaaaattgacaacatatgcaaaacggagaaaaaaagatgtagtctgtgaattctattatgttggaagccagagcacaaaaaaatatagcttctattggctcctcctacatttctttaatatatcattcaaaattaaaaaaaactgttttgacaaagaattgtaaaacggttccacatgccaatggctactgcaactattataatgacttaggtgactaaagtaacttgaggcgagcgacgccgacgaggagaccaggatccccgtcctgctccgcgtgccggggggcagggggaaactcctcgtcggtcgggccggcgaccggtgtagcctaggggcccgccgcccctccctctcgctagagctggggtttgattcgaatgcgtggacgaccgtggaggcaaaggcaaggcaaaggggggcgtcggcccctttccttttttttatttgggatgggactcttttcgctttctttcggggcgcggggggaataaaacgctcccccggatttgaacgttgaagctctcgagcgcagcaaatttttgaacgcttttctcaagtgtacacgagccgagtacggggcgggcgtaccgtgtcctctcgatccgtgatcacggcatggaacagtggacgggtggcagcggagccggagcggatgcagagctgtcagctcgtctggcctggcctcagccctcaggagaagggcacttgcggcaagtgtcattcttgaccagccggcccgccgccctccctgtcctgcggcctcgcatttacaccgcgcctccctaggccagctgcgagcggcgagttctttaaggaggcgggcgacaggccggtaccggcgcggtgcctttgccttgcctgtcttggcgtggagtggcctgcattctcttctcggagaagacaagcaaagctaagcaaagcaaggcaacccattcccgttcttgtcccgttgtctttgtctctcttgtcccttgctgctcgctcgccgccgtttctcggagcgctagctgctgctgctgctgctgggagtgtgagagtgaggcgaagggccgacctgagccggggagaagaagggggcctgccggccggggctgggagac

SEQ ID NO: 4751 - DNA, 1500 bp, Zea mays
acctgccatgtttaggcaatagatgttttgtggttcatcgattgcaagacgattaaggctgagaaaacgggtgtgtgtttgacagttgcacaatgaaaagcagtatactgaaacatggcaacggaatctggcttggaatattgtcctcttacaacatattttcagtcttatacttctgctccccttgttgtagggtacacaagtgaagtcccttgcagcagagaacacgtcccttcgatctgaaatcggcagtctaaacagagcgctcagagaagctcatattagagaactctgccttaatggtgtaatgaaaattttcctaatgcctctccctactatattcaggcgatgcctttcctctgacgaaatagatcatttcttctcttgggtcagtttagtacctcaaaatactttgtagcccattatctcaacttaatgtgatttgtgttacaacaatcatttgttctgacatatgattattgttagtactaatcttaaggtactcgaccttttaattttgtggccgcatcaaaatggttgtcctatacgctataaccgggggcgagcccatgtagaagcaagggtatttaattgaatacccattattttttggcaatagaatttatgtgtatacatattatatctatgaagtgaaatattgtaaaaatataaaataacaccattttaaagctatttgactcaaacttcgctttttgctggtctttttcattttcctaccgtgcgactagggattgggagttgggacacgagtatatggtttgcaaatctataactacgagacaaaatttaatccacacccatacacatatatgttcctagcatgaataacaattttaggctcctaaaaaagtatgtctactagaatttcgaatacccatccttcaaatactgggcacaccctgtctataacatacggaatagcttgttccactacttgcgtgaaatgtcccgcgcctgcctgatagggcgttttcttttctagtaattgtgaatggacagagtatctaaactaccaccgatgatcaggtgctagccccgtagcggtttcaccttccgtccaaaccggcaaacccggtggcgcccgccgcgccgccccctgctaatctgcacccgccctccagtcaattctcctctcactcctttctgcagcgtgcgcctgcggtagctatgactacgactatgaggccatgatgacacaccccgcagcacctgatcatctcgcctgacctgggggctggggcatgcagcagccaactcggcacagcaagcaggaagtggtttcctttctccgctgacctccccccgccactatatatacctcccgctctctccttcattcgccattatcatttccattccaccgaagatcccagaaacaagccaatagcccaataggcaatagctagaggtctcttcgttgcgctgctagtacacataaaagcaagagcgagagcgagagagagagagaagaagaagaag

SEQ ID NO: 4752 - DNA, 136 bp, Zea mays
cgtacgaattcacaagaacattttaccttcttatcgtcttttacgtacgcaagatgatcagctcgccgatctatcccgtctgtcaatcgtcatcgttgattggtttaggttcacggggacaccgttcttccactca

SEQ ID NO: 4753 - DNA, 1316 bp, Zea mays
tgcagtacgtacagttgatttcttcactgaccatatatttatttgtagtgggtcttgagataatgtcatcgagcaaccacaatcatgaccataatgtcaatgaatcgcagtcaccgctgaatgtttactattgtatgtttactgttgtatgttcactgttgaatgtttactattgtatgtttactgttgtatgttcactattgtaatatgctgttgatttattgtgctgggcaggatttttaagtgggttactggcagaaccaatattgtttctaaattctaagtggcctgttggcggggatttttcccccatcggatccccgtatacccgacagggacaggtacagggaaaatttctctccgcgggcgtggacggggaacggggaatatttagtttggcgggtacgggtacggggagcagccccgttgacatccctacaatcactcttgcctccattattgtttaatagacaatgctcacactgcactacattatggcaagaaagaagtgactggatcatttctactcaaattgctaacccttgtcttgtattgtcctccccgtattattcgttacatacttcctaataattagttcatgttttgatagttctctaatgaaaagatgtgctatgtgagaatagaaacgactcactccagttttatcagaataggcagaccgcaatctgcagtctatatatgaagtgttcctcagatgcatatatttatgagttagttattctgaagtttcttattagagatatgtatgtactatacttgtactccaagttgtaccttgactatatatatgaaagtcacccctccattaatggatgtgaggtgcatccctaattctctacacttctcctttgcaataatttctcgccattctgattacaccgttcgttgtcagtttcatagttattataaggcgatgtaaggcgaccgaccccttttttcctttgaggcggtagagcctaaggcraggcggcgccttaattatatagtaatataacacattaattatatagtaatataaaagattacgctaaatattatttatataaatagtaatataaaagattaggctaaatattatttattgttgtgtatgtaggtttttaaaaacccacataatcctattgggtttattgctatttattaacttatgtagaaatttggcttgtttgcctggtgcattgtattgtctgtctgtcttgaatatgtcaaccttgaattttacctctataaatcttgatcctatgcttatggtttgccctctttcagttccttctgctacaaattcatagtcactg

SEQ ID NO: 4754 - DNA, 1500 bp, Zea mays
accattgctaatgactagttattcgtttggtatactaagatttaaataatttcttgatgcatgcatggtgcagctgcctggagcaaagtcttattagagtgttttcgacacaataaatgagcctatctatacagtaggctgtgaataaaaccaagcatataataagatggaaatttacgaattaatggaaatatctccctagctattttcagaacattattatcttatacttctctggaagtcgatatacagtctgttctgctgatcgttaattataattaattcagggtcgtcgtcgccaacgcagaatatattttaagggaggatgttgctataattaggtgccgagtacttacacacttggcttgcggcagaggagagtgatgggttggttttaagtagacgttgtaggtttgaaacatcagaggggatgttgagacctgaacagcagaactccctccaccagcaagcaacccgccgtccgcctacaagctacagcgatcatctctcttttcgttcccgcttctcccaatgcaaactcccgatgaccatgcattattattaggttacgcaggtgaagaattctgccgcacacgaagatcgagcttatgatatatatgatccagaaagtaacaaggcgatctctctgaaaggtactaatacgctacatgcatgcttacatatgcattatattgttggttttttttgtcaagctaatcacttctagcaaagcatattaatttaataacacgtcatgtgttgttggcactagctagctagagcacctgcaggtctctagatagctagctctacgtgtgttaagttgcatgtttgttgaacagttgtaaccggcgagctagctaggtagttagtcgatcttgtggaaactacatatatatggcatccatgtaacgaagcttaacgtacaaaaccacccgtcagcccacacgtagcatcaagctaactccggcgtaactatctcctaactcgctatcttctcactcactaacgatatcaaaccacaacgagagaagaagaagaagaaaactgtccacagcccaccactgcttccccttcttatatatataccctcggccggcccttatctgttatctctctcctgtgcctctccatttccttttgctgccctcccctcttgcatcatccttgttcatcgtctctccagccgcgcgcccagcagcagcgttctcgatcgatcagtcgtcgatccggccgtgtgttcttcttctgtatcactatcaccttcaccgcttcacctattcggccggccagctgctgatatcttcttcttcgctgccgcctgctgccgattaatttattcactcgacggcagcgacttcatcgtctatcataggaagctgagcaaagaagacgtagggtgcagccgtgcaggaggaatagagatagagagcttcaggtatatatagcaggcaggcaggctgtgtggttgatccggtgatctatatcgatccgtcgagg

SEQ ID NO: 4755 - DNA, 1462 bp, Zea mays
cgtaagcactgctctagtccctgctcctcctttctttaattcctattgtctcgatcctcgtatcaccctagctacccgatccgattctataatcagtatccctaaataggtaggaagatcgagaacttacattacctccaagtccgaggctaggtcgatccgatggaatgtgaaacccagctaagctactgtctgtgtttagttcctttcgcttaacaaacgaaggaggcgacggtgctttatattggcaagctgctactgctacattctcgtactcccgactcccgagtcctgagacgtcgactcgacccgtcgtctagtgcgccaactcaagaatataatgagctttcctcttctttcccacccacattcgtctctctccttttcctctccttttctgagataggataagaattttttyttctttcagaattactttatactgaaagaacggctggagttaatcaattgattgcaccatggatttgttttgatttgattccaccccattccagaaaacataattagcgaatatattctcatcttgtcttatttagtcctctgtcagccaactgaccaagcatcgtgccggaggggctagtcgcagacgggccgaggcgtacaggaaagctaaggaagagaagcgtgaagacgtttgggccggtttgggttaatgggctgagcgagtgcgcgtgagagcgatatgtacactgttgtctgctggggagggtagcgaataatcagaactcatcttcatctccaagacattgtgctctctgcttcctgccttcttcctccttactctgaatctactctgagtattgtatccagtatatgcgagagtgtaacatcctcttcccaccaaatgtccaaatcaaacaagatgaccatcatgcatcacagcaagcactgcaattctgttgagcaaacccaatcatacaatgtatttgtgcatctctcttatgtgcacattttcaatatgtggaatccataagagccaaaaaggaacaagttgcacaccgatgtatctaattatgaattcaggacacccaccccttgtatgccaaagaagaaagtaatcatagcttacaatacagtgaatagggtctttctaaaatttttggtgcaaggcaaattcttcttgaacagttttcaatacaaaattagcaacatagtctaaatacaagagcaaaacactgaatcaggttgtgtttggttaggaagaaatatgttcagaggcaaacaatcttgctgaaacatcaacacatttcactatttttaagaggaactatggaaggagattgccggcatgaacattacactgaaatatgccaagttcaatccttttaactatcactacctaccattatttgaacaaatagcctatgttggtattaatttttttaccttttaggtgagccgtttgcaaagtgaaggatattatggaggcgtccggctgctg

SEQ ID NO: 4756 - DNA, 620 bp, Zea mays
gcgccgatacgattgaagacgcatgttacttgcacggaacgtaagctaaagcaaagaaatacggggtgggtgactgggtggcagcacgcgcacggggtaggcaggctgcgaaacaggggaaggcgcgcgcgagaagcggtaaatcgaggccgcgccgcaccgatcgcgggatccgtgattcagagcgtggcacagtgctgtgagatgagagacgtccggccgcgagcatctcgcgctggacgcgacgcgacgcgacgtgaggaatcggcaacgtagcgcgcccgccgcacacccgcacccgcccgacgcgccgcgtgggtgtgtggtgtctgtctgtctctctctctcccatctcctgcggtccagctcgcagattccattcgccccgctctctcgctcgctcgccgccgcccgtctatctatctatctatatatgccagggcgggcgcagatcccctctggctctcagtcacccacccccaccccaccccaccggcaccctcaccctcaggcctccgcctctttctcagcttctctccggttccttccttccggtcgccgattcttctacgcgaaagattcctggctgcctctcgtctctcgtctcgtttctcgcgtgc

SEQ ID NO: 4757 - DNA, 284 bp, Zea mays
gataaattgacgatgaggagcagctagaggtcgtggtggagaagggctagagaaagggatgacgagggacagttgcaagttgtggtggagaagggcgacgaccccatgacaacatgaggtgaatttctatatcagttgccaatcataagaaacaaatcttattattgcactctaggtattatgcacaagctttggagttcttgatgtttcatgtttgtgtaaactcaaacgtcgaggattttattgaagcaataaaagggccagatgctattattgatggctat

SEQ ID NO: 4758 - DNA, 1500 bp, Zea mays
aatattctttttaaggtagagaaatagagtagtatgagtgcggatagccttagaacccatccatcttttagctgaaaaaaggtttaagatctttgcgcgtctcgctgcgcgcgcccacggtctttagtgttaactaatcggcttggtcgacaagatcaggctgcgactgcgattaaactagccacatcctctgatcacatggtaaaaagaccttttgcaagcctagagcaagcggcgtgcatggcattatattggtgcatatacaagcatatccccatggtcgcccatcacatccaaaagcagttgtttacttcatccgttccagtataaatatatttatagaattttaaagtgtacttatttttttgatgaattttaaattctacaagtgtacttgttatgggacaaaggaagtaaccaatcttcggccctaattaaccattatttttaaagagactaatggtggcaaagaaccgtcaaactaaaaccgctaaggctgagcccatcagtacaaacaagtagacatacaaaatatttgtatagacatactatagacaatacaaagttttgaatagacgatgagataaatgttgaccggccgatgartccaaactccaatcatatcctctatatccctcgtttgcatactcttctaaaagatttcctcctttattatcttattcctctacagtgtcctcgatagctaggttagatactcatattagagacatgttttgctctagatttttatacgtacgtatttatcatatcattaaatatcttatacatattttagtttttagttttgcttaatatgctgtttaaactctaaaacaaataratgagaggagagagaatatatccattctctatatatggatatatagagagaagatatccatttagaaaaaaacattgttagaacttaaaggaaagagaattatctctgaatataagatagaggacgattcatggacttttgttggagtcattctaatgaaagaagaccaccggaaccctttgacaagtccacctgtttatattccaggtatatcctaaggccttgttcggttacatcggattgcacccggaatcgttccgattaatcaaagtttatataaattagagaagcaatccggctcggaatcgttccgacccaccaatccgacacaaacgaacaaggcctaagggagctaggagtctctggaaccagctacggcctttgaaacttctctcgccgcacgacccgtcccggactctccggaagcatccaccaaacacctgccactcaggtcgcacattccattcccagaagtctccagagccgcataggccactataaaatggtgatcccgatcggcctcactcgagttgcgattgcgagcgattcgagttaaaaaagaacatacacaatcatatcaccaggccagggcacgcacaagcgagctgatctgcagcattatttggctgattttttaatcgttgacggtgggcgaacat

SEQ ID NO: 4759 - DNA, 805 bp, Zea mays
ctttactcgtctacattttcagttaaaatctcgttacatcaacaacagtctaggcgatcaacaacaatagaccgttgaacctaggtgtcgtataatcgtggcaaccaaataatagctattgtttttttcctctcatcatgataaagttttagtgtttactttcatccagttcgtccccagccaatcagctattaattggtgccacactgccacggctagcctagccctctctgtctctgtctttcttacctgactctgagctgtatttggtccttgtcatttctctaagcaacagctgcgtctgttgacaggcagggtccaccgatcccgggattaccggccatgcgtcgctaaccgctgtataaatagccgccataaccataatcacacagacacagctaatgaaaacgataacactacagactatagctcgggtaagtttgtctttttgggtccgcggtcttgttacgacagcctatcgcttgggcccacgcccagcctggacccaaaagtcgccaaccaaaaaaaatccaggaaactggcactgtagccgtccgatcaacaaacgcacggtggagagatgggcaagccacctgggctgggccccaaccgccacagcacaaggccaggtccacagcacctccagctcgaacgaagccccacctcggcaagacggcaacagagcataaagcagcatttcaaatccgtcctcacgtagacgagacccgtgcgccgctcccgcccccgtcttcttccttcccccgcccgcgcccgaccccagcaggcaggcaggcaggcgtcagcc

SEQ ID NO: 4760 - DNA, 1500 bp, Zea mays
tagatttctgacatgggttcaaattttttggtatagaattaacaactagatataacactctagggtcctttggttgggcttttgaactcgcttttgcttttgcaaaagtcaaaagccaaccaaagrgctaaaagtcatttgcttttgctatagtgcaaaactaaaagcaacccacccgctacttttacatgctatgaaggtgggaacctttaaaaatatccatctgccactagttatgaatatactatttcattttttcttttttccatctctgacctcttctcgtatgtgagattgtgacccctttctcgttctgtatggtgtttctggttgatgacgatgctccttcctctcccccgctcagctccagcgaccccttctctagacttccggaggcaaggccatctcttcgagcatggttctagctactgcgtaggacattggacgccacgtgggtgagcgctggtccactatcgtggttgagcacgaccttggccgccatgtgggtgagtgtgtctccaccatcgcaagagagcatgaccttgattggggatccatcaggagtaagaataagtggttgacagatggggtctatttgtcgagaaaagttgacattggttttttaaaagccaaaactattgaagtaaacgacttttagctcttgcatagctcttagttttaaaactgtgcctcatttagctatttccatgagactctttatcgcacctttcatctcatcgctatttcaaacttcactttataaacagttatactacaatataaaatagtgaaatgatttgtaagtctgtataaggtctgctggagatagtttactcaacccattgtcacatgttgtctctgccttctccttttcttttcttttaaaaattaataaaaaatatctagaggatgcaaaatcgggcttggacgaggcattcggtgggttccattcttacctgaacccgatgccgaaacgagagacagtctaccctacttatcacactgttaatcggtcttggactctctgtcctggactcctggtgtcctggtggtgatggggtgacccaggtgggtgggaaaaaatatgtacatcttggatgcaaatgttcttttttaccgtctttcacatctaactagaagatccaaaaaaaatagatcaaaatttgcaacttaattattttgtaatttgtttttcttggataaaagtgtttttagcatcctggatgcaaagatttttttttgcgggtgggtcgtccaaagtagaatccaacggcgcgccgcagctcctccgcccctccgctcccgccgcctatattccttacttgcgttcgttcgtcaagcccttgcacaagcgcgggcggccctccgaccggctgaaaccccggcggcctcctgaagattacggtaccgggatcggtctgagccgccgaggcccgcgcaggcgcttccttatatatcgtttcttggcgtggctaaggtggtggtgaccatccggtgaat

SEQ ID NO: 4761 - DNA, 1500 bp, Zea mays
ggatgtacgtgggaatgataatggactttgcgggaggggaggaatgagaatggcaggaatggtggcagaatatgagaatggactgtgcggggagggggaatgcagaacacgaaatgacagcctaccccttactgtcttaataagtagtaaagatagagagagcgatccgagtttttatagtttattaaaaaatcactcggtaaattataagtattataagagcatttccaagatgaactcctataattgggacatcaaaagctaaattagacttgattcaagttaatttggatcaatattttttctaactccaatagcaactcctaaactcatgtggtagttaactccgtgagattagacacacagaaataggtcctttgactggagtgctatatttagtaactgtgacttcaggtgctatatccatttgatggaaatttataaaatagcaattttgttggaagttattttgagatcttaactcctatatttaaatataggacccggcttaattgtagatgctctaagtcactaaaaaaagttgcgaccatatttgtttatttgttgattctctgacaatttttaatatctcgcttaagatatagaaaataattttacatcagtggtacggaactatttctaaagtattcctatatttttctcatttgcatcagcatcaagaatcatgccatgcatatccgcgggtcagcgtggaagtattcggggctgagatggagtgcgtgaagactgaaagttgagatgaagagagcagtaaactcaaaccacgagaattcgacggcgagcagagcatttcgggtttccgcaacaggagaggagaaaaccacacgttgtttgccgtattcttccccctcccatcccagccggtcagtcctacggtcgccgtcgacgagccccaaagcagcaaatctccagaaaaacaggaagctcaatcaactacgcaagcatacacgaacgcgaggcgcaaatatctcccagcgagttcctcgcttttttgcttcgtgcggccctgtgccccgtacttcaccttcacgaagacatccccggcccactagcgatccgtgcaggcgctgccatccaccacctctccctcggcgtcgcactagcgtccccaacttcccctacgccgtcggtcgcacgtgctgagcgcctgacatggtgacacccacggaaactggtagttgctcccccgtggtgataccgagcctgcctctggcaagtggggtgccccgtaccccaggcggctgacgggtggggcacccaggtgacccgactgacatggaccatctcttcctcctcctccgtcttcctcccctaaccccagataaagccaagcccagcgaggccaccaactccacctcgtggactccttccccacaaaactaaaccctcgcttcggaggcgcgtgaacccaagaccgacaggcgaacgaagcgagggtcctcacaaccaccatcccctgctgcaacgacgccgccggcg

SEQ ID NO: 4762 - DNA, 643 bp, Zea mays
atagtttctactaaatgggtacagtgatcatgtacatatctgtcaccgttgagagttgtagtattatacacacgtatatatgcgtcatatatttactatgaaattactagattggattaaacataaaaacgcctagactctttaccgtcctttagagccactaatagatacaaaagtcttgattgcataggactgactgactgaaaattcgatactgctcgataccgatgcatcctttttttaattttttaaaaaaagtagtgcacatattgaccgagctcgctcttgctagtgctccccaggttcgtccaattcaatggaatggaggtcagcaagaggacgtggacgtcgtggtgggatgggttctgcatattttgtgtgtgcgtgtgtgcggcgatgcaacctaaacacggactatttctatccggaaaaaaacactcggtccaatttgcgcgggcccgacctgcttgctccggagacatactggcatattcgcccaaatcattgcgttcccacgcgaggggccttttaaccccagcccggccctgcgagcgagaccaccccacccattcactcgcctgcgctccctcgccgccccagttccccaccccctgctcacccacccgtcccctcctgctcgccc

SEQ ID NO: 4763 - DNA, 685 bp, Zea mays
ggtaattgtaaggtaattgatagcattcatatttacattgggatatgaattctcttatattttgcatatttaagcatctttagctatattttatttgacatgtatggaagtcggcactaagcagaatacgctgcggtacttgatgtttatttaataatttagaggtttgtaaccgtgcttgggaggaaccactggttcctccacacatgattattatgaccatctgtcaccactggttttttcctaactatatcttttaggatatgtaaacatccacttttagtgatgctaacaaaagtatagaataacaattagtgttttagcatatcaatgtattttatcatattgattccatagcaacatggtattgttttccgtgagggttcctatcaccattgtactcacgccgtccatcgctagagctataagccgttggaggattgtcaatttgtgttccgtcgcaacgcacgggcacatagctaattaatttatgatgaccgaggacgaggagtagcggggaatggaaaaacaacactggttcagtcggacgaccacacatctttgtgctgcgtgccggcggcgtggagcagactagacgctagtcgaacacgaggataagctcctgcagccagtggttggttggttggtttcctcgcccgtgccgtgcgcagctgaagccgatgga

SEQ ID NO: 4764 - DNA, 1500 bp, Zea mays
gggggagtttttgaaatccttgatcaaatttctttggaaaacctctctttatgtctctacaagtggatttgacttagagataggaatttgagtttgatttgcaaaaacaaaccaagtggtggcatagagtgatccatatatgtcaaatttgaatcaaaacaagttgagttcttatttgaattgattttgtatttgttctaccttctttatattgtgttggcataaatcaccaaaaagggggagattgaaagggaaatgtgcccttgggccatttctaagtattttggtgatttagtgtctaacaccaagtgcttaaatgtaaaatggtggacaaagaacaamccaaggataaaggtatgtttctcagacttagtacattgttttagagactaatgtattgtgtctaagtactagaaacaggaaaaatccaattggaaatgtcttggctcgagcagccaagactctgctgagtctaggagcaccggactgtccggtggtgcaccggacagtgtccggtgcgccaggctggctcgagcgaagtggccgctctcgggaattcaccggcgacgtacgactataattcaccggactgtccggtgagccaacggtcggccgcgcgatctgcgcgggtcacgtggccgagccaacggctagaagggggcaccggactgtccggtgtgcaccggacatgtccggtgcgccaacggctcccaaatctgcaacggtcggtttcgccatttaaggaaagaaatcgggcaccggacattgtccggtgtgcaccggactgtccggtgcgccaggcgacagaaggcaagatttgccttcctggattgctctcaacggctcctagctgccttggggctataaaagggacctctaggcgcatggaggagaacaccaagcatcttttgagcattgttgatcactcacacatcattcttgcgcacttgttcgacattctagtgatttgagctccgttctagtgtgctagtctcttgagctcaagtctgggtcttgtgtgtgcgtatttgctgtgatctttgtgtcttgtgtgagttgctaatccctcccttgctccgtgcttctttgtgaacttcaagtgtaagggcgagaggctccaagttgtggagattcctcgcaaacgggattaagaaaagcaaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatatcttttgtggttattgtgttttgttgagactcctctctagccacttggcgattattgtgctaacacttaaccaagtttttgtggcttaagttttaagttttacaggatcacctattcaccccccctctaggtgctctcaattggtatcagagtcgttctcttcaagaagggactaatcgcccgaagag

SEQ ID NO: 4765 - DNA, 1028 bp, Zea mays
tcttcggaaatactaaaaaactgttttcaaatccgaagtttcaaagctaaaagcttagcaaatcacagtgcacaagagctaaaaattgagtaagcgggagtggttggccagaaagcgtgctaaatgagtttgcggtatggccgtatttatacgctcggtgcgttgaaaattcaaagaccccgcttgtcagtgaatgttgctattctagcaaagggaaggtgttttttcggaccttcggcgtaaagccttcgtccaggtcgcaatctgaattcgttattataaacaaattaatattgcgaggggctactgttggggaccttcggcatccgaaggtcctcaaaaacaggatttaactgtatttctggagtacaatgtgtgaacaggtatcctcggacaagtcggcgttgctgtaaaccggaatgatacgaaggttgatacagagccgaaggtgtgagcaggaaagcttcggcgtgacagcaaagagtggaaccgacttaaagatgaaaaggctattcagacctcaatagactactatagagttattatcaaatgtaaagggcatgaatgtaattttgtaagggctgtgtcccgtgtctataaataggtgaacagtatccccgtactgttcacgctgacttggcattcgctttttgcgtcacgcttgtactgtcatttccttccgattgaaggtacacttgtagttcaataatatttttgtttatgctcaataataataaatgataaatgattgttcacgttttcttttacattctttatatttcatccttcgtcattgtttgatgaatttatgaaggtatgaccttcatcaccttcgtccgcaagtcattatatcctaagggaaataatgcttcggaggacgaaggatattaacgattaacattttctatgttgccttgttcttaactcttagcatttgagaacaagtccccaacattggcgcccacctccggtgaactcacttccatttcttgagcttttcaataccttcggcaagcatcaccttcgtc

SEQ ID NO: 4766 - DNA, 913 bp, Zea mays
gaaagtactttaattggaaccttaatacacaaacaaaccagaggaaattcaaactgtttgctcaaaaggaaatgcccacataattaattgaatacttgctaaagggaacaatatgaaagaataatatgataagcatgttagtaccttagccatcagatcatcgagatcaggcacaagaaggcagttatctagtgatgttgtggtcatcttaattcttaaacacttggttctgtccgacaggagaaagagattttttttattactgaaaggggctgcagaactggtacctagtatacctactgcatctagtttatggtcgagatttgtaggatgttgtgactgcctagatgtgtatctatgtcgcagctgattagagagagctagagtctacttacagatagctggaactgtgatctttcatttgaagcaagagttctagtctccggtttaacacgaccaagcaaatctgctggccgttcgtattcaccgctcaccagaccgtggactaaataaattaaataagcagcctatatatcacgttgttccttgtgtactcctgcagcaatctcctgctacgccaccacgcgcacacggcggccaggccagcacacattccttggggtgaaaggacaatcttgccacattccttcattcccagagtgccttaacactgcaggaccacagcacagcacaggccaccggttataaaacctttaccccatccagcatccagcaaggccattggaagccaccagcaagagaccaacagcaagggtgcgaagaaagggtggccccctagctagcctagctagagagagagagagagagagagtcatcataatactcagagagaagcacgagcacagctgcactagctagctagctactgcaaagaagcaagctctcgatcaca

SEQ ID NO: 4767 - DNA, 165 bp, Zea mays
ggtacgcatatatacactacactccgatcctatgtgcgacgcaagcatgcacccaccccacctggactggacggagacggcgggcgtgacgacgagcaaagactctaacggactgtccccttgatttgatcccaggtcgcggctctcgagacggagctgcagcgg

SEQ ID NO: 4768 - DNA, 1219 bp, Zea mays
acccgaaatttcaggacgaaattcgggtattttaggttcgggttactaggttttttttttttttgcatagttaccaccctcagcgctccagcggtcgctgtgattcgctgtttgaagccaaagagaactagatgttccagattccccgtagatcgtaggctcgtgcgaggtgctcgccaccggcgaggaggccgccatatctctcatcgcttgcccgagcgacgtgacggtgacgctgctgggtgctgctgacaggtgacgcctgtcctgccaggctgccactgctcaccgccagcgatggatgagaagcgcaagtgctgctctctggtcaggtggccttccagctccggtgtggaactgactctcgtgcttcgtccctgcaaccgcaacggatatgatcgtactcgtacgctgcctggttcaactacagcctgcgcacgacgacgccggcgcgcgttttacttgctcctctgtccacgttaaaacagccgtgtgatcccgtgtcttccgccgcggtcaccaactcacgatcacacgactcctttgccctcgccaacaaccgctttgtcagcggtggatctatccctagaggatttccgcacaacgtgccccggacaaggacaatccgcgggcaacgaaaaatcccgaccgatttccttccgatcggaagtgtggaggcgcaccgcgcacacaaacgctggtcaccatatgcgcggacaactggcgaacgtgcgtactacctgtttccaagcgctgccgctgggccatcgtgcgcagcacgaggtcgtcgcatggacgaacggaatactcgccgcccatgtgccagccaagtagccggcggcctgctgctgctcgcactcgcacgcgacggaagctcgctggatgggcgcgcacgcagcgcagattagcttgcgcttgcggacaagaaaaatgaaaaaaaaacgcgagacaagcggtagcggtggctggcctcggcgtgctgagtgacgagacgacaattcacaatcccagcaacatctttgactgactgactgcatacacccccatccattattccagcagcagcagctgtcgccagtcgcccagtaagtcagtcagtcagtcgtccctcctgttctgctcctgcctccgctcgtcgtccttcttaaggcgcaggccgcgactgggcgcgcacggcacggccacagctgactgactcctcctgcgttggctgataatc

SEQ ID NO: 4769 - DNA, 89 bp, Zea mays
cctgatggaatttgggcctgtgggacattatttctagatgaatgctaatgtgcgattctctgaacaggggcttctgattggtcgtactc

SEQ ID NO: 4770 - DNA, 284 bp, Zea mays
catacctgctttcttccgagattccaccaggatatgcccattttgcatgtcaaaatagcacgcggactcgaagagaaagcacaaaggaccatatatctatgctcctctgcacagaattgtaattatcttttgcccagctgaatccctcatcagagggcaaaaccttcaattcctcttgaaaggggtcatctttgggtctcacttgcttctgcgtcttaacaagagaagtcttgctgcttttcaccagactagtaccatttacagccaccttcggcgtaccgtta

SEQ ID NO: 4771 - DNA, 730 bp, Zea mays
caccacattcataaatcaacatcctaagaatgggcacggtataaaaaggaaacttcaagcaatgggcccaacggccccaaccaaagcaatgctacatccctccctcaccaacttcagctgaggcaatccagcaagagtcctgatcggtagaaagtcgcaatagatggaaagctcaagaccatgtatggggcctaaacaaatggaaggaaatcaagacaaaatcaattcgtgccgtttttaaaaggaagcaccaggtagcggccagctaataataagcgcgcacgcagccatctcgagggacagaaaagggcgccggggaccggcccgccccgccgcaagtggaaagcaagcagagacagggaggagagaggagcagagcacagacgcagcgcagccgcagcagagcacccgccagcggtgttattagcagtaactcgtaatcgctgcctgagctctccggccaatcgcgtcatttacttgctttactaatcacgcttagcgattttagtctcctcctcctcttcaccccacctcttcctccctcccttccctccctgttccctttcccacccctgcctgaggccttccgccttcgtctctgaatcgcggcggctcctgagtcccgaggcgccgcctgatgagcggctaggcgccggatctacggcagcgttggaggtctgatttggacgggagagagcgaggtgaggtctcggttttctcgatataggag

SEQ ID NO: 4772 - DNA, 1500 bp, Zea mays
agtggattgtagtgttttaaagggattgagagaaaaattagttcatattacacttcaatacacctcataccagcctaatccactccaatccgaaattacccaaacatgccctgaacggtgtccattattattattgttcaacggggacaggggatagagcgaggatctatgaagaaatcatgtcgtcgcaacaggaggaggatgagtatgcactacgggacggacgacgggactggacatctcattcatggagcttggtattcagcaccgcgcatgcccatcatcctctgacatccatgtccgcggatgatgagactagactagactagactgtggcttagcgttcactcaaccgcatgcattgatagatagatggtagagcggcccggccgggtcttctttgacctcccttccgggtccgggctcccgcttgctgcgcggcgccacttctctctttccgctggcgctgagccaaatagactatggaattttttatgtcctgctactgctagacgatcgacgatccctggctgccatgtggtctgggtgataagatatgtagggatggcctgctgccaagccgcaagcgaacaaaaaggctagtgactcgaaatcatagtttcagcgaggcgcgagcacgacaaagcgccagcttgtccgggctcccatgtccgcttgctcgccacgacgtcgagcggaaatgacgctaaacacccctggagagtggagactggcaggcaggaaggagaaggtgaagaaaaaaaaggaaaggaagaagaaaaaaaacagaatgctccatccgagaaccaaccaatgcagctcgcaacgtttgctccctatctctacttgaacgaaccaaatctttggtcgcaagtcgggaaaaaaaagcatggcaagagaaagaagcatgtgtgtactgctgtacagtgtccactcttgctccgtgttggtggtggtggattggatccggactccactccagagccctactgctgctgcggcgcgctagctaattacagttagttacaggcgcacatctatcatcgctgtgtgtgatggttgagcagggagggagagggggcagaaaaaaaaatacggaagctagccgaacgaagaacctgccggcgcttgcctcctctcgctctctcgctctggctcctagttagttgtgcagcgggttggagccctgcggcaccatcctcttggactcgccgagcgccgcctccgtgtccaggtctgccttcgtgggggaggggggcgtagcgcgcgcgcctgccatcgtcgtcgtcgtcgcctcccgcccgtgcctccacgccgccacgtccgctctgggaatcctgtggccgcagcagccgaaggaggccagctccgtcgccagcagcagaagcattgccagcagcatggctggtagccgtcgtgcgctcatgccgtgtcgctccatgctcggggtcgggaccggacggctgggtgctgcctgggagtctgggactgactgggagg

SEQ ID NO: 4773 - DNA, 514 bp, Zea mays
tgtgacgaactatgctttgcttgaatatgttgaatgttttatttgtcattcacagtgataaccccttccttaaatgctaactttgtactttctgggcagtacgttcaactagtatgtagttttgtgttcatgatttggatcagtggcaatgatggattttgggaagtccatatttttcagtcatcatcttggatttatgttgagataaaatatttactgtgtatgtttgattagtttgtttaattaacatagatctgtttattattaatatatgtggtcaccattgggtggagattagctatttgggctactgatcttaatttcttggctaagatgttgagtttcttgacataaaattttcactgtgcagaaggactatcggttagtgagaaactgtatctgcgggcaaatttatgactctagccctgtagattttgtcagtgatgtgggcgcccagtttgtccaaaagcctgctgatggaaattcatctcagccaactatattgcattcatga

SEQ ID NO: 4774 - DNA, 181 bp, Zea mays
tgttatggcgcttggtcttttggttgtacttcttagcatgaagttgaaagttgtgcataaatttgggtcgcatatatgaacaggaacatgttggagatggagtagagttgctggatgatgatatgtatgtgttgctattgttcaaaaattcaccaaactctacttcagtgagtgcacatgg

SEQ ID NO: 4775 - DNA, 944 bp, Zea mays
aattaagatcgaaactgaaactgtacagttttgtgaaaatataactagcaacagttatggtggatcaaacgaaaagggtggcgtgagctgctcgccgacattaacatagacacagtactacatcccgtgagcgtgcgtgagaggttgtctgctgcaaccggtaacaggcgaaggcgagaggaagaagacgggccaagatcacacaatgcgagcagactacagtggtcggagcacgagaatacaatgtgagcatgcttttaggccgtgaacaaaactgctcatatatactgtatactgacccgatccccgtgtaacatagaagcgtatctggttggcctagagatggcaacggggacccgatccctgattccccgcggggaattcctccattaggggatggagatggggaagaaacttcccccgtggggatataaacggggaaaatttatccctcaacgggtaaacggggatggggacggggaagcattccccatccccgttccccgcggggacccgttaaacttgcacgtgactatgttttttatactagttaacgacaaaaataaataattaccttatcaagagacgactaattgtacaaatgtgtttattttgatgtgtgcataatgatttcttatatctgacaatgtgtataagcgacaatatttaacattaatagcaaagtacgtatgtcttcattgtaatttaaacggggatggagatcctcgttggggatttatccccgcgggggaacagggatggggaagaaatgctccccgcaagcgtttgtggggatccccgcggggaagttttttcgtcgtggggacggggatggggagctattcccgggcggggaattccccgttgccatccctacgctccaggctctcgtttcctggtaggcgctggtacaagcggaagcagcagtagcgtgaggcatcccc

SEQ ID NO: 4776 - DNA, 583 bp, Zea mays
agtttttcagacatctcattcaatacaagagctagcgcaatcaatacaagacacaattcaatagaatcaaagcttcttcaagtcccaactccactccaaacacctagtgactagagagagagttttgctcgtgttctttgagctcttgttcttggatcgctttcttcttccccattcttgttcttcaaacacttgtaatcaaagcaagagacaccaattgtgtggtggtccttgtggggtctaagtgaccgtttgattaaggagaaagctcactcggtctaggtgaccgtttgagagagggaaagggttgaaagatacccggtctttgtgaccaccttaacgaggactaggttctttggaaccgaacttcggtaaaacaagtcaccgtgtcatccgctctatttctttggttgatttgtttccccctctcttttggactcgattttatttctaacgctaaccctggcttgtagttgtgcttaaagtctataaatttcagattctgcctattcaccccccctctaggcgactttcaattagtatgagagtccgacacttcattagagtttaaccactcgaagtg

SEQ ID NO: 4777 - DNA, 218 bp, Zea mays
agtcgttgggctacagttccctagtgcaccggacagtccgtctctagcaacacttttctttgtttcttagactttgcttgatacttgttgatcttcacttgtgatcttcataatgtcttgttttgatgtctttctttcctcagtgccttagtccacgtcactttagcatcctgtgagctacaattctgaacaatagcaaacacgatcagccataactt

SEQ ID NO: 4778 - DNA, 1500 bp, Zea mays
ctaggctaaatttctattgtatcccaatctatttgaaactcctaaaaaacaaaaaaaaaattgccattacataaaaacagaaggatttacactaccattacactaagacaacactttattacctcgatggagatgagtggatttgaatttggggccgacaccgaacacaaggagagaggatccgccgaggtatcatggaggacctccagcggagccgaggccatcgagtaggagagggggtgacgcccttagaggggagtcagccatgggaggtttggtaggggtgggacaacgacgacgacgctatcgaggaggtcctccactagcttggggatgacgatgctgccgaggataacagccagatcatcgctagggacgttgaagacgggggcttagctagggaaagggtctcgtcgccgacgaactgttggccagggggagtggcggcggcgacgctcggggtctggtggggaaggcccggtcggataccgaagtgggagcaaacgaacacaggtcaacaacatgagcaacaatggaaaagcgaataccttaatcatatcaaacaccgtccgactgagagcaacaccatcgttatgccaaagcgaagggaaacacgacttcgtagtcctattttgccgggatggcgttcagagtatcagactagcgaacgacgatgttggtgttattataatgccaaagaaccctgttgaagttgtattgctagctttgctagctttactttacgtctgttgttttacttgatttagatttatttttaaaatataattggtagcgctcttgtctgattattgcggggraatagaatatgaactatcgatttccaagcccgtggttgtattgcactcgtcaactgcgtgaacgaaccattacatacaaagtacgacagggaacacattcaatgttctgtttactttgggtgatcaagttgacaaaacagagagacaatatctcagttgcatttgttctatatgctgacaccagcaaggcgcggtttgtgtctctcgctctcgtcacccacaagacaacctcttttgattatgtccactaatgctaccgtgtcacatgctcgttggtctacgccaaaagtcagctatggagagggaggagagagagagcagataaaggccggcggtggaggtgacagagatcattcagagacgagcagcaagtggacagccactgctggtgctacatacggcttcttctccctgtctctgcactcactgcaaaccgctgatcctgggtatataaaattcaccttctcagccttttgtacagatcaactgatcaacagaatcatccggctccgagtggcgagctccaccaaacggcctcctcattctcaactctgaagcggcacctacctcttcactgcagtgcttccctccttttcttgcagtccctcctctcctctcctcctccctccctctccctctgtctctgggctagcagagcagagtgccagtgagtgcgcagtgc

SEQ ID NO: 4779 - DNA, 1500 bp, Zea mays
tctgaaagctaacttcttagagtaggccgtaggaagttagtaggggcggctaacttcctagaggaggccgtaggaagttagcggctcgtttgaccgtctgcggtggtcagtatctgaaagctaacttcctacagcttttataacaaaccgtaggaagttatggttatttcctagagctaccaatagcctctcggaagttagtaatttcatacggtttgttataaaagctgtaggaagttaaaaaaccgtaggaagtttatatttttggtgtagtgtgctatcagcagtaggggctattagcgtggggttttcagcctaattgagaatggaccacgccatgacgccaaatgtattgggctggcttgggtggaggctagaaaaccaatgtttttagcccaaacgagcacaactcctgattctttttctatttcctgtgtacacataccatatacatatatattagtatgtattgatttttttaccaaaaataataggtattttatttactattaaactaatcttatttgactttaattaatagataacaatgtgtattacagtactataaatatgatagtattttttaaaacgttaaaaactgatatataaaaaataaataattcagttaaagtgttaagagggaactgaatacgaaaattgttagagataagaaaaaacaagagggaagaatacttaaacaagtaaaatttaaatatgaatagagaatatgaatacgagaggatttgagatggtgccgtccctccccttgaagtcgcagcctcgcagcaggcttgcgcaagcttttactcctcagtcctgctccatctgcctttgctacttttgggggacctccacgcccctcaaatccagagaacaaaaaggagagagagagagaaagagagagagagagagagagagagggaggcagagagcttgccatcccaagcaaaggttccctccttccccacctcgcgctcaacccccctcatcctcgcacatccgattgtgccctgtgctctgccgttctcttatccaagatttcgctggcggcggctcagggagcgaacaaagattgttttttttttcgggctatggagacgaggcctgattcattcaggcccgggcggtggagtggcttcctgaccgggtctgattcgtattggttcaaatgatctgggcggcttaattggttgcatccgcttccgccggggaatcggagctagggctgtggtttgttggccggctggtggatttgtcggcttgggtctggtgagatctggagggtttctggttcagcgcacgggccgcaggtctgcgtagatcccctcttcgattccgtggcggatttgtttagggttttgggtttgagtctggtggaaacatgattagcagatccttggcaggctgccgaggaagccggggaaggctggggatagccgggaagctgctgctgcggggaatggaactgagccgtcgaattcctacagtgttgtgaggggc

SEQ ID NO: 4780 - DNA, 152 bp, Zea mays
cactggcggaactgagaaacgccactataaatacgttttcaaccgccactacagagcttctgtgtactagtgtgcagctcctcccctgggtgctgagtgctgactcgctcccgtgcttctgctagccatcgttggccgcccccgccgcgcca

SEQ ID NO: 4781 - DNA, 551 bp, Zea mays
acccttagtctgacttaccactcgaatgaggtagcaattcattattaccatctaagccaatggctatggtaacatgcgaacaaatagtgacgagtaccaacaataataagcaacttcatatttggggaagatcatatatactaagcaayttgagcaaagacaaaaaaaaagctaagcccaaaggaaaaaaaaatatatacttaatgaagatctctgactctccgtccaatctaggctcatcacaataccgtttgtcctccagaattagcacagcccattttagaaaargtgctacaagacactgaaacgtaaaagagctacccaaatatccagaacggaaaacctattgaccacgtcctttacctctcaaatagacagactattcttctccacatcaaaatatagggactcccgatgcaacaaacacgggccaccacacaacaatggtgaaatgaccatgcatgcatccacgtccgtacgcagccatttgatcgtcatggtcgctataaatttgcttcccatccgattcaactacaagcttgcgggcaaaa

SEQ ID NO: 4782 - DNA, 1500 bp, Zea mays
ttcagcttttatctgacataaattttgttttttcagcgccgcagcttttcaaaagtgctcctctttgggcccttgggggtctgtaactgctgggtggcctctcttttcttgcctccccgctttcttttccgtggtgagtttaaattccggctttgatggcattttttaacggatctgacggcttctgatgattaccgacagtttggcccttttttccgcttctctttcctatattttttcctccccttcccactgtcactgatgcagcgaagcttggtatagcatgacctgaattcagcttgtgtagacgaggagccaagtttcttcttcttttcctttgctccaaacagatcgctaattgtgttcgtgttttgttctggtagggccgaaagttgctggattctgcatatgcaatcccgtgatgaattcttaacttcgagaacctcagtttcagttcagcgatagaaaatagacactttcgatttcggtgttctagctgattcttcgagccacaggaactttcttttctttattgttcgtttcactttagtctgttttctgttttacttggctgtacatgttgttatcctttcttttgggttgcaactcgttcgagttgttggcatgtcaatgaattgttgagaagaagactaccgttcccggcctgatgcctgtatctgcctatctggtttcgtgcttagggtccacctgcagcttggaaatgttggaatcttgtgtctgaaaccttgacccaaaagaaaaggacagatgctgagactgagggctagaagccacaaatattatttgttttgatgaaatgtatcaagttattaggtaccaccgggcagtacatggaaaaacaaaaatgtaacagatctagaaccgtgctctctttaccacttcccaggtgtggtgttgtgcagaagtttgagaaccatgttggctattatttgtagacttaaccgatgtgctcctaaatcttaagacgcaccaaacggctcttttgagtttcctttttttgtttttttttttgtcattttattagattaaatttcagctttgctgttatgcctcaattttaaatgtcctggcaaacgttttcagggtttgctagcggagtccatccaactataatgaattaggcacccagtactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggc

SEQ ID NO: 4783 - DNA, 819 bp, Zea mays
atactagtgatcctaattccaacatagggtagtatggaaaaaaagaagaagatatcaaataaactaaaattaaatatccacgtttaatccagaaagagcatgaagcagcagcaataactgtggtttatttcggtgccctagagcagagaatacagggtattactagaaaggaagaaacgggccccactgatgatcccgatggagatattatataactgcttctctcggtcttgagctaagcagcgcgcacgtcgtggtcattggcctccaccagatccgatgccttctttttcgctcttgctctgctctcatgggcagggcagggcatgcccatctacttgaattgcgatgcgtacatacatcgctgtctccatctagctgcacacatatatacatacatgcatacagagtgagagagaaacagatcgatctcacttagctgctgctgctgctgctgcttgctggtggcctgggcctggctgctgtgtctgtatcgatgtgtccgtattttctccatctcgtctgcatacgctgcaattggtaaggagctagctggcctttcatgtcttccatgctgccatagccatacggccggccggcaggcaggaggataccccatcgctcgctgcacatgcatgtatgcatggggatacatgttcatcatcagcagcacagtggctctgtatcccccatcccaatctgatcctatataggaggagaaggaggagcagcagcagcagccaggcgcggccggcggccggagtagtatccgaatccgctcaacacccaccggctggtctctagctttcctatcgatca

SEQ ID NO: 4784 - DNA, 1137 bp, Zea mays
gcactagtagcaaactagctagttcaattgtttgtgttgggcaattcaaccaccaaaattaattaggaaaataggtgtaagcctaattccctttcagtatctgaactatgacttgcggtttaactctgtctacctgacttacttaggatacatggttttgttgttgttgtaacactcttttggtcccatcaaacattttatttattgtttgtaactttgctgacatgtgtgatatttgcagtcgttctatcaaatgcaaatgcctatatctatgaagctgttatttacacattccatatgatttacttagcattttctgaatgatgcatgaaagtaggtctaagtaggcacttgatataaaaatgttaagttggtggtaagtaaaagagttatcgaaaaacatataatttatagaggatcttgattgagtgtgactatgaataacaattagtttacaatatgtaacgctctcgttttctaaaaaaagttaggtcagtttcaaaataataatcgctttagattttgatttttatgtctatatttaactggataaagataaacctcgacacatatataaaacttatactcaaatatgaacatattaattaaataaaacaaattttaatttgagagggagcgagtatcgtttcagttactaattggtttcgataaatatggatcgcatgatatagaattttgtgcccgtagcaatccatatatcttccacgccgggctaggctacgccggccgcgggccgcacatagttctgaagccccagtttgggaattaggattagagccccttgtgaatctcgacccatwaccagacccacgcgtgcgctctcctgggccgaacaaaaccccggacggctaccgttcagtggccagcgtttcaacagtaatcagagtaatctctctgtgcctgcgacgacgactaggtgggttaccgccgtcgcgccgccgccgccgccgccgtcatactacaggtgcgaggccttcatcggtatcttaacaggcgacgaacaccaaccaggtaacttcgtcggtatcttcacttcaccgacggcgacgagcacgaactcgaaccttttttccccccaaaaattagccccctccctgccccagtctgcactctacg

SEQ ID NO: 4785 - DNA, 1403 bp, Zea mays
tttactcttgagtagtttatcttaaaaaattgtattcttagaattaccttgatgatgtagggttaaaaattagggtgcaatttttttgtatacacattagacactctagtaaagttaggattgagatttcagttattacagtaaatttcatagaattttaattcacccctcttatgcatcatgatcatttcaccactatacctactaagggtctaaatgctttcacaaaaatagaattacttagaagttaagacaagttagcatatcgccaaaatcatttaagattaggatgagaaagggtaaaaaagttgaaattataagaaaagatatatctcttgagactagacatgaataagcaagaggaaaccttaattttatctccctgcattgcccttccctgcactaggctgctcctgcccctccctcttcctaggcattagtagggcaccgttccttcactctctaatcccttgaattctacttctagatccacatcaattactatttggtatagttcttccgtagaaggcaatactagagtcaaagagctgcatcaaatgggtcctaaatatgatgaggtgtgaggaaggtacaagagacttatttggactttcttgcgaagtggaagaatatagttatatctttcaaagaaggtttctttacataaccctcttggaccttaggatccattatctttcctattcagagattaatcatttatcattgtgtttttgtgttaagatttctttgtacatgaagatgaagagatggcaaatcggctatgtttttatgtaaaaaaatctttgtatataaacatgaagatatgtcaatgctgccttagtatatttacccaaataagaaaaaacatgtagacaaattgataaagctttggacagcttttgcttcgtttttttatggatatacgggcctttgtgtgtttgttgaatctattgccatcaagcccattctaaatcacgtctacagcccaaatgaacaaagaaccattttacgcctagcatttatcttcttgagaagtgcatgtatttgatgtttcgaacaccgcacgacgtctccaattcgcaaacgtgactacctgtctccgagcttggaagaggtaaagtaaaatattccggtggacgggcagttgagctgcacccatggcagtggttgagctgtggttgctgcctgttggctctctcagtcgcagcttctgttcctccgatctggtcgcttccaacgtctctgcgcgtccaacgcttctcaccttccctctcacacgcaccccacccgccagtcacagctaccacgcagctgcacggtgcacccatctgcgatctatatatcccgcggcgcggctcacttatcacgtgacctcgccgccggcgcgctagctctctctgtcg

SEQ ID NO: 4786 - DNA, 714 bp, Zea mays
gacccttagaactattttggaaacctaaatccttcttgggatcccttccatttttagagtaaagatccacttaggtaagatttgaataggatatttagttatttatggggtttctctccctaggttttctcctaatttccaaactagctccctccctaggtttgtcttcgctgattattcatataccattttaaaggtggagaagataaaaaaatatgtttttcgatcaagggggttaaatagggattcgatgagagtttaataaagagactaagggctagtttaaaaatataaatctactctaggattttgaggattgaatggaagttaatttaatttcctactcaattcccgggaattccgaaagggaattatatttttctctcgagagattcccatttttctaaaaaaaaataaattcattttacttggaaaaatgaaaatccttgaaaaatagggttgccaaactagctctaagtctagtttgacaactctactttttcaagtgttttccatattccaaaaaaaaactatttttctcttgagaaaataaaaataacttgaaaaaaatgggaaagtagccctaaataaacgttttccttctgccgaaaatgtttcctcatgagtggaccgacactttgtagaaattcgctcaatagcccggctgacgtcactaattcaccctctctttccggccgccgccacgggctctcc

SEQ ID NO: 4787 - DNA, 201 bp, Zea mays
ggttcgagcagaagctcggagcatggccatggccgagggggagaagcaccatgcccggtgccggtggtaggtagggctctctgatatcgcaggcctttcacgcggcccggcccaaaggcttcccgtccgtaccgtcggctagccgaggacggaaaccgagatcgggtgattgcttgactcgggagctgagccgaggtcgca

SEQ ID NO: 4788 - DNA, 1048 bp, Zea mays
caagattgtttattaatatatccatcgtagtggggaaattggtttcgtatagatgataatacttcatttctttcctgatacatacattagttaacttgtagaatcagatgtaaacttgtttatgttgcaggtcatcctgagcaatttaatatatgagaagaaacataagctaagaactacaatgaagatgcatggcctaagagatatgacatactggattatatcgtactgctattttcttctatcactactatatacactttagttttttctctgttttttattttaaaaagtttaaactggtaggttatatagcggtatagatgtcgcaacgttagcatagacaccttataccttgtttgggagcaggtgtaatgaggggattgatatattaaggcaagtgtaatggaggggtagggtattgatgctatcaatcatccatgctctcaaacaaggccttaatagtagttttaataagtaacgcgagataggacctatttttcggagcgacaagacgacaactaatgctctgtttggaaatagagtatttaaaaactacagttttaaaatacaacattttttaaatgtcaagacatattcacaattttttaccataaattgaaaactttggtctatagctaagttttcaaaactgtgcaaatactgcagaataaacaaaaccgcaattcggaaaacagggtttttaaaaagcctaccaaacactatattagaaaaacactaaaatatcttaaatactatgatataatccaaaaacagagaaaatattgcaccttcaaaccgatatatttctcgtcctacttacatatggcagcgagggccttgggcctggactctggaagacgacagaacgagccacaacccacaaacatacgcaccctctcgaccggttcgacttcagaacttccagcatcctatcagataccgaaatctccaactcccgcatcgcatcgaaccttcggcctgcaagcgaattcgtcctcccctctcctaccggcgcgaattcaaccgcccgcaaagccctaggccg

SEQ ID NO: 4789 - DNA, 887 bp, Zea mays
tatacctcgctggttcactccgccgtcgtggtttcagtctcgaccgccagccatcctccattgatagaataaaatagagggaccaaaaattagtttctagaatcaaaaccgcttactgtttagtgatgtagattttaagtaactaagtttatcatactgcagctagatactctaatcatacaaaaattcaagacatagagtggctagatgggacggcactgtttgagaaggtacctgcattggacaccagcagctaactgcctcaacagaatttctagaaaatctcatcgacgtgtgccgctcaaacctcaacttgggcgttctcctgtcctgtcctgtcctcttgcaaatcacacgctccaagcctccaaccgcctcgtcgtgcctcgaaaagagatatgacgccgccgccccgcccgtaccgcgtaaccaccggaaagcttccaatttgagcggggacgacggactgccgagcgagccgacaaggacacggccgccaccaccactagtgcacagaaagcgagtgcggataattgcgtttggctagctgcgccagaaactgccatgagcatcttggcgcccgtctcggcgtcgctactcgtctacctcaaccaccacatctgggaccggccagcgaacgcgacggcacgcggtagttcttcacactacagcccgcaggggtagggtgttgtttatccgcgcgccgaccagaacgagaggacagctgctgccagcaggctaggctggcgacaagcgtgcgggcgggcgggccaaacgattgaacccgaggatgccgacggcggcgggccgagcgtggtggctggagtggtgactgactgctgtctactatcgtgggctcttccagttcccaagaggacgtggatgcc

SEQ ID NO: 4790 - DNA, 1500 bp, Zea mays
aaacaacatgcaaacaaatcaagatcatatgacctcaacttacttatagacacacttgcatacattatgagaacttattgttgaatatattgctgctaccaaattagattaagaattaatataagacgtaaacaaaaagaagacaaaatttcacctcaatatccctaatttccctaagaacaaaggattgtgtaggacctccaaatcaatctaaatctaaccagaaatattgctattttataattcaagaacaaaaacttgggttttgtaacctagattgaaaaacatacgaatcatctaaaatcgctccacaaccactctgccctgaatcctctccctaagcaaatttcacctcatagaccaacacaaactarttgtttgcaakgaggagagtggcgcatgccttcgccgtggtccacacgagtttgtcacgcggctggtacacttagcgtacgcctgcacactcaggccaccracttcatgctctcctggttcgtgtaggaccaccggcttgcagcgtgatgggagaacaacaacgtgtgcctagggttgggtgcgcacagagaacgagcacgcaaaacagtggcgcacacctcaatttggccgtggcggaagtatgcatttttgggagccctgtatgtgttcttatacgagcaatctcctagatgccatagaaaattacacacatccctcgtgtgccactgagtccatatgtcatacacgcaaaaattatcccctagatgccacccagaggtatacaaggaatgagtataaaatctgatagcatctaggagatttttcatcttatatgtgagaggagaatatgtttagataggaagttttaaaatttagaaagatcaagtcgtctggctggctttaatccaacccatcggtctgttgctgcaatatatagaccaaatacacttttaggctgtttggtttgaggaatgagctaatccattatcttctcactcctcacttttttttgtttggtttgtggaatggtatgagttgatccatcatcacctcattcatcatagttagttagtactaatataatgaatgaggtcaatccaccaaatttgagaaatggacccatgatgcaccaccatattttgtatggaatgattcctcaaatcaaaccaaacaccccctttattacagatcagcagcagtgctggcatgatataaataactgttggaacagttttttttcatatttccctaaaccaaataataggttgcagttgcactttcgggaacaggtggaggactggtgtgcagcgctcgagtgctgacgcgttgagccgttgactgggccgtcatttactagcccatgggccatacggctgtctcaggtctcagcacccgatccgagtaaccgctgccgatctctcctcgtcatttcgtcgtcgtctccatctcgcttttgatcgactcagaaaattccccaccaaaatctcctccccctgaagtccygaagctcgcggaagcgccgag

SEQ ID NO: 4791 - DNA, 800 bp, Zea mays
cttgagggtacccctaattatggtccccgataagcaccaactatttcccccaaaacacagatgatctttgcaagtgtccttcaatgtataaaataatttaatgaagtatatcgatgatctgcaccatagaaattagattttattttacaaattatattgcttcttatttgtttgagtcatataaaattttgttatttttattaattgtgtatttttatagttgcttaatgacgcgtttgatgaatttttccttaataaaacatcatgtttttattctaaataaaagtatataaaaaaagttgatgtagcgctcatgtgattataaactaacgataaagattatgaattgcagcagataaagactaacgacagtctacagtatgatcgataacctaacaatcgttaggccttgttcggtttgaattggattgagggtgattagagcggattaaatcgaattgttagggtaagtagatccagacttaattgagccaacgtcgactagtcctctatagtttacacacggagacgtgacgcacgttgtttttcactaggtccagccttaattgcggcgacatccagtactagtactaatacactgtagttggcacacacggagacgtgtatcacgttgttttattatttcgaatcatcatgctcaacctcgacatcttattcttcatgaggccgcagttcgtctcccgctctataaatagctggcctgctcgctcatccatcactcactcactcactcattcactcacacagcaaatacccacagtccacagcaagaaccgaag

SEQ ID NO: 4792 - DNA, 408 bp, Zea mays
tgagacctagtttcggtgaggacatttcttcatttgtattattaaattttttgccaaaatacaatcagagaccagcctaagtgcattggtatgtaaataactaaacataaatatcctttcccagattgaaataacactagcgtgtcttctccattcccatggattggactttatatttgtctattcaaaggactaactgaagtccaggtcttatctggtgtggtttatgttgtttttcacatatccatttctttattactgggtttgtcgtattaagcttatgttatagatatattctcttgaaattgttgtttctgggttcattgcttaaatacaggaggtgaccaattattaccaaggaccttccaacattttgttgtttttcttatacaggtgctaggtcctaac

SEQ ID NO: 4793 - DNA, 836 bp, Zea mays
ctgctggaaaggcacaccttaggcttagatttgtcatgaatttgcagacaatttcattacaccaccctgtttcaagaagcatctcaattaacacggagtaaaccccaaaaaggtaattcttacttattttcccaattgtattcatgcaatctaaaattttctaaacatggagcagtacaatctatttgtttgaaggaaaaatagttgtatctagttgccatagaaaatgccaaaaaatattcagtcaaagatcacttcataaatgtgggctcaataattatatggtgcaaataagccggtgatcactttgacaggaatagagatctgcattgctgagtgtgacattgtggctggtaactgcaaatcaaaatgatatgcaatcagtatgggaatgaccacaatggtgatctggtgagtgaatgttaattgtaatatgcaagtacgatgatgaccaaagaggtatcaattagcattaaaataaaaatctgcggacaaagttttcacgcaagccacatattaatgatgagaaagtgacttctaagcttgatccaatgtaaatgacatgtccaattgagtactgacatgtgagttaacgttgatgctctcattttccaaattattattactatataagggatcacgtgggttcacatttgctttggagcgttcacagcccctactcctcagtatttcggcctgcacatctgtaacctttagtcaatttttgatttcctttctgacgtaaattatattagctgaattatatcaagtaaaggtaatggattggaccagttttatttatagtgtaaaatgttgtagtgagaatatttactgtt

SEQ ID NO: 4794 - DNA, 586 bp, Zea mays
tatcagtccaaataattgactttaatctgtcggtcctaaactttggcagtgtcaggcataaagttgttacacgttgattcatgaacttgaacaagcaaaatacctgctctagggtagtagtactagttggtagtccccaacatttctgttggattctccttcgtcatgtactcatcatgtggaggcattcctgccatctgaatatgtgatggttaccctcggccggcgtcctatgccgggtcggccgcatgtgcagatcagaacgagatgacaccaaggccgccgaacggcaacctgacacaggcggccagggccagggaggcagcttcggcgcggcgcaggccgcagcgcgcttgctatttttccgccggccccttggccctcgccttgctcctcttctttattatacgcgccaccacacgcatcgcgtccgcctcccaccacctcgccattctccccctcccgcgccccgagaagcgctgcgggcctcacctgcccgtcctcctgcctctcaggaaccgcggttcaggaaggaaggaaggaggaaaggcaagtgcctgccggtgccggggctcagcagcgcgcg

SEQ ID NO: 4795 - DNA, 468 bp, Zea mays
ggcacgaacgcggatagcgaacgcaagctcgtccgctaggattaccgaacgatgaggaccctgtaaaatttagcgcatcttttagcgtctattactggagacgtaaagtaagtcaccgttcgctacatttaggggagaggaccctttayagggtgttgctggagacagcctaaagctctccaggcgaaggttttgatgtgcttccaggtgcgttgtagtatctgcactgctgctgacatgttgagtcctgtactccgtcatatatgggcctacgatacgaaactgggccttgcgaagtttcccagcaagtgctagagagtgccaggcgacacggttcgctcggcggcggcgccatctggcagcttctgcaaaactgaagtgcccattccagccctcccgtagcgatcgacctctgaactacgcagcggaaaaatcccatcaaaaaacaaggggaaaaaacaacacagc

SEQ ID NO: 4796 - DNA, 590 bp, Zea mays
tccaagttttccacttcccaactacgacaagagctatagcattcaattctagacacacaccaaagagatcaaatcctctccaattccactcaagcctttagtgattagagagagagatttgccgtgttcttttgagctcttgcgcttggattgctttctttctttctcacttgttcttgtgatcaaaactcaattgtaaccaaggcaagaggcaccaattgtgtggtggcccttgcggggaagttttgttcccgtttgattgagaagaagagaagctcactcggtccgagggactgtttgagagagggaagggttgaaagagacccggcctttgtggcctcctcaacggggagtaggtttgcgagaaccgaacctcggtaaaacaaatccgtgtgtcatactctccatttgcttgcgatttgttttgcgccctctctcgcggactcgttttcttattactaacgctaacccggcttgtagttgtgtttatatttgtaaatttcagtttcgccctattcacccccccctctaggcgactatcaattggtatcagagcccggtgcttcattagagcctaaccgctcgaagtg

SEQ ID NO: 4797 - DNA, 676 bp, Zea mays
ctcgtcgtgaacaaaacccatacctcccctcgtatcacaatgcctttccatgcgtttttattttgttcctcctcttttgtgctaccattccatagttgcaaactgcagagcgcctcttggcatgtgataccgttgtgatagaataatcagcatgggtagtggtgtccggtcctcctttccctgaaagaaagcagcggcgtgctggtcgcggtcaagccatgcctgtcgccttccggctgccgctgtgggcatttgtaacgcgtctctgcccagtgaaataacgtttgttccttgtgtttgtgcccccgcccaaaagaaagctgcatcggaactgatcttcccgagactccttcctccggagacgttgcttttgcttccgtccgcagagcaccagttggaatctcatccgtctcgaactggggtgagccacgtagctcatgcgttttggacttgtggccaccacacaagtgtgtgtgagttggtgagcgtgacggactgatgagtgacagcgtggtacgtatgggcgtgtggccggcgtggcgcgaaactggccaccgggaagagccagacagacgttcctgtgaggagaaatcgtcacaggtgacgtgcccactgccaggttggctccacgttaagcgagccgtgtcacctaaaaagccacagcccaggaacgccc

SEQ ID NO: 4798 - DNA, 241 bp, Zea mays
gagcaaaagggcctctagagtaatggttaaggcttccgagtagcacctctaggtctcgggttcgatctccctcgatggcaaattttgggcatggttaaaaaaatcgcctcgctgtgccccgtccgctctcggggatcgatatacagcgtgccaccctccggctgggtcgttactaagtgggcagttgattggcccgttagtgatagggggccacggtttgggggttttctcggtcgagaac

SEQ ID NO: 4799 - DNA, 608 bp, Zea mays
ctctaagtcgacctgcagcatgcacagcacaggacggcgggtcaaaataaaacccgggacgacgtggcgtcgaaacgcggacggcaggttttatcccacggtcacggtgggtacacagagccgtacagcacaggcacagcagctcccgcctcccggtgaaaaatgaaatgctagcgcgtgagccgctgccgcgagcagcaagagggacagtgtgggcccaccgtcagggagatcgccatgacccaccccacatccccacccaggcacccacccgcacgcccaaaccgaattatccgggcgccacacccgtttcgtttcgaccatcccgtcgcgtcactccgccccaccccgcccgccgctatatcttcacgccgatggccgatcgcttcgtccctctcactcacccttcctccccagctttctttccaccaccttgtatacagcgcgcacgctcggctcgctagctaccgccaagcgagctctcctcctccacttctcctgttccatgcaccgccgcccgctccaggttcctagctagttgaggctggcattgaggactgaacgcgctccgcgtgtttcgtttctgcgtgtcggttcgccttgctggg

SEQ ID NO: 4800 - DNA, 584 bp, Zea mays
aaaagcttgtgccacacgtgttggatctagctgcctcaatgtgcagtaaagtggaaaaaagagcgcgtcttacttagctacctcattgtataggaaataggaaaaatgagcacgcgagtgtggagaaattgacaccaacttcgtttagtgagtttctatcgagttgtcaaatgtggagagtaaatgaagttggataacaagtatctaaatttagcaaatttatttggagaactattgaagaagtattcttctgtttaccttttaaatttaaaatttagagagagagttatttagagaactattggatgctctaatcctaccatcacaaatgtcatgctcggagcctacttgtgcttccgagctgcatcagcgtgcttgcacgtggattggtgctgaaaaatgccagccgtcggatcagcgggctcgcgtgccagatctatctggacctcaagagcccattgcggtccagaggaacccagcgtccacaccacagcccacggctgagactcaggtgaggtccgccgcgtccccccgctgccacaacccacaaccactacctgagtacctgaccaccaccggatagg

SEQ ID NO: 4801 - DNA, 941 bp, Zea mays
agtaaaactaccttaaatacattttaggtatggtgtatcgcaagtgcctgcatttttttttgttcgcaaggaaaggcttagcatttctcttcatggatttcttagaaaaaaaacagtaagatttcaaattataagtcacggtgttaagtaaaacctctagcattaactaagcttatttatagatatatattgacactactacgataccataccaagtaagtgtagtttaaaggcacatggcaaggtggtttgaacgaaaatagtttgttatcgtagatattggttctaacgttctatcgtcctggtacaagttagagaaggtcgtcaaaaaaagttagagatgtttaaaaacaaaaccaaaataaggaccggttttggtacaagcaatttacacggctgtaatatttaaacaacaaaactataaactagacataaagcatgccatagaattatggtttttaaacaaaaccaaaatgacacgggcagcagctgcaaaaagtacggtgcccgctgttcgcgtccccgcaggctcctccgctcgcacaggatcagaaccggccgcctggccctcccccatcatgggtctccaaccgcaaccgcacgtccgcctccgcagcagctgtcgtcacggagccggcgtccccagagccgcggctgacgcccctccacgccaacgccacccgagagagactcgcgtgcaggtccgcgcgaaccggtcgaaaggcatcgcggcgctgcagtgacgtcacccgcccacctcaccgcccctgtatatatgtatcccccgcgtccagcgccccaacccaaccatcacccgcccacacggagcacgctccacgccccgcgcggaaaagacggagagagaacaaaaaagttaggggggggaagaggagactcggcggcccgaacgacaagcgctgacgcacgtacgtcggcaagta

SEQ ID NO: 4802 - DNA, 481 bp, Zea mays
atgctgcaagacaaagtatgtaaagcatgccattcatatctttcacttgaaacaaaatcctgctggttatcattcaggtagtgttgttggacaaggcttcaattacacaggtatttttttcttggttccagaactttgcccctagttcttaggcgttacttggacagaataaatgccatgttgtcatccaacaaagcacaaagatatcagatgtttatgacagaataattgtcacttgcttactgctgctaacttggatctcacttcatgtagggatgataaagctgccatgacaggcactgatcttacaaatgaccaaactggacttcgcctctgaagttgacgcctcaccagttcactgattcccagtacagactgctcaatttatcacatctggtacagaccttataactccacccggagaagatgcaaacccacactttctggtgctctggtgctcttactcttcagaccatagaca

SEQ ID NO: 4803 - DNA, 1383 bp, Zea mays
tttcccagccgtctatcagtggccatatcctgtaggctacatgttcttgaactaagtctcttgtcccaataaaagagcaaactgtgctgaaggccctttgaaagggaattaggcttacacctatttcctaattgattttggtggttgaattgcccaacacaaataattggactaactagtttgctctagattatatgttctacaggtgccaaaggtttatctacaactatactaaatcgactgtctggaataccgtagattattccggacaggagaagctttttggaaaaacaggccaagcgcggaccgtccgggcccttgcggcggaccgtccgcaacaccaggatgaccctcggatagaaccaatgcaaaaatccaagtctacactacggaccgtccggaggaaaagcaagaaccgtccgagacctcgcgcggaccgtccggcctcaggcgcggaccgtccggtaggtgaggaaccgaaaaacccgaaggtgacgggttcggaaaaatgaattatagcgtcctcgcggaccgtccggggtgcacgaccggaccgtccgcgactggctttatctgacatctgacgacgcattaaatgcaatatagtcgttgatatagccgttactgctgaccgttgcgttttcagccgttgatctacaggggcggaccgtccggaccaggcgggcggaccgtccgcggtcggcagaatggagcaacagctaggaagtgggtcgtggctataaatacaaccccaaccacctccattcacttcacccaagcattccaaccttcaacattcaatacaagagctagcaatccattccaagacacattcaaagcctccaatctctccaagttccaaagttgagacaagtgatcattagtgattagtgacttgagagagagagaaagatccgtgtgttatttgccgctcttgtcgcttggcttttgcaatcgtgctttctttcgatctttcttgcgatcaactcaattgtaaccaaggcaagagacaccaattgtgtggtggtccttgcggggaagtttgttcccgtttgattgagaagaagaagctcactcggtccgagggaccgtttgagagagggaaagggttgaaagagacccggtctttgtgaccacctcaacggggagtaggtttgcgagaaccgaacctcggtaaaacaaatccgcgtgtcacactctttattcgcttgcgatttgttttgcaccctctctctcggactcgattatatttctaacgctaacccgacttgtagttgtgattaactttgtaaatttcagtttcgccctattcaccccccctctaggcgactttcaattggtatcagagcccggtgcttcattagagcctaaccgctcgaagtg

SEQ ID NO: 4804 - DNA, 410 bp, Zea mays
ggtatgcttttatttcttctcgccttctttgatgatattagattctcagttgtttctgtagccacttctttttttatattacattctttctacagcatatcacatatatttacttaagtctgttggcactggtgactgatctgatctgaaaatctcattttgacgtgatttcttggtaacacctttggtggtaaataatatgtgtcatgcaattgacttctgtgattccatcattgatcaacatttgttcactttccaagattttctgtgcagctctgcagttttaagtatggttgacagtgagcaagcaccgacttctacagctactgggcgattggtaaacagcatgcaacctctttcaaggagaactagatcaattaaaggtgacaaccacattggtgggccagtag

SEQ ID NO: 4805 - DNA, 607 bp, Zea mays
ggtcctgttcgcgccccccacaatcctccacacctcgtaaccacgcttcacgaaatcacgaaatgcccggtttcgtgattaagtgcatgtgcatgtccccagtggtagcagtacgagtagtattattataattgtacactgtagtagcatagtgagcgcgcgaggtagtgaaagggatgagatagagagttggtggggggtagcattagcgtacgcccgcgcttttgtcgtgttttttttatggctgcatgaccactcgggtttgcttgtgccgcctgccaaggcgacgtctcaaccacaacgaacgcctttacgccggcgctctgtttgttcgcccgcgcctgatggaggcgctagtgtggtgtggtgaaaggtcggtgcgcacggcaagcccatgattccggttgccgtctcgctaagaaagcatttcgttcaaccacttgttccggtcttttcctcccagactctgggtgggcgagtcccaccacggatgccggtgcacctacatcgttgtacttgtacaagaccgagacgataggttttgtctgttgaaacgggaatgtgatgtttacgaataacctctgttcgtttccaccaggggtacggg

SEQ ID NO: 4806 - DNA, 173 bp, Zea mays
ggtgcgcgggttcgccgccgagcgcggcgtgccggtggtcgccgtcgacgggcgccttcgacgggtgcctggagctgcgggccctggtggacgccgccgagccgctcgccgccgacgaggaggtcggccccgacgacgtcgtcgcgctgccctactcctccggcaccaccggg

SEQ ID NO: 4807 - DNA, 607 bp, Zea mays; identical to SEQ ID NO: 4805

SEQ ID NO: 4808 - DNA, 960 bp, Zea mays
attcttttttttttgcttcttttactttgatttccacaatttctacttatatgaagctgaatgttcatcatgaaaataatttgacattgactgctgttgatgttccataacatttgcctgatgatagctttgattatcgatttatccttctgctggttcatggaattttaacaccatggatttgtttgcccagctcataaatgttgctttattagctctgctgccttgcctgaagtgtcaattgttgattgggatgcagtttgtaacctggtgtcattcagcttaaagtatcttcaggaaaaaaaaagatatgtttagcatagaacatattactgcattcatctaaatgaaaaacagtgcaacttggtgtaggacaaacgaggggattttttttaatctcaacctgaaattcgctcgcatagggagtcaaactcaggatttgaggagtgctacttaggccacctaactaactcagctagagacccttacgcaaggctcagaaatttcaactacacatatatgttctcagcacacctagacaccacacagtagagtaaatatttaggcaatgtgccgagagtagaggatctagtcttagttttggaatgatacaatactgctacatcttattcttgccattgatttattttgtgattgtttttacttctttccactgctgattctcttatagtcggacacttagtcagctatgtgttactcagtgattgcagcaacttaatgaattattatgattgaaacaacttaatgaagcactacgattgcagcaacttgatgaagcactatggttgaaacaacttaatgaagcactatgattggagcaacttgatgaaaaatgtgtttaggtttcagtttccttgaaatgcatagaaaatcatgttaactgcataaacaaaaatgtcatacaaagaaagttatttcagctcttgaatattgttactc

SEQ ID NO: 4809 - DNA, 810 bp, Zea mays
ctttgtctgggcgcgcgagtgctgcaaggagacctcctgctcgtcaagggccttcacgtttcttgctcatctccgacgccatatctcactcgacctgcgagactggctcctttttagcacactctctgctgatgcgttgttgaacgcgacgcgacacgtggtccttatatggaaaaaattctgtacataccggatgtaaacaccacatatttctacataagttatcgtagtattctatgttcccgttgcaacgcacgggcacccacctagtgatgccttaagaactatgaccacatacggtcatcatgtggtttgaatattaaactaactcccactattatttacgaagataatgtgttgcattgtgtaggcatagaagggctatgtgaagagtaatcttacaaagcacactgaccccaagttcttctatgcatatgaaatgcataagatgaatgatattaaaaatttacacattaagtcatgaaaatctcgtgaaactctaatttcagctataaataagagtcttcagctataaactagggtattagagaagagaaatagacaaccagcggtattcttcatatttatctctttgttttyagttttattttagttaaggggtaaagggtcgtattcgctagcgtttgagaaggagcatcatccccagccgaacgcacagcaatctggtccaacatccctgcctattcctcaaaggtaggccctgattaaataatccttaactgtctgatcatccatgttgcaacgattctcctgtactgtacgattctcccggggagctcgacgatctag

SEQ ID NO: 4810 - DNA, 1218 bp, Zea mays
cttttgtgttatattgtaatggactatgtgatgtatttatgaagaattgtgaattgtagaytcttgatattttggtgaactgtgacgtatttgtgaaaaattgtgatattttgtgttaaatgtatgtaattctataattaatgtttctgtcatattattgtgattatattgttgttgaaattgctgttttttataatttttttctctgaaattacttattttcggcgaccaaatggtgaccgcggaaatattgctggtaaaattttggcggcctctattttcgacaggtatggccgtcgaaaattaatgtttatttttggctaatatttttggcggacagaatcagctgaaaatacgcttaaaatagtttattttcggtaggaatagtcttattttcgacggcttctacccgcaaaaaatgattgtagctgtttagtgtccgcttgtccagttcatgtagtcgatggaagtgcggtgtgttccggccggcgccgacggtggcttccgtgttaggcacgtcccacgttacgcatcgatctgacgatccctatgtctctcctcccatggccacctgatcggcatccctgagcaagctcgcgtcactcgtcaggtacggtggccaggcctgcaagttcgccgatcgagcgccacgcgacgagtgctcccagctgcctccccgaagtgcttgccgtcatcactcaggagtcaagcatatgcgcacatgcatcaacactgtagttttttctcgcgttgacgcgtatccaaaaaaaaagtcaaaaaggaatcagaatgcattagcctacctgttgctcgcttccctgtctgactgaagaagctgaattgccgctgccggccgggtgcatgcatggcattgcgtgcagactgcatgcgaccctgaacctgtggaatgatgcagcggtacctgttcattcctcccctggaagacaacgactagacaagcaaagcatttactcattcgttcgttcgttcgttccaatgtcaaatgacaatgcaaaacgtctctccctctcgttcgtagcctcatctctgatcctctccacgcactgccaccgtcgtctagccgtgcgcacgcccgtgctgctgggtgtgtatatatacatacaaagcatgcattgcatacgtgtacacatcgcagcacacagctgatcacacgacgatcgcgatcggttgctagctgaatccatccaccgatcgacc

SEQ ID NO: 4811 - DNA, 441 bp, Zea mays
tatctcaattgatattagtgggaactgttttcaggggaattagctatactacgtttcctcggatgggattgttgaggtcgtttacttgagctcaaacaaaatggcgcgggaacctacccaaaagatgcctcccagtttcagaacttagtgtcactagaattacagaacaatccattgttagggtctctcccttcgatgttgggtacctatcagaagtcatatgtcttgatctgagtcagaaggcaaatgtatctcaaatgatgcctcccagttatgccgatatttagtgccttttattgtacatgctcaatgattcaaccatggattttatatgctattctgatctacacaaggatgtcatcagtatttctgagagcaggatttttgttgctatgcataattttttacgtggtcggctggtaaactgccctcytcacctcg

SEQ ID NO: 4812 - DNA, 225 bp, Zea mays
agtaagtttcttcctctcatcttttccttgtctggccaatgttcatcagcgttaggattttagatacgtctgtcctgattagtgccatgaacactgccccgatttgtatatggtttcctaaagtaattcaaactgtacagagaatttattacatccttgtacgtctagtctgtcgtttttatttaatgttttaaattccacttgctcctccattcattttaggcg

SEQ ID NO: 4813 - DNA, 493 bp, Zea mays
aggatccccctgcaggagggaatgggagggtcggaggggactgccggcggcggtgctgtgcagctcctcttgctcgtctgtcgggtgtctgtctggtcgccttctctctctgttccggatatgggccgttggttctggagcgtttgggtcgcggtcgaagctgccctatttctgggtcgcgtgcggacctgctctatatttgggtcttctgtttcggtctgctgttggaggcctgcaactggtgtgttacagcccattttcggttcagagcaccgtatggatcgcttgttagagacagcctcagattcactttttacttccggcccatctatcgttgtgaacaagttgagcccgtgagaagccaaatcgcgaacccacccgggccaggggcaaacctcgtgctcccctccacttgccgaggaggctcgcgacccgcgacgccttccgcagccccgacccaaaccctagccccctccaccgtactgccaccgtc

SEQ ID NO: 4814 - DNA, 123 bp, Zea mays
ctgagttcaattcacttagcagtagtttgaagcgcagtagacacaggaaaacacatgcggttgattaacagtttttgatgtgtgaacatttcactccttttctcttgtgacaggaggttggaa

SEQ ID NO: 4815 - DNA, 588 bp, Zea mays
gtcagctaatccttggtagtactgtacatcaagttgattagatcgatcttactctttgactttgagctgtagtggtactggtctcttgttttttttttcctccggtcacacgtgcgcgtccgtacgacctgtatgacggacggttgttgatgggggtaacaagaccaccacgacccggaacggtaggccggcgaaacaggacaaatctcgcctttttttagcaagccttctggatcgctcactgcgacgaccggacagctgcgtgaaaagctacctctaccggttgctcgtttcttggacctccagagattctagagccattcgtttgaatcagggtgtgagggtctttcttttgaggcatgtgttgctttcttgttcccttttttatggaatgaaatgaagtggaagtagcacctgagttgccaagggggattggtaagttaattcgctacaaatcaatttggattttggtacaaggtacaaggtacaagtacactacagtacagatgagttggtggagcttattgctgctatagcttgctagtagctccagagcgcgacgtcagctccggagtcgcagcagtcacc

SEQ ID NO: 4816 - DNA, 192 bp, Zea mays
gcaaaatgagattgcatgattctggcaaaatgtgctgcaagtatttctaagtccaccaagtaaaaaagaacatagacttgcagcatacgttctgccctacatattctcaatcgcttcagtcagtcagtcttactagtagccagccattggcttcattttttagccaaagacaaacaggaggagggaggaggg

SEQ ID NO: 4817 - DNA, 887 bp, Zea mays
agtcttatttgatgggcgcatgtctaggttttatttggatactcttgtattcacttcaatccacccttatatatggattgaggtgaatacgagaatatccaaaacaagaccaatggagttttagaattcgccatgaaggagctacatttctagtgtgtagacagggctcaattcctcgcccttgggtttagcgttagttagattgttggtgtttggtgcctgcagtctttgcaaaagttccttttaatgtttttcccattctttttgtatatgtgatctgtctgtgttgtggggttgggtgatgtcgtttgggggtttatcctcttttcttcttaatgcattgacagacaaatctcctgctgagtattggagttttccccctcaaggtctgaggttttctttgtctctgtatctcccatgctgtaacaatagacttccaggaagaattggatgctgcactccggatttcatgttagctggagatctctgtccccaaaaaaaaaaacagaattaaattgaagacaaaaggcaatttaatacatatttgttattcataatagatacacacaagctatgtctcctaaaagcgtgtcggcaagttaagcgaaatctatgccatgttctagaccttctaaaaagaaaagaaaaccatttggttgggcggaaaatagagatacacatttgttctcgagataccagcaaagaaaagctttgtcatagaatagaaacaacattatcccctgtatttatcagtattaataatacagcatgtcgtgaaaggtagagaagatagagagaaaagaatatcagcagaaactgtaaaaagcagtccgatttcagtagctcagttgacgccctgcagtttcagtgttggttctgtacatagc

SEQ ID NO: 4818 - DNA, 67 bp, Zea mays
ggtttttgtttccttataaaccgttgcaaatgcctctgttgtaccgaccaaagatttgaattcgggc

SEQ ID NO: 4819 - DNA, 1500 bp, Zea mays
ttagattttaactagtgttgatttttagaaaagcccaattcacccccctcttgggcatcgtgatcctttcaccatgtttcatagttgaagccctcagtgcatccattgtaggtgagtcatggaattcctactactgacttgtccctttagtatcccacataggtgctgtaatgtcggttgatctctcatggtgttcgtcgaccaagtcttgatccactggtctgggttggatgcagcgctgacgtcatgggaggatgaagacacgctcaaggaagtgttccctcatacgaccgcttggggcaagcaccatccmaaggagggggattgcgaggacccctgaaactccaacgtcgaacgtgtctacccctggtgccgacaagccgttgctgggacgacgtctgaggaagccaagtgttcgttacggggccccaaagtagttgtagagtggtggcggcccacgaacatcgttgcgtatgtaagcggtgagcagtaaggcgaggtcaggatgattgtaaacgagaacttaactctgtctatctactccctggttctcactccccttccccctcccacacaattggacaccaagttgctaacaagcttaatatggaccaatcagaataggcagacattatcgaccggttcgtgcagtgtagtggtcgatatagactgattatgcactaacgtgatcgacaccgaccagttggatcggtcgataacgccaccgatcgatcggctcaaccgactgcgggtgggaccggtggtactgacccttactcagcaatcgatggctcacagtcgaaaccagtcttagactaagtgtcgatgccatggtttgtgatgctatctagtttatatgattctttggtatatgtcatggcgtcaagctattacataggtgtgctgtgacattcgctactagaatttttcatctattaactgttgtcataccacaaccttagtctagaggtgcttttcaattttgcacgagaaaaccgacttttgaaaaaagctactttttggtttggaccgtttgacttttgtctttttagaggacaaaagctaaagccaaaccaaacacatcatcaatacatcaatcagctttgtcctctaccttgagcgtagagtcaacagactgtctttgccaaaaaaagtgtattaggttttttttaattcagtccctaaaccggtagaagacataattgtacatatcctaatggttacgtgcacgaaaaagaaaaggtaacttggggactactgcatgtgcgaaaactgaaaaatagtaatactaccgcatgagaccatttctaggaccaaggttgcattcggaccgtccgtagcgcccagctgacctctaaacccttgtctccctcccccaagtgaatccgtgttgtacctctcgccgccgccgtaccatcgcccgaaatcctagccccattcaccgcctcgctcggaatccaagccccattcggcgccgccgcgaccgccggacaggaggtc

SEQ ID NO: 4820 - DNA, 192 bp, Zea mays
ggtttctgggttcgactggcagctagaattgatctctgcaaatcagatgatgataaagcatgatttcacatatgtagaaaattttactttctatggatggtgttatcttttatctcaaattaatctaactttgcagttggtttctctcttttgccttctcagaaagattatgaagagctggcggaaaatgtc

SEQ ID NO: 4821 - DNA, 91 bp, Zea mays
gttttccttatgccacattcttgtaggatgtaatttttctaactcctatgcaaatactctaacagcgctttggcttaacagcaataaaaca

SEQ ID NO: 4822 - DNA, 613 bp, Zea mays
tcgatattgtttagtcatgtcattatggaactggcgggcatgcactcatgggagcatactacctcttgcccgctttctcaattattgaaacataaagtttgtttgctaccatattgcttgaggtcatccactcatccagtattttcacaataaaagaaccattctgaactcccaagttagctaacaggagatcactggctgtaattttttctatatcctggaagtgtacaagcactaaggaattaactgggtcatgtgctagtatttaggatttgcacaaaacataaatcatgcaagcacctattctgctattgacgtaaaaagaaattaaacaagctacaagctactttctagcagctaaactcatatataacctagataattatttacatgttggcaaaatccttccatctcattttataatctttatgagagagtattgggccggttttctcaaggagtgcaagttaattttctgctgtttttttttctccagggatcctgccgaagtatttcagttcagagtggtcatttgctcagttccatttaccagaagtcactcgttacatagtagcctttggtgcccagaatactgtgatgatggttggcctgg

SEQ ID NO: 4823 - DNA, 807 bp, Zea mays
accgtcgaccaaataagaaatgtcatatttttcgacatcaaagcacatgtattacatacatctccactatataaaaagcaacattgtccacaaatttcactgtcatcgtgcttagggcgtatttaaatggtaaaaaggataaaattatttacggagcaagggcatgagcatagaagagtgtgtatgattggctggccggagtggttagggcgggggtcgacatcgcagtctccactagatcgattaatcacggcaccgcgcgcggcccggtccgtcccgagcacgtcgctctcccctcctgctctcctcttccgagacgcaacgcagcgacagagagagatccaatccacaaggaaacagaggaagcacacgagcaaggcgccaaaccaagaaaatatcgcttcgggtacgcggacgcactcacgcgcctgcagccggccgctgctggatatcgctcgccctgctcaccccggcgctccccgatgacaccagcatcgtttgcaattcgcataaaaaaaggcgcccactagcgcgcgcgcgcccgcccgcatatacagacacgccgcgcatggcgatggcgagagagagagagagagagagtaggggagggatcattgaaagccgcagcgcccatgtcccaggcccgtctgttcgccaccatttgtccattccccctccatcattcctccccgctttctccaccatcagggcgaaaattttatgcgagctttggaaagcgcgagctagtttatccggccgggcgtggtcaccgaggcagtagcggcgagagaggggaggatctgatcg

SEQ ID NO: 4824 - DNA, 329 bp, Zea mays
tggtcaccgccgggtgcgcccaccccatttcccgagcctccttctcacgatcctgacttccgaagggactaacgcgcaagaaatcccgaactttttactttgcacccagaaccctatacttatgcattttattttttctatcactcactcggttctatggttcgcgcacctcgcactacatactagcctgaggacctgaaaattcagctgaaattgttacaaggggtactcgaataatagccgcaaaaccctaaccttggcaccgtataaacgagccaacctgtccaccccgcgccgccgccactccgccgctcctctccgcttccaag

SEQ ID NO: 4825 - DNA, 1500 bp, Zea mays
ggattcccgtgccgacatatataggttcgatctagtacgtagtactcctactagttaacaaaaaccatcctatatggctggatcggttttgcctggatgcagtttgttattgaaacattcagaggaagtgaacgatcgatcgatcgagtttgtccgttgcatgacttattaaccagaaacagggtttcgattcgttagctggcatgcacttcgcagttctaccaagtagaagcatgcatgccacactgtatatatgtctctgcctagctaagctagatagctagaagaaagaaaaaaaactgtaccaagtatatatggataaactaactgtagcatgtacatttatggatgtccatagacctcacctgcccggaatttgatggatcatcagatatttcggtgtagagatggcaatgggtaaatacccaccgggtatcagtgtcctatactcatacccacgacaaaaagaataatcttatcggttcatccatatacactggtgggtatgtatttacccccatactcatacccatgtgggtaggggtcacccatatggtcaccggtaaccacaaaaattaaacatctatcaaaatattatattatacaaatgtcaagtatatccatctaaataccattacaaaatttctagcattatttaactgtccattcaacacaccaaagataattggataaagtagtaacattaggacagtactacatagcacactatattttccattacatggtcattaaattgtcgttgagtcttttatgacattatgacctaaaatgttgttaaatagtaaaaaagatagatgactaaagtccaagttcatgcttgggctaagtttatattgggtattttatatccacaggttaacgggtacgtgtgaaggtggaacgttctaatacccgtttacccattggggtgaagatttttgcccaataacagacccacatgtagaatatttagcccacatacataccctaatggagtaaatacccatcgggtatcgggtcgcgggtacccattgtcatctctactcatatacttatttcatactaaattagtatttattttagttcttgatttttaagtctatattcaattagatggtgatgaaaaatacatattaattattgtgtgaatctattaaaagtctaaaacgaattttaatttggtactgattggagtattattttgtggagcgtcatcttgggcggctgaacgaacaaagttggacccagccttgcctctccccgtggagaattcaaagctccgccgtgtcctcttctggataccggaagtcgtcgccgtccttggaatggcttggcttccttcgctaggaggttttctttctttccggccgactctgtttcttcgaaccttgctcttccagtcagtcgtccttggctcctcttcttccccacacaaacacaacggaatagtcccgaccatactggaaaaccggcgaacttggaaagcaagtcaacaagagt

SEQ ID NO: 4826 - DNA, 1500 bp, Zea mays
acacaaccacggaaggggcgtgctgcatccatggccatgcatgatccatgcatggtgtgtgatgtgatggagaccgtgggactcatgccgtctgcgctcacagcctccggactgggcaacgacgatacgataccatcaaattcgttggcagccccactgataccacgtgattaaccagctaaatttaatcattccaacgtgtacatttctgctctaatacggtgactatctccagtagactccctgtcctactatacaaacagtataatctccagtgctacgcgtaccggagatggatggcctgtatagtctaccgtctcctactctcctaccaaaacataagtctcaccaaaaaaaaaaaaggaccaaccgacggatctgcaaagcaaacacggtcccgtcctgaatggccccacgtcctggatgattctcctggtagtacgctggttaggctccccaccaacacgccgacgaaggccgaacccccgccttggtcaaacgaaccacgtggtgggctagagagtggagacccaataggaagcacggatcccaaacgtggaccagcgaccgacgcacgcaccgacgaaaaatggcccacgacctaacgaaactatttacacaaatctcccaaaatgtatcgaccgaggcagcagtagtatcgtcaccaaggaagagggccgaagggcggaggaaggcgggtataaaatttggcgggttctcggttccgccggcgaagcgtttacttcttcggccgcgatctcgaggagggagggagcgagcgagcgggaagaaagaggggggcgcgcgcgcgcccatgttttgacctcgcccggcgtcgtctcggcagcgatctagatctgaggtcagttccctcccctcccctgatctccgcgctcgtcactccttaacccactcctcggccacagatccaggcgtgtctgtcactagggcttgggatttcatttcttcatccgttggtaagggagggagcactggtttgcctagactagatgcatgcccgttttgttccgcaggatcgtttcttactttctttgttgtggttcctgcgccctgaacacgacgagtacttgattctggcatggatgtgctcccgatccacaaagctggattcgtttgctgcgtttagatccactccgtttgaattgacgttgtctccgccattattcatgcggtggagcaacatgtcttccccccttttttttctgttatagcaatttattttcagaagtttctgacttgtgggttctaccgaacctatgtcacatgttaattctatcctagagtttttttatcctgtatatatctgatttttttatcccgtatatatcttgatatctccacgggaaaacggagactggaaggggaaaagagagagagagagagaggcaatcttaagaatcgaattgatttattattctatgatttttttttgcaggttgtgaggttcttgattgagcggtcacaagtcctgtcactaca

SEQ ID NO: 4827 - DNA, 1500 bp, Zea mays
gggaaacagtggcggagctccgtaaaaataacgctccggtccgctccgagccactctataaatataacgatatattactctttttaatttttcgcgctcgccgcttaggtggtcgctgcccattggccaggaaggcgctccgccctcggctatgaataagaaaaaaagggaatcaggttaagaaagttgtatagtttgggagaaaatgtaatggcggggcggatttgggcagtggtgcggcgccaatagaggcagcgcgcggggcactactacagggtcgcagagaggctgaaggcagactggcggaggcggagggcggactgacggtggcggatgcctgggtcagagcccgcccggctgcctcgaatgttgctgccttgtgcccttgctggatccgtggatcctaaaggcgtggagaatgatagagtactggagggaggcggtcgtgccgctggcaatataagaagcgcagccacacaggtttgtgaaataattggaagagtctgtgttctcgtgactcgagcgactaagggaagccgccagcgccagactcaatcgctacaaacaggaggtcttttggacaaacattttttgactgaaatgtattttaggcaagattttttggctggaaaaaaacctataaacaagaggacttttgggctgcgtcccgggccacgggccaggtggcccgggcccaaatccgccgcccctgaaaagagggttagttaaagacttaaatcacactaatcttcacccaagttttttttttgtttctgaaaagatcatacattttctgcaactatacaaatagatgttcttgctcactcagcaccacaatctcctccgctactacttgtttctctgcttacacacaaaaaaaggaacacgtgtgacaatctgcctcttggaaacgaatattttggctccgcaacgaaatatgctcgtcctcagctgtaaacttcctcgctagtagtgagctacttcagccccatcggtcgcctttcgtgttcgtgtactactatagcaacttttagtagcatcacgggctcacggctgcagaacgagcaggcatttcaaaccacatgctaccggttgacgtcgccgcacttgtaccgctgcaaaatgggctacgacgtgggctggaatgcgagatcgggttgacaaatgcaggctggtgcctggttccgcgggccttagactttctacagtgggctgaaagcctgaaatcttaacagactgctggggaagttagcccaccacaaatatttacggggtcgatcggagcatgcagttagttgcacagtacgtttggtttcttcaacaggcaaatagaactatggaaggaatgttcacagtcacagcaaccttactctggcgatcactactagcaagcatcggtagaactgaacatgcaaagaaacggtcaaccactacattgttgccacagaaacgcatgcagtcttgttcggcaatcggcataggcttggatcgagttgatag

SEQ ID NO: 4828 - DNA, 1500 bp, Zea mays
gggctaacttccccagcagtctgttaagatttcaggctttcagcccactgtagaaagtctaaggcccgcggaaccaggcaccagcctgcatttgtcaacccgatctcgcattccagcccacgtcgtagcccattttgcagcggtacaagtgcggcgacgtcaaccggtagcatgtggtttgaaatgcctgctcgttctgcagccgtgagcccgtgatgctactaaaagttgctatagtagtacacgaacacgaaaggcgaccgatggggctgaagtagctcactactagcgaggaagtttacagctgaggacgagcatatttcgttgcggagccaaaatattcgtttccaagaggcagattgtcacacgtgttcctttttttgtgtgtaagcagagaaacaagtagtagcggaggagattgtggtgctgagtgagcaagaacatctatttgtatagttgcagaaaatgtatgatcttttcagaaacaaaaaaaaaacttgggtgaagattagtgtgatttaagtctttaactaaccctcttttcaggggcggcggatttgggcccgggccacctggcccgtggcccgggacgcagcccaaaagtcctcttgtttataggtttttttccagccaaaaaatcttgcctaaaatacatttcagtcaaaaaatgtttgtccaaaagacctcctgtttgtagcgattgagtctggcgctggcggcttcccttagtcgctcgagtcacgagaacacagactcttccaattatttcacaaacctgtgtggctgcgcttcttatattgccagcggcacgaccgcctccctccagtactctatcattctccacgcctttaggatccacggatccagcaagggcacaaggcagcaacattcgaggcagccgggcgggctctgacccaggcatccgccaccgtcagtccgccctccgcctccgccagtctgccttcagcctctctgcgaccctgtagtagtgccccgcgcgctgcctctattggcgccgcaccactgcccaaatccgccccgccattacattttctcccaaactatacaactttcttaacctgattccctttttttcttattcatagccgagggcggagcgccttcctggccaatgggcagcgaccacctaagcggcgagcgcgaaaaattaaaaagagtaatatatcgttatatttatagagtggctcggagcggaccggagcgttatttttacggagctccgccactgtttcccggggcggccaaaagctcgtttttacattttcctggggccacctactaatttggatttattatttctaggcttattgtctgtgctgttttttttgcccaaaatcatgatatggtttccacgtcatgaaatcgacctaaacttcgttttttttttgccaaattgtccgtgttagcaccgcttgcacaataatggaacaaatgtcaaaaccatcgggggcaaaaggataggagaataaggaaaaaaca

SEQ ID NO: 4829 - DNA, 1293 bp, Zea mays
ctagttatttgtgaagaataaaacagggcaacctactttctaaagaaactttctttatttacggatgcagtgatcttaattctcatgaagatatcgatatgaagtgtgtcttatgggactacatacatgtgaaccgaaacatctcaacgagacctgaatgaatttttaagctcgagctgctgaatactcatcatccatttatctccgtataataataatgataatgatgataataatagtaataataataataataataataataataataataataataataataataataataataataataataataataataataataataataatcataataagatgacttgcggccagccggtggtgaggaagagaaaagacaaactactccacggtcgggccgctaggagctccccaaccaattgttcgtccacgtggcccatccgcattggttgggaggcccgccataccatcacccttttgttttgtctgtatgccacacaaccacaaggagctgtcatccacacgattcgtctctcgaataagtttagtgacgccataacaataagttttttttgattgaacgccagtaatcggacgagatagcatcttggttttctagtgtattactcccctgtcattctaaaaaataactgcatatcttgtatttagattagaggagtcaaataatattttttaaagtttatccaaatataataaatatatcaggtgcacatgacattagatatgggttatatgaaggatgtcctttgcaaaatatatggcaaccacgagacacattagatgatcatcatgttttaatatgtgcagtaaaatgccacgttcacctaacatgttatctaaataatatctaattggtcgtgttatatatatttatagaacagaatttatgtagagagacacgtatataaacatcttgaggacggatatgcatttatttttagaacgtacttacggattagacatagtatataccaaggcgatgttttccattcatcatgcatgcattctggatccaggatccagaattccaggcacatgctgcgggtcttggacgacctttgtgtggctggctttacttttgtttccattgaagcgcgcggtcgtgtcgtcatgggcagattatccggccggccgagcagcttcctcgcgagcctgcctgcacgttaatcaatcctgtggcctggcctggcctatatatacacaccatactagcatgcgtaatatatatgcgttataacagcagagcagaggtcaacaagacgagacaagaga

SEQ ID NO: 4830 - DNA, 121 bp, Zea mays
acgatccagatcaagcagtactcgactaccgccactacactacctgctctgctcgtgtcttgtttccagttttctttctctgtaagcggtgtagggtttgccaaacttttatgtacgaatt

SEQ ID NO: 4831 - DNA, 1195 bp, Zea mays
atcattcatgcccatccatctctatctctgtgggtcgtcgttgtgtgtaatttgagtacgcgcgtacacgtactgcttttgtttcatttgagcactgttcgtgtaagcgtcgagttgccctgccatcgtctctctctctctcgatctctactatttctgtgtgtgcgcgcttctatttttccaatgttgagttacgcatatttgtccagtaaccttgttttgcttaatcacacacagctcccaaattccagtcgttctgtggtgacggttggttgtggggtgtggcggcgacgtcagtcatgggagaagagatccgaatgcatgggggtgttggcgctttctctgtccctctccctctccctgtcttctcgcgcgctcgccgtcgtcatggctcgacgaacagacattcactgccttccccgcgcgcttcagacagaccacgcttgtacgtagcgccgcttctctagtcgccggagcaggcacgagtgggtggcgaagaggccacggcccgacctgctagcgccagcgaccgcatctcgccaccagccgctgcccgctggccgctgccaccgtatgttgggttgggctgaagcctgaagcccgtgacctttttctttttctttattctttccttttcttttgccggacaagacaagtgatgttgcaaaatccatataaaatcctagagaaactataaagtttttttttgttgaactccttataacaacgtctaccctttaatatatggtatataatttcacatgttttagtataaattgtttactgtatttctatgtctatatgctcttggtaagattgtttataaattttaaatttaaaatcttaaaagtcataaacttatagaaaaaaattaggatcctaaacaattttaaacaaaaaaaaaaacttttcaattacaaaatcgtatgtgttctttatgcatgcatgcaactgagaagctgcccaacggccagcgcagcagaagggcagagcggtgggcggccacgtcgccgccgcaaaggaactgacgtgtcccggcccgacgacaacgacgcgaaccttcaccgcgccgcgctccacctctcttaagctaaatacgctagtgcaggcgcaggcatccagctgcgacaacgtagcatacactagtgcttttgctagctacttgtgcgagaagagagagcgcacggcgatagat

SEQ ID NO: 4832 - DNA, 343 bp, Zea mays
ctgcagggttccatgcctgtgcaaggctcctaactgccgtgggtacatgaactattaagactaaccaacctcagaaacagggactaaagactaacgtgaccccccttacagttacagaggccaaaggctggccatttttcccggaattcttccgttggcttctcggtttatatttactggaaagtttattagttctcgtggctgcccaagttttgaaccattttgtttagatattgcgattgagggcagccaccccattgtatattctttcattgttgtaataagataccagtataatcaagaatgctgactttgaaatggaaagaagaaaaaactcaacttg

SEQ ID NO: 4833 - DNA, 609 bp, Zea mays
ctgcagggttccatgcctgtgcaaggctcctaactgccgtgggtacatgaactattaagactaaccaacctcagaaacagggactaaagactaacgtgaccccccttacagttacagaggccaaaggctggccatttttcccggaattcttccgttggcttctcggtttatatttactggaaagtttattagttctcgtggctgcccaagttttgaaccattttgtttagatattgcgattgagggcagccaccccattgtatattctttcattgttgtaataagataccagtataatcaagaatgctgactttgaaatggaaagaagaaaaaactcaacttgatgccgtcgtctgcctgtgacatcaatgtattaaccactcgctttggcctgtccatgtctggacttcgaaccagatgacctgatcaaaccgtggaactggcagtaatcttgctcttcaatccatctatcatcattaacaacaacatccgcgttgagccggcaggccgtgtgcccgtccgacgaccgggtcccgacaggaaagtttaagcagtcagggcagggccgccgtggacgcgggaccgaagcagggccaccgccgctgcacc

SEQ ID NO: 4834 - DNA, 1086 bp, Zea mays
acgagcaactcggctcggcttgtttacgagctcgagttggctcgtttagctcacgagctagagcagaaaaaaataatatatacataataattattttttagttaatttacaactattttaagaacacaaaccacgttaatgtaacaccaaatttgcacaactcatcactcatcaattcacaatcacatacattatttatcagtttaacccataattatatttgcatagaccaatttaacacataaacatattttattaattattagtttagcttataggctacaaacacctcacatatatataacatgttcatcaattattctgtaaatgctatgcatatagttttgttttgctggaatgtggtaccccatttagctcgtgagctggctcattaacgaactaagctaactcgttaacgaatcgagctagaatgtcagcacagctcttgaaaaaaattcaaacgagtcgattcaaattgactatgaactgaatgagccaaccagccacgagcatacgagcatttcgtacaaccatagatacaattattcaagaaagaaagacaaaaaaaaaaaatatttaacatccgaatccctgccccttcgcccttcccctccggccgcagccccttccctgccgctccggcctcctccgtcgggaccgccgacgacgcgccgcgcggaagcctgcgggtgagcgtccagatccacccgcccccttcggcattccccgccgctccagcctcctccgccgggaccgccgccgacgcgccacggggaaggcctgcgggtgagcgcccagatacagccgcccctttggccttccccgccgctccggcctcctctgccctaatccccttaatgcgtcgcctaatgagcgccttaccgccgcctgaggcgatagggcgacgccttacgcataacttaaggcgggtcgttggacgccttggttttttccggcgccttaccgcctaagcgtcgacgcttaggcgacgcctttatgttcttcttactcattgacaagacacaaattgctgctgtacaattagggatattgggtaagcagttgtgatcctgttctcttgctcgg

SEQ ID NO: 4835 - DNA, 302 bp, Zea mays
tcttggaagcggagaggagcggcggagtggcggcggcgcggggtggacaggttggctcgtttatacggtgccaaggttagggttttgcggctattattcgagtaccccttgtaacaatttcagctgaattttcaggtcctcaggctagtatgtagtgcgaggtgcgcgaaccatagaaccgagtgagtgatagaaaaaataaaatgcataagtatagggttctgggtgcaaagtaaaaagttcgggatttcttgcgcgttagtcccttcggaagtcaggatcgtgagaaggaggctcgggaa

SEQ ID NO: 4836 - DNA, 160 bp, Zea mays
gctccatctgagcacgagcgagaaacctactgagcgattcgcggtgcgttgtaattgctagtaaaaatcatcagttttgtataggctactctgcctttttcctcagttcctctgccacggagcttggcctattcattttcaagtgtaagtgtaaactttg

SEQ ID NO: 4837 - DNA, 1500 bp, Zea mays
ggatgacgattcattcagtaaggctagtggaccaacggaaggatataatatyttactaactaatctcaaattaaatccacatcatgtaagatgaagagtcgttaacacgggattaatagttgattcttgtgggccagatgggagaaatcatatgacagcaaactttatcagtataaaggtgaacaaatgtacctaaaccataattaaatatgagaacacaagaggttttcttagactagtctcactctcagaatacataacaccttagtgagcagacaatactatcttttccaccatccctttctcaaatcgaccacatagaacaataaaactcaaagagaactttacaattgtagacaaaattcataaacaaccagtgatgccttgaacctttcaatgataccattgagatttgtgacaccactgctacaactaaatgttggtggttgaactgagtgacctgtggatgggcccagtgctttgtactccattttttcctagtacccccatctaacatcacatatacgatgatgtttagcaactttatgtacagttccaaatccaacaggtattgcttatctaaacctttaacataaaacctaattgtaccaaatcagtgacaggcctgtcctcaccttccaggtggcacgagttagggcaaaaagaattctggaagtacaaaagcaaacgtactatctgctaactttattaaaaaaaggacagctttccactttgattttatttttttcttatttaaacaataaatagaatggccaaaagaacaaaaaaacaatgcaaattaaatgacaaccacaacagtaattagcaattccttagctgtcaagtactccctccgttcttttttatttgtcgcgttttagttcaaaaatgaactagcggacgacaaatattcgagaacggaggtagtacttatgtatttccttaagtggaaatttggttggattacttatggactatctgaaaaccaaggaaagaagactatcaaattttgatgcactaccttcatcaagattgataattttatttacatggaaaattgctttcctgcaagtgttaaacaaactgttaaaatactacaaggagcaaaattgttaaaataactaagattttatcatatctcctgatccttttccccctgtttcaaaactgcttgctttaactttacaaagatgattgatgtactgaatatgtttattctagacaatggcaactgatacatatggcccttttcattctatagaaacttttgccacagaattgtagatcagattgaaggattcattatctaagatgattcttggtatatattttaaaaaaagcaaaagatctattgagtttgtcttttgatttcatgatttgcacatagaactattctttgtatcacgattgtttgtgcggctaatttccaaagatatattcagcttccttgatctgttttatctagtgatatgcttattctagtgaaaattatagggtcta

SEQ ID NO: 4838 - DNA, 265 bp, Zea mays
tttccaaaataaagaggggttcatctcatagccgttgtccccgcatcgcttccctccccggccatcgcctcgcccaacggctctattgtgcacgccgctccacgttgaccgttgcgagtttaaagcatccccttcctctcgagactccttcctctcacttctcatcgccgggatccagatcgttcttcctcttgcccgccgattcgttccaccaccgcgaaagccacacagagagcaggagagacaatccagagagatcggcgcc

SEQ ID NO: 4839 - DNA, 1339 bp, Zea mays
agcttctgagagcgagctatagaaacttgcagtaaccttatgctttgtttaagacactgtatatactatgttaactcctgcaatatgtggaaatacattaacaaaacgaggccctatgtggaaaatgacactatctcataacactgacgcatttaagagagagacttgatatctggaggtactaaaattagcactgcaaacagccgatcacaatgattttattttgagttttgtattacgaacctttttgactggtgaaacggttattccatttgcttcaagcgatttggaaatgattgttacagaaagctgtttgttacagtgagtgtattttgcctcttaccagctaacgtttcactttcacgagcgactggcaatgaccctgaagcaatgacaggatacataagcagcttcagcaggccaaggcaactgatgcgaggtcggtacgtgattttgggagtggctccatgatgggcaaaagcaaacgatgcgtagagaaccctttcagcggctgaaatatacttgatggactaaattacttggttcggcatttaacattgtaaaacttttcaaaatctagatataaatcttctatcttaaattcacacgttacgagagagaaaaaaagatttcatcggtgtccatggtctgtttctatattgcaacctataccatgcaatttatttgtatataaattatgattatcaaaatatatttcaattgcaaggatctctaaatggcactcaaaagcaaaaggccttccaaccaagacaaggactcagtgctagattggtggacaccaagcaaactctgacgaacatgtccgacgccagtcttgcagcatgactaggactctccggatcagtcgtcgcaatggcaagtggtgcctagccccatccacaatataagcaccatgcaatgataatgaatacaaactatattcatatgttattgaatgaatacagatttagtctaaaacgaattatattttagaaaggattatacaaactaactgctatcagctgggcctaaggatgcccccgtcttttatatacaacctgttgcagttgaccaagcttgaccatgggttagtagacaaaaaatagaaagaggtacaacactaggtagagcctcagtgctagattggtggtcgccaaccaaactctgactggcaaagatatccaacgccagtcttgctcttgcagcatgactaaaacaggaaaaagcctgacattccctcttcgggtcagtcgtcgcaatggcaactccatccgatccagaatataataagcaccatgcattgtctgcaaagaaacatataatcagcatcactatgatg

SEQ ID NO: 4840 - DNA, 535 bp, Zea mays
ctgcagttgacttgcgcccagatttgtaagcatcaacgattcttcgatgcaactaatgcccgttcttcttcactctgaacttttgatccccttttgaagctgaatgagaagctgtcagttaagaagccttctggtcaaattaagttgaaagttctaaagggtatatcaaaagagcatcaaattgtttgggataccactaagagtgagcaggagcttttgaaagttgacctcctgaagagttgattatatgcgctgctgaacctctattgtgctgagatcaaagcttgtcaattctagtattaaagattagcgtcgctggttttacattaaaattagaaatatatactcaatatttacattttcatcttattataaaattagtggaagcactggtagagtagatttttggaagcatggttagtattacatattcccttgaaattattagtctatacttgatttgagattttaagttaactttagaagtttataatggtacccaggcttcgattccaggctggctccaccactggaa

SEQ ID NO: 4841 - DNA, 417 bp, Zea mays
gacacgtcggcgacacagcagccctgatcgtcgctgccacgttagagctcggtgccataggctattggtggtgccataggctatggtgccgagatgtgctgcctcggcgctatagatcatgacatcgagtaaaggatacaaaacatgaaataagtctttcaagtgtctaaaaatgattttttattaaaataaaaaaatttcggccactatggcggttggcttcatcgtcaccgcgctacacgctacactcgaccagttcctactccccaggccaacaaaatcacctcccgcacctccgcgattcttctcgaagactcgaaccgcctggaatcagaatcgccgttgtcgggaatcgctccgatgcccgcggcgatcgggaggcggccgcccgaacgccgggtctagacctcgcgtgcg

SEQ ID NO: 4842 - DNA, 823 bp, Zea mays
ggtaggtgtgcccttctaagtattgttataccatcgatcacctgctacagctccagaatatttccccttacaggatcattacaacaatgataagtacagtctgattagacgtactacgaaacctactccgtaaaggggcttacaaatggacccaaatgacgacggaacgcggcctgggtcccaccgccgttgggcggcgtggcctttgcccgcacgtggcacccttcgccctgcgaaatcgagccttcaacctcactaagactagcgtcgttcaaaactgtctgagtcgatgggggcgcttcacgaggctacaactaaccccttttaaatagtgcggctcttcgttccgaagtttctgacagagacttcgatcctgataccggtcgaagacctctcttcttgtacctacgacaaaatctacctaggacaaaatctattcagttgatgttaaaaaagtctgaccgagtgaacggtcaccggtccgcagtttatatggtgaagtttaaattagtagacgagaaagaaaggtygctggagagagtagtataaaacttctaaaaggttagcaagccgccagaagggcccaacgttgcagagtgttgtagatgcgggccgcgctgtatggtcttagcaagaaacgaaggatatatgcggcccaagttcgggctaaacccctccttctcccacgacgccgatccccgtcgccgccgcctcatttcctatcagtccgaaccgttcttccgtcctgctcaggcgttccgaccagcgttgctcgcttctcgtcactcccgccggctgctgctcttgtctacgccacggtaga

SEQ ID NO: 4843 - DNA, 488 bp, Zea mays
aaagcaaaatatcatcttggaatttcagatgactgtatgacttctttctccaacttgtatagtctagttctttcatgcctttggtttgggttctgtgtctggtctttaagagcacattgacttgtccttaaaactcgacagctcgaatggacatttggacctagcacatcttaaagtgttatctcaacaagcttcattgtaggcctttcttcacctttcaagcttaagcatacttccgcaagccttgcatcagcctcggcatctttagcccttccctcttcaacaatttgtggatctagaatatccaacaaactacagtcttttatcacagacacgaagtgtgatgctaggcttttgccctctgatgaatgagtagagaataccggtttaatccttgttagtagctctgctaagattacaccaaagctataaacatcactcttctcggtgagtcgactagtgtaataatattcaggatcaaggtaacc

SEQ ID NO: 4844 - DNA, 451 bp, Zea mays
ctgatctagtgagtaatacgtatgtatgtatgtatataattgttttctaattaaactcgtccatatgcattttgtttggatggaaaaaagagacattggtgcaatacgaagaagacctgcatacattaatgtttaatgctcaagctagacaatctcgctgctggtcgtcgttgcagccagccatgtgcatgcatttccttctgttgcaataatctaatgattaatagattctttgccggccctgtactgtacgtacgtctcctccagctcgagctcacgagtcacgaccctaaccctgaccctagctacctggctatataagcaccacggttgctgcagacattcctcacctctccaagctccaaacttgtctgctagatactacacactctctagctagcacgtagcagcatcgatcgccggctggctgtttgcccggccgcaagctaag

SEQ ID NO: 4845 - DNA, 1500 bp, Zea mays
taaattaatgttattagaatgtaatttaattccagtgatctaaacggggcgttggtaagtttagaatctcttggaaaaatagggttgtcaaactaacctaaaaataaataatttataatcctgcaggcttgtacgaacattccagtctcattattaaagtccatttaggttagaagctctatagataattattagcgactaaaattagtcgtagtggtttctaaacagatcagctaaaatatcaggtaattgttagttagatccttaattaacattttgtttattagttgagttgggacaactaaaattagttaaaaatagacaaaacatattattatctattattattatctattatcccttttcctttcaaatatattttactccccgtgcgctcgccgcaaatgcgtcatccatcaactggcaacggaagatcgctcatcgttgcttttgcccgttgcagtaggcaggagcagatggtggactggagaggagggaggtgaagatgtcgtgccgtccgccctcggctcgcttcaccttcaattcttttctttctgtcgtggccactggccagcgacttcccacccgtcctccgtctcctccacggtccattgcagctcttgcttcttctcttcccctcaccaccatcctgctcaacgtagacatcgtgatcgccgtacttgatcttgccaagctcttgcttccgttccttttcagtgcagtttgctcagtgctctccccgcacgtgactatatatacatatgctgtgtttgggcctatatataatcaccgactaaccaatttcattagggagtgctatccactatactcccaattaatacatctcgccccttctctgaaagctctcctctctactgggcttgccaccattaaaccgatgacgcaacaagccaatcatagaaacgtctatatattgtcgtgggctcggcctagaaaagggagttctgccggatcagacatagctctttgattgatccgaacatcaggctacctccaaccattcgcatctcctgacgaacatttctaacagttaccgtcatgcatagtcgttgcatacatcaatggtattgagaggggaggaaatagaaaagtggactgaaactgactgttatattccaggattaactgagctctgacaagatagcttcactgacccatttttactagtacatacatattatctgacgaagggagtgcagtagaagtgcaatggcctaatgtccttcaccatataaaaaaaaacaaagttcaaatctttcatatttatttactcttggagtagcacagcataggggtacaagggaagtgcttataataatggtaacaagatactcatcctctcatacctgccgtctcactgacaggaaacggtaggtggcaagttggtaagcttttcggttttagccatgtccgatcccatgtgtggatcctgtactgtacatcgacatgcgacatcttgcttggcctatctgatcttta

SEQ ID NO: 4846 - DNA, 265 bp, Zea mays
ggtacgttcgattcggatgagccccggccccttctttggatgcgctgtgcatttctttgttgcgagctttcaaatcccccgcctacaatatccccgaaagaaaaaaaatgtttctgtttcgtctgaaacaataacagttgcagagatcgagcggcagatgtatatttcatcggaaaaacttgagaacgccgctgagctgctcggcacggcgccttcccgtgtgcaggttcctggcctgatcacaaagcaggcggcgacggcgcgg

SEQ ID NO: 4847 - DNA, 404 bp, Zea mays
tgtagatagatccttggcggagaagcataggtcatcacctgctcgtgctccgacagaatggcttccccttcaccatacaccatcacaaactttaccactaattatacctgagacaaaacatgctagaagtgcatcggatagtttagaaattagttcttctgttagccaaggagcctgttcattcagatttgttcccgcatcatcaggattgatgcctttggacccggaaaacaggtacccgtaacttagctcaaccaccatatcagcaccaagatttgttgctaccaagccagcaaaatcaaggtacaattttgggaaaccaagttcatcctcatctgccccaacagttacatccccattcccatcctcaccatcaggagacttttagaagctttgcccctggc

SEQ ID NO: 4848 - DNA, 976 bp, Zea mays
tagtgtatggtgttgtgatcaaatatgctataaaaatatgtggtcagttgtagttttgtctaccatattaaaacatcaccacacaaggtcctgaagaagtgtgaggatgaaactaagtgctatcaatggagtttcatcgcagtttcatagaactaagcaagcgtgtatactgatttcatcacatgaaactcaactcatctctctcctcgttaagtccatgccatgttactaattttgcctatgcagcacttcgtttaatgagaataaaactcttataaaacttacattgagaattatatatattgtctactcaatcctagataatattaactaattaataagagataaatgaacattttctttcttcatccatatattatctaatctattagttatgaatccaaataccattacttattatctatttagataatcgtcaggtagttaatattagctactgcatattagttttttaagacgtattacttactagctagataacgatagataatctataataaatctaaacaagccttatgcgatcaagggccatggtttctttttcttttctagatagatagtagttattgtacttttttcaagaatgtaatatctgtgcaaaaaaaaaaaactccatgcgagtcactctgaaattgatcttttccaaagcggtgattacaaataaacaacacacaaaatggaaatggcatctctgattgctggtcgagtggttgcgctgcatcggagtttaccgccacccgttgaagggacggtggcggacattattgtcatttcgtctcgtcctgttcttttaaatactcccaaatatcatctcctcggaaagaggagcgaagagagcgaaatccagagcacacggcgtcgcatttggaacgctcctgctcgtcgcacgtacgaagcccacgcgtccgcgcacgtgccagagccgagcccccgcgccggcgccccgccggagagg

SEQ ID NO: 4849 - DNA, 1500 bp, Zea mays
atagtgtgtccacccccattcatatcataagtgcatatttcattaccttcctccttatgtgatgttgacggctgtggaagcatagacattaccttctatgctcggctcctagtcttacaggctgccaaagaaggataaatatgtcgcctttgcatgagcagcagtgttctctttctctaccgtcaccttttcaatttaaacgacatgcaactagcggtggatcggctggtgctcgagcttcgcctgttgctccctagtctacagagtccctcctaaaatttaaaacatgcttagtataatcttattatatattgtataaattttaatataataccactttaaactattacatttgtctattatgacttatgagtaatttagagacattagattgttgtagtggacgaaagggtctctagcgtaatggttaagacttctaagtagtaccttcaggttctgtgtttgatcctccctcgggggtgaatttctggcttgattaaaaagaatcccctcgttgtctctcgcgcccgctctgggttacgtcatgtgtggcccgctagtgatgggggctgtggtttgaaagttttctcggtcgggatcatgtttcggtctctttttaatataataccgagaggatggtctttctcttcccgaccaaatttttttatgtcgctgcagtggtttagttcgtatcctctaaaaaattcttgctatgtccctgtgtatgtgtattgttttatcttttttaatgaataaaaaggtgatgggtgctccccaacttcttggaaaaaatgttggttttcatatccacaaaattttgattgagaaggaatcaaaccagagaattatccgcgccgctctcacccctagatcaaagccatccaaacttcttttcccagcgagctgcatgtctaggcttgcaggtttgattctctatactctctcctgacagaaagtacaaaacaagaaggaaaaaagtttgcttagggaagaagagatcaatgtcctactttaggaagcaaaataattagagaactgctattacagttaataatttattagctggctaacaattagatcggtgccttaatctcttcagccttgtgcgtgcgcatcacaattcacaaatcacaagcacgcatagcactgacgtaaagcattcagctaaccaaccgcattctgtatgtttacgctcgtaattaggcagccaccacccgtcttcagctaagtgtagacagttcaaagaggtaaagatcgataaagtagtttggtagcctaaagcaaacttgttcaaagattcttcgtgtggggattcatcagcaccctgcatactcgccatgtctcatcgacttgcttcagttgtcacacttcatccacattgcttggctcacaatgatcaacgagttcttcgttaggcaggtacacggatgagtcattgggggttgagacacatccacactcaaatgactctatttattccttgctttcgttgccaagcta

SEQ ID NO: 4850 - DNA, 1239 bp, Zea mays
ctgcaagcgcctatacaggttattccggcgggtccggtccggcagcttctagcagctatgcaaactatctgggatccgtctattgccctccccagcaaccatagattcgcttcatctctctcagaaatgttgtgctggttataaggtgtgttgtgctggtgataaggtgtaactttactctcttttctttttgactcatccacagcactgggttttgggttttggaggtgtaactgatgtagtccagtttctttggaagctgtgtgaggcgccggtcaaaatatgagtgttctcatgtgcactcgtatttacctttagctgtgcttattccttaggatgtttatatctttctgtcaacaagtctgtcttatgtaggaaagtctgtcccatgtactccaggaacatgtaacttttttacttgctaatgttgtgattgagctggaaaagccaaaaagtgtcaaacttgcgaagcttgcgcatctgacgatcttaagcaaataatattctctactttcagttgacatggcttgtacagttgtacttgcaggtctggcataacttgtgttcataaattttgctgaaacagtgatgtagccttggagaggccatcaaggcggctccggctctacctttccgtgctgtcagtgtcagttcgtgagatcgcgatcgtcttgttcttgtcaacgcccgtccctcggcctctccagtctccactcctgtgcagcgactgggaataaaacaagacgagacccactgacccagcttacccgccctattcagtgacagtcataagcggcagtgtagttgtgtctgaattaaagggattaaatctatttctatttaattttaacaacatcatttttttgaagaaattttatttttctaagaaaattttagtttaatttctttaaaaaatagaaataaagttgttaaattggccctaaagagatttaatccatttcattcccctttgatacagacgcaagcggacgaggcctaatcaggtcgacgtgaggcgatccgcaacggcaaccgtaagcaaaatggtgctacatccgacgtgccggacggggtgcgacgcgccgtgaattaccgaattacccctctatccgcctcccccctggccccctcttctaacaagtcgtcgcctcggccccggcttcgcccccctcggcgcgacgacctctcccccaggagagcctaccccctccctcattccccgcgcgacgaggccgcttc

SEQ ID NO: 4851 - DNA, 186 bp, Zea mays
ttggtgttttctgcacatatttagttttacagttgatggttgagcgatatcgcactgtattgttgaaattgattgaactgagttctatgcttgtgtgcagaataagagttagatcttttatactatttcgttagtggccatgtcagctatcatgatagttgctaaaggtttcttctccaattctgt

SEQ ID NO: 4852 - DNA, 470 bp, Zea mays
tgcagcgatcaacaagaggaagacatgcgagcagcaacgctaatccagtaatcgtagattagtactgctcaaattgttaaactcggaaataatagcccgaggctttctagaccggaaaggtaagagcaaaactgacgaagacgtaacaaagccagcctaacttcaatacatgtagtaacatatgggcaacgggtggcagcagcacatcaccaaaaagccaacaaaatatctgcttcattgcgcagcccctgcatcaacctcaacctccggctttaagaaatcaagtcccgtccatcctccggcttaagacgtcaagttcatccatcctctgcactctccacggcttggcaagctcgctttcctcaacacctccatccacatggtcaccattgatatcctgttaacctttgcgtccctcaggcactcaaatacgtccagcacagcatttgccattgggtgttgctgctgca

SEQ ID NO: 4853 - DNA, 198 bp, Zea mays
ccactgaaccagttgacccaaagccatttaagctagctaggcttggcaggttytatcttgaagagccaaggatccgagaattttcctcccgacaaacacctcgcaaagtctcaggcggcggcctagtgctctcatactgtcacacaaaagctgagcttgctgtctacgattcagaaaatcaaccgtatcgttgaagga

SEQ ID NO: 4854 - DNA, 371 bp, Zea mays
tgcgcatttagtctcacgacattgaacaaaatggtttctgtatgcaaaaggcacagttcagacaatatataattttggaagaacagaaacagtgttggcagtagagatagggggaacaaggtggagctaagtagattgactgatgagatgatagcctaccataacttgcttgggactagaaggctttgatgttgttgttgtaccctccattgaatcatgtaaatatagtcatagtcacatcaatgaaacacttaacacttcactaattggtgataagctaattgaactacaggagaattgcagaagtcaaagagaaggaaaggcaaaatgccttagaagagattatctactgttgggttacatataggttc

SEQ ID NO: 4855 - DNA, 1115 bp, Zea mays
agctgccgatcgcctagccgtatcgactacgattgtcattgatctggtcggtaacgaccgtagctcgttggtctggcactgatccgatctcatagtagtttggtttagccgtggattcctaaaaaataattttagctatgagctatgagaaagctaatgtgacttcgacgattgtaagaaagctaaaaatatgtctggtcaaaataatagccaattgtagattgaatggtaaaaattggaaaaatatagagtagtagatgattctaaattgaactagataaatatgtagattttaagaaaatctattctgctagtgtaccgatttagttgaaactcactatgttccagttctgactttttgacaccaaatttgatgggttcatcttattcaatttttttgcaagaaattgaaaattttaaagtcatacttaaagtatattatatggcaaacgatatcataatactaacaaataattattatgatttttaataacacgaggcgactaaattggtgtaaaaaactcaggcaaattataaattataacggaaggagcattgcatatttttgacaacgagttttattcagaaagctgcagattcttaaaaaaaatacgattttagctgtgagctgttgtgagcggacagttgtatgaaagctaaaatatatttgtttaaaacaactgttgaatgtagattttataaaaacatgatattttggaaacataaatggtagtaatatgaaaaatctagagtagaaagtgattttaaatttaattacaagaatatgtagaattagaggaattaattttgttgtagttgattggttgagattttagattttaaacattgtttagttcagaatgatggaaaatactcgtgatccaacttagagggtgtttatttaagattataatttaaccaaattatataattcaacaaattttaaactaatttattgaattatataatctggttatattataatcaaacaaacagctgctaccttttcgtcgattctactctacccggtcctcgcttccccgttctgtcctcgcggtcgcgcaggcgtaccaaacagctagggccgggggccgcagccgcgcacacagcaagca

SEQ ID NO: 4856 - DNA, 1500 bp, Zea mays
atggtcgaaaagtgttggtgatgccaaatataacaccaagcactactactgtcacactcctgcacagaacagtacaaaagcaaaatataaatcttttttggcaatttgtgatgtcatttagtggtggaagataatcagcttgccatcaagggaattgaaaggtcttgtgcacatatgcataaaaaacatgtatcatacagctgcccaaagaagagtatttctgccttctcatctatagttgcctccacagctttaaatcccagttcttgcaaagccaattgctcaaccaatcctgtcagaacaaagctgtctaaagaacactcagaatgatttattcaatacacatgtacagtaaaatcaaacttgcgagcctcactctatacaacataaaattcaaatacctgatgcgcaaaggttatggcttaccttactccacagcctaccatgctgagcacaacagttggccattctccatggcacatcccattggcgaacgatcgcccactcgtctgaattgtgtttaggcacagataatgtcacaagatccacgccagtcaccacaaaaacatgatgaaagttggaataggctaaatgcatataatgtccacaaatgtccaggattcctctacacacattgcttttacaatcttatatggattcctgaacgcttactctggtctctggtgcatccatatactgattggtttgttgcgcatgcgcacccaggttcgcgtcagccaggccgacaagacacgataattctgggcgtacgtgcagatgcaaggaaatggtctcaaaataacttactttacatctgcttatgcagaccacgtccctcgcatgcagtcaacgaaacaaacgctcagctacacagtggttcagaataggatggtgcgcagacagtatattttcctagcttgttccggaagctaaattctacacttaacatactgcatccctaattcccttactttgttatttacaaccggagcatgtacttgttgtgtttaattcaggaggttataaagaaatggaaagtttgagcatctctttatctgaaggcggggagaatcttgttcttggctttgtaggagaaacacgcgtagcctccgccccttctgcagctcctcctccactggccagtcaccggcctccgctgcaaccgctgctgagaccttgcttctacgcggacagctgggaatggcttcctttgtctcaagaggaggacgggtatgcacgggagcggccggaggaggataagtgatagcggcggcgacgacagtgaggaagacgccatcggaaacatgccttctgcactgccccctctgctctgctgtctcgcggcttagcggggataagatgaggagtctttagaaaatcatgcacactaccaggtgaaaacagaagttgtaaaggtactcgtgaaatatcctatagattgagggtccgcatagcaaaagagaagttaggccttcttgtccgcttgtgttggcggcggcg

SEQ ID NO: 4857 - DNA, 943 bp, Zea mays
ctcttcggttcagctctcgaggtacgcgtgcgcggatcccaatctttcttcctcatctttatactagtcgactactagacttgatgccaaacgattttcgtgtatttgcacggtcgcgccggaagctaaaacacaagtattctgttttgcaattattgcacgattccgtggtagaatggaaactgtttcaggttgccaatgaaattcgtgttggtggatttggacgctatgatttgtttgattgtctcatatcctcatcggtccgtctctggcatgttgcctctttctgagggctgaggaggtggtatatactccgcgcctcaggtccttgttttctaagatcacggctaaccttttcaattcgatttagttttttttttgtgtgttttggaaggaaacagtacatattaagcaagcaacgcgatcttgcaattagctttcttttcccagataaagaaacttgcgcctttcagggcacgaatctaagatcaaagcgatgtatttattatctcagggagggttaggatgagtaggccattcgtggtgggggtggcttcggcttaatattcggattcaaatccttgtattccagctgctctttaggttctgcggagctgtttatatggattaatgaatttttggagtttaactcacatttaactatcaagtatcaactacatattcctaaagatatagatatggatccaaattgattgttatgttcctacttgaattgacttgttattgtaagcttgccaatcctgcaatgtgtttccttgtttcattatggtcgcttgctaagaggtagggaagccttattgatctttttctgtcccacgatggcacgatatttaagttgcaccatgttttgtacatgctgatccgagtgcatttatttgtctttaaagataaagatgttataggcatttctgcagtttccagg

SEQ ID NO: 4858 - DNA, 429 bp, Zea mays
ccacatcaccccctcctccaccacctcctcgccgcaccgcaaaatccacctccccttcccggccctgcattgcatccgttcttcttgcttgcttccccggaacctcgcgcttggtctgacgcaacgcaacgcgccttcgggccctgagataaaatctcccagcgctcgcttgctccgccaaaattcactccttggaatttcctgagctgtgggaaattttctcttttgttttggttcttctttgtccccttaggtcgctagcatttgtgcgtcgttccgccgaagctcgcttgtttgatcccgtcctagatgcggatgcgcctcttgatttggttctaaaatacatcgtttcttgttttcatccttccgaaggggggaaaatcatcttttttgggccctgatttgagtgtgtcacctttgcttccggca

SEQ ID NO: 4859 - DNA, 360 bp, Zea mays
ggtacgatggtaatttggctgctgtcttattcatcaatgctaatgtcaggttgcaaaataacacatctgtgatgtatcttttattaaggttcagtaagcaagatctgtagtattgcttaacatctttgttgcacatccggttcagtttagaggttagcgcgcaaatttcgcagtccgtacaatcactatactgttttgtgctgcagctatgctttgattgcatcataatgaaatgttatagagcaatgccagcacttgatacacatcggattttttcttctgatttctactttcatgggacgaagtttaacacagctttgattggttgatttctgttaggttcatgtttcatcataagga

SEQ ID NO: 4860 - DNA, 1500 bp, Zea mays
tactgcgagtcggctaccagtactccgcatgataagcctgctggttcagtgatgagtgtccctgcgtgtgtcgtggcggtgctagtgctagtgctaccgaacggaggaggagagccatcgctttcgcgtccggtgagggtgatggatggatggacacaggcagccattatagctgatcacgcgtactagtaggctttcccagcaatgttcatgtaccacgaggcatttatgggcatgcagtaactcgaggggttcccgtacctctgcgctgcagttgcttaactacctcttcttatctatagttcccagttcttccagcagcgtggtccatcgcactgtgctgccgccgcacgcagagagagctcattgtgcagataagggggctaggctacccagcagcacccacgaagccagtcgatcggcgtcgtggcctcccagaaagaaaacgcgtttgccggatcggatcttggccggacgcggccgcggcggccagccagccagccatccgcaaaagccgccgcgtccggggtgggcgccgccggccctcggccgctcgcggcgatcgcctcgcctcgccgcctcgactcttttgaggtgcgaatgattgcgggttcgtcctcatcctgccgcgtgtgtttttgggccctgttcctggcccaggccggtggcctctctcgccggccttgttgccttgcgctcggacggttctaggcagctataggcagaatcttctcctcccacgtttcccccgccgctgcgcccagttgcgtcgtgagaaaacccatcgacaacacgcttcgcgccgccgtcatcgctctgcccgcctgctactgctactactacagtgggtttcctctgctcgtcttggtcggtggtggttggctgctcgtgaaaacggcttcctcttcaccgcccttttccttccttgcttccattttccctagttccctccctcccctcccggccggcctcccctgagcactggccactctgatcgagtctgtaggctgtggttccctgctgccactactgtactacccactcgttcttctcccttggcggctacgcttctgcattcaactctgccggcctctgtgagacctctttccttcgctcccatgtttcttggctacagcctacaggcctctgtaaaagattctgccctttctcttccgctgaagcttcttcccctgccttgttcgttcaagtttcctgtcctgctgcgctagcgctactacaggtttcaaaatattttgtttcgtcgaccaaccaccttttgctcgtctgcatctgcgcagtgtagctttcaaagaaatcccgggttgatctccgcgagttcccccacttccccccgctgtaggagtacttgtgtttctgtagtctcgctgcttcccaaccacttcctttccgggtttcccgcgtccatcaaacgccctcgcttcgccttttcacgcattcccccgctgctgcagctaccagcaccaagccacgccggccgcc

SEQ ID NO: 4861 - DNA, 118 bp, Zea mays
atggcctgccgcgacgaatggcaaggtgcggctttcgacgctgtgagccttccttcattcccctggctcggtcaagcttgtgcgcctgtgccatccccttttatatgttacggatttg

SEQ ID NO: 4862 - DNA, 1500 bp, Zea mays
aacacgctctcctggttcgtattggcccaaaaataaacttgcggcccagttacaaattgccagcccaactgattaaccctccgatccacgggcgagcaatttctaggggtccattacccatacagcccgtacacccctgcctttgcttaattgcttgtgtcgttcacctgtcgtgtgctctctcctggcggcgacgatagggcgactaccgccgccaccgccttacgccaggtgcccaggtcgtctggcccttcggcgaagagcgccgaacaggtatgggcacccgttctctttccttcccgctgtgggaarccgagcacccgaaccctaacttaagctgttttgtctatttgctttcggatctgatataatttcaggcgtatacatgtactattatgccctgtaacttcgcttttcttgcaaaaaccatcagttgtatatgtgtgcgctcatctcccctaatgggtgagcctggcatatgaaggagttttagttcctcttttagtcggttgaatcagcttttagaatcactatacaaccttatattcgctgggatttactcccttaggctggtagcatctggtttcgtgtgatttggtgacatattttatcagatattcatattactgaatatatgcacaaatatactagtctgctaacggattttgctttccttggtggtaggtttagctgcgatttgggttatttgttttgtttccatcaggtattaataataatctaaaatggtgtgcagcttaggttaaaatcaaataatattttgtcggacggataattcaaggcctacaccagaaggaataacctaccccttgtgcggcaggccaacagctctctccatctctctctgcagtgttatttggtttactatatgcaattgcaggggagaaaactaaagaaccgttcactgcagttagaagcagcaactgctgtagccgcagcaggcttcttctacagtattttcggtttggaagttgcatgcggagagagacttttgtgtttacatctagttgacctttaaatctgcagctatgttataggtcaaaaaatcatcagttaacaggggcaaggacttgccttgatgacacaattattttggtctatctttcacttctcctgatatttaacttttttgagtaagtgtgcagattaggtcttaaaaagggattgggattaatattttattgccagagcttgagctgtataattatccatttacacagtgggctgtacagggggtaaattgacaggaatattacttggtgatcctataagataatgtgctgtgaaccctgatttgttttagctgcttgtgttcgttttgtctacttagtcttgcacactgaggacctttatcgaggtattccttgatccccatggttcttgataacaggccatgagtttataccccctccatttcaccttatattgaagatgatactattcttgcttatgcttgaaggttgtcagtctgcaagttgaatc

SEQ ID NO: 4863 - DNA, 1500 bp, Zea mays
acatacaacagagacatgtaagttatcgtgttataatccggttccgttgcaacgcacgggcaccctactagtaacatgtgaagagtcaattgtataaaaccactttctatatcttatctgcattatagagaatcattcacgttttctatattttgctagcgagaaaaccggaataaaagatgttatatttagatagtcatttagataagctgttgaaggacattttttacgaaaattagattactaagaatatagagagtctcttagggggtgttcacgctaactaatatttcagctattaactatttttagtaaattagctactagttagctagctatttattagctaactaattctactagcaaatttttagtcaactaactattaattttagtgcatttaaatatctcttatagttattgttgtatagttaatataaagaacgctaaactaatatggcgaggagccgaaaaagagactagtcaggatgtccatgaataagcggctgggccaaatggagaatgaccgacatattccaaactcctgttttagtgcaaagcagtctgactgtctgagcgtgcgaaagaatcgtccccatcgaagatcctgaattcctgatgccgcgtttccgaatcgtgagccgacatatgccgaaccaactcgtcctacacggctacacccctagctaactagacttcttcgttgacttcatagcctacgtatacgtatcacctactagactactactgtacctacagaactaaagtcatacatattcttttcgattgcacgttagggaacacggggaactcgagttagatagctcataaccactggccaaagtttcgcagatgactagatcagatgcaaacaaccagagtcgcctggacaggttgactagggccgccaatttgaaaaaatgaaaatgtattgggacaagagatatatgcattggaaatcgagaatttcaaatattttagaacaagatttgaagttataatgtcaactattttagaacgtaggaagtctaatatatctgcgacaaaataaaaccatatgagtaatcaagagcaattcggagacgcatcaaactctcaatttctacaacataatattaatacctcttgattgaagaagcatactaggagtattgaatataacaggaaaataaagttaaaagaacaattgaacttgaaggaatatagacacgctaatagaagtggagggaaagaacgggaagaaaaatcggaaactaacttcttcacaagctaagtccatgatccagcccaacttacagaagcccacaaagtattcacttaacgtctgtaactaccggcccatcccaggaagaggccccgctcctctccctgctcgctgcacagggactcggcctccgggacggcagacccacaagcgccagcacgctcgagactgtgccgtgggagtgggaggttcctcaggtgctgagcagtcgccggcggcgaccgccggtgtcggag

SEQ ID NO: 4864 - DNA, 1500 bp, Zea mays
atctctgtttcttgaattgaaaatctgaagtgcctgcataaatttcttttggaaaaaaaatttgttctgcgctttcccggtggaaaaaaatctgcccaacttgcttaagcaagagttatcaaagtgggcccacctaggcacctggctacccacaaccgtaagcgtcacggaagggaacatgtcgctttcgttttacgccttcttcccccgttcggcgcttccgcccaactcccgcctccctcctccgttcctcactttccaatttccgtctccaccctccgcggtccgcgccgcggaccgcggtcaccactcaccagcagcgctgcagcgccacgccgccactccagtcccccaccgaccacttgccgattgccgttgccgcgtcggcgttgctggatcctcaagcagaccgcccggacccgggaacccgcccgcgcgcttattaataacggccacctcgttcccccgcccgccccgaaggccgagggaagtgtacgcgcctagcgaccagcatagattcgttccacgcctacctcctgccctcgcccgtgctctcagatctcgcgcgcgccccgcaaaggtacggacgcggaccccgccaccatttctttttgctaacgcttatgacgcccgaccatctccgtccatggatcgttggttggttgaatgatccctcgagtcttgtgggtgcgatctgcgttgctcggggggcgaggggagggggggggggatctcggcttgaatgagttgatttcgcagtttatggtgcgtatctggtgagtagggatccagagaaggggcgttttgagccggatctaggggtagtgggctggattcgccttccgctaatgagggtataggggacgccccgtgatctatggttctagaagggtgcgtcaggtgctcttgctgtgtgatatttgtcgccttgtgacgctgggaccgggctattggcgggagtttgtcagagcaatacaaaaatagctggtgccacgagctcaggggacttccgatcagtttatgacttatgattgtttgatcttctgattgttaacggctaggatgccttcttcattgaggcgcataccgaatacgcactgaaaaatctatagttttttctcagttcggcaagtcagcagcttatgcactcttaagagtctagggttcgtcaatagaattcatggaatgggttgcacttgaattgcttggtggtgactggcaaatcaatcttttagctggttgacttctaatgctgcaaacgtaagacgatcggtagaagctgatctgtccttacattacatcctaattgatataatttgcctggtgtcccaattatgtaacattgtatttctcggtagacaaaagtggttgcttacttgctttgccccatttttctgaaataatccctctcttttttgcatttgatatgtgcaagtttggaattttgttgtacaaagatgcaataccaattgtaatcaaactgcagggtaactttgagcc

SEQ ID NO: 4865 - DNA, 712 bp, Zea mays
atctagctcttgttttcttcggtgctatcccttgaagtctatagatattcgcaaataagtccttgtagtgctattttagctacaaatgtttattttttttatcgaaattaatctattcttgtttctttagctttgttttaacataattaatgttttagctcagctttttcaccagtttttttattttcaaaatgaaataaaaataatggtttgaataattgattttggatatagttttctttataaaactaaaaaaagaaaaggtttaggctatgcgtttatattattttatggaaacttgggttaccgggtccttgtgcattattttattttatggtgatgacgaaccaaacagaatcttcaattgagttgtaaaaaagaaaaggaaatctccagctatgacgtcaagtttcctccgctcatcagttctttcttggaagtgcctcgatgatgctgactcggtcgtccgtgcactacatataaggaaygccgaattcgacgcggcacattccaaatccgtactctgcaacggaaaaccaacgcgatcaatcaagtccatctgaacccgagctaaactcccccaaaacctttccaaaaataccgtagcgcccggcatataaataaatccctcgcgatgaagtccatctgaacacgagccaaacgcccggccggcacataaatccctcttgagttggcgagacgagttgcgtcg

SEQ ID NO: 4866 - DNA, 1047 bp, Zea mays
tggggcgggcccgcgagtgtcggcggcggcgggatcggatcagcgccgagggggtggcattggcaggtgcggggattgagttgagtcagaagcttggtgtcccgcccgcgcccgcgcgggatctccggatctggtagttgcactagggttcgacgcgggaggcacgggcacgagcgccgccgcgatttgctcggggtaaactcgcgctccaagcaagtgggcactgctgctggtggtgggcttcgattccgcttcgattcgcagctgctggctgctggctggctgcctgcctgctgccgactgccgtgctgcgactgcgagagaagagaaaatcacgcgccgtccacgttggccgagataaaataagaaagattgggatgcccaattattattacgacgtgctgcctgtttctgtttcgcgtggcaactttcaaaagacgcgcgagggcgcgtgtttcgtgtttacgtataaaaaaccgaatcgtaagactcttaattttatactataagatttaaggatcggatcggattaggatcggatcctatttctatttatttttgaattaaaatttatttagggccctactattttgtgaagaaccatttggatcgcgatccattaccacccctacgtaagagcatctcagacggataaaaaaagttagaaaattaaatttgtatcagaaattctaaatctaatctaaagtatgatatatattagtaaggtgtaaggataaggataacactgtgagccttggccttggacatcattcttgcaagctaccctaaggcctaatccagcccggcctcatcgacagggacaaaggagctcggctcggcccagtccattatcctacagcccaaatacgaagcgggtttaggcccgttaacccgttcagagccactcttcgccagttcgcctcggcaaacaaggccccaaaaccctactactctgtcgagccagcgccgtctccctcccccactccattcccactcggacttggaccccaaaaccctagcggctagcgcctcctcgccgtcaccgcc

SEQ ID NO: 4867 - DNA, 1500 bp, Zea mays
agatgatgacaccattgaccttgaccattgccatggcctctcagtttgccaccagccttcaatgtagagtaagaaaactgcatgccgtagtacagggtcggctacagatggaaattgagtgcatgcgtccagctatcacctacacccaatacttcgaacccaagataatgatcaccatatataccctgtgatttgaagagataaaaggttcctggattgcgatggtagacccacatgccataatttgagaataatctcatttcatatgtattttcattgtartctgcatgtttctcccttttttgaggaaaaaatgaaggtacaaatctgaccacaaaactaaggtcagtcctttttcccactaatattttaataacagaaaaatgtcaaacaaaagatgttctggtgtacttcttagttatgtacagcttgtttttatttatttattttaactagtaaattccaactgtacgacacagcctctgcactacaaagcaagtgacaatctttatgtatgttaaataaaaacgaaatgtcaagcaacagaggttcatatacgtcctctatgtgccagtgatgtactgatacatccgttggtaccctatcagttgtggcttcacatattttagttgtggtttatgtaataataccttcacgatttttgttttgtttccatggcaattatgcctctcacaaaaaatataacgccctcacaaaatctcagttttctggtagtggccatatggtgtgaccctagtacacaaagtgccaattagaatcacatttttttgacataaccacagcatctacattgttagacatgttcacatataactaccaaaattccaatgaccttttaattaagagaagaaaccatgttcatctcaaattttttggagaaaaaagggcacagatggatgtcatgctttgaacttttatatataattcaattcaaatattattttgaaaccattttcaactgctattaggttatgaactggtccaaacgtggtccaattcttctgtaaagaaaataacatttcaactgtatttggttaaacctgcaccaaattttgtgtacaattcaaactaaagcagactagatatcatatctgtatctgactattgagagcgtaatgcaatgtctgaaggcttgaaaacaaataggatcgtcaatttacctatatacgcagaacagaagatattgagattcccatttccatctagcccacgtgcactcacaacccttgtagtggatcctgagttcaaaacatgagaatctgtagcctttcaagctttgagccttctgcaaggaggacggcaacgtgtacagcagttcaccctcgtcaagcgcctataaatagtagccagcctagcaacaacgaaaacaaaacatcagagcttgcaagagctacaacttcagtccagctatctaacaagactctacacataaaaaatcagcactagttccgtttctgaggaagacaatccaaaccaaag

SEQ ID NO: 4868 - DNA, 1047 bp, Zea mays
tggcggtgacggcgaggaggcgctagccgctagggttttggggtccaagtccgagtgggaatggagtgggggagggagacggcgctggctcgacagagtagtagggttttggggccttgtttgccgaggcgaactggcgaagagtggctctgaacgggttaacgggcctaaacccgcttcgtatttgggctgtaggataatggactgggccgagccgagctcctttgtccctgtcgatgaggccgggctggattaggccttagggtagcttgcaagaatgatgtccaaggccaaggctcacagtgttatccttatccttacaccttactaatatatatcatactttagattagatttagaatttctgatacaaatttaattttctaactttttttatccgtctgagatgctcttacgtaggggtggtaatggatcgcgatccaaatggttcttcacaaaatagtagggccctaaataaattttaattcaaaaataaatagaaataggatccgatcctaatccgatccgatccttaaatcttatagtataaaattaagagtcttacgattcggttttttatacgtaaacacgaaacacgcgccctcgcgcgtcttttgaaagttgccacgcgaaacagaaacaggcagcacgtcgtaataataattgggcatcccaatctttcttattttatctcggccaacgtggacggcgcgtgattttctcttctctcgcagtcgcagcacggcagtcggcagcaggcaggcagccagccagcagccagcagctgcgaatcgaagcggaatcgaagcccaccaccagcagcagtgcccacttgcttggagcgcgagtttaccccgagcaaatcgcggcggcgctcgtgcccgtgcctcccgcgtcgaaccctagtgcaactaccagatccggagatcccgcgcgggcgcgggcgggacaccaagcttctgactcaactcaatccccgcacctgccaatgccaccccctcggcgctgatccgatcccgccgccgccgacactcgcgggcccgcccc

SEQ ID NO: 4869 - DNA, 750 bp, Zea mays
ttctttattcttcaatcttctttatttgtgctcttctagtcttggacatatgctgaatatttgtatatcttctatgggtcttctaataccttctttgaagcgttgctaacctaatgtcttagtccaagtccactttgtattatgtaattaaataaaagcataataaatagcaatgaaaacatatataattatttagaaacacatcatataggataggaagaatagagagccttatgaagttgctctaagcatctccaatagttgtgtaaatttagtacttatattatagatttagaaagttgctaaaacagtttaaaaagtaaaaaaaaatattcatacgctccaatagttctcttttttggttgccaattttttaaaattatccatcaacaaaaaataagtaggtctattttctatttttaattgactatcgatgtaagatcatacgatcgcgacgacggtatgaaaacctctgacagtgcctcgatatatgagattgtctgacggtgacaatgttaagatgtctaaacgttagagatagatttgtggtcaacatggtgatacgtcaccctcaattttttttaaaaaaaacttgttaaattataattattagaaagttgtttacgtaatatgtcacacctcgtctgccaccaacccacctcctagttcctgtttcaggacgcttattattctccgccgttggcgtcgtgaagcccgaagacaccgatctcacggacaaacttacaacat

SEQ ID NO: 4870 - DNA, 865 bp, Zea mays
tcgagctccggtaccctgaattcaacctgtacatgtatatggaagagaaaactggcaaccatgattgaagcagaaacattagtgggtgggaggagggacgcatagcctttcatgaggctgggtgtagagcttgttcgttttgttttaattcttaccggcttctaccgtttatatcatatttatgtttataccatatttatgcctatataaattagagctgcaacagtctaaacaactgaatttaattcgaagcgaaacctccgcgcagatattgcggcagttggggggctggagctggctgctccctcattatcttaggctcgcccttttcttggcactacatggaagcatctttggcacgctgagtaaggtgattggccggaggaggttggatttgtccggcatgcttgcttgcctgcagaggaccccacacatgagctgagatagaagcgagctctcatcacaagaggcctgtccagtccaggttggagaatctccttcctcctcttcctcccctgcctcgctagatataacaaaccatgccggcctacttgccagctcgcagtcccagcagagaccagagcctccggaaaccgcagcctcttggcctttgcttcctcgcttatctggcgtacaggctaagctagagagggagggagggagagctcgccgtttccgacccatcggcagcgccggagatcctgaaaagaggtgagcatagggcttctatgttcttgcgtaggtttccctcccttgaaacaattgtctgaaaatcgtccaatctgcagtgccagctgagtacctcctgctgctcgaattttctcgtgggacagacaattttcagataaggacgtcagggagcatc

SEQ ID NO: 4871 - DNA, 531 bp, Zea mays
tttgaggcatagacagttcggtcatgtagtttgttcttttaattatattagtcggttacataagattgtcttctaaactcgtcagaaaatttaggcacaatttttttagcactttgccatgacccatgatcccctcccctagcattaatttgtttgcagaaagatgagatgtgcgcgctgtactagttgggtacacatggaagcgcgcgccactgtgactgtgagtctcaggacggacgatgatcactctccattaattcaatagggaccatggtttgctttgtcttgtctctaacgaatgcatccacggaaggacggaccaaccacttgcattcgacagcatgcgcatgcgatctcgtcgggtactgaagtagcgtccacgcctcctgcccccgcaatcacttccacctccctgctctgctttgctgtttgcatcgcatcgcgtcgcctttgctgaatcccagcgacggacgggccgccacgggcactgtacggtgccgacgagcattgcttgctgctgcctcggccggc

SEQ ID NO: 4872 - DNA, 1500 bp, Zea mays
ggagcttgttctgcttaatcaataaggttttggactgaagtttttgtagaaagtttgaagaccatatgttagtgaataagtgcctttaagtatgttgggtgtgatcccacaccaaaagtgaagtaatggctgtccaaagttggactttcagtctgcggtgacagaaggttattcagtcaactgtagctttggtccagtgtgattttccaaatttttggagctattttgtgactaatccttggagtattaagccatatcattataagcagagttgaagaacatatattagtgtgcaagttgatgtggggaggtagctctgtctctatgaagaaatgggagcaaaagaaggatgaatctggctctgcagtcgaactgaagaagttcagagcagttagtgtagtctgaaatttcagactagaaatagtaactggcagagactgaatctcagtgttggtgctcagtttagagtccctgtgcagccaatccctgtggttttgaattgagagttttgtagcaaaatgggagatcatgtataggttcataaattcctttaagtcatctggacctggtactacataaacttaggagaaaaggggtcacaaaatggctctgtcagacgttaatggctgttgattggttcagataaggaagttcgagctcagagtaatgtaccccacttgtgggtactctagatttgattataggtctttttagcctatacaaactacagtaaccgggaaaagctatgtttactgaataatcttggggcaatgaagtgggcatgttgtgttaagaataaagagaaagggggagctgaacttgaggtttcagtcgagtaaaacagcaggagcagtttcagaataatctgatggaagtatctccatccaccaaattgatatagggaattctaggatatgccagcccaaaagagacttatgagaaaggaaagtttattgtcaaaaattcaccaccccgaggatagatgcaggaagggtgtaaagcctatctcttggatgattcagctgcttcactgttgatgaggtgtcatacatgcagtaaaggtgtgctggactttttccctgagcttccaccttgcgtggtaaacatgcaggtgtgtgttggggattgttaattcgcattttccctctgaaatatgttagggactgccggcccaatagcccatggtgcagcccaactatctgatgtcttgtgctacaaaggagcaaggaaacatagcagcagggaattattcagagaacagactcttggttattatgcttcttcttccttagcgtcttcctcttgtacccagatccacatttcctgtgcttctagattcttctagtgtctttctctagtatctgatcacctgcttgctgtctatcctatattctgtctcaaatcatagtttgtgttggagtgaattgagtgtgagttcgtcctcgagattgagtgctgttaacaattggtatcagaggagtcgattctcggttagctcca

SEQ ID NO: 4873 - DNA, 107 bp, Zea mays
cgacctgcaggctgaagatctcactcttgttggaagaagaagaagaagaagccgggggagacccaggcctgaccggaccgcgcgcctgagggaggggaaggacgacg

SEQ ID NO: 4874 - DNA, 1500 bp, Zea mays
ttgcttgtgtgattatcagaagttcagcgatgagttaccgcaatgaccaaatgcccaggccagggtgtgtgcgtggagatccaacacgtattaacgtaataacatcagcaacagtttgatatattatcagtaaacagcgtcgccttctaaatattgagtgccaccgcaagttctgcacctaataaaaggaaagcttgtatgtcttatgcacggtgggtggatggacctcaaagttaggagtaggaatttgtgtagaaggatttgaatcaaagaccgtgttaactgccaaacagcaggctctatcaattgcatgctttagcttcacacaacacctttttgaatggatcgatctttgttactaaatctataatcattcctagccttccaaacgcaccatacaatgtcgggcaatttaagaagacaagcttatgttcatgtacaatgctatggtttttttttctatggttttacttaacgccccgtttggatcactggaattgaattccattctaataatagtaatttcgacatatattaattaagctaattcacttttatacaaaatatatttgtatactattattagcaagatgtcctacatatttatgtgctacatttttattatagaggagtagaacgaagagtgtcatgtaagttacagattagaaacaaattctaatcatgcataaaatcatttcctatcctccaccctatgaatttgagataagcttatatctaaactttagaaagtggtggaatgtcaaattcaaaactaaataagttattttttttgagtgaattccaattcatttaaaatgaagggattcaaacaactcattagagaattaatgaattcgtataawatttgatgtctgttttatatacggcctcttttagatcgagggaaattttcctgttttctatgtgaaaataaactgattcctgtgaattttttatatgatttatgtgaaatttttacgttccaaaggaggtttacacgtctaattcaacgtcatacatttaaatatagatataaaaacaaaaagctaaaaatattattttgaaatggagtgagtagaaaccaagagctaaaaatattattttggtaggtcatagaagctacgttaagtttcttatttttaaaagttccgtattataggctgaatgtctttaaccttcgtttcctggggattttcaaaaacttcattttagtaacattagtataaagttgctacggtgcaagtacgttcaaatctttctgagggacagatgagtgtgcatatatgatctgaaactaacatagggctcaatttctcacaaaaaaattatttttatgcaattagctctatacataataataaaaaaggccaccaaaaatatctcagattccgaagaagggtaaatgtaaaaccttttctgaataaacccccggaaaactagtcaatttccgtttccatacttccggcgcggcggagatcgaatcgagcgcccgccacggcg

SEQ ID NO: 4875 - DNA, 1232 bp, Zea mays
catggttctcttctctggcatcactagcaccggtgaccaaacttgccgtacaaaaaacggggctgaaggaaatcaccattgccgctcacccaaataaagactgttccgttcattgccggttgggtgtggttcaaacgcctaatgatcggcctcaagttgccgatgggttcattctcctggctgagaaaaaaaaaatatacatagtcgctctagcatattcgatgtgcatctcctcgtctgccagcctcgagcaccaaacaccggcgcaacaaacgagaacccgccacgtgtgctaccaccgacaccaagccgtggagcaggaccatacgcgccagtacgtggcgctcggccagtggtcaaaggctctgcggcagcagcaccccgccgcatccgatcccattccacggaacgcccgtgcaattatggcaccgcgtggagtccgcagggagcaggtcgctggtccactggccagtgactcactctccacgctctgccactgccaccatcatcgctgacacgctgctgtaggaaaaggggggcttctcgccggcggagtaggcgcgaagcatagtaatccgtaatcaggaatcactcactcctccaaaaattacggcgacactgcgatgaaactgagggttaggggggcgctaatcaaatgcggcgaggccgcgtcgctataaaagagctcctcgcgcttcctttttcaacttcccccgccccacaaaaaactcccgcagaaccacagccccggcccgtccccgtccgtccacagccagctccgcctcccatccagcgcccgtccacagccgccgcagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactagtactagtcgttaggttggtagccaagagaggttctttttccacacctcccttgcgcaagtgagtcctgtcctgagtggatctacccaccactgccatctgtttttactgtggctgttgggttccgccagtttcttcgtttgttcttggtttgctagagagagaggaaaaaaaacaaaaaaacaaaaaaaaacagtctag

SEQ ID NO: 4876 - DNA, 944 bp, Zea mays
tgggggagcaaaatggtagtgctcgggccaggcgaagcgacgaactcctccggccctcccagagatcccaagtctcaattgacacgtgggcacgctaaagtggatttcggccgtgcgaccaatcctgccgacgcgctgtgcgccccaccgcctcccgcagcaaccggcaagcccgccgagaggcacccaacccgggttctcaagtcactgactacgtgatcctacataccatagccccacctgtcacacggagcgcgacggttcaccgccgagcggggagttgccggtggccgggccccgcgcccacagcgacaggacaggccgcgccgctctctttaccccggaaccacgcggcagtttttccacgcgtggcaactggcaagttacccttccacccctccctgtcccgatcccgtgcacccggtgcacggacacgggccacatcccaccgtccaaaccaccaatgatccttgagcgctgtgacccatgcacctggtccactcgaaaccttgacggcctaccacgcggagtagctgctcggtgcccgtttccaccgccgcgtgctcgtgagctcgtcccgtccctgcaccctccgcacgagctcgtgggttccaaccaccgtcagttcgtcttcgcgatccgtgtagcaggcaactggtccatacgacccgtccacgcggaagtgagccgcgcagccccgcggcactgcactgcacactactcccaccgcgaccgctggacggcgcacctacggcttacctactcgtaacccgccccggcacccctcccgccccgccccgagcaacgcccgctaggctgctgtgctaccccgcagtcccaattccacagtccccactccccaccccaccagctgcgccacgccgccaccgcagcctccgccccggctgcgttgacccccgttgacctccgcccgcccggccgcc

SEQ ID NO: 4877 - DNA, 301 bp, Zea mays
catatcagcaatggaataaagttcccttggcctcaatgtgatgcacgatgctccatttggcactgaaatgtccaccaaggatgtaactctgagatctcaaaaggcatcatctcttgaagaccttttctgggagtagcgttgggaaatagcactatcaaatatactgagtccactgttacaggcagttctacttgagactgtaattttagcacgtgtaccgtagagatattgagttgtttgttgtagttttgtttcaaattgtgagtacccaaacgcaggcacacacaacacatgttgaacc

SEQ ID NO: 4878 - DNA, 89 bp, Zea mays
tggctaactcctgggagctcgtgcgtcggggagtcgggagtggggagtgagcaggcagcagcgacggcgtgaggaggccggcggataag

SEQ ID NO: 4879 - DNA, 383 bp, Zea mays
taagaaaaaaagtaaagttagagggagcaataactcttttggcctcaaagctctacaagtgcctgatgtacgaacaaatttgctttcaacttttttagatatttaaaaacttatttattgataaactatttggatattgtcatgatgggaaatgtacatttgataaaaaaatggaaactcccagaaaatatagaacaaaagtacctgggtcgccattgatttgggctagtccctaaattctctgggcccaacgtctccctccactccccttgtcggccttcgccgtccatttcaaaaacccgcgaaaccaaagcacggcgtcacgaccgcagcatccccagaggcggcaaggcggtctctctcgggcccgggcaccagaggcg

SEQ ID NO: 4880 - DNA, 709 bp, Zea mays
cgtcccggctgacggctgggtccagcggccgatgggtttttaacgtcaccttccctccccatggccaggggaggccggagtaggcgctggtaaacatcgccaacaacaacgacgcacgcagccgcagccgcagcggggggagaggaggtggtggcattggcaagcatcaccacccgcaataacaacgacgacggcgccagcagtccagcaccaaccaccacttttttcgagggaaggcacgaacaggcacaggcaggcgcgcggcacggggtaggaacccgtcgcgattggcccgtccgacgacgaaccggtcgcgggcctcgtgcccgtggtggatctgactccacctgcgcgcggtcgcggtcgcgggcgccttgcttccccctcccccgctcatcgccgcggcgtccacggggcaatttccatccgcggggcgccgccgtgtcgactccatcttcctcggcggtcaatgcgggcgcggagatgagagccggcggcggggaggaggaagaggaggaggaggtgttctacgagtcgcgagaccgcgtgctctcctcctccctgctcctccacctccgcctcggacgatgacgacaacgaccacccgcgacggcgacgggacggggccgcctctgcggcggcggcggcgctcgacgtgtggacgtcggagccggcgcccgtgcaggagcggcgccggaagctgctccag

SEQ ID NO: 4881 - DNA, 551 bp, Zea mays
cgcaggagcatccaccattaggagaatacaaacaactcgtggcctggaagcttatgagacaaggaagtttacgtgagaagcttgttctttattgaaagacaaggtaaagaaacaaagaccgtggagtgcaggaggtgttttttgcaaaatagctacgtaccgttcgattcaatatgtacgatctagatgttatgtgtgcacatgtgcatttcttagctacgtgcattcgatactttgcccctaattaaacgtttcagcgggacgagttgggagagcagcatctgtggactgtggtcatcccctcgcgacgctaatccgctgaaatccagcgccagcgaggccgcgtccacacccgcacacggcacaccccaccatcttcctcgcctacgccttcgccttcgtctccacggtccactatataacgcgcccgcctcgccacatcaccagaaatttccccacacgcgcccacctcctccggtcctcccctctagtcctctctcccgaccccacctctgccgtccgtgcgtccgtccggcaaccgcgacgcaaca

SEQ ID NO: 4882 - DNA, 136 bp, Zea mays
gtagttgtggttcggtagctgaagttcttcaatttggctagttggggttctctgatgtggtcataggaggagttttggcaatatgcttccgtcccttgtaataaatggccgtaacctcatttgaggccaaggtcgg

SEQ ID NO: 4883 - DNA, 444 bp, Zea mays
cgcgccgaaacaatacacggcataggaaagggcccgcctcaaaggcgtccaatgacccaagtctggctcggcccagaccagtcaaatggtcctccccgcgcgtttctccacacggcccatctcgaagacgtacgttgactcgagtctgccccggctcagcccaatcagcttgtcggccagctcctctcgtcgatcgtttccaccaaatccaccggtctgccggccccgtcttccgctccgacgacccggagccggaggtctgtccagttggtagtcgcctcaagcaccaattcgcccctccgccgaagctaagctgctcggtcccaagggcatccctagctggctgaggcggatcggtagcaaaaccgatactgttacgttgccacggaggcagtttgatttggtggacctaacggccttgcggatctcttgggagccagagcg

SEQ ID NO: 4884 - DNA, 611 bp, Zea mays
cgtcgtgcatcaataatttataagaaaacccttacactttttttaaattcaacccgcagtacgtggcctccttcttgtgctcccaaacaaccgcgacctcctccccttctcgcgctcccaaacaaccgtccggcctcctccccttccattctcctccccacgccgccattcgctctgctccaaccgcgcttatagcttctatccctcaccggttgttattcctctccctagataagctttatctcaccaaactaatcacgctataaacaaggacccgatttcatccagtaatcccgctataaacaaggaccagatttcatcctttgcgagttagaagcaaaaaaccaaggtggggcgaaaaggcgaagaagcaagggagaaggatggagcaggaggaggctgctgctttccctgctccttgacgcggaggctgccctggatggtggattcgaggcattccatggcctgccccatggcgtcaaggcgagcaaacccaaaaacctcgcaggcagaaggcaaacgcggctgcgagcgcggcgcccctctcccactcccactccccagccgccgccagcccgcacacccctccctcgcgcgctcagggtttcgga

SEQ ID NO: 4885 - DNA, 988 bp, Zea mays
aaaccaaaaaattgaactgaaatttaaaaaaaaccgaatgtccggccstagtcgcagcggccgaacgaggtcacgtgcgggcagtaacaggtttgtgggctggaactacatgggtaccaagtgttactgggccactactagggccggacctaggcccaggtccgcgcctgcttccaatagctctccattagcgtcgcatgttttgccaaactcaccaatcaacagacctttgcaatttcgtgcttgtaattgcacagtgtggcctaccgaacaaaatttcgaacgcacatggtgaaaaatactataaaccctttgtgctgcttttcataaataccgtgtcaatttaaattgtactatgtaaaagttctgtatcttcaacgatgttattttatcaattttcttggattattcacataacatacattaatggagtaggcttattgcagaaagatgttgctaactttgagtgttatgtttcaaccaaacactacctaagtaaatgatgaagttacatgccaaatttcactgtgtgtgtgtgtgtgggggggtgggggggggggtgttcataactaacaaaatcactagctggaacaaacttctttcgggaagtcctttaccacaacaatattttgatttccaatgtagagtcaatggactcaaacaagatgagagacagtttgccgttcggctctagatgaattaactcaacaatcattaggactttgcaacttcaaatatttcgcaccccttgttgtttgtggtcaggctaaacggttccttagtgtataatgcgtaccatcctttacggtcgcctcctttgggagcatatgctttaacattttggatattcttgatcttgcaccactctgaaccttcttgcagggttataagtttgaagagttcttcattacagaaaacctctagctttgcagcactagtttcttccaagtactgtggaaacagttctgcggcatagtcctgcaatgta

SEQ ID NO: 4886 - DNA, 666 bp, Zea mays
tataggctgattttaccgtgaagacaccgtcggtgtttcatttctaggtaatggagtccagcacctgtggttggaggtggaaattatggagtctaaatcacaggaagacgaattcctcgatctgcaccgtggaggtaatcttgcctctcaacgacctaatccaattcccgtcattgatctcaatgacaactgacttgttttttcttgagactagctcgaagaggtgcggtgctaggtttcttggcgtcaatgtcatcaagccaactgtcgtgacagaatttagctgtcttcccgatttttcttgtttgcacagtacaagacaaacattcagcgctcaatgttccagcgtgtagaatttgtcatccgagcttcttcgatccttcgacggagaaggcgctcgagaagattcaaagaagagtagtcaaggatatgaatataaccagaaaaggacacaaataaactatgcacattttcttcgaggtgccatctgttcggtcgaatctcctgtttatcaactcccttcccaattataattgcaggagcaagagcaaccagaatagagcaagtgtgacccatcttgtgccagtgccgccgttgacctctcaaaacacacataatttcaatcttgttggccctgctgagctctcttgatcaagtgattaactc

SEQ ID NO: 4887 - DNA, 1500 bp, Zea mays
gggggagttatcgggagttttcgatctcttaatctcttatgatcgtaatgttcaaagttacaagagtttctcatctcttgatcttcgacgatcataactcctagagttataggagttccctgtctcttggtctctcatgcccatttggttctttggtctcgcctacataaggttcatcatttcattgttactcggtcctcttctacttctattgtgggccaagttttcccatttcgtttctcgtgcgcacgatcattgggagagcataccttctaaacgagtgtcgctcgagagttcacttgctaaggcgaagggcagcaatcacgtttttggggagtgtccataagcgacatgactgctcactccattagcttcttctcaaggaattggcggtgatgagtgacatgcacgagcataccggctctgacaacacgtcgtgatgcctcgcgctcctcctcgctcttcagcacacacacacacactttatcgacaaggtcgctagcaaggttatcctccactatgaatcatttagggcccttggtgatgttttggtaattaatgacaaccatttgtgcactaacaattctttgagaaataagaatgcaggttagaccacagagaacagaaattcttggagacttataagcattggtcgtgttttagctgagcttgcagttaattgaaaggcatgagagcctagttttttttaaaaaaatgactttagagcatctccaagagtctttctaaattccactttttaaattattatttgaagagtcatttacataaaaaccatttttatatctttcaatttccaacagcttttctatatgttgtttacactctaaagagttattcacgttttatatcattggctagcgagaaacttggaatagaagatagctatatttaaataatcatttagatacaatgttagaaggtattttttatgtaaaaaattatattcatagtaagaatatagagtcagttggagtactcttagagttgaaatgcgaaaatagaactttagagttgaaatcagagatgcacaagagactgagactgcacatgtaaaagttgctcacgcacgcatttcataccacttgacggtgatgaatgtagtgtaggagtacaagaggctgcagatccgatctgttgtggccacacgggcatcgcaggcgtgtgctgggcgcacgcgatccgatgcgacgaaaggaaacgggtgggtgagtgtagcgggggtaggtagctgatgacctctttacatacccagatagacgatgactggtgggtccctttttcattacccccacctccgtggcgaggctcccccacctactaatacctgtcctctctcgctcgcctgtcgcctttgtattcgtcttgctccagccgccgtcggatcggatccgatccaaagcaagcagcagcagccggctcctcctccgcctcccgcagcagccacaccccgtccgtcaccagaggaagaggaagaggagg

SEQ ID NO: 4888 - DNA, 1500 bp, Zea mays
gacacatgagatcaagagatgggaaactcccgtaactccaagagttccaatcacgggaaatcaagagatgagaaactcccataactccgggagttccgatcgagggagatcaagagagggaaaactctcaataacccctatttcctccacatgcagtaattccatgagtggcaaaatatcatcatactccaccacgctacaattgtgcccgcttcacgccatgacacaccaggcctcgccttagcgacaacgtgcgcacacgtggtacatctttatcacattcttaacatctccatgcagatagatatagtataatcgtacaagttaagttaacatctggccaacgtccatattataataaaccataatgtatactttatttaatatgggtcttataatttatttaaattttttatgggtcaaacccacaataataactaacaatgtccaccaaattctagggtaggtattaaacaatctcaaagtcatggttctttaatataccaggattttttggtggagactgttaagttaaacatttgtataggacaagggttacactcattcacaattaaacaataaactatgtcttgaattgacgattttgtgcgaagtaagtttcaccaaattttttttctggtactagaatgctataataaccccttttaattatttagagctattcagagagtccatagagataatagccatggaggtctaagcaggctatagatagaaattaaataatactccagaatttgtctttcatgatttattttgctttgatttatatgcgatcagttaggtggtcgataatctgcagtaattgaatgttttttatgtggagatagagacggaaattgtattccttttatccttaaaaaaatggtagccctcgtaatttgctgggtggacgagacgagaggacaaaccgcaaggaggccagacaattgtgttgtgttgctctgcagacagagaggcaacaaggcaggcgaggacagacagacagactcacagacagggaggcaaagccaaacgaaacgaaacgaaacgagacgtcgtggcctggttctgatggccttgaaatccatttccttcttcggaacgagaatcctctgaccactgacgcgtggcccattcttcccttcatcaaccacgcggcgccggagcgagcctcctctagtctagcgccgcctagggtttctcctccgccgtgtcgtcaccgtccacgcgccattgcaccatctcgatcgcgcgtcctccctgccatcttgcagctttcactgattcaggtaagtaatccctatctcctcttcctctcctctccctctccctctcctctcgacaacaaggttttagatcatcacttctgcacacaactcctctcgagatttcccatctccatccatccatcccgtcgttccattccattccatgcatgactaatccatccaatctttcaggaccaggtacccgtcactattatgctcccgccgagcg

SEQ ID NO: 4889 - DNA, 124 bp, Zea mays
acagctcggtgattacatgcatgctatacagacgaaacgttttgtgcacgtaagggtttccagttgttgaatcggagcaaggtagattagctgcaagctttgtgctctttgtctcctaacttag

SEQ ID NO: 4890 - DNA, 368 bp, Zea mays
tgcataacagtcaacagacgaagtgacgctatggtaataattgaaccaagcccccccgtagctaagtttcagatgcacctgttatcccgtgcgttcgtgcatacgagagggtggagccacatggacatggtggtctccgcagtccccactgttccctctccataccagtgtctctgcatggtatggcacagggatatgcatatgcaaggcatgagcagagtctcagtcacagagcggccgcacacaggccattgcacctgtctccagtttatataacctctagcatttgctcccttatgctgtttctctgaatccaaataaagcatcatcctcccatatgctacccatcgctcacttgaacaagagga

SEQ ID NO: 4891 - DNA, 560 bp, Zea mays
cccaccccacgccgcgattaattaagcgcgcaccggacctgagtacctgacctcacgcatccatcgaccaaaacggcagctccttttctcccgcggcgttgccgtcgcactcgcacgcacgcactcaccgccggcctgagcctaatcctaatcctaatcctaatccacataccgggacaatccagacgaacgagcgaaccaacgcacggacggccaccagccgctgcgtgcgttcgctttcccccgaaacgtgacccgagccgagctgcagagagagaaaggagaagccgccatgaagcagcagcagctgcagctgcctcctagtcgtcaacgttaaatccctgctcgccaagccactactacgactacgagcaccagccccagtttttctcctctcgcccccgttccccgtcccgactcccgaccgacccaacccatatcagaggttccgtccgttggtggcgctggcgttcccgtgagtcggcccgcgcgcgaaggcggccgtgaccgaccgtccggagcttcatgcgccaggggcggcggctccaccccgtcgtttg

SEQ ID NO: 4892 - DNA, 489 bp, Zea mays
agaaatagaattatatatgaaggctctggacatcaacttgcaagctggtttgtgagcaggcactcgttccctttggaaaaggtttaacttcttgcattggcatcatcaccactatagcatttctagctaatcggtcagctagaaaggtattttctgtaggattgtggtataaattttttcttatggtcatatccatgttgatgccttattatccagtccagagtaatatcacattgttccttcatacaggtgatgggctcagaagtcagaactgtcagcaaggatatcacattcatgaacctgcaatgagtcgataagatggagaccaaggaaaagtctaaaggcctccacgtgagggctggttcggtggatagagaaattgaggagatccatgagcagggatcctcttgctatttaggcttgtttggttattccaattccatgtggattgaagtgtattggaatgtattgggtagattttgacttgct

SEQ ID NO: 4893 - DNA, 146 bp, Zea mays
cgtgaacaccatcttaggagacattcataaggggggtcaccactcgatctcgggttgctcatttttgtgaacattactcctttgtgtcttctattaagccatacaaggtggaagacgcattaagggattcagattgggtgttggcg

SEQ ID NO: 4894 - DNA, 292 bp, Zea mays
tgggtcttttccttctctagtgccgaggcccagtactgtgtcatgcctaacggcgtggatctgtcacctgccttaggagctccacagcccgctgacgaggagcactcttgtctattgcgacaacgtcagcgccgtgtacctctccaccaaccccatccaacaccatcacacgaagcatgtcgagatcggcatccacttcgcccgtgagtgtgtcgccattggagatgtgcgagttcttcatgtcccgactacttctcagtttgccgacgtcttcaccaagggactccctacg

SEQ ID NO: 4895 - DNA, 1000 bp, Zea mays
cacactagctatagctacttgatctcctccaagcaacacgtatgccctagtaggcagcaattataataagtatacggggagtgacaccgcgagggtaatgccaaaagaacggcctagatagctagcaagtagcgatgcaaagccaaagcctctctctctctctctctctctctctctctctcagctgctggccgaccatcttcttctgatcttctctccaacagcagctagctagcgagtagcgacgcactggactggagcactgctcctgcacagatatccatgcatatgcatatataatgatgagtgagagagagagcgctctgctggatggccgtcctctggctagctgatgctagggcagtgagagagagagagagaggcctgtgggtgggtggggaagaagagaggcagcagcggtccaggtcgtccaggcacagacagtggccggctgacccacacacacgagagagaatatttgaagggaggaggtggaaggagctgagcctgactgagctcgtggggtgggggtgtggtgtgggtgcatagtgtagtacgtgtgtgtgcggtcatatgtgtgcgagtgcgagacagtgagactggagatagggctaaagagcggcagcctttaattcctctctagctcgcagtctcgcacacaacacatcacatacccggccggccctctctttctccccctgcccgcaggctgagctcccccatagttactagctagcttatattgcatatctcctccccctcctccgtcctcgctagctcgtgttcttcttcctctcatcttttgcttgtcctccattccatcgatctcctattcctgtgccgaccgcgaggccatcgtcaaagagaaacacagagcgggtcggggactctcggggagtcgggggaggctgctagtgctagctagctcgaccatatacagtttgtgggcgcggccgggcgggcaacaagctgctaaggtaccagcataccacccatctcc

SEQ ID NO: 4896 - DNA, 730 bp, Zea mays
ggtacgactaaccttttgtttttagtatattattaaatattacaggagcttcgtcataagaaaagtttcgtgatgaggatatccttccccaccgaaggtcctcgagacgaagatattgtctaaaagcgacaacgacaaatatcgaaactgcagctgaaggacgacgacttcgttttaaggcggcaacaaaggtcaaacatgacgctgagccgaatagaaaaaaaaaactatttataaccagagaagtatcgaggtgtaaatcggccatcatcatcgacaaaacaacgacgatcttacctttcttcagttcccactcgaaaggcccaatcggaactggcctgctggctgctgctgcggcccatggcccaggtgatcgtccccactgacagtcgcggccccaccgccgaaaacttgggttcccacttcccgcccatgtccatctcaccgtctccttgaaacgcacccgagccaggtcgagccgtcgagtcgagtcgtcgacgacagcacgcggcgggcggaaggggacgcagacacgcagttgcaggctcgcagcagcaagtatataatacgaaccccctcgtcaggcccagtaaattttttgatgcactattagtagtagtgccgctgcccgctggtgctgggagctcatcatcattcgtcggtagcaggaaggaggcggcgtggaaggggaggcagatgcgggaggcccaccgcagggtcgtcgcaccag

SEQ ID NO: 4897 - DNA, 1500 bp, Zea mays
actctatttatgcttcaacatgtgtgtttgacttagagatagagatttgagtttgatttgcaaaaacaaaccaagtggtggcaaaggatgatccatatatgccaaaattgaatcaaaataaatttgagttttatttgaagtgatattgcacttgttctagtcgctttatgttgtgttggcataaatcaccaaaaagggggagattgaaagggaaatgtgcccttgggccatttctaagtattttggtgattgagtgtcaacacaagtgcttaaatgtgaatttatgctcatggatgaacaaagtgcaaatcaagagcaaaggtatgtttctaagtcttagtacattggttttgtgtactaatatacttgtctaagtatcagaaacagaaagaagaagaaaagagaagagttggctgtgtacagccaagaggctgtttcggtctggggcaccggactgtccggtggtgcaccggacagtgtccggtgcgccaggctgcctcgacctgaagacgccgctctcgggaatttgccgacggcgtacggctaaaattcaccggactgtccggtgtgcaccggactgtccggtgagccaacggtcggccgagccaacggtcggccgcggaatctgcgcgcgacacgtggtctggccaacggtcggaaggaggcaccggactgtccggtgtgcaccggactgtccggtgcgccagatctgcaacggtcggcaacggtcggctgcgcctgttaaggaaagaaatcgggcaccggacagtgtccggtgtgcaccggactgtccggtgcgcccgacgacagaaggcaaggatggccttccagatttgttctcaacggctcctagctgccttggggctataaaagggacccctaggcgcatggaggagaacaccaagcaaccttagagcattcttgatcatccacactcagtctttgcgcattcgtttgtcattctcagtgattcgagctccgttctagtgagaactttgagatagtcttttgagctcgtttcttggccgtgtgtgtgcgcattttgctgtggatttgtgtgtgttgcttccctcccttactccgtgcttctttgtgaaattcaattgtaagggcgagagactccaagttgtggagattcctcgcaaacgggaaaagatcaaagtaaagaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggcagttattgtgctaacgattaaccaagatttttgtggcttaagttttcaagttttacaggatcacctattcaccccccctctaggtgctctcaattggtatcagagccgttctcttcacaaagggactaaccgcccgaagag

SEQ ID NO: 4898 - DNA, 132 bp, Zea mays
tctttcctaaacatagaaactatagagccgtgtaatgctcaataaggtaactaatgctaccattacaaaaagggactatttgctaccaaataatcacagccaatcaactcagtgtttcctaaaataaactct

SEQ ID NO: 4899 - DNA, 1500 bp, Zea mays
gatttttcggggaaaaaggggaatcaagttggtgtaagctgtagttgctttgttctgacccttggctacctgaatgagtgggtcaaaattaaacaggcactgcgctaattaagtgctgaatcgtgtttggagtctgcacaggggtttgcaatttgggtttgcaattttctaagacaagagggagtagtcagctttcaggttcaggatcgattagtgaatagttagtgtttgtaaagatggagtacatgctagcaatgcagagatgatgattccacgcattgtcgctggtgctaataatctgcatagtattggagtaatacgacctgtacatgcatgcgtgtcgctagacctttagatttgcttgtacctgaaactgaaactcataggtgcgctcattccattgaggttttcgatgtgggctgattgtgtcaggttcagatgcaaaccaatgtaatttcagagatagttaggataggactatgtatcagataaggtccgagaggaaaaagatagtgttcagtttgttgttgtctttcataatccggtgcacccggtgtcatatatagccatgagtttgttgattgtattagtttgttgattatgtatctagattatatatgccctgataagctatgatgtaaaacaatggcaaggattgatactgtgtgtaaaaaggattttttttttcttttttgagttgctaacttgctattatacttgcataccatgagttagtacatgctgttatcggctgctctagcttttggtttgaactcaatgtgttaacgatcgtcaactgtagaacctttccaccacacactctcggtcgaactacgaaaccagcacgagtgcagacgtgcagcccttattttcacactgcatggtcgttggtgcagcccttattctaaaccctaaaccgtcccaacagcaatatacaagaaaaaaaacgactgcgttgcgtggactctcggattttgcctccgatcgttctgggcatctggctaaccacgcagcacttcacggaagcttcgtccctgcagcctgcctgtgagcctgtcgagacagcagtgcagtggtgtgtgtgtctcgtccagtgtcaaccgccacggatcacacgaactgaagacgcacccagccccgatttccactctttttctcgagcccgcaccgcaaccgcatccgccacggcttttctttagagtttccgggggattttccagccgccgtcagctatccctctcgcagccgcaaggccaagtacttggcggaagcagacgggcaccttcctgcgcgctgccgagccgagccgcaaggccaagtaccgtcgcgggtcgtatatataaagttcgcctccactatccctgctaccatctatccaaccgcaccccagcgcatcgcaactcgatcgtcggagcaagcagattaagctagcacccttaaccttccttcgcgcggcagccggcagggcgagtatcaagctcgatcaaccaaccgatacat

SEQ ID NO: 4900 - DNA, 933 bp, Zea mays
gtcaacctaagagagcttttctgtaaagaaaagcgtgataggttgttattgatgcattgttgattctaagcggtaattttttttctccgaacccagtctcattggacttgattcagacatctttactagttaccacatagaagaaaccgcgtcagcgtagatattgcttttaagcaaatgcacatatcgatctccatcgagtgattggatacgcgttgtgagctacttgtacttctttctgttgtagagaattaacaataaaatcattgttcaatcatttaaatgttgttaacctattactactcatagatgcggttattattatatatgtctgatttcactttataagggaaggggtgtttgcacagattatataatccaacaacaaatgttaaactaacacttagtttaaaatttaatggattatataatctggatagattattataatcctaaataaacactccgtaagtctatttttacggtgttttgttacaattacagagaaatactttatatttaactacatttgttatgtttgtttgccaacttttaggtaaataccacacactgtgagtttgtatctctacccagtaatctaacagtattcagtggacctcaaaaaaccaaatacagagacggagagagacgcctgcctggccaaagtggcaaaggtgagcaatgaaggcgaccacatcgatatttggaggaatccaaagggctcctccacaaaaaaagacagacaaaaaaactaatagaaaaattaaaaagaatccattgactcgcaggttcccctgctctcaccatttccacctataaagtcggccgcagcctcctgcgcgacaaacacctcccaacccaatctccccagagagagagagccccaagccaagatccgcgcgaagcaagtcacccggcgaagcaccggctccc

SEQ ID NO: 4901 - DNA, 366 bp, Zea mays
cgattctcccccgcctgacgtcggtctcgccccagggccaaggccccaggcccgcctcttccactttcccgcttgggggcttccacgtttacttacctctccgtccgtcggtccgcccgcgcgcgtgaccgcatcattgcgccatcagcccgccgagccgatccgctctgtcgccgcgccggacgaccaagaccaaaggccaccgaacgccataatggcgggcaagtacgagtaggaagaaggaggttatacactccctgcctgctccacttcactccagagtccagacctctgagcgcacgtcgtacttgtaccgttcgttcgcgccagcagcagccagccaccagcgccggcgccaggcacgcg

SEQ ID NO: 4902 - DNA, 1500 bp, Zea mays
ggattggaaaacctgaccttccgacgaaccagccaaacgacaccgactgagacgacgaactaatcgatccgatcgatgatccgacagtaaataaaacagaacgaaattactagaagtagcaacagcagactagtactctagtatatataccttaagatcgcgacggcgagttgcggaatctttgatgaattttgtttggaagcggtgaagaaaccgtcccggacaatcagatggaagttggagaaatcgcaggacgagattgaggaaggccagaaggcggcggcttggacgggaaggagatggtgggcgtgcgtttccgcaaggaggtggtggtgtggtgcattacctcccttggactctttcccttgctccctgctgccctctctctctcttctctgtcttctctctcctacgcaatctgtgttttccatcacgtactactagcggcgatttcttggtagttaaggtttacgaatctgggttaagattgcgtgtttaaggccctgtttggaagagcttcacttcaagaatttcaatttcgttcgaacttcttcaactcaaacaggtccagttccacgagctttagttttaaaaaaatcgaaactagaggcccgtttcatgaaatttatgaagctccttagagggtgcttcaaaaacactgtttttatatctcctcatgaagctgtacgaaaattatccaccatgccactgattacgcaacatacaatttccgttctctctggcgacaacccactaatcatcaagggtaatcaaggaaacccacacaaatcaattgtactataaaagttggagtccatatgcaagtcaaacgctcttgtaacccaccttaacaatttgctggagttgttttattgtgaagttgaaaaatcaaatctgaagtttttgaagtaaagctctcccaaacacgcggacacgcctaaacacgcctaagatgagagaaatagaaaaaaaatcaaatataaaaacacgtgaaaacaactagtttacatatctgtattatattaggatctattatagacattaaaaataaaaataatccctggttgcatcaatctgatgtatgaataagtattgtgcaatcttaaaaagagtcgcgtgcttcattttttttattagaactgtgtataaaaggtgaagtcgtgcagtcttttattaggtgcacaatcaaaaagtttatcttctatgtttgaaaaatagcttacctgtttctgtatcaccaccaccagaacatgaggagctttgagaattaagaaccgaaagtaaacactgccaaccactcttccgtcttcaaccctttggcaaccagcaaacaaataccagtaccgctccactacttgattgccgcctcactggcaccgctggtccgctcccagttccagtgacactgcaccagaccacccggctccagcgagatccagacccaaaacctcacctcgcagccaacctctgctcggaggggaagggaagggaagggaagca

SEQ ID NO: 4903 - DNA, 283 bp, Zea mays
cgaacaagatcctcatgaatagtgttttgtatttctattatcatgcatgtgtatatatacataacattgttctcatgcttatatacaagaacatcaaacatgatatatatataaagcatacatactacctcatatatgataggtaaggcatatataatatatattattactaatctccttgtttgctttgtacaatgaaactttatattcgtttttgggtaccttaccaacatcttattaaaatatcatgtttctctatgtgcaggtgtaataactttcaaca

SEQ ID NO: 4904 - DNA, 337 bp, Zea mays
gaggagtacgacgtacgctttgcttggtattcagtcagtcattctagacgctctgccaccgcgtccacacatgcccatgatgcttggtatattcagtcaaccgcgcgagcatgcataattctcaactgctgcgtagctgtgaacttcgtcttcgtttttttttttaaaaaaaaatcatggatctcaaatcaccggcaaatggtaccccacgttcgcacgacaagcgcaccaacaaagaaactcagctcgagttgacgttggtggttgagaccgagatgtcaggcgcttctagtagtagtgcagtggtcgtcacgacgttggtggtgatgacttttgt

SEQ ID NO: 4905 - DNA, 1132 bp, Zea mays
gtgtcccggtgtccgtagccgaacaaacatagtggttttagttcctctggaaaccgttagcaagttgcgttaccgttccggtacttcatgttgaaagaaagaaaaacaacacctcaatgttatattgtcacgagtgacatccaatcctctgcataaaaaaacataatagcggttttttacggtgtagatgagaaattttgacacgaaatgggtaaagttatgatgttgtggctgtgtcgctgttttccgctaacccgtgggcgcgtaggctcgaccaaaacaaccacaccgtacctgcgtgcaagtgaaggtgccagacagcaaccggtccagttggcccaaatcgatcgctttccatgtccgtcgtctatctctgctggtactgcctagtacctatatactaggataggagggattttccgtgccgatccaggcatagcaacggcactactccgtactaccaagcaacggcattcataacagcgcaacgcaacacccccgcaggatggagcagcggcgcgtcaggctccgccgcccgtgccgtagcatgcacccgattcagagccccgtcgtcttcgtctgcttggcatcgtcgtcgtcggctcgtcgccgcacatgcactgggtccacacgccagcatccacaccacaccgtgcctggccgcccattggatttggatctccctctgtgctgccctttgtgctagatcacatcggcagattcgatgcttcagtctgcagaattgaataatcacccgctttatcagagtaccaggactgacgctacctacgccgcgtccggccggcgcgctgtcttgtccacccgggccgggaaacggaaacctgccattccaaaccaagcaacacgaaaccgcgggacgaagtttcgttgctgctgctactcactccactccagtccggtccaactgctgcagaattccacatggaatgtgggctccatccagcttcacccatttcacctgcaatgcaaggtgtgtgtttttggtgcgaattccagtataaatagccagctacccatataccttcctctcatgcagcagcgaacaacacaaattaagtagtggagtgtcagaacttgggaggcacaaattaagtacaaagcagtctaatta

SEQ ID NO: 4906 - DNA, 1500 bp, Zea mays
ttttacattaattaatttcagcataaattaaaatattgtgaacaaattaatatagtgtttggaagatacgtataggaggacaaatgggattattgatggatacttgtctttggttttctagaatctggttagtaatgtaactcagtatttctaaaaaacactaatatatatgttttcaatatggtggtcactgaagaaacgtatactgacaagcatatgttcctcctgatttacatggatgtttgatgttagttcacttttgtcagaaagcacatccagctactgttgggggccttcggcttccgaaggtcctcaaaagtatgatttaacaatgtttctggagtacaatgtgtgaacaggtatcttcggacctgagttaaaaccacaacgtgaagaaccacagaaggggtatggaggatggcacggagccgaagctgtttgtagaagagcttcggcatgatagcggaaagaggaaaccgacttaaagaggaaaaactatctaggccccgatagattactatagagttattatcaaaagcaaagggcctggatgtaattttacatgggctgcgacccatgtctataaataggtgaacagtactcccgtactgttcacgctgacttggcatttgtttttgcgtcacgcttatacttttgctttccttcaagccgaagatacatttgtaatttgttatattttctataataataattcatagaaatgagttaataataatatttaaatatttatgttatttctcatactttatgtgaatcctttctcgttgtttgttgtattgatgaaggtttgtccttcataaccttcgtccggaactcgttatatcctaagggaaataatgcttcgaaggacgaaggactttaacgtttaacaatttctgtgttgccttgttcttaattcatagtatttgagaacaagtccacaacattggcgcccacctccggtgaactcacttccacttttcgagtttcgaacaccttctgcaagcatcgaccttcgtcatgccgccaaaaaaagcttcagcgacaggggctgtggctctgcagccgctggacccgaaccaagagaccctttctcatcgagaggcccgaagccagaagaggaaggccactagtccaacgccccaggaggaggacttggaccaagagatcaggactatggagatgctccatcaacaagtacgaaggaagaaggaaaagatggctcggctagctgacctacaaaggcagattgatgaagccactgaagaagtatgtcattttgctcaagatgagcaaaaccgaaggccccaacacagagagctgcaccaagagggcttctacaatgaggatgaatggtatgaagatttccatcatggaaattttgcttttgatgatgcttctcctctgtcagcagaactgcaggctacaacttggccctcgtcttacaagccaccccaactccccatgtatgacggacactcagatccgaagcagtttctg

SEQ ID NO: 4907 - DNA, 922 bp, Zea mays
agaagtcaccagacatgtccggtgtgccaccggattgtccagtgcagcaaaaggacaaaggattctaacggtcaacagctccaaaccccaagggcgagctgacattgcgcgcaccggacaatgaacagtgactgttcggtgcaccaccggactgtccggtgcgcccatcgacagcaaagacatccaacggctaggaagtggttggggctataaatacccccaaccacctcattcaaagcaatccaagtattctgaacttcccgttcaatacaagagcaaacccaacccctcaaagacagattcaaaagcattcaatccactccaagtttccaaaatcaactctagtgcttagagacttgagagaggatcatttgtgttcatttgcgctcttgttgcttggattgccttcttcatttctctttctaattcctaagtgctttgtaaagctagcaagagacacctaagtgtgtggtggtccttgtggggtcttagtgacccgtgtgattaaggaaaaggctcatccggtctaagtgaccgtttgagagagggaaagtgttgaaatagacccaacctttgtggcctcctcaacgaggactaggttctctggaaccgaacctcagtaaaacaaatcaccgtgttcacttgtgttgatttccatttgatttgtttgctccctttcctctctctatagtttccttgctaatatcaatttgagattgctcccaaacgtcatctgcatcatttgagcaactcgtgcaaagagaacaatcttccacactcggatttatttccaacgctaaccccgaccctagtgtgtgtttaagtgtataaatttcaggtttcacctattcacccccctctaggcgactttcaattggtatcagagctagtgcttcattaagagtctaacaaactcgaagtg

SEQ ID NO: 4908 - DNA, 1500 bp, Zea mays
tactctatcgttttgttgttacgctctcttcttcacatttgtgcgtgttgttgttgcgttgtgctcttatgtgcgtatctactcccctccttactccgaattttattgtggtcatttgtgtaagatgtgatagactccaatttatagagattcctcacaaagggatattgatataaggaagacaattgtgacactcaagtttgatttttgtatcacttgagaagggttgagagcaacccttgaccaagggaggtcaccacaacatggagtaggcattgaccgaaccacagtaaaaatcttcttgagttctttactcacttgaaatatttctcctaagttcagtactctcgtaaaggagaaatcaagtgaagagttctcctttcttctctcttctcatctaacttgttttagttcacactaacacttgtgtcggtaccctaaatcaggggtaccctcttctacagcatgaagacgccgcacctatgcaacatctccaggccacgcggaggacgatgcctgaccccaccgcatgggcaggccaaagggcgccacgtggcaaggaaagacagcacatcccagtatgtatcgtggggtctggacctccacacaaggacaccggacccctatacatataagtccggagcctccgagtaaggtccgaacctcagcaaggtcccagaacgaggaagaccctggcgtgagtaggggtctggtgctgacacgtgtccaggccttgcccttcacttcccgctcaggcggagacccgttgcttgtgacccatgacataagccatcgggctgagcctgacgtaaagccgtgcagcgcctacatttactgaggagaggacgcgccgcctgccactgcgctgacgggcgacgtgccctctcagcatttaatgtgtcccgtcccatccgctggcaggcgacgtcaaggtcatccagcaggcggcgcgcttgctgtgtctactggtgaacagtgcacccgtgccaggtagtgcactgtgttatcccttctacaagaagcttccccaccacgcggaagatacccagatctcggacgacaggacacaaggggattgccccggcagcaaatatttatagtcccaagtgttatattctctatgtccttgggcccacatgtcagagcctagtacccttgtgcatgccccccttcagctataaaaggggaggcatgcaacgttacacacacatgcaatcttagatcacaccttagactcgcaagctcatacaagctcacaagcaatacatctcacagtggagtagggtattacgctccggcgacccgaaccactctaaatccttgtgtgttcttgagttcttcccgttcattccaacgatcaagcaaaacgcctaagcccctcctcatctcaggatttagggcgggtgcactccaccacccggccggagatttactcttcgacatttggcgcgccaggtaggggcctaggcattaggtttttgcttgatccctagcccaagc

SEQ ID NO: 4909 - DNA, 110 bp, Zea mays
ctttcttaatgaagggttcatcctgtttctgatagttcttctgattggttactcccaggaaaatkgcaagataatcaagacgggtgacagttctattgccacacaaatta

SEQ ID NO: 4910 - DNA, 1035 bp, Zea mays
ctgtccccctaattgaaaactaaaaaaaatgaaaattggcccaactacggaaggcccacgacgacaacctacgttgctgctagcctgctagagactattgtcgggcttttttccgttatgctgcctatgtcgccactctgcctttttattttgctacctgctgccattgaaatagacaagtctgaatatatacagcacagtcagtgacaatgaggtataccaggtttaatctacaagaggaagctatacacctattcagtcaatcaattagaagaaaaatatttcagcaagtgaaataggagtttgttggtttgctatagaaagaagattctatcaagttaggtagtagcaatcacccattagaatttgaaacttgaacaaaggggacaaccatcatcactatatattagactaactccaacggagcagccaaacggccagccaaagccaatatggctgccgtggtgctactgtagcgattagaaacaggttccaacaacacaaccaaaaggagcagctattttagaggggatgagagagaaaagccagattcgctggttcagagccggcagccattttctcccccttcgtctctgacaatccggacccatttctgaggcttctggccactcgccctgggaaccagctattttagctgctccgttggatacgacgaacgtatggatggccagctaaattactgtggcaagccaacggcctgaatgtctgcccgttttggctagtgcctgttggagacagccttagagtcgggagtgcctgttttggctagtgcctgttggcgacgcaatacctggctggctggctccctgctagccctgggccctggcgacctgcttctgcttgcgtgcctggaaggctggaactcagctcaaccacctctttggctctatccccgtttggctcaagcagctgcccagccttgtctaccgttcaagcccaaacgaaaaaaaaaacaaaaaaaaactcaaaccatagcttcgtaaaccctcgccgccgccgccgccgccgccgccg

SEQ ID NO: 4911 - DNA, 1500 bp, Zea mays
atctgctagctgatttttgttgttgtgtcagtttgtaccggatcatgcaaagattgtgaggttcgtagccttaacaggacagcttacaactgtgtcaaggacttgcagttacaagaaactgtagcatttcttccatcaccagtaaacacttctttttcacgggtgaacacgaaatagcagcactcctgccgctgcttctagttctccatcattcatgaagcgatgactgaaactagtttcagctgcatcattttacctattcctaatgcttctaactgagttaaagaagctagatgactgaaactagtttcagctgcatcattttacctattcctaatgcttctgaccgggttaaaaaattagttgctactgaaactaactgcaaatctgcaacgctttcatccagcatggggcttggtttaggaatgatttgctattgttagctcttgttagttagtgcagaacattcattgatctaattagctttgttgggcaaaaaatagttaatgtcgtggtgttgcctgtcatggtggtacgtttacggttgtagatgactaaattctcactaatacactcataccttgacattactaagtaattagtaggtgtattttatattctgtaatgcaagtgatccatatggttctttgtaattgttttgtaattcccactcaagttctctgatgtactttttgcacttcgcgggctggaaggagaaaaagaacctcaactcatggaccaatagtaggaaaagaagtttaacttatgggaggaaaagactacttttatgtattacatagaagcattttatatatgtgttggaagtcaaattgagcagcgcggacagtccggcgctgaggccggacggtccgcggtccggacagtccgcggtggtggcgcggacggtccgcgcgcgcgcagagccagttagggttcctagtttctcgcgggatttgttacctaaaaccgcgggattaactcgggaaacagttggaaacggatccagacctcccctttatatagatgaagggctacggccgattgaacccccaacaatcgaatcaatacaacttctatttcgcattttatcttaggagtagttctagtttagccctagtttagccttccaatccccaaattctccgtctctcctcgactctacgtcgattagaggagtttaggtcggcctgcccgagcctagacaactcctaggatctctcctccccgacggggtccctcccgggagcgagatccaggcgctgccggcgatcatctgccgcccctgcgcacgcgcggacagtccggccccagggcgcggaccgtccggccgtcaggcagggaacccgtgctcctgcaccaggtcgcggactgggctcaatttctcagttattattgatacaattaataccgctactccacaactgggctcggccctgcttcctccaatcctcttccactgctattgttgttgaaaaaagatacacacacaaaaaaaaggag

SEQ ID NO: 4912 - DNA, 188 bp, Zea mays
aaaattccagcttactggcccacgtctatacccatcgtctctcggatagtcgaatctattcgcggaagcgggcgagaccggtggccccgatagatgtccaggtacggcccatcccagcttcttcgatctaatcgctgcagaggggagatggagagccgttctatctccagtagagaagtcattcggac

SEQ ID NO: 4913 - DNA, 225 bp, Zea mays
ggtcgatcgtggacaagccgccattcacgctagcggatctcaggaaggccatcccgccgcactgcttccagcagctcgctcatcaggtcctgctcctacctcgcccacgacctcgccatcgccgcggggctcctgtacttggctctggccgtcatccccgccctcccgggcgtcctcctccgcgccgccgcctggccgctctactgggcggcgcagggcagcatc

SEQ ID NO: 4914 - DNA, 48 bp, Zea mays
gcccctaggatggcggcagcggggtgtttcgcgtgaatctggtgggag

SEQ ID NO: 4915 - DNA, 1186 bp, Zea mays
ctgcaggaggccggaccggagcagagtcgggcgtccatcgccgtcactcactgtatgtacgtgtgtgcagtgcagcgccgcgcgctaccccgtcggcgtgccacagtgccagtgccagtgccgccgccacgcgtgtgggcctccgcaaactttgcgctgcactgccacgcgcgcgagccaccgacgtgtggtgtggtgtggtcgagaaggaaagcaaggggtgacgaataaaaagcgtggagcctttgacatccatcaacgatttcacgacgaggaacagaacactcatcactcactcggtgggcacggccgccccgcccgcgctccttttcacaaagctagggctactagcactgcactgcactggatcgatcgtactgtactcgagtttaggtcaaagctgggcgccttttttctgtgttgttcttttttttttttgcccataccataccaccgatggatacgagtagtgctgcgtccgccgccgggccggcgcgtaggacaccccgtacgcaatgcacaccgtacaacccccaagcgcctcgtggttcgcgcggtacgtaatcccgacccacaaaaaagtagtactttaatcgctgcaattagacaaaatattttataaaccgcagctggattaaaggtagcgaataagctcatatatagggcaacgactgctatgcaagcagtgcttctgtgtaagcgtgcaagcaaaacatctgatccattagattacgatctaaccatagatataaccatggtttgttaggtgtttttttataaagattattaagctggtggtggaaaggtttaagtgttaaatgtgacttacggttgtatcacgatctaattgatcagacagtttgcttgcacgctggtacagaatgactgcttgtaaatagttggagccattttaaagatggaggaagtattttttaaggtgatatagtaatctatgatagaaattgtagataagggaagaaatatggataaatggttgaagatggtcttatacgacctgatctgccggatacagccaacaacgttgaaaacgggtgatgccgcgccggggactctggctatagggagtagcgacgaccttagctagcaatagcagccagcaggaactgtagattgctgctgggcaacagactgagagttgcttgcgctgcggcagcggagaagagag

SEQ ID NO: 4916 - DNA, 214 bp, Zea mays
tgataatattaagaggtcgacctacaactttagtacgacgacccatcagtagagatatgagcctaattaaacatgccgggtcggatcagatcagatctaggcgcgcatgcatgaggcttcggctataaatataattgctggttcgcaacgccagtagctcaagaaaatacatacatacatacatacatacggccggggtcagtaaacatagaaa

SEQ ID NO: 4917 - DNA, 980 bp, Zea mays
aatgctgaaccagatggttcatccattcatcattcatagaaaaaaaaaatgataagttccttgctagcgccagacaggaacattgcatcagtccatctaggtcccttggtctttgtgaatagagctttcctcttttccctttacgggctattgccactgcttcttaacttctccatacaaatatcattgccaccacaaccaccatcagaactcccattcctgtcatctattcctcatgaatgcgatcatcatgcttacgagccttcgtcgtcacggtgtataacaacattcggttcacaatgtggaggtaaggcaaacatctgctctggggagcacaggatctcatccagttgggcatcttctgttgctgttgcatgctgggtgtcagcagtcacaccattgtcgaggggtgtgatgttctttttcttgaatggtttgtacctggggttacagcagttcacctgtgtttgatacatctgccttgtgacatttttgtgttgagttgtcggaacacatctattatcatctctaccataaaattgttgtggcccttgcatcttatcctatgcatgctgttttgaaaactgcttttgtccccccccccttttttttggtgcactaaactttcatccattagattttttatcgcatcagaactggatgcccatcatgaccggtgatatatccattcacttccaatgatcttttcttgaggatactccctctgtcacagaaatagtgcacctatggattcacgctggttaaacccttttttaaattgactagatttgtagaaaacattagcaatatttgtatctctaaataaatttaatgatactaattacgtacacttcagaagccatgagtctggaaactgggaaaccagcgttcaaagctggagtctgaaaggtaacattctatactattacaagcataccaaatctcagcaaccttggtctgttggataccaggacattgct

SEQ ID NO: 4918 - DNA, 697 bp, Zea mays
ataagataatgacactgctagttacagtgtgcatgtatatacacaaacacacacacattgtgtggtgtgtagtacacgttttaccctgctgcacgccatgatataccttaagcagatggatagggaatatatcttgtccagctctgtctatatcaattttcttttttttatatatatgccgcaataatggcaagcaggaaacatgcgcaacagccccttttttttctctcccatatccagttgaccctgtcggaataaaaatctgtgccaaatatgcacgcaagattgcaacgagattcattcctgatatgagccacacaataaacatatgtagaagcttgacagcgaccgcaatattattggaggggatgggtttgcagattcctgtggattctaagcgcggtttaaccataagcagggcatgatgccaatgcgtcgccgtcatgggcgtccaggtgtgcggctgtgcgctccccagcaactcgctagtcccagccaggccacatctttctcccctctccggtgtcctgtccttccctccctgccatattttaagcagggccgaggcgagctcccagatgcaaacatcctcctctcctcgcagacatcttatcccctcccgatcgaggcccccgtttcctcctcctccggccaccgcacctagctgtcttaacttgccgttcgcagcctcacgccc

SEQ ID NO: 4919 - DNA, 1500 bp, Zea mays
atcatcgatgcagagactagacatcccttttctctcgcgccgcaacatgttcttagttgttgatctactggtcatgtcatgtagatgtcaggtcagatttgtacgtattatttaggtgccgtgaatgtgaagcgaatgtctctgtatgcgtgtgcgttgggtgccgtagttctgatgagcgcatgtggatatacgcttatatgtatgtatgacacgacacaaaacttcagtacagtgatggattatatatttaccggtttggaatcagaaatggaggatgcagcatcctggtttttttttcccgtattgattcatcctgcctgcctgcccgcccgcccgcccgtgacagttgaaattgaaaccgtgtatgcaggtgcagcagcatgaacgatcggtacgagctgttcattatattattcaaagtttcaaacagtggacgactagaataccatggattcttcttcatcattcaggcaagtcatcatatagcagcaatagcctggattatcatcactaatagcaaagcatgtcaaatgccaatgcttagtcgcgtaaggaaaacaactagaacaggattgaatatttacctagcatatcatcggcaaccgatggcactggaacgtcaaatggcgctctggtactgaagacacagaatgtaaccgatgaaacttgcccgccaacccccaccgtccaccaattagcaattaacaatgtcaagagcttgtatcgtgtttaccgttgttggctcttccataatatatgtccgaatctgtgctggtatgggtacaagaagaaactggatgtcaagacatgtatatgtagaccaaaaatgtatcttagccgatttcaaactgcctagcgaaaagatgatcaagctgctccgtgtttgggtgattgcagcattatgtatcttattaaccgaattcgcagaagacttatctctcatggaacagatgaacctattagcagtctacgtatataaagaagtgacttccagactgccatatttagtgattagggctgctagctgtgactgaccgtttacctttgcaaacaatctttcgatctactgctctgtcatgcatggtttttgcatcgtcyattatgtttatttcccattgttgcagcttacgatatcgtgtatacctggcacctatgtttatgacaatgaaactcaccatctttattctattggcattcattttcattcaaattacataacgtatgctagaacgaccgaatacaaattactgctaataaacatcctgcgtacgcgcaatggtgcaccatttaccaattaatagctgtaacggtactgcaagtaatggtcgaagcgttatgttttctctcctctcttcccaccgtacaggatcatatattcatatatatatacacatgcctctggaacggctaattcgatagttccaccacgttacttccatatatatttcccttggattggattggatcgtcggcgcccaaacgaataataatccggca

SEQ ID NO: 4920 - DNA, 269 bp, Zea mays
tgaatgatgccaaagaggttttttccccttcttctttgcgtgtttaccaaaaccatccactatctttaacacggagcaaagtggatggttgcaataaagccgggcccacagaaaagtcgatcggctgcctctctctccgacaagtatttaaaagcctcggcggcttggcgctagccgctaccgccttgttgcattctatctatgcgttgtccttagcttgtccgcccgcccctccctcgtcttacctcctcctctctacggccggccag

SEQ ID NO: 4921 - DNA, 1246 bp, Zea mays
cgggtaggatgactatatacactgtaatataatattatttgatttcgcttcgggtaggagaaaagtcctcttttggataaaaaaaaaacaaagaggacttttctttatgctcgattccacaggaacattacgagagaaaaaaaaaacatatgctaaaatctcattgtgttcttgttttctgtttccctcctacaattaaactaaacacctattatcataaaatctttatggctttgtattgcattttcggtcatattctatttttgtgttattcttttcagttgtatgtcctaaaaagggtctaaatacgatctcaacaatctttgcatcgttaccacaaatacatcatcttctcgttggtgtcctaactaaatcggtgccaacttcaacgtagcttcccctaccccacctccctctaatcacccgtactcaagttagtacatttttaatgaaaattttaaattgaactgacattgctcccgagacactacaaaaacaagggcttatctaccgaacttgttgtgttgaggtgttttcacttgcattttactaacaactatgtatgagtagttatcatttttaatagcacttggatccaaacgacgctactcgagctatgcgtttacgatgttccatgatcttccctcgtggtcggtgggaactggtgcttaataatggtagaagacatagagaagagaagagacacagttgttgaagaaattgaacaaaaaaaagagcgactcatgacaaagaacacagagcgggctaggcaggcgtaaacctgccacacaaacaggcccatggtcccatccaaaccctaaagcagcccaacaagaaccagtaaaccgcccagatcatcatcatcactcaccagtaaaaaaaaacacctactaggcaatgaatgagtgagaacaacgagggttggccagcaccagcagcgacgaaagctgccgcagtcaaacagcgaataaaagccaaagccaccaggccagcaacaatagaagcgagcgagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgca

SEQ ID NO: 4922 - DNA, 325 bp, Zea mays
gtgaatatcatttaccaatgagtcaatgagtagttgacaaggataacctccattggttgattttttggtagtaggatgtgtcctggaaataattcttttactgggccagttatatgctctggtactaaattggaagtgctttgtttgtaggttcttctttccctcccacacattaagcaggaagatttactagcatttaatgactctttgagtaaaactgctagtcctaaagagcaaaagcaacatatgcgaagcttacttctgctggctacagggaacaaactaagagcccttgctgctcagaagacaactaatgtgattacca

SEQ ID NO: 4923 - DNA, 51 bp, Zea mays
ttttgacggcaggattcttctattggcttcggcgcaccagttcgtgcaaac

SEQ ID NO: 4924 - DNA, 326 bp, Zea mays
ctggacaaatgaagatggggattaactcccttgttttgcttggtgcttggatcttatggaagcaccgcaatcagtgtgtcttcgagggcggcagtccgagtgttgctgctgttctggagctggagctggagcaggttggagaagagcgaaggttgtgggagatggcaggggctaaggggcttattttcctagcagctaaccttcctcacggctaatttctgttcaagagttttgttgtttttttatctgttttttgaggagtttaaacctcagtgttatggtttgtaagggcttcggccccgacttttttcttcttcttaaatata

SEQ ID NO: 4925 - DNA, 1158 bp, Zea mays
tttagtcgtgaaggctagagcagaagggggggcactgagaaggagagaagggcaggcagacagagccgagattttattattaagaccgagtaaaacgggaaaaaggaatttcagcatttaacttaattacgtactagtattcctgttttctttgctaacctctcctccctctcgctgtgcagctgaggttcaccaccaggttgccagccctggcactggcagttggggggcgccgcaccgcacgcgcacggacggggtttcgggcggagacgcggagccgtatggttttttttttgtaccgttgcggggagtgggcaactggcagcacgaagcctcaagcctagagatggcaatggggacccgatccccgattccccgcggggaattcccctattagggctacttttggaacttcaaatccccttccggattggagggattgaggtgcaaatgaactaattttatctccaatccccttcaatcccgaaggagatttcagtttctaaactagcccttaggggacgggtatgggactaatttagtccccgcggggatctaaatgggggaaatttaatccccgtcgggttcacggggatggggacggggaaccatctcccgtccctgttccccgtgtacctgccccatgaaactttttatccaagttagtcaatttacttgttaaaattatagtaaaaattcagtgcatgatatgttataaaatagcaaactaaactctaaagtagatgtctcttgtaattttcaatcttgtttgttaaatttgtattaatttaatacaatcaatttaaatttatctttaaatattatacttctaagcgggaacagatatttcgtgaggttctccacgggataaattctctgacggagatagagatggaagaaaaagctttgtcgtgagcattcgcggggacggagaattttcctttcgtccccgtggggacggggagccatttcctgttgccatccccggtcaaaggtataccacgtaagaagaagggaaaaaaggctgacctgtcggttggtccggcggtcaaaggctcgcagcgaagccgccctcacagtcacagctacttctgctcgcccgccactcggagtagcgtagtgcggtgcggtgcggtgcggtggtgagtgacaggaagg

SEQ ID NO: 4926 - DNA, 252 bp, Zea mays
tgtctgcattgtacgtgtcctacagtttcacacgtggagcgcagtgcgacgcgggcgggcggccggcacctgccaccgcgataccgtaccctttctggagatttctcgccgccctttttatcacccacctcgcgccgcactgtgttcatccactgagcactcgcacaagcagggacaaggaagtgcaccggcggcgtcgccatcgatcgagtagatactagatagtgtgtcaggttgctgtcagctagagcc

SEQ ID NO: 4927 - DNA, 1500 bp, Zea mays
ttatgttaccatcattaagatccacctaactatagactgatggcgattgcatgaagggtaaaaattacatctgaatgacatagaaggaattgagacatttgcgatttcgtcattctacttggtttatcagggtcaaactaattgtggattgacgatgatggcatggaagaataagaaatttattcgagtagcctagagagtattatgacatctaagatgacaaataaggtactaggaaaaattgcagtgatatatagagaattttcctattaaataatgacttatgattaggtattctagtgtttgtttgttggttcaactgtagattcatgaaaatatgattctacctatgagaaagttgacgtttgtgaaaaatctaaaatatgtttggttaaaacaactatcaaatgtagattatgtaagagtatgatagcttgttaacatggatgacagaaatctgaaaaatctagggtacccgtttggttagaytagagaaataatctatagtatttaggaatctattctattattgtacccgtttggttgagattctagatttttttacaacgaatctggttgtgaaaactgaaccaaacacgttggcttatagcccatgtgagagcataggttaatggaatagtgtgaaggttaacatataattttttttcgaaatatctctattagtaatagtaagatattacatgttcgacttcgacatctatccatggcatatcccactaaaaaagacgcaatatcatatcttgttaatatttcataatatttgaagtcttctcgaattctagtagtgactactggtgcattcatatttggattcctgcaaatcagttactgattttctatcctttaagcttaggctgtcttcagtagataggatataatagagaatacaaaactgtagatgacactatttgatattgtttgtgaagtacagtttgaaatagagaataagattgttagaaacgaaaaccaaacaaactcacaagcactggatggactcaagagaatttgtgccgctaattcttgcgatgttttctgatgcaatttataacaaaaacaaaggaatacaagtagagtccgagtgtctccacgatatacagaattgacgtgtccatccccacgtccacacaccgcgagtaccgcgtcctcaggcatgcaaccactcgtgctgccactaacccactactgcatggcatccacaaaaaccagagctcatgcgaccactaactagctaatgcatgcaactaaaatgttgactacgtaactaatgtgataaggcttacttttcaacaaagacaagggatgagaattagataggagatctcctggagataatcatagacagactttttattgcgccgtatactagatacctacgtgactacgtcacagtcactagtgttcaagacttctataaaaggtagaccatctggaaaacctgcagaaccagagcgacagaagtaccagtcctgttcagagatg

SEQ ID NO: 4928 - DNA, 630 bp, Zea mays
ttggcacgtaaaaatactttaagggcaaggttatccttctagtctccaaatacaagaaagaaacagaaaataagaaaaataattgaaataattgaaatcaatcaaaaaatgttacgagtgttgtttttacgaagtggacaatttagacgccaaaactgcgaagcgtgttgtttggagtcccagttctacaattttctcctactcgcacgagctgtgtgatgtttctcaagagaggatggagcaattttgaccaaaaagcaagcacaccagattcctgtagcagggccagaattaaaaggccggaacgtggaacggaaagccgaaaggagaggccctcctcgttgaagtgtcgacctccggtcctcgtgtccaacgtggcaacggcagcaacatcaaaacaaaagtcgtcggcgccctcgcccgcgtctcgtaaaaagggctctcaagaagcggttgcgctgcgcctctgcccctgctcgacgcgtcggcgtcggcccccgacccccgtccgcacgagaaaacaaatcgcctcttttccaggagccaaaccaccacaccttatatctgtcatactttctcgccccccgtgagccgtgaccccgtctcgcctcgccgccgccgccgccgccg

SEQ ID NO: 4929 - DNA, 1500 bp, Zea mays
gagcttggtgtcgggtgtagcggaccctaacagggggccgagcgtgtcgaagggaaaccactcgagtggatcccgactcgagacttgaaagggaattaggcttacacctagtccctaattaattttggtggttgaattgcccaacacaaataattggactaactagtttgcccaagtgtatagattatacaggtgtaaaaggttcacactcagccaataaaaagatcaagttttggattcaacaaaggagcaaagaggcaaccgaaggcacctctgggtctgggggcaccggactgtccggtgtacaccggacagtgtccggtgcaccagaagacttcaactccaacttggcagcctcgggaaatcataacggctgctccgctataattcaccggacatgtccggtgtacaccggacagtgtccggtgctccaaggaagcgcggcctccggaaatcgccagcctcgggatttcacttcagccgcttcggctataattcaccggactgtccggtgtgcaccggactgtccggtgtaccagcggagcaacggctatctccgcgccaacggctacctgcggcgcattaaatgcgcgcgcagcgcgcgcagaagtctggcgtgcccatactggcacaccggacagtaaacagtacatgtccggtgtgcactggacatccaggagggcccacaagtcagaagctccaacggtcagaatccaacggcagtgatgacgtggcgggggcaccggacatgtccggtgtgcaccggactgtccggtgcgccatcgaacagacagcctcccaacgaccacttttggtggttggggctataaatacccaaaccaccccaccattcattgcatccaagtttttccacttcccaactactacaagagctctagcattcaattctagacacaccaaagagatcaaatcctcttcaaattccacacaacgccatagtgactagagagagtgatttgcttgtgttctttttgagctcttgcgcttggattgcttcttttctttctcacttgttcttgtgatcaaagttccatttaatcaaggcaagaggcaccaattgtgtggtggcccttgcggggaagttttgttcccggctttgatttgagaagagaagctcactcggtccgagggaccgtttgagagagggaagggttgaaagagacccggcctttgtggcctcctcaacggggagtaggtttgcgagaaccgaacctcggtaaaacaaatccgcgtgtcactctcttcatttgcttgcgatttgttttgcaccctctctctcgcagacttgtttcttatttctaacgctaacccggcttgtagttgtgtttatatttgtaaatttcagtttcgccctattcaccccccctctaggcgactatcacccacctcagcctcagatacctcagatgcccagagacaagcgtgctgaattcatgagaggtcatccaccaacgtttgctcattcttctgaccccatgg

SEQ ID NO: 4930 - DNA, 868 bp, Zea mays
tataatattttgttgtattacacagggttctacaacttttattaaaggtcattcctcatatcttgaatataaattaaagtttcactttagtaaaggtagcatcattataaagcttcaaactatatttttaaggcaatcagagtattttctcgacattttcttggcattttctctacatgaacccttaataacttttgttgaagagttgatatagagtgttttgggaaagtttccatatgttgggtctatgcttcgtcgccgaaggtcttatagaaagaagtgatcctcggatgaagctgttcgcacaagatagccgaaggtgccttttcgaagagcttcggcattacaaaccgacttaaagatagaatgaccttttagtccataaaggtctgagtcaacgttgtaagttcttataaggggcatacttgtaattcctcacaggctgcgtcctgtgcctataaatagtgaacagtattccgttactgttcacgcatttttctgacattttgcaatcgcatttctcggaatacaacctttgtcaaggcataggtatcattgtattttatgattcaatatattaagtgaatattatataatgcatctgtggatcatttattcattcttaccttttactttgcattattctacaacgtttattgaaagtttattacgaaggttcaacttcgtaataagacgcttatcaaccttcgtctaagatccattatcctcaaaggaataatgcttcgcggacgaaggacagtatcatttaacattctatgttgccttgttcttaattcatagcatttgagaacaagtccccaacattggcgcccacctccggtgaactcacttccacttttctgagctg

SEQ ID NO: 4931 - DNA, 139 bp, Zea mays
ataatatgtaagatgatagaagtgaagaaatgaagttacaaataatttcttccaacattgatttcaccattgaagtatggatacatgatcaaatgtacgtcaagaggtatcacttatgtttttagtatagagtacagaa

SEQ ID NO: 4932 - DNA, 503 bp, Zea mays
cgtttaatttgtggtgtgtttctgcattctttgccctcatgtatctctgtgaccaattaaagctgaacaaattaatgccaccaatccatgtcgtcagagttatgttgtccattcttgctaaaagacaaggaaacaataattatataatcaatcggatactgttgttttacatttgtacacctgcagctacggcacctcttccggtgcaattcatttttatgaaccatatctatatctgagactaaaatctgttttggttgcttaacttacgtttgtcaatgttacaagttttagcttttaaataaacatatccgtagcagcacgcactgtgctcaattcactacagacagttctatattttgtccattgaatggtactcaaagcttgagactttgaggaaactaatgctagggaagggaaccacaggacataggactctagttccttgtgaaagaagtcccacaatctacattcggcagtcctaatccgttttaactcacagg

SEQ ID NO: 4933 - DNA, 347 bp, Zea mays
taaaaaatagtttagacctactgggaaaaacatttcaaagcactaactgtagaaacattccatgattcttttgcaaatgggcaataatttaggaataatctaggaataatgtagctctgcaggaggcagaaaaagagtgacgatgcatgggggcatgcagtgcaatggcggcctttcatctgtctagcccttgccgcatggtgcgggagggtgttgaccagccctgagctgacagtcagtcgatcgttctatttatacggtacgctctgtgacccgattgatctccatccatccagttagttagttagttagttagttgagggagaagaagcaggggaggggaagcg

SEQ ID NO: 4934 - DNA, 509 bp, Zea mays
ggtgaatggatgaaattgcccctaccgttcggcaacgaattaaaccgcgctttgctacttttccgtttaaaaaaagatgactccaatctccattccatcatcataaacgacccacaccatgcgctatgtacagaacatcaacaggcgcgctttagcatcttatcgtgtcaagcaatggcgaccctcggatctggccctttaccagaccatacacgatccgggccgtccgcgcccgattttctcgatcaaggcgcctttagtttgttcccgctggctggctggctggctgcctggctaatagaccggatccggatgaaccctagctaataatcggccgctccatggaactcgctcgcgcattccatgcacacatacaggaactgcaggacaggccacgctataaattgaggtgcggcctcttctcagcttccgccaagacagcaacgccccaaccaccactgctggccagcgtagcagctgctgcacacaagagcaaagctagctagtat

SEQ ID NO: 4935 - DNA, 53 bp, Zea mays
tgtataccaccccgctaccatgcccaccattacgccactcttagccggctact

SEQ ID NO: 4936 - DNA, 915 bp, Zea mays
gttttatatgatacaccaatctaaatgtgtgctggwctccggtactaagtcgagtgacactccatttaactgtctcctcaaatatttgagaatttttggtgatagatattttagtccaaaatctctcacctcttaaaatagatctacggagacgaaaataaaaaaaaactgaaattaattaatagaggtagccttgttcattccacggcatgtcgatgatggcaagggttctgctgctgtcggtccagtaaaatacagtaacaacaagaaggatgctagggcaccctgtgaaaacaaaaatagattggtccgtcgcgccatcaaggtcagcgacacggcccacgcggaccctactcttctccttgttccgtgagatccgcggtcgcgctctacaacggcatgatccggggttgcgcttaccatggggccgcacgagcgcgcgctggagctgctcgccgaaatgccgcgccgccgccgtgtccgttttgtttttccccataagaaatagaatatccaatcgaattgtcaagtgctacctgatttgaaaatgtttttccctctaggatgatctgatttcagatctcaccagaagaagcactacctggttattggaatccaaaaatttttatgtactgttttgatcagtgaaattcacacttcgctagtccaacaagctgacaggaacgggttctagacggatcggacggcacacgataacagctgccggtgtcccggaccatcctgtccatccctctataaacggagccctgtccagttgtgatcgagacccctcgcaaccgccggccgattcgagcagcgccccagcagcctctgctccgctgcctctggcgaccgccggagcccgaggaggaggaggagggaagatctcgctcgatccaaggaggtgagtacaag

SEQ ID NO: 4937 - DNA, 1500 bp, Zea mays
attaagaagaagctcaaatggagcaccgaccgagaaaggtcacgaaagctggtaccccgtgcaacatgagagtctgccccctataggctagatatttactcgtgctttgagccctttcagccccttcacgagggtccgtctccataggtcagtccatctcgtgtgcacacgaacagggaaccaatgagtgacctttttttaacctcagtctgaaattcgcttcactaaaattcaaactcaagacctaaggagtattactcacaccaccgaaccaacttggctagagactctttcatatttactttgcatattttctaggtacttttcccgtaccggtgggtacgacctttcccttagaatggactgaattgaggcccatatatattgttttcgcttccagccaacgcgcttttcaccaacgctctttccggagaagcgagctgaaagctgcgttttcagattctgtgtttttagtgcaacgtccgtggttttttacctcatgcggtgagaataagcaagaaaaaagctatgcgtttggagagaaaaaaaatccgacccgacccaaagccgaaaaatcgaagccaacccgaaaaaattccgaccgacacgtcaaacaggtaggcacagactgacccgatccggcactaagcacggatcaaatatgagccgtgctaaatggcaaatgacccgaccttgattcgacccgatgtttgaacagcagatatgacacttctattcaaaagttctgaacacgctggtgttcggtatgtaagcgtacagctgtacaaaagtgaccaaataatgcatggatcgaaataggaaagttgtactaatactatgcagtactgtagtactagtcaccaagtaccggttcaacgactgtaaaccttgtttgaatttttatgggaggaaatagtcagctgcacgtgtttcgcgttaatatatacagcagaggagaagacgcttcagttacatcgcatcaactgacgaccaacgcactagtgtattaccagctgcatgcacgcacaaggcacaggcactgccacgccttggtcgagatccggggggaactgcgacgcaactttccagtaaatggtcttcaatatttggtctacgaactgcggcgcaacgggcaggttttggcgtgcaatcaagaatcaacggatagatagagagactgaccaaaaaggtcgtaacagggaatgacaaaacgtttttggtctcccgcgcgcacgccaccaaaagcataatccactgcgcataatcgagcactaacacgcattgtctccatctatttatatgtaggcagtgtgcgtacgtcttctcgtcgtcgtacacagccacaccatcagagtgcatgcacgcacgcactaccctactccacgaccacgtgtacgggtgtagttataatcatcacgtacactctgcttaatcagcgattaattacaagctttgtaattattacacgggtgatatcacacgtacacgcattagattaga

SEQ ID NO: 4938 - DNA, 1500 bp, Zea mays
aaaatagggtaccaaactagcactaaactgtaaaaaacgaaaactaaaacagttttagtttctgtatttaataattatagactaaaaattttaaaatttttattttataggatatacgttaaaaaagtctgctcaaacagtaaaacttcaaatctatattataaaaaacacattacaatgtattatatttgagacacttgagatggtatcatataattgtttgactaaattttataatataagatactattaaaatagttttttctgcatatagacattaatttaaaacattggaggtgctcttaatttttcgaaaccagtcatttttacaattactagtgatgattactagtgatgggtaggtcacaggcagatgggtaattagttcagatttatatcaaacaagccgttgcacacgacaatcgaagtgtgtagtactgtagtggcaacttggacaaaaaggcaagacgggaagaaaaccgaaatagagaaggaagtgcatcacggcgtcacggcaggaatacgtgtacacgcccgtttctattccagtggcctgttcggttgtaccggaatagaccaggatttattccagctcatcaaaatctatataaattagagaagtaatccggctaggaatcaatccgggtttccaatccctagcaaccgaacggggccttaaggatttgtttgaatttggatttttgggtgggcttcctgaggtcaactagtctcgataaagagtacatctgatccacttgggaccaggccgagtaaggccttgttcggttacaccggattgcacccggaatcgttccggttaatcaaagtttatataaattagagaagcaatccggctcgaaatcattccgacccaccaatccgacacaaacgaacaaggcctaaaacgaaaagtaaaccagctgtatggtgaagcacggcttccagagtccatactagaatactactggatatgggcccaaaattataagagcaatactacagctgaactcgtgttgttaggctcttggcatcgagtgggtgggagtggctaacctcgcgcgcggcccagaatatggtggcatttttaatttcccatttggccaaccgatgcatagcctagcatagcctcgtgctcctcgtctgttcgtctccctcaggcggtcaggcctcagcaaaacttcgcgtgattttcatcttgtagtctgatcaaatagaacacgcaacagtttgttcctatatacgcaacgctggtcgtttttgctgccattcgttccacgtacgtcgtcgaaatgcacgaacgaaattataatgataaaataagaacggtttcaaccgaattcagttttgcagtgcacttgatattcttacagctccgaggccgtcagaaagcaattaagcggcctcacgtcaggcatgcatctaaagctcgaaccaacaatagggacaacaacaccgtggcacgtacattaattatataccaccccccggccctgcagctgc

SEQ ID NO: 4939 - DNA, 253 bp, Zea mays
atgagcgagcgaccaaggaggggggattaattgaaggtgcttcctttgcttaatttgtagcggatcggattaactaggaaccattaatctatccatgatagatggtggtggatcgatggatggatggatggagatgacgaactagagatcatatcagaggtaattttgattttatcaatcataatataatcattctagctactagctatatacagctagctagccagcactttgtcatcgagggtagtaatct

SEQ ID NO: 4940 - DNA, 316 bp, Zea mays
atctagtatttaagtcttgtattgaccaaaaccacagtcaattcctatctttcgtgtattattatggccgggctgtgtgtgctctccatgactacatgtcgttcctttcctgctgagtgttgttgattcttacatcgttgcacgtcagtacgctacgacgacgtgcgctccagaaacattctgcagactctagtcccccggccggaacgcacaggagctataaatagacatgcgaggcagcaatccccttcatccactttgatctctcgagctgatttacgggctagctaggcaggtccgcaggtgcagtccaggg

SEQ ID NO: 4941 - DNA, 596 bp, Zea mays
gttaaggttggtttgagctggagtcggtaggatttggggctgtccatagttacaggtttggtttctaggcttgttcatgttgcctgctttcttgcgctgctctccacgtccgcytccagacttgttacggttgcagaactcttgcacatagattctgctacgccagtccaagttaaggacatggtttttggcccagccttgtctgaattttaggttcgtttgagcttccattgctacgtcagttaaaaaggttcgtttttggcccagccttgtctgaactcttgcgctgaattttaggttcgtttttggctcttcttttctccctttttttatcaaatctattgtagttcaacagccatggtcgctggctacagagccaattaggttctcacttgagctctcgttcacatgtgaagtattgatagtcacgccaatttatctccactttctgcatctaataaattccaagcatttttaccatctaaaaaaaccgaacttgcctgcctgttcttgtctcacaccacctgttaccagaatattattttgcatgaatcccttcctgattttgattctcagtttcccactgcattgcagca

SEQ ID NO: 4942 - DNA, 214 bp, Zea mays
cgccgcccgcccccgccgttccctcacacgccgcccgccgcgcaagagccgtgacctcgtcacgtctgcccgctggtgccgtggccccgtcgacgtccgcccgcacaggactctccgagtgtgggattgagccgtactttttttttttggtggctcgggccgagatccggtactgtatgagggttgccaactagactttaagatcgctgattca

SEQ ID NO: 4943 - DNA, 170 bp, Zea mays
ttcctccttccagattatttaaagccatttccgttgcgtccaggtccagggtagagagagagagaggggatggtgtgagggagggaagggagcaaaggcaaagcagccaacgaccagagagacacggaggctcagagagagagagcgaggaagaagaagagaagaagaag

SEQ ID NO: 4944 - DNA, 106 bp, Zea mays
ctgaccaacctgagccatcacagagaagcgtccgctgcgcacacccaggtccttttcatctatctgtgagccgtcacaactcgtacagtatacttgcgcgccagcc

SEQ ID NO: 4945 - DNA, 547 bp, Zea mays
tcttcactctcctccgagttgccgctctcctcggtttctcgcctcgcaggcacaaacgttgctggtgccgctggctaacgaatcgaagccagtatgggccgagttccgttttctcagaagacttctgagctcaattgccagttagcgagccccgcgggacatttacatgggccacataacagccggcccagtaaagcgtggcgtttataaatcttctcaaccgtctagggcatcgtttgcagcagcagcagcagccgccgacgccgacgtaaaagcccgagtcgctcgtctcttcccagatcctccgagcacaacagctctccgtcgccgtcgccatgggtaacgatctccttgtccttctttctatctcttcttgcgtgcaggtgcagcccgccaatagctgccgtacgcttagactggtttatctgtttgtggcgcaggtaaggttcacggatcgcttgcccgcgcggggaaggtgcgtgggcagacgcccaaggtggcgaagcaggacaagaagaagaagccccgcggccgcgcgtacaagcgc

SEQ ID NO: 4946 - DNA, 469 bp, Zea mays
aaagaaatttactgcttctatgtaaaagaaaatcatcgagcgatcgccgattgcaatcacatcgaccagtcaaccctcctctctgctctcgcggatggtgagaagtgagaacactatatccaagtttgacgcaggcagctcgactgatgtaactaacgtcacacgccgtcagattagtaatcaactaatgatccgacggccgtgcagctggccagctgtccgtggacatggatcctaggtagctgggatgaatgagtgactcatgcacccttatatataaagcagcttcttctccgacatgctcaatacatgtatagagagagagggagcgcgcgtgctaggcaaagccgaaagccttgccattgcccagccaccaaccaaaggcgcgcgggaaggaacgccgctctagctatctagcagccctgaagacccaagtgccggccggccggatccatcaaacgaatcgggg

SEQ ID NO: 4947 - DNA, 1080 bp, Zea mays
ttaagcggtgggtcataaaccatggaagccatacaatatgacgaatcgccatgaatgtttgtcaacttcccaagttcttctcacaagccgtctcaattatgagctgcaagttgcacgctggtatagtggtatcttattcgtaagtacgctgtctactctttgtaccctgtgttcataaggtttagctagaccatgatccaaatcctacatggcataacttttctacttctcctttttcttcaaatgcaaattatgcaatactagtacttaaattccactgctgtttctgaccagtttttttttaactaactgtgcaagcatacaactgcggaggaaaaactccaggtcgtgtatgtttcacttcactaattgaaaattactgccagaacatggtaattttataaagggtgccttcctccaacatggtgtgctgggcagctggatggtgtttgggcgaagaagatgaagggcagagaggaacggagacggcctttgggcggcggctgcagataatataggaactgctggcagccgatactgcttgcgagttacccccgccaaagctgctggccgctcaagcgccggttgtcattcctggtgcctccatgggccacgagggcaccacacagccacaactgcatgcatgccttctcatgatccaaggaaaggaagaagacaggctgagatgtgtgaggagaagaaaaggaagggcggtgggcccaccaagaaacaggagcatacgtgcaaatatgcgaaaccggagagcagaagcaagcagttgtcaattgtcatcgggaggaggaggaggaggaggagaagaagatagggcctgcctgcaatagaatccctctggaatctggatgatggatggctgtcttttgaacacaccgccacccaatcactatcgtagtatctcgtcccactctgcaccactcaaacccgctgctcccctctgcatttcacccgtcctccacctcctcccagacaccacaccagcgctccctttctggctgcagcttccccggacagctagctgcctgcctctcactcgagagtcacagagaccacccctagctaggg

SEQ ID NO: 4948 - DNA, 1500 bp, Zea mays
atcgatctatcgatgaatttgggccgttttgtgttatttctcactacaactgtcccaaggtatcgaggatgagcaagtaccaatccatcaatcgtacggatctgctataccagctactagcttctgataaagaccgaagcatcatgagagaagaagctttgcattactgcatgccgcgaaccgtctgccatactgtctattaattacacgaccaatggcatcatcgaaaagcagatcaagcaaagccatccagggtctaaatccccgacctttttctagctggccccgcagcgccctccatatcctcctatgttcgttatatatatcccgcctgtctcgatcccccctctcctttttcatcaaatgactatatattcaagcgaacgaggataaatctagacacatatgtaaaatacatccctcaagtctttgatgaattcaccgttgacttaaaacgaaatttattttgatacggatggagtattagattaaaataaaatatatttttacagaaagcctattgataagatgtagatattatagactttaagaaagtttattagctggctgggcatcgagcatccacatcttctttctttgtatgtaaccatgtgatgaaggcaaggcaacggcacccacggtcccacgcctgttctggtctggtctgatgatgtccctctctgggtccagtctcctccaggtccagctcgctggatggagttggagcttggaggggcagacatgccatctctgtcgtgggaggatggacagcgagggttctgtctcgtctcttgctcttgttgcctcaccctttcctctcatctccgcatgcggtcttgtccgcccttccccttcattccttgccttgggtccagtgcctccctttgttaccatctgccagaccgcggtggaacccaggttcttgtttgccattgccacctactgctgttgtaactaataataataagaacaaacaaagctgtgttattaacctgcaaagaatacacacatctgtgtgactgtgtttaataaaacacacatttttttcttcttttctgacgacgaatatatcaatcatgaagggggcaaaaaaaccatgcatgttgcagctagctaatactgagtaggaaggaaagacactgacacaccattggcaagggagagaagagaaaagtgagctgggaaggaggctcaaggagtcaagtcatcattgcagcaagtagggtggaggctggaggggaggggaggggagtgtccagtccaactgcaggcatgcatatccactaggcaattattattagttaaactgctccgcttccgacgccttcaactccatcgcctcttccaccacaacctaaacccaaaaaaacaattggcagcgcaaccgcccacagctcgtgacgaggcgacccaacccccccgtagcggcggcggcggcggcggcgagcaatcctccggtccggccggcggaaacactagcggcgggaggcagagcgtcca

SEQ ID NO: 4949 - DNA, 207 bp, Zea mays
cccctgagcgtccgcttcttccggccatcgctgccgccgtgcagccagtcgtagaggctgccgttctccatgtactcgtacacgagcatgccgccgccgccgccgcactcgcgggacgtgacgaagccgagcagcttgaccaggtgccggtgacggacgcggcccaggatcttgacctcccgcgcgaagctcttgtcgtggagcagc

SEQ ID NO: 4950 - DNA, 248 bp, Zea mays
cctaaatagcgattaaaatttaaatagacacactttaaaagtttcatggaccggtcacccacgcctaaaaaaaccgtaatagcaaaaacgactccacacggtccacggcgtcttctccggcgaaccttcgcgagccctcggctcccctctaccaccgctgccgcgaccccgcctccggagcatcctcgggtagcgctctggcttcccgtgccgccggacgtcctgcaggaggcggcggcctccgtggc

SEQ ID NO: 4951 - DNA, 489 bp, Zea mays
cctaaatagcgattaaaatttaaatagacacactttaaaagtttcatggaccggtcacccacgcctaaaaaaaccgtaatagcaaaaacgactccacacggtccacggcgtcttctccggcgaaccttcgcgagccctcggctcccctctaccaccgctgccgcgaccccgcctccggagcatcctcgggtagcgctctggcttcccgtgccgccggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccctggggcctccttcgaccccttcgatgtcgataccgacccgccatcacggcctgagctgacgcccgagcagatcgggctttgcgtcgacgcgctcgcgcatttcgagtacaaggggaagcgccggg

SEQ ID NO: 4952 - DNA, 109 bp, Zea mays
ggcaatgataaataatgtgacgcagttggcaaacaaatctccctgtcgctgaaattggtatgataacttttgcgcattagctgaccgatttcatcttcaaggaagcgac

SEQ ID NO: 4953 - DNA, 1323 bp, Zea mays
ttgttgccttgttttcaaatgtcaatggtttctctaagagactgtggagaataccatttgagataacttttgattgtaagaatgttgtacctagaaacttaaccagtttatagaaaaatttattaacgtctaaagaccagacaaatacactaagggtgcgcttggtttgaggacaagagtggatgggatatggccatccacggatttagggatatggatatccatgttgtctgtttggttggatggatagtgtttggttggatggatagtgcgagccatttttctgtttggttagatggatgaaagtggatgggatgagaatacttgactaattatatttatattatttaaaaataataactaactattcgctaacactactttttgtcatgataatcactaattacaaaaaatatgttaattagcaccataattatcctaattagcatacaaaacatgcactaattaacatattagcacttactccctccatcccaaaacataatttgttttagactaaacatacattcatttattaacctatgaatgtagtttgtatgtatgtctacattcattatcatccattcaaatgtggacagaaaaaaaaaatatagctagaaagaactattttgggagtgagtaattttttgtgtttgtatgtgtgcacggaccgacaaaaaaagtggaacaactttttttatggataattatattttaggtatactatatacacaaaatcaaactatatgaacactgaatacaaaataaattgattggtagtaaactcttattttgattatagggagataggataacctatggattgttgctcttatgtaccatttactaacctgtaaaaacaatgcgcaggtctacatttggaagaggcacgtggagatgccgattaaggttctacatggccacacgatgattgtgaactgtgtaagctggaatcctgcaaggccccacatgctggcttctgctagcgacgaccgcacggttcgaatatgggtagggcgcaaaaatgcaacaaagtaaacgctgttgaagtgtgaagttttgtatgtctgtgtaaatagttgtacatctggactgcatccacaaacctgtttgggacaatgctctgttcttcacccctgatgaatatgtcgtcgtagctatttgttcagaaataaacctgcaacagccataggtagccggtgctgctgtgtccagatgtgtgcctggctaaccggtgagttttgacatgtgtacaggacaaagatgcatcagaactttgtacatcttgttagtatatgccttggacactcgaagtgctgaaat

SEQ ID NO: 4954 - DNA, 446 bp, Zea mays
gcctgagcgaaggcgaagccatgacatgtctctctctctctctctgtgtatgtgtttgcagtcgaatggtgattgccttgcctgaataaaaataaacctctctctgtatatctgagcgaatcgttttggaaatacgagcagattccatccaacagcatgtgactgttcaggttcagcacagcacagcagcagtactccaactgaaatttcggaatgaaaacaggtcatttccaaaacgaaaacgaaattggctggcccacgacatcggggcaatccaggcccggcccaactactcatcgtcatctttattccacacttccactccccatccccacatccaaattcccaatcccaaccccaagtcacactccacctccgcaaccaaacgcgctagggtttccgcaccgcacctctagtcctccacccaccccaccccactaccggcg

SEQ ID NO: 4955 - DNA, 416 bp, Zea mays
tgcagccgtcgtcggccagggccaggccaccaacggcggtggacaggacagggtcagagccttttccacgcgggaaccttcgcggcagcgtcgcccccatcctcatccggaggagggcacggggccacgcctggaccgcacgagttgggctacgcagcgcagcccatataaacgcgttccgagaccctccaaccgccttggtggccaaggaggcaaggaaacaggcagctctccacggacaacgcgattctatttagttatctggcggctgccagtgccagccagccgcctttcgaaaccgagcacgagggagccgacgtggtggtctctggaacctggttcgagcgagcgagcgatccatctatccagccgcccgccgggaatttctgtgacgaggaggaggaggaggagggggt

SEQ ID NO: 4956 - DNA, 1196 bp, Zea mays
gcttatctactctactcacctgcacgacggggaattgcagcaaccacctccgacggccaaaatagcgcgtgacgaagatggccccaagcatggcgcctcggaacccaagcccagcgatggccgcccactcggcatcctcgggtagcatggccgccgcggcgcccacgcaaagtgcatcggccacggtgaagagggcggttgcgagcgcgcgtcgcggcagcggggtagaccgcaggtggccaggtgcggagacacggagaggaggagctcgtggcggcgcaagcgaggaacagatggaaccctaggaggaggccgaggagcgggtggcggcggccgcgcggggacactgtgaggtggagcgcgagcatcctcgtggcggcgcaagcgaggaacggatcccctaggaggaggccggttgggacgccgaggagcgggtagcggcggccgcgcggggacaccgtgaggtggagcgccgaagatgaggtccaccagcgctgcggcgtggtgcgtggatgcgacgacgacgaggtccacgtcgtccgaggatgcggcggcgcggggagcttctccatgtcggccacacactcgccggggtgcgtgcgcagcgaggcaggcgggcgtcaraggaggtggggtgggcggcaggcgggcgtcagaggaggtggggtgggcagaacggctggggcggcaggattaggacgcggggtggaaaactggtgtgcgggattggagggctgagatcttagaacggtagaatagacggctgagatcgcagaatggcagaacggcagactactcttagcttcttaataagtagtatagattctgttgcaacgcacggatagactgtacacgagagggaactgagtattcgtgatggaggcgtaggaaaggcaggcttaaatcgagccgcttctgttttttttctattcccgtctagcggtctggatccaatcatgcagtccaagtggcgcgtaaaatagtcgccacgctcatgctcaggcccacttgtgacgaaaggaaacaactagtccgacccataggctcggtcagcccaccccagacctttccccttccgtccccggccggcgccaacgccactccagtgagccgagggcggagacggtcacggtgggcagagtgacacgccgcacgcctctccgccccgctccgctccagattgcgcgcacccaccc

SEQ ID NO: 4957 - DNA, 402 bp, Zea mays
ctatctcatttaaataaggtttatctatatagtatataaaaatcgtagtaacgtacgggcaggtaactagtttgagaataaacgtacggtcccctaatgaaaaaacgcaacgaaaccaacgaagcacaaataataggattttcaaaaaggaaaaagattagcaggaggactggaggagcgcctccgcacgggcacgggccggcagcccggcacgaagcggaaaacttgaaaactagccgagcgaactgccgtctcaattcaaaatcccgtcaactctcacccccatatccctccccgtcttccttccccccatttctcccacagacttcggcctcccgaatctcgaaccctaacctcatcggcgacgaggggagccccgcctccgcctcctgcttctctgtt

SEQ ID NO: 4958 - DNA, 283 bp, Zea mays
aactgattcctccgcctcttccgagttccccagaatccccagtttgatgctgcctctggccccctgcccaccgattggatcttggtcgatttctccgttcttcagatcctgtgcgcatccgctctaggtagtggccctttgctcggctcccttcctcctccttcgcccatgctcggatctttcaatctgcgccggttttgagttcttgcccctgctagctgccggccgtcaaaggctagagctttaatttcctggcaaagattggggattcctgctcgcgagg

SEQ ID NO: 4959 - DNA, 85 bp, Zea mays
aactcagttttggttgctagagattcttctgttattttagaggttgctcttccccgtgcatgcagtagatcgcgtgaattcagag

SEQ ID NO: 4960 - DNA, 923 bp, Zea mays
ctatgtttcagaaaaccagaagaacccaaagtgatttcggttgtagacctaaaataccgaactagccggaaaaacgaaatataatagaagcacaatagattcatagaattttaggcatatttcaatatagccttcctaaatactaagtatataaagcacacaactcctctaaataaatccatctgcaaccctaatcctccataaagcccaagatacaaaaagcccactgctatttgtcaccgaaagaagcgtcggatcctgccggttgccgaaaaacagcggacttctctagcttccagtttcgcaatcgtgcagggcagaacaggatcgtgttcgattacaatccatcactagagtgtggcttcacagctcactctatctggtggtgtactggtatggccggatcatgtacaccctgtatctggtgtgaacacgtgatctttctttatcacgcaattcgtgtttgacgctacctgggctgggccgtcggctatggacagattccttgcgtgcatcttccgaagacggttacggttaattccataaaacaaagtgggggaacaaaatgaacttcaataaaacaataggtgatgcaaataaagatacacgggtttagttgcctcttgctgctcgtcgtttccagccccaagcttgttcagaaatcagagccccatatgtggcgccaccgccacgcaccgacgcacgcccaccaccacatcccgatctgggcgttcggcctacgccaacgcaaaaaagagcaaagctccttctttccatctgcacacgaacgcgcgcaacaccgcagccgcgcttacaaatacccgccccaagcgagcgaggtgcccgcctgcccggagcacgacacgagaacaccaccaccaggcaccacaaccaaccgaccgatcgaagccggcagacaatca

SEQ ID NO: 4961 - DNA, 1500 bp, Zea mays
aaccacacacaaccaactctaggctaggcaatgacttcattcaaaccaatagataagtggtccaacaatggctccacaaacatgcatcggggagagaaccatcagatcctcaacggattaatacataatcaatggatcaagaaaatcaaagatttattccacaattagcatgacaaacatgcaaccactttaaatcacatctaggctttgtggctactaaaacacaagatagaagagagacatgtaagccactctggctagctatgtaaagacttcccccaaaatccatataaaagtaccaatattcatttctttcagaactagtttctcgacataaacaatcattctttgcaaagatagttggagctatccaccaaccgcccaacaacttaaattcaaattgatggttaccttgtaacccaaaacacgcaattcacactcctcttaggaacattctcaatcaagcatatataacaatattattgcaataaaactcaaccacgaaaaacatgatgaaaacaacataggcatacttgtatatcacaagcataataacaacttcgatcttaccaaagaccaacaatatcaatcgcattaataaaacaatataaagatttagagataaaacatattaggcattaagtcataaacaacttaccacatcaccgtaaaggaatagggaggggtgaaattattgtcatctgcacttcaaagacactaatatatatcaaagatatttgaacccatacccttcctatatgtgcaagtgtatcaaatttatcttcaaattgccaagaatctaaagcctatgctttgataccaactgtaacaccccagagtccacaaacaccccggaatgctactgaactacacatctgacatccatatataaaatttcggcagcatctcctttgaaagattgcataaacgaggggcaacagtgtataaacatatatcatgacaaaaaacatactaagcattattaatatgctagcaaaggaaagttaaacataacaacatgaactgaattaaccagtgcacacgactagaaaaaaacaaacatcatttgacatcgagtttctaattaaatcatggctgcaactgggcagcgttattataatagtgaaggtggacgtgctgctacttccctcattcccaacatgaatcaaatacctgcattgagtaatgcaagagggagatgatacatcttagcaagcaaattattttgacgagatatttaaaccacaaattgaattaaacaacattttaaaggaatcccaattgagatcagaaatacttgtagatatagaactcaatagtcccaatataaccaataccatctcatttcctcgaacaaccacaataggttgtataacccttccctgcgtcaacaatacctgcagatatcacttcaatgtatgcataggaatgcaatgtgtaggtcatctgccctcatacctctgagagtataaaaccacatcatctgctaatatcacttca

SEQ ID NO: 4962 - DNA, 381 bp, Zea mays
ccaaatacagatcaaatcgacaacaaaaaactgattgtaagacgctagcattccaagttttcagtcaacttcatcctagatcagcatcttcattgttccaaatcatcaacattcaaagatccagagatggaccaaaattcagtgttcaaaaatacatattttttgccatgttcatatggagtaatttatgttcagattgagcatttgaaaatttcatcagtacattcatcctggaaagcagttgtactatttatgtattgacatgttagaaacaaattagtggcagaattatattctgggaccatgttacagcacttcttttgacccgaatacatgaagccatgaaagtaatggttgaggggagggggaagcaagtacctg

SEQ ID NO: 4963 - DNA, 1500 bp, Zea mays
acacaaatatatatactctaaattttgtgtagtctaaatatatataatttagattttgtgcaacataattaatcaaaagatataatatagtggttgctaatatatgatccataactctgttgtagtatgtcaaccaaaatttaaaagaaacataatataagataaaatactcgttaaatgaccaatcaataatatgagacgtcaaagctaattcgctagcagacgttgatatctaaacctcacccctttatgatttatcttatcatctggctggacatctatcgattgccgccgaccatttgacttgactcttccaaggccccacgaccaaagtccagagaaggtgtttacgcgaaacaacagaataagcgccaacagtccaacaacatcaatcaccagaaccatatgtcataaccagggcatccgcatagactacaaaactagatccaaatatggttaactttattattttggtattgttaccgcgacaactttagttcaatatatcaattagctagaaaatagattcatggactaaagataatttataaagaactaaaaattttattccatgtcgagtgcttaagattaataacatcatataatattttttcacccatatagtattgatgaattagtcggtccccttatattgtaatcctagctccgcccttgctcacaatcacaagagtgttttcttgaggctgccttacctagcccccatcccataagccatcgacacgtatccctacatctcctacgtcgtcctcctggcctatatatgctacactgcacggcgtgtgctctctctcccctttgccctacgattgactcgcagcagcggcacgcgtgacgcgtgcgagcgagaggacggcgtccagaaaacagccgctgccacgtgggccatcccagaccatgcaggtacgtacggtccagtggccagggaccaatcacgtcgccgctggctgtgtttaacaagttagctgtgggagaaagcaacagtgatagtgagagagaaaagcacaggagacctccgtcgtcgctgtgttctctctctacgcaggccgatggacaggtgaacagagaccggccggaaggggagaggacgggagaaagagagagactttcactgtaaacagacagacttgcgttgcgagagaggagacggagagtcagagaccgagagagggacgatagaaggcataggagctaggagcgatgaccgtacgcgcatatactaggagcagcaaattaaaggcatatataggcaaatagtagtagtagcgagtagcgacgggcgagagagaaagcagtgctactgctacgactactccttagctcgtagccgggtagaaggtgacgagagagagagagaaagggggagagagatcttgatctagttctagtagactgctagcagtgaacagggccggtggaggagctgaggtagctgggaaggagaaggaaggaatcgaagaaaaaggcagcaaagcaagcagg

SEQ ID NO: 4964 - DNA, 1076 bp, Zea mays
gtgtttgttattgtatttaatggcagatccaaaatcccagggaagagaagcatgtgagaaagagaattgtgaacggatgcaactcgtcgtacacaaatcatactattagctaagccttaccactctcattagataaatagcatcaacctctatatacaggaagtatgcatataaactttacacccaccccaaataaatacccgaaatacacacaagttgggaatattatactatagaaaagccatagtgaccaataattaggaacatagggagtagataataacgttaataacaaaaatcacctcccatggtgcaggatagatacagtagttttacgtgatatagtagtaagaaaattctttttaagaaataaatggaatccaaaataaaattaacaatagcataatattttgtgaactgcgagcactttaatgcttaacacatgtataaattagtgaatagtgaacagatcaatgtattatgtattcctattaatgaaagcactaaaaactcaatcagtaaaattaaacaaagccaaccagcaaatagcttgataccttcaccgcaaggggacaygcgcgtggagatgtggagaaccttagtagggatcytgacaggtcccttaaccctcaaatgcttatccttggctccctttaccaaatccgcacaatctaaaatgtactagaaatygcacatatttgtcacttcaataattcattgaaaataccaatgaacaaatgcagaataatcagcctaatgatagaaggtagtaagtatatatactaaagcagatgagtgcaaatcataattcgaatcgcgcatttatttgtactaattcatgaatacggaaactgtttgctagatgattgtactgaattgcattgaatgatctgaaatttctgaatcctcactttgcagagatggacacatcaagccctgcaacacttgtcaatgcacagatgcataacatgtttgttgggtgaagagtgcgcacggttgttcaagtccaacacaatgaaggtggagtgcttgtcgggcagtccaccgatgggcaccagttgtgtgtcaaaagtgcc

SEQ ID NO: 4965 - DNA, 805 bp, Zea mays
agtggtaaaacaaaatgtgattgtacagaaacacataagagttctaggcaaatggtaaagataaaacatgtgacaataaaaatatagttaagttgccagctatgaatttttataagtaactataatcggtactctgattcatattttatatttgaaaaatcattgacttggtgatcatcggtgcttttactggagatccctctccaaagtttcaaaaggcaaagaaggaaaatttaaggattgcaaggtaataaaggctttccagcaataatgctagcaactgtattttttatacaggaaaccaatcaaatcaactgcagttcctgattacaacaaagcgaatggaagtaatcccagtgcatgtataaagtggaaaatgaagccataaatatgagctcaatctttggcgtacaaaatctgttgaactacaagactctagcacagtggtgttgtgtcgcccacatcgccagtttaattccattgcagtttcacactaaatgtgcctcagttgtgttgtgatacggatacgaactaaacggtaagtcctagtcctagcaaaaaaaaaggaaaatactgcccgccgtcaactaattgtccaacgaagcgcataaaaatactaacagggtatcaacatttcccaggatcaaacacaatctccgtcccccttccctcgtccacatcatttcccaccaaccaaggattgcggcaagctgagaatgggaaccggacttacgggtctcgggtgatctggcggaaactcctgtagtcggcgccgctgtgcgacgagctgtccgagtccatcgac

SEQ ID NO: 4966 - DNA, 1434 bp, Zea mays
tggcgacaaacacgcccgtagagtgtggtcgtggtcgtacccgggccgggactgaacagcccaactgctccagcttccagtcgttctgacagcatgcctgaaccaccaggctcctcgctgacccctccgcttccttcccgccaagcgaaagcgccacccgcgctgcccctgccccccttgacgccttcctccgatcctcaacaggatacacccctcgcaacagaaaccccctccgccgaggcccgccgaccaaacttctgccagtaccgcttgcaccttacctgccaagctgcgtactgacggaacgccttgagcgagagcgaggttgcgctccactccactccactcgccagttcagttcttgcttcctgctcctgtcgtggtgccctgagtccctgactgcgaggagctagctatgcatccccgcggtggccgacgaactgcgtagcctgatcaaacaggtactgaatatgttctctcaccttggttttgatgctcttctgtttcggattattgggatgtctttgtcatgttgaatgctgggtttcagttttacaactacattggtgtagcctgtgctcgtcaactttagtggatagttaatatatatattttctgaacaaaatggcacctgaaatgtttcgattttcgtacgattttttaaaagcgagtttgtgtctcaacttttgcatgtgagtacctcagggatgcgctaatttcagaattatttgaacaactgaagtagtacattttctttgaattggtttctatatttccacagattattcgtactacatattttgccaacaaccaactcactacaaactcatcaaactaataggcacttaggcagttgttagaagaccagcagtttcgtcggtcttaaattggaccagtcaatatcaagaatttttgattcagggttgaataaccaaggggttccagtacgacccaacatttcaaaagcatacttctttagtctgttgcatggtttggttgggtttggtggtcataatttgggaggaactaatgttcaacgtttcccaccaccaaagagttcagatatcagcaagttttttccttcggaatgagacacatcaactagtagtggactagcggttgcttcagaagcccacacatttctatctctcctttacaaaaaagctttggtggacggaatgaagaactgttcagttgtaggactatttatctttagcaactggttggtaaaacgtgagaaccaaactagtgcagttgttgcgggctcatacataagcaagagcatcatgcaaacctaattggcttgaccaacctctgttgttactgtcttacacaagttgttaacgtaaattacttgttcattttcccacgtattctttgtttctgcataaacttttagctgaataatctggggaagcaagcgtcaaggtaaca

SEQ ID NO: 4967 - DNA, 1500 bp, Zea mays
gctagcgcattggattcttcaaaacattcgcgcacctgatcaccacgctggctggctatcctgcactgcacatgacagctccaccggggctgggctcgctgcgttcctgccgtgctgcttctcgctcgcccgcccgaaacgacagtccactgtccacggcacctgaggacaccccacgtgcggcgcctgcaaacaaaggtactgctgctacgctacgcacgcagcacgccaacaaattaccagtcctcctgctgctgctgctgcatgcgcatttacagtggtactccactcgccctgatcgcttatcccgtgattcgtgaatttatttcttttttgaagcgttttcgtgtcctgttcgcgacaagatagcttttggtattaacagagcagcagtggtggtgccagcaaacattcacaaaattcccgcatatccctgatgccataatcatggtttttgcagtaaacagttgctagtaatagccaggcttctggaccaccatacacacagctagtcaaaaattccgttcttcgccacggtaaaagtgaaaccattattactagcggcatcaggtgccaagtgccagcaaccacaaaagttacgcccgattatacgccgcccgccgtgcaggtggaggtggtgaaacctatgaccgttactaaacggaaaaactacagcgaaacagcactcgcctcgtctctgatctctgcgcagtagagtgtccagtaacactgttcctgtgggccctactctctcattggtcgtgccgtacgtactagtaggtagagcagctatgtgcctcttttctatttcctaattcctatagaaaccaatatttaaaattttaataccgttattttttatgacatacaatatttgaagtgtttgtagtattttttatttttagatattaattggttcagtatttaaaaattttcttcaagaatatgtatacgcatattatttatatgcgtatttgatgaatgtgggtacgttgtgcaatgtatagttctaatagaaaaaaactagctccaaccaaaaaggaagccgcaacctaccgagaccccgtctgtctggccgcctcgtcctggcagcaggccacagcgaagcgcgcccccgccgctgcgcgtttggatccgtctcggctccagctcgtgtccccacggccaccctcgcgcccatcctgaagcccacactccgtcactgacatccaggccacggaacccgggcccgactgggcgactggggcgtgtgcgtttggtgtctcagtcatagccacagccacggtacaccaggatccagcctggctcctactccacgggctccgccgttcctcacatataccaactcgtcccctcttatctccgtccaccacgcatcatcgcccctcgctcgctccgcaattccgcatcgcctcctatccttcgcccgccaacctcggcgggtcagggcgtgtttcgcgcggggggttgtgccaggaggagaagcaacacaggcgcgcc

SEQ ID NO: 4968 - DNA, 112 bp, Zea mays
gaatgtcctcctgagatctcaaagtcctacgctgctataagcttccaacatcctcccaaccagccatacctgcggatcgaactctagccaagcaacagagagggggggagag

SEQ ID NO: 4969 - DNA, 78 bp, Zea mays
gtagtggtggagcaaggagcaggagatggcggcggtcaggcggcgagcagtagcctgggaagcgtgagtgcagcgacc

SEQ ID NO: 4970 - DNA, 431 bp, Zea mays
cgccaggcgacagtgcgctcaagtgcatttgaatcggacctggaagaagttcgcttgattgtcgagtatcccattgcagtgctttaagcgaggccaattacattcacttgccgatgcgctacatctgttcacaagttgaaatctgtcagaactgtaatattggcctcaccctcccgttaagttgcactttttacactgcacatcgaacacaactcatctctgcggcttttgtgtagctcctttggaacagagatgaactttttgcgccccgattggggcgttttttttgtgtgctgggtcagtgacgaatcgtcgcacccgcctgacgcggcttgaccctaaagctacttcacgcttcagagttttcctacagcctactcagcctcgccatgaggccatgccccttttcgttttctttgaaggtaaccccc

SEQ ID NO: 4971 - DNA, 585 bp, Zea mays
tctgtagaaacgcctccgtcgcttcgtttattcagatccaccgcgtcgttcggagcaccgacacctgaggcggaactgttcgttggagctgcgcctccgccaattccagtgcctggcaaatggactgccggaggtacactccgagcgcccgcattgccgatcggagcgccgcctccagttcccagctgcttactagacccagccttggcagagctgatgctttccgccgcgctcccaacttgcacagtgctcgcatcacgggtcacctggccaccgcctccgcccgatccgccgaacgtgacgcgcagcggctctggcgagggggcgggcgagtcggcgggcaagatggacgagaagaggctggaaatctgcgagcggtacggcgccgtggacgcgtacactccgccgaaccacgaggcgccggcgcccgcggagggaggcgaggcgaaggcgacgtaggcggtgaacgcggcgaaggcaaaggcgaccgcgtacagcgtcagcctcgtgcggcgccgcgagcggcctccgagagggctgagggggccggcgtcggcgcacaccaggccgccgctctgcttccac

SEQ ID NO: 4972 - DNA, 250 bp, Zea mays
gacaaatctaaacggatttgtagtgggtttgttagtttttggcacccaaaattcctatagccaccaggcccaccacccccttcctccccaaaagcttcctcaaaccactcgccatctcacctcaattgccaacagcccaccaccaccacggccagtctcgctttctagtcgcttccgcgtcctccactcgccgcgctccccatcccggagcgcggcacaccgtagccccgcgccgcagcggctggccggc

SEQ ID NO: 4973 - DNA, 1319 bp, Zea mays
aggtagctttctaagccctgaagccacgttgtttttctttagcatgcatcttgaaattggtttgcttgaccaatctttttggaagcagcagcactcatgagttagtctaagagcgaagagcaagtagcaagcaagcagaaattctttttttttgaaattaatgtaacagcaagcagcaccacttatgtgaacgtataaaattacgatttttttgtttctagaaactaaattttagtccatccattttattacattttagtttctaagttatcaaatacgaaaactaaaacactattttagttcatgtatttgacaatttagagactaaaataaaataaaatatatggactaaacattaatcactaaaaaccaaacacccaactagtctaacaacaagcagaaatacgtttcctaaattagtctaacaacaagcaaaaccactcatgtgaactcatgaattagcaacttcgcagtagaattaggatcttgaattttgggcaggaaggaaaccaaattattttttgcatccaaacaatgaacagcttctacgttctgatgaggtggtagctgcacctgccgcctgctgcacggtgttgtcctcagcaagccgatggccacctttcgtcgacaaccacgccgccaaacaaaaaaaaaagttttttttggcctaccgtgaacatttgtaggagtcaagccttcggttgccactcaagagcgttgagatgacgctagtcgcgttgtgccggcctaggcggcggcggcggttgagccagagagttagaggcggctctgttgctgcggttttcgcgacggaggcggccgttgttgccgtgactcaaacaacggggcgggccgccattgctgctcacgctgccgagcagcttccgcgatcaaggatgcaggccgccatcgacgcctccgttgccgctgacctggtagagggatgggatggatatttggcgcgcgacaaacatctcgcgcgcgtcgaaacctggatccgagcgtgccagcaggccgcagcagaggatccgcgtcatcgactcgacacgacgagcacagctgtcctcagccggctgggccgtcgagaagacggcgttggacgagcgcggacgagccaaccggggtcgggccgagccggagcagggcggcgccgaggagtggccggcgcaggcggtcggctgaggaaatcgtggaaataggggttgatatggtcactaggattggagggaaatgaactattttatcctcaatctctttcactcctataaattctggtcaccaaattggctctagatgtacttatacatccatttctaaaa

SEQ ID NO: 4974 - DNA, 1500 bp, Zea mays
atgcagatgctcacaactgcattgcatcaccgatgatttaaaacttcattttaatttctacgtttctgcatcacatcatgtgcaaggtgaagtgttatattgtctctgtacacaaatgagccgtcttgtcttacaattgcgtgtataacgttagggtgtgtttggttgaggagtggagaagaatgtaacggctccattctagtcttttggatgtttggttttcaacaaaagaggagcgggtcggctcctggagtctccatacggaaatttatcataaatagttggagtgctcctgctccactaaaatggtcggatgcgagcgctctctcggacacgagcgttctcctcccccttctcttctctacactcatatggctctccaaccgaacaaagaacagagcggtcctactctattctactcttcaaccaaataaaaaatatagtgactttattttacttggcaaacacataataagacggttattttattaccaaaaactgaaatagaactgctcctttctaattaactctctaaccaataatatgtttttctatctcatcccttcatcctgactcaatatttgcacacccacagtgaaacctcatcaaaccaaaaatgaacgggaagattagctcatcctttcgtctcacacgcgatatgcatattgcttgtacgaatcacttcatttgatcacagagacacaggggtagcacgtgcggagagagagagaggagttgcaagatttcacagcttgcatgagatggtatatactgcgatgtactacgatcttgcatgcactgccacagcttgcgcagtactactgtcactgatcgttgatagcatgtcagctccagaagaaaacaacagccagacgacaaagaagcctcctgtgttcacgccggtcacgaaacagaattgcagtggcacaggacaacaattattatacgtgctcatgtcaggacttgaatttctcgtggcagaagttgctccgcatataaggcatgtttggtttgctacctcaattgccacactttgcctaacttttctgtctaaggttagttattcaatttggacgactaactttaggcaaagtatggcacatttagccacaaaccaaacatgccctaaatccagcaccaaagcaagccgggccccgccataacgcctcccgataaacaccagcgcacccagccacccaccagcaattcccggccccccggtggctggcccacgccgtcagcgggagtgctgccgaatcggtgttgggctcccttttatagacgtaaccgcagcagagatgcgggaggggtggcggccggttttattatcggagaagcaaattgaattgaatggcaccggctccgattagctggacccgtagctgttgttcctgctgttgtcgtagccatagcatcccactcctccctcctcggtagattcgcctcatcgcctcccctcctcctcctcctcctcctctctttctgctctccccgctctgc

SEQ ID NO: 4975 - DNA, 1500 bp, Zea mays
tatcgttttcaaccttacttacttccactctatctcttcacaatatgatggaatcgttttttaaactttctacaaaactcaaacacaatcaaagtcaacaatgagtaggatctaaggctatcctcaccacttaggtctgaagtaggtctaaataaatgtttcaacactacacagtagaatatagtctttagtaaggtcaacctaataaatttaggaggtgaaaattaaggaatcattactttatgttgtaagctcgaaacgatgaaattaaatttatcatttcttccatcctatgttttaagtcaatacaattttagtcaaaagttataaattttgctaaatttatataataaaataatattatagtactaaataagtatttctttaattatatttctacaatataactatttaatattgcaacttttgttattattttttacaaatttaataaaagttaatacttgttttgactattggtgaaagttaaaatgactaaggaaagaagtagtagtaaaagagaagcgtcgtgcgcacatggcacaggtgatggctagaaaccataaacaaaaaccgtcgcggcacgccacccgctaaagtccgaagcccccgtgacacaattcctttacctaggagtacacatattatttatttattacttgtttactttttttttatttagtgccttttgtagctttccccccgacaccaactgacctgattcaatatttcatcggcacagtgggcccaaccgcgctgcgcccatcgtggtccgaacaggaaccacgtgggacccgttccccgcgcggagaatcccaaggccccacccgccaccaccgcgccagtcgcctcgtgcgctccccgtcccgaacacgtgtcgtcctatcgatgacccgcacaccggctccgtggcacggtggacgctcggccgccgcaaacccttccaccgacatgcgggttccgtccatctctgccccagatgtcagtgacgtgcacgggactcaccgcggtgcagcgggaagggcgtcgtgccgtaccacgtgggggactcgaccggggaaccgataaacgtggcgcgggccccgccgagagagacgcgcccgatccggtcaccgcggctcgggcccgccgcctctagtcgccagtcgccatgcggaccactcaattatctcctccgtttccttagccattgtcagctgagtaatctaataccctcgtttccaattaagaaaggatcgcaggccattaaacaagcacacacgggaggcctacaaagacgagaggggagaggagaacggtcaaggctgccgcgcgcatcgtcatcagttcactagtcagtcgaggtcgaggggcggacgaggagctgaggagagagaagcttcaaggagttggggacttgggggttgccgagctgtccgtctttcccctcccctccacccaccagctacctcgggagggcaaggcaaacatctgcggcctcctttcccgaacccgggttgg

SEQ ID NO: 4976 - DNA, 413 bp, Zea mays
ttgtcaaggaaaatttaatttctattttctcttaagaaaatagaaatttctttaaaaatagagttaccaaactagccgatagggtacaaatatagaaaaaaaatatattgataggtacatatgataaaatctttctaaccttggtaagggggtattggtttgacgaataattatccgaaacccagggggttcccccaaatgtagccctagccccccgcgaactatccccccgcaacaggcccgtcgaaagcaaatcgaaaccatctcgactcggaaaaaacggcagcagcaaaaaggtcccgcaaacccaagcgccgccgtggacccaatcgcccccagccccagccccagcctcagtccccccgagacgagacgagatccggggaccagccgcattgccgcggatcgaaggg

SEQ ID NO: 4977 - DNA, 892 bp, Zea mays
tgtccttttccggcactcggcataggtaacggtcgtcaactgtacacggctactgatagccattgccgagtgccatgatatgtcgagagctcgacgttcggcaaattcttctttgccgagggtatttgtatgccaagtgttttgcacacgctaaagacggtctttgctgagtgcttgttcgacgagagtgacactcggtaaagtattttttattgaatgtctgagattttacaatcgataaatctttgatttctcagtaaagaacacgtttgcggtagtgtacatggcattctgccattcaccgtagcgtcgttggactagtaatactgcattcggtacgcgaaactgaaacagattaggtagcgcttccatctaatccatctatgtagtagctatagaaacatgtatgcatgcatgatccaggggtttggtacacaggatccatgcaatgattactcatcaattatagtttcctcccatgatttgcagacctgtcgttccttctgtatccggctgtgcacgaatctcccgttactaacactgcatatactaccttcacaatgcaaagtgaaggtcctagcaactcttgataatgcacaccgtgcgatatataactgccaagcggccgttaccccctttttttattaattagttctccgtttctcgcatgatttgctccgtagccatgtgacccctacctaaggccaaagcaccacgtcggcgggcgcaagcgcaacggccgttgatggcgaccgcggcgggcgcgctcgctgccatccttggagattcgtttccggtctataaatacccgggcaaggtggtctttccagatcatcgaaacacacacaactcctcttgtcggccaaagtagctctactagcagctagcaact

SEQ ID NO: 4978 - DNA, 404 bp, Zea mays
tcttcaagtcggttatcaagacagtcatacacagaagatgatattttatctcttttgcccaactgtaccaagaaggcgtatataatctgctgttccttaaaaatgttctatcacttgagatgtatgtgtgggaatctggtatgaccgagccaaaaataatatactcttgctacttaggccacagagtgaaaagctgtcctggcatcgccaagcccttgtcaggttctctggcactcctgttgaatcttctaagcagaagctggactctttctcgatggattttatattagaagcattcttgggcaacaagattgagaagaagagctctacctattttatcatccagggaatggcatctgcatcaagtaaaattggtatttttgcaactgcagctgccaaggaat

SEQ ID NO: 4979 - DNA, 589 bp, Zea mays
ttcgaacctatgatcagtagtgggcgcggagcctgagtgctctggggtggctgtcgaacccttccgaggggccagccttcgaacccctgatcagtaggagggctcggggcccgcttccttcgcagagaaggatccctttcggagtatcccctttcccggtccctgtagcaagagagagaaaggggaagaggaaaaggataccaaattgaacgacgtggcgcaccttttttgacgcggtcatcatggcgaaggcgaagcgtcgcccgcttctcctgccagaggcgccacctatcccgccgcggagttaatgcgacggggcgagtggttggtggggcggccgctgcgcgtgcgcgagccgttcgagggacggctatttcgctttgcactttttgaatcccgcgtccggtccgggcggagcgctggaaacggtctcgccctggtctttatatacccgggagagagcctggtgacggctcttcgctccgcttcttgcctctttctttaggttttcgcaacccgagaggctttgaccagagaagagaaaaccgcccttcctgccccttgcgccgccatcccttccgtcttggtg

SEQ ID NO: 4980 - DNA, 1500 bp, Zea mays
tgttgcaattttgaactcactagctattgcccaccagagtaagggtgtgtatagaaacatctatacatacaacacagtaacatgaaaggggttgaatatctgaacattcaaatctttactcaaatctttaccaaagttttgtctgttctatttaatcttgttgatagatttatcgggtctcctaacaacaagaagtggtagaagctagcgatgctgacacgagcaagcaagagaggctttcgcggtggcgcgacaaattaaaatagggtttgcgcatgcatgcatctgcatccggagccgacgagccgtcgtgacttgtgacttcgttgtggatgaccgaaaacgtcactgcatcaacaagcagtcctgcggcagttaatggcgcctccttgactgggtcgtctggataccaccgcgagtacccatgcagcgcacaggccggccccagcaatctcttgtccaccaggagcgtggaaattgaaggggcacgcacatgagattgctgccgccggtggagctcgcattgaatccacgggcccggggggagtggggggctatagctagcgagcggcagccgggctgggccggtccgatccggggccccgatcggcgatcgcatgcggcggccgacgggatggaaaccgagtgcgtcgcatcgcaacatgccatatgcggccacgcacccggcgcgtttaatgcgacgcggctatggcgaggcgaggctagcggcaggcagaggcagagcccggcaaaggcccgcgcccggccaatgacactgtgctcactgtactgtgcagtgctgtaccgccccaccaccaggctgactttgccacgagctgagagtaaatgcacgctagctactggagtagtagtacgagtactcatcatcatcatcatctctctctccatttgactcatcaagtgaactactataggcgggctatagctagcttagctgcctttgctagcccagctgtctcggcatcctggccgtggccggcgacgggttagcagccatagcccacacacacagagagagagagcacagcacaaaaggtcagcgccgcggtttggggctcttgccgccaccgttatatatacacgcctacgccaacgcctcacccccccaccttggacccctgtcctcaacctcaagccgccacgctccaccaacacgcgcgcgctggcttcttcaacctcggttgcttgctcgcaacaagacacggatcgtcagagcaagagctctggtgacctgacgattctgctcttgttctcgtacggcgccggtgcctagcgtctgtagcctttttgtgtgtgttttttcgcccatatctccccaccaccaccaccaccaacctcagccgcagttcacccgcgtcaccgcacgagtacacgagcaatccgcaagcgataacctgcaagctgaggggaaaggaaggtgaaggccagctgttttgctcacggagaaagaggttcgtcgttgatcaacacggacacacc

SEQ ID NO: 4981 - DNA, 565 bp, Zea mays
cgtctgcttaagatattacgtatccacatttcattggttggtaggtagccacaacattaccgggcctactgacctatggctctcwgaagaagttggttttcctcaaaagaaaataaatgtagcagccagcaccacggaccacataccagggaggatagcttggtacgaagacaaagctgttggttgctttctaccagggagtaatgtctttcagtctaattttgcatcctaacggtttagatcttttcctcctgcttcgtgctgtgtggcgtgaaaagtttgtttactggtggctgtcattcatgctgcgcgctacgtggaccaaacgaacgtctttcgaatctaaaaatgaggcaggcgatttttcaccgcatttcgcccaaaaaaattgctccttccgcttgaacacacacacgtggccacactctgcccatgcataacagaagtttcgaaccatgggatgtagagtggaatctcttccctcgcaggataaggtgcctcggccgtaaacagagtggttgttccgcttcgtcccagcctctagttcttcctttcctccagagtg

SEQ ID NO: 4982 - DNA, 135 bp, Zea mays
ggtattctgtaataccttcgcttgcattgcatggacaagaattaraaggattcacttgtcttrtttttatctatgaccttatttgtactcctggcatactgacacaagtattgataccactacagaaatctataa

SEQ ID NO: 4983 - DNA, 595 bp, Zea mays
agtgcgtgatctccttccttttctagcaaagacgatcgttgccagccacggcccatgtggcacacgcactggactgagccacgtgtcacccgctgatcgctcggtcgaccgctggtcgggcgcgcggctggcacaccggacagtccggttaattatagccacggtgccctcaacattttcccgagagtgacctgttcgccaaggcgccagcctaggcaccgaacacacacatgctggtgcaagtttggctagacttagccaaacttctccaatccaatttctctcgatttgacaaggttcctagcacttagtagaataatgttagtaccaaaaacaatttactaagtctagcatcataccttgctttttccatttgcatatctttgatacttagcttatatcaaacaaaacaatatgtgttgagcatctcatcactaaaacatttatagaaatggcccaaaggcacatttcctttcaagttttgtggcattaagtttcaagttattacaggagcacctattcaccccccctctaggtgctctcaattgggtatcagagccgctctcttcaagaaagggactaatcgcccgaagag

SEQ ID NO: 4984 - DNA, 581 bp, Zea mays
ccttattagtagctttaagtgtaaatatttgattaataagataaggcataactattttttagtcttgtctcatgatataaagtgctttctagagatacatacgtcgattcattagtaccagtgttagtaccagtgttgttatagagaattaaatatatttttgatctttatatttttgattcttttgagagggtgggaccgcgggagtaagatggtgttgattggttggccggacagattattgcgattccccataaaactatctttcccggtgagagtgagacccgggtagtgtctgtgtttcgtgtccccacccgcccagacgccccacaactctgcgcatcaccaattcaaataaaacgatattttaaaatactccagccagtggtgcggtgcctccttgggctcaccaaatctccactcccaatcaaccacttgctgcaaagaggaatacgattcagcttagctcagctccaccaccaccaagaacaagatctcgacgaagcagccagacgacaggcaggtagcaccggggtcaacgcggcagacaaacaggctctcccgctcgtcagctagcagcc

SEQ ID NO: 4985 - DNA, 927 bp, Zea mays
ttcccgatgtatgtatgtatgacctgacgggtcgcgtcagtgcgccggggaccacaggatgcatggcatggcatgtcagtggtgtcaacaacggcctaccgtaccgctacagttgtagcgccaccaagctagcttagctgtgccaatgttgttgtagacgacgtacatcatcgtgtgttctgagctattagctgatagcaacctgacacactctattccccgcaggtctcattatattagcacctactagcacgcatattattgggcctaattggtttagctttttctagaggatcttttctatgcaggcccattatttatccatccgaagcacgcgtcggcctacaacgccgagctcagaataagttggcctagctacctgctggcccgtcattttccacacggaaaatttccattttttttggtatgtaatgcaattcgaaactaaaacctagtacacatctctgcgatagaattaacatatattagaatggccgaaaggatgtggtgacaagtctgtagttcactgagaaaccacgcaaactaaacggcgactgtagccaacgacagaatttaatttatcttaatcgtcgagaagagggtaaaatggaatttaatttttcgcagctggactctaggaagacagatgccacagcgacacgcaaattattatcgacgcttgagctgtaggtttctggaacgttctcatggccggcgcccccatccggaaagcacgacacgactccacgtccccctcgcctccgggacacgcgtccccggagcgccgccgctgccccccttttatttaaggcaggctctcagttgacacaacacaacaagctcgacggaacaactgactagaactagtacgtagaaatccaacactcgggacgaaattaaaagagacgagacgacgcatcatccggc

SEQ ID NO: 4986 - DNA, 1500 bp, Zea mays
tttttcctggtgccgtccttctgtactgcctgcgggtgggttgttccgatcataaccgacaaggcgcggcgtgctctcttccctcgcgttgtagactctcgcgggatctgtctcggcggcggcggcgggggtgggggtgggttactgggctcgcttcatcctcccggatcacggcggcggtttgttcaggtgagtgagcctagctgattgccctctctccttaagtccttactccttactccttagtgtatgcagaggacggttcaaggctggattttcgttcctgctcttggtaccttactatcgggcttttcctggttcctggtccccctccctgttcaccaagaaatgaattagcccaattactttccatgtctgtttgttgttctctctgacggacgtgcgtaggctgcttccttctcttggttgatttcttgcgagacgaaggttccagctgaattactgacgctagttaacgaatttcgattcgccaatggtcatgagtaatgtggttgttattggttaagtgtagtcacacgcactgaaatcattggttggacgataggtatcagcttgcgatggcaggcgcacatcagagcttgcctgagataaattagttggatgtatgggacagataatcattgatgcaccgtcatggctgtccaataatggatttgcactgaataaatactgaaaactgtattgttttttttttcaataaaaaagtgtgtgccagttgtgtggactttgtctgattttcatttttgttatgaccctaagtcagctggcctcacctgcccgcgtgaaccaagtaattgtgtttcaatgattatctacacgcacgcgctgagctctcatatatgtatatgctgcttgtaagcttgaagcacatcagcattgtttgtctggttgaaatctaagcaaaaagatggccactagagttatgcaagcagattgcgcatgtatttttcttacagcttattacagaatttactgcaagttcaactactgcaccttatatatactgaaaccaacacatgcttttctggttgcaagcattttagatatccccataatacatatagtgggttcttgtaggttgttgttagagtggacgcactaaccaattcaacccaaaagctctgccaggattcgaactcgagacttctggctctcataccatgttatagtggacgcactaaccaattcaacccaaaagcttaagctgatgggaaaaggtagtttatccacttatacacttcaacagttgcaacatccactggacaatcttggccagaattttaaccataggttgacttaacttcgaaagcatatgtattcaatatagctctttctactggtacctataaccgaaattcactctttttcagaacatgttagaagccagggaagatcggtgaaatgcttgcattgatataataagtccaggctgaagttattgagctgacagcactaagatataatagtttgagaatctca

SEQ ID NO: 4987 - DNA, 433 bp, Zea mays
cgcgggctctaaatacttttttctccggtcccaatctatttctaatatttttgaactttttatatactttcaatgttttaaataaactttttccgattttcttagtaaaaagttgaaaccatcctaaaataaaaactatttctaaccatggtagagagctaatttaagcggctttaagatttgaagaagaaattgccttattttagagttcattcaagaaggaaaaaatggagtcctagttgagggaaaacaccacagattccacagccttcgcctgttcgccacctttcctccaaaatttgacccacacgcggcgacgcccgaggccccgagcgaccacatcctccgcggccgcggcgacgcccgaggcctgcaaaaccctaaccactcaggttctgccggccaccgccaccaccaccaccagtccaccacc

SEQ ID NO: 4988 - DNA, 1367 bp, Zea mays
agaaatggcccaagggcacattttcctttcagtaagatagctcccgggcattatattaagcagaagacattctcacacaggtcgagaaaaccttcgaacccctggcccacccatacataatggcaccgtagccatatgagaaacgaccgcgaccgaggccgggccttagaccatatgctttggtgtgggacagacgaggagattttattaaccacagcctaaaattcgctccacggggagtcgaatcgaacytaagacctgaggagtgctactcagaccacctaaccaactcgactagagggtctttcgcactaccctcatgtaatccaggagacaaagaagaagagaaagcagaagcatgtgaaagtgattttcatgcgtcgcaagatctctgctttaaaaaggaagtctcaaatgttgaaagaagatttttgaatacaattctaatcgtgtcctgtgaactgtttggcttcttgcttatctagtagagtgaatgcaattctaatcgtgtagcgttctttgcatcacagggtacgctcttacatcagcgtgctgtttcgcagaaatagtgctattgttttttttttctaaacttaaaatagacgtggctgcaaagaggctaaggccttgttcgtttgtgtcggattggtgggtcggaacgatttcgagccggattgcttctctaatttatataaattttgattagccggaacgattccgggtgcaatccgatgtaaacgaacaagccctaatcggtctcgaactcacatgccacatgggatggacctccctcggaaactaaacacccctcaatcctagtcatcatgagcgaacggcaatccgtgtgctgttgcgttgttgcgttgtcgtactactgaagcacggagcgaaccgtgcaggctagcctagtcggtggcggtggcaggtgatccatcgtccgccgcgctgtgtactgtacgcgcgggtgccggccggtgcggcttgacaccctgttggctcggtggttcacgtcggcgggcccgctctcctttgttccgagccttcgccacccggtcgccgtctggccacaaccctcgcgcaatcaagcgacgagacgaccgaccccaagccaaaggaccaaagcaaggctaggcaagcagcgtcactgaagcggaaaacgcgtcgccttcaccagtctccactccaggtgcgtcgtctgctccgcaggtttctcccctcgccctctctcccccaccctcactcagactcagcccaccgatcccgtccagctttaccgattcctactctcttgttttctgttttcttggttcgtcccatagagaggagagctttgattgctggtggtctggtcggcggcggcggcggca

SEQ ID NO: 4989 - DNA, 348 bp, Zea mays
ttttttagggtccaaacgtgttcttttttccgaaaaatggtcaaaatacaaaaaatgggactgaattttgcagcataatcggtcgttgttcagcccgtgcgttcccgtggaacagcaaattttgaaacggactggatgcggccgctgtccaccgtcactgtgatgagtgccaacggcccaacgcggcccttgcgcttccctcccgaccaaccgcctcgaccttgcgcaagacgtggcacgtcgaacgccacaaggactcagtccacactccacagggaaggagggagcaggagaggtaggtagccaagaagatcggttccagcggcaggcgcgagcgaggcgtgaccg

SEQ ID NO: 4990 - DNA, 145 bp, Zea mays
agctttaatttgccggcaaccaaaatcctcgtgagatttaattgggaccaattgtttaatgttgcttcttcgccaaattattactgatacgaagtctgtctgaaataattgttcgaaaaagaatggcatcgatcgcccttgaatt

SEQ ID NO: 4991 - DNA, 1500 bp, Zea mays
tctttgtgagttgttgtctgatggtgaaggttttgctgaatcgggcagtaattggattacgctttgggttctctgtttgtttcaattgctctgcgttttatgtctgtattaacatacatcaagcatatataatagtcatgttgctgctgcgagtctaatcaatcttgcgatcctggttttctcgctcaattgcctacactgaatgaggctgatcacgctgctctgtgcctacagcaggcgattgtcagatgctagatggcgataatacaagcttaataaccagagcatggacgtagtgcagtggttctctctctcacgcacacagagaaacactttttattagccaaaagttgttagattatataatctggccagattataatcccaaacaaacactaaattagtatatgtgaatgtgataaacaccaaattagtatatgtgaatgtgatggttgatttttttttctttaggatggaagtaatactgcattagcatctacggtctgaagcggccggcggaactgccgattccgcgacctcccaaatgctaacgttgccgccggcggccaagacctccacacccccgccgcggcagccaccgctcactattccactcttttcagacggatgcacgtaccttccctagcgcccatggccgcgcccgcccttgcttccttcgttcggggactctactaccatttggccgcggctgcttgcggtcgcgaccatgcatggcctccgttcctcaaatgacgcggcctcttcaccaacgggttcggttgttctgtcctgcaagcggtggaagtatttgtgaaaggagctgaaggttgaaggcgattgattttcaggctggcaactggcttgatgcctgattcttggtaggatcttctgctactctccagtgcgaagtgccgacactttcaaattcattcatgaaactcccggtctcaaatgttgcttaagcatttagatttcttcaaaagaaatgctcaccgtcacttcacacacacacacacagtctgctataactgatgaaatcgctgttgttgtttttttttacaacgtggtgaccatttactgactgggaaaaaaaaagagagaactcgcaaaccttctacccacttccgatggaaattgacctggaaggaagaagatacattatctcgtgaaaccgtccaaaagatgctatctgcaaaaatatctttcacttgtcgctgtctcgtccagcttacatttcttttgacccatagcagaaggcattggaagcgtggtttctttgtcatcacctgaagtgtgcgatgtgccggattcggctgcttctatcttgcagctcagaaacatgtggtcagtttccctccactccgtcggtttttttttttccttccattatctgcatgagcagataactccaaacgacgggctgagaggtgctgtgacactgcaggcgataaaggtatataagccaaacgcttttgcaaactgggagcctgggatcaccaa

SEQ ID NO: 4992 - DNA, 299 bp, Zea mays
aatatccgctcggtacccctgcggagttggagcctcctctttccatgatagatgggctcctaggagatttggacttcataatagggtccagcatcttcttgaaggggcttgatcgagctttagtgttgttctctgtgatatggtgttgagcaccgtcagattggcaggttccgtcaaaggagcttactttcacaggcgttgatttggaactgcttgctgaatctctccccttgtcaccacagttgttctcactggggcatccattcatcttttgcaggtcagtgcatttgcctgaccca

SEQ ID NO: 4993 - DNA, 516 bp, Zea mays
actaaaatctaaaaaaaatttattcattcaactgacaaggcatttcacaggtgcattttatccgtcgatctcaaaaagagagaaaacggagcaagaagaccgaatcaccgaaatctaaaaaacttcaaaaaatattccattgccgggatttgaacccgggtcgtctgggtgaaagccagatatcctaaccggactagacgacaatggaactgtgattggttgaacatttaacaattaatataactaaactaactgagcccagcccaatcccaagcctatgtcgctcgttctcactttctcagcctcgtccatgcttgccagctgtgcttcctgccgctcctctagtctccacaatccagtccttctccagtctgcccgctcattctgtcgaacacctcgtcctctacatcctcatcgacgtcttcccaattcaaaactcctaaaccctagcccttcttcccgacaccaccatccatccaaaatcactgggtgatgcggaagaggtagcctccgccg

SEQ ID NO: 4994 - DNA, 1500 bp, Zea mays
atcctcatcgacgtcttcccaattcaaaactcctaaaccctagcccttcttcccgacaccaccatccatccaaaatcactgggtgatgcggaagaggtagcctccgccgatggcctgctgcttcgtccgcgtcgctgcggcgccccgcctcctcatctaccgcgccgccgctccgcggcagctcccgtcgccgctcaacgtattcaggaaggtaaatattatactaaatccgttatcctcttatggcgtgacgacttgggagcgatgtgtttttgtgggacgtccattagccctagtagcaccaggaagttcgcggaccatctactggcacttggattgcattgccatggtttgtacttatactaagagcatctccaacaagaagtcctatatttgagtcctcaaaattaaaataagacctgatttaaagcgtttaagaccacaaaacatttgcaactccaacaattgagccctatatcatattattaggaaataaatcatgttatttaggaaataaattgttagaaatagtatacgaaatgaggataggctccgccttatagttatttgatattttttttaaaaataaggtctctgttggagcatgtttctgctgttaaagttctatatttcaaaattaaaccccggagctcctgatggagatctctaaaatttagtaaactttaagactatacatagaatataaaaaagcgggcctcaagtcacacaccctctaatatgattacttaaaaaacaaaggaggttccatctctctcatacacatgcacgtccacaattctactttctctctctagtctcaccaaccaaacccaaaccaaaaacactaaaataaaaaatttagtcaagagcaaacaaaccctcaagccccctaaaaccatatcattctgttttataagcccatccccactggcatgagttgagtaattagtctctccgattctatacaccttaaatccaaagcaaatggggcccatcttaggtataagaacaataggtttcaaaaaggacaaaaatggtgagagaagcagtggaaaaggatccacaagaaaatatatatttatttaaaaatccaccaaaaatctcccaattttctcctcctcctatattaaactcctcaacctcctccagtcgtccccgtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggca

SEQ ID NO: 4995 - DNA, 131 bp, Zea mays
cgtgattaggcctttttccttttagtgctctcaaaacttttcccctcccctttctctctatttctctttttggtgacatcttgttgggtttcaactctagcctaccccaacttgcttgggactaaaaggct

SEQ ID NO: 4996 - DNA, 265 bp, Zea mays
aacatgatcgctgtgtcccacaaggccaagttgttgaactggaacgcatgatgacttcattgcaaaaggaacctctggagcatatgcctcccttgttcgttttcaggaaacggcacggaacagggatcttggaggtgcatctagccgcaggtcacggtcaattcacttgacaagctcactttccaccaaatctctcagcctcaggtctggaagtctaaagaacctcagctatcagtacagtactggagcagatggtcgcattgag

SEQ ID NO: 4997 - DNA, 831 bp, Zea mays
ggttttggtgcatctccaggtgaacacggctgatctttagtgtaggtgtagtttttgacttagagagaattagagagctctagctctctctctacttaaggaatggatttggggtttctccaggggtctttttgcaacatttccttcccataattgctggttataaggttacttaaagtttggttaaagattaactcatggtttgcacatttgcttattctctccccctctcaaccatggttttgggagatagggttcaagagaggtctagggttttccctcctcttgcccaaggtagtaagtgcacaaaagcttgagtgatgctcttaggtcatttgaaatcttggttaacacatggtctccaaggttcttatgttcaccttaagtttttaccacatgtgatcacagtccttagtaccaaggtgtgctctagccatggtaacacctgaggtgttacatcatgttcctaggattttattttaatgtgtagattattactgtgtattttctttacatggctggtgtgatgttaattttctctatactctgtgcttgtttgtattgtggcgagtagaagagcccgtgactgaggatactggtgagcagcagatagaagtagctgagcaggagctcattgaaggcaagttgtgcccttgaccactttttacccaataatgttctttaataacatttattcatgcataggttaattttgatgggacccgataggtcaccctagattgtttatctcattaccttgtttacccctgagtcacttgggtagttttgctattgctttacatggtttttggataatcatttattatatct

SEQ ID NO: 4998 - DNA, 167 bp, Zea mays
ggtacgtccttcacaatcttcgtctgaagaccattatatcccaagggagataatgcttcgtaagacgatggtctttaaccattaacattttgtgttgccttgttcttaactcatagcattctccggtgaactcattcgaccaccttcggcaagttctgaccttcgtc

SEQ ID NO: 4999 - DNA, 997 bp, Zea mays
tccactgtaggcgccggagcagtgggcagtggaggcctagcggggaggcggggcggcacggaaagggcggtcgactgctcgggcagcgctcgcccgtggcagccataggggcggtggaggatgcgcggggtggcagagcggcacgaggtggctgggaggcgcgaccggcagtggaggccgagtggtgcacgaagacgacggtgagaggtgggggcgatggcgactgtggatgtggatggaccatagcggtttaggtttttgcgttgctgatggggatggggatatagggtggaggtggatggtggattcgtgggccgtgcggggttcggttgtatagaattggtgtggctggaccaaaggttgactagggcttcctatagtaattgagagtctagagctcttaatagatatactatatatatattaactaatctgataaatttagatttttctcgttcaatgtgaggtctttcttctaaatttttatagtgttggcataataaatcggaacatgcaaaagtagaattttgcttttgcagttctgcagtcgggtccaagtctacgctagggtcagcaggaaaagcaagttgcacaaagaacaaaagcgagtagccagctaggaagggcatggatcgacggagacaatagctcacaacttcaagtggagcaatagggcgggagcttggacatcggtccggtggcgcaatagggaggagaaaggggcgccgttggaagccgccttgaaaggaggaaaaacagcgagcgctcgggagtatgtacgggccacttggggtgtggtgccgaacgtaagcaggcccacgtgcaatcagtggtgccagtggactggatacatagcacatgcatgcaaataagcgtttatagacagactcggagtattttatttaaatggagcaacgacaacgatccccacacatgttcatcagctacagctagcccttgagagctctctctcttttttttttttgagagcagatag

SEQ ID NO: 5000 - DNA, 1183 bp, Zea mays
gccttttcctcaccaaacactactaatggtggaactgtcttgaaccaaccacaacatttatcctgaattcaccatagaataataggctattttgattaagacgttagactaaacaaatgcaaccatcattacactatctatagtttaattaaagaatcaaatggccattttggacggccctaccatgttgccttaggtgcttgatgaccgtgatttgaatgacgtggaaagatttgttgattggtggtgcatttttcttttatcagggggagaacttcgagttaaggaaatggatgaagaattatggtttcatgaagctgaaaatctattctaaaaagcggtgtataacgtgtgtatttcaattttcgggtaggggactgtactgtaaagcaaatagacctctagcgaatcaaatatgaggagaaactttcggcaaaaaaaaaacagtgagagatgcaattttgtgtctctgatgtacctttgtttcgcctcgtgtgatcgtgtccgtacgaaaatgtgtacttcatgtcgtttttgcttcgctgcccgaggcagaaaccgtaacaggataatcgtcccagagacccagactcccccgctcccaatcccaccaccacccaccttcttgcaattgcagccgccagccggtagtggcagtacggcaatttcagcctcagctgaaggtcactgtctctcttccatctttttctctctcaacaaaactccctgaattgcaaactccaccaaaacaaactccaagcccatccatcaccagtcctctgtcccctccccgaccgcaacgatctgctttgcatcttccccttcctccaattccagtcccatgcgtaatcgtctttcggaattgaatctctccatgtcatggcgctctgagcaagtacagctgcagtcagtgagagaaatgtaggcaccacaaatcggtccagcaaatccctgctcgtgctctaccaaaaaatccagtctttttccagcccaaatccgcctcttccgctgctgccataaagtccggactttacgaggctttcacgacgtgcgagatttctgttatcgatctccacgaacccgatagcctgccataaagtctgcacagacgcttcgcattgcttcaaccaaagatccatccaaactctgcaccccagaaagctagtacgatctcgggggggac

SEQ ID NO: 5001 - DNA, 923 bp, Zea mays
cccaccacacactattacagagatgtcagcagtggactcgctataggagaccgcgggatgagcgggaaagatggtatgccataccggggatacgactacgcatgaccctactgagggaccactgcgacgattaggagtagttgatctctttctctctctccctttctctttttatggtagaaatcgatcaccactgcaaggtttagcccttgaagctataaaagtgtaggccctctttcttctcaacacacaagcacacaagatgcaacacttctcattgcaatactacgatcatcactacactgaactagggctccgacatgaaatagtataaagcccatgtctctagttcaccgttcgagtccccgcaattcaccgttgggagcgagtccgcgagtctgcgctagcctcactcactaaacacaaatcttattgcccatggttttaggaacgtttccgaaaccatgacattaatatatcatgatttttgaagcaatttaaaatagtttacatatgacagacactaaatttaacatcatcctcacagtaacaattcaaataacacgatgttgagcatacaaagcaaaataacatgatgtcccctatatgcagtttaattaaaacatggcagactgtagtagcaaaataacacgatgttgagcatacaaaaattgtgcgctagtaccaatgatggggtgccaatgtgcgtgccacaccatacggctgccagtcacgcacagatatatactagtaattgtttgactgagcgcctactccatcatcagatccaggatatcacatatcaggcctaaatatttaaaacagcaaccactaccacgctgcgccgctgcccatagcttcgttgacaacctgttttcccaagccatttcctccactctcgttttttcccttcctgtccaaag

SEQ ID NO: 5002 - DNA, 1094 bp, Zea mays
ggtgctgggccttgggccatctatctgccagcatgtggtcagtcaactctaagcaggagactttgacaaggttaaagtttagttcatgaaggtgggcaatctaattaggatgctcatgctttagctaggagtgccattagttttcctgttgaaaggcatgtttggttcctctttcctactgaaagagtttgtaatatctttactactattaagaaggtaaggggtatgctgccattactagttctgtcattcccattcctaccgttctcattcctattcccattcccggttctgtctccacccccgatgcccctcccccgcgtaacccccgtggctcaccgtaccacatgaaacctccgatcccatgacctcgacggcggccatggccgacaagcaggtgcgatactgtgccccgcctcatcccgcacgtcgtccatcctttcaccccccacgtgatgcccgcgacttcgcgagacaactgctgtccggcccccgccacctctcccccgcgtgacgccccctcccacaacgcttcacgcgcatgagtctgcgaataccggcagccgccaccgtactggagcccgatctgctagctccccctcagcctcaccaccatgcccccatcggatctcatcgagccatgcgtggcggcgccggtgatggatgcggcgttgctagccgtcatcgtcccgcctcgacgttcgatccatgctcgccacggttggtgctcgcacgcgatgtggcgtggcgaggttaccgcgggcgccgcggaggtggagggggaaggggaggatgagggcacgggcaagagagtgcatcgcggtggacggtctcgtgagtgagtgctgctgcctgcccctctctctctgcctgcgttctcctggtgctgctctccctctcctcccctgcttcgacctcccgcctttccccaccgtttcttggatttctaggatccagacaaccgcccttgtgagcctgccttcctgcctactacctgcgtacrtacaggagggaccttgggtgatccgggtgcttggtttcttggttctrcggctttcgctgctgttggatttgccgagccggagccgmcggag

SEQ ID NO: 5003 - DNA, 1168 bp, Zea mays
ggtgctgggccttgggccatctatctgccagcatgtggtcagtcaactctaagcaggagactttgacaaggttaaagtttagttcatgaaggtgggcaatctaattaggatgctcatgctttagctaggagtgccattagttttcctgttgaaaggcatgtttggttcctctttcctactgaaagagtttgtaatatctttactactattaagaaggtaaggggtatgctgccattactagttctgtcattcccattcctaccgttctcattcctattcccattcccggttctgtctccacccccgatgcccctcccccgcgtaacccccgtggctcaccgtaccacatgaaacctccgatcccatgacctcgacggcggccatggccgacaagcaggtgcgatactgtgccccgcctcatcccgcacgtcgtccatcctttcaccccccacgtgatgcccgcgacttcgcgagacaactgctgtccggcccccgccacctctcccccgcgtgacgccccctcccacaacgcttcacgcgcatgagtctgcgaataccggcagccgccaccgtactggagcccgatctgctagctccccctcagcctcaccaccatgcccccatcggatctcatcgagccatgcgtggcggcgccggtgatggatgcggcgttgctagccgtcatcgtcccgcctcgacgttcgatccatgctcgccacggttggtgctcgcacgcgatgtggcgtggcgaggttaccgcgggcgccgcggaggtggagggggaaggggaggatgagggcacgggcaagagagtgcatcgcggtggacggtctcgtgagtgagtgctgctgcctgcccctctctctctgcctgcgttctcctggtgctgctctccctctcctcccctgcttcgacctcccgcctttccccaccgtttcttggatttctaggatccagacaaccgcccttgtgagcctgccttcctgcctactacctgcgtacrtacaggagggaccttgggtgatccgggtgcttggtttcttggttctrcggctttcgctgctgttggatttgccgagccggagccgmcggagatgaccgtcgacgagctgaagctgcaggcaagggccagcggcggccacgacctaaggaccagttccccgtcggc

SEQ ID NO: 5004 - DNA, 1094 bp, Zea mays; identical to SEQ ID NO: 5002

SEQ ID NO: 5005 - DNA, 1145 bp, Zea mays
cggggtggtaaaaacaacctgagtaaacaacacagctttggatcattacggaggcttcggtgtacgttttgcattctgtttatttcgttggactcgtatatggcctaggaacgtttccaaaacaatcacaagttggttgatatgtttttggcttgagcattctcttcattcccaccaaggttaagtgcttaatttccgattttaaaatattcttcttacaaacagaattctagccgttttgaacgttttgctatgttctttggtcatcaccgagaacattaagcactagtgggtgcccatgtatttgttgtgtgtcatttaataatgttttggaggtttgagtgtagcattatgaaacaagccaagattgtataagcgcaaagaaattttattggtttctattcaccactctggtcggctgtttggatccttcatttaccggttgtgaattatacatgtggtttttctgttgtgcattttctagaagaaagttcttgttatgtagttactagtagtttaaaaataaagaatgcagctaaaaataatagcattaggaagcaaattaaagagactcaaaccttcgagagattctttatttttcgctttctatttgactctatatttatctttttataaagattatactctatatatagcatatcactctaccagattatctatttagtttgactagtcagagtagctagccaaatttaactagtgaataagttaatttatagagtcggatagcttgacgartcagatagctagtatgttggagagttattttaatattggataagtaaaatttagttagacaagccatttgactagtctcttagagatgctcgctctgttagtcaaagtcaatacaaatttacccgtgtaggccgcccttttgtcgaagtgagggcacgtcacggatgacgtacacaaactgtacgtctgatccatgcacatggtcgcatggaccgaatccggacgttcgcaccgatccaaaagaccaaaacagatgacgatctacatggagccatggactgaatgctgatgttcgcagaacggatagtccagagttcaaagaaactcgagactacagactactcacaggtcactgtctcactcacttgaagctctaacagcaagcc

SEQ ID NO: 5006 - DNA, 642 bp, Zea mays
ctgcggatcaggtcgggcatccttccgtgcgttggcgggcggaatgccccaagtgggggaggtgggcaacgtatggagatggtggaagggaactggaacgggcggcgtcgaggtcgccggtccacgcaggcgggatgatgcgtcacaccctaagccgtgaccgtgacgggagagcaacggggccgtgtgggaacgggcgccctcggcacatcacgacagtcccccgcattcctatgaagtgacacgacacgagcccagcaaggcgacgccatcgcttggcggatgccattgtcgagatgtaggaaactaggaatgcaacagatgtgtacagtagtacatcatggggcaaagagcagtaggactcttgcagtaggttggtcgttggtccgaatggccccggctttaatcccgaattctgcgccatggaacgcatgcaaacaaacaaagacaccagtcgcggcggcaagcgcacttgtccaaccgcgcctcggccaaaaccaaacccatcgccgaccgccttctcctcgctacgccgcggcggcggcagcctgccggtctttgacttaaggagagatgaggcgcgtcgctcagcggccagcgaagtgagtttccctttcctaggggagagagagagagagatcg

SEQ ID NO: 5007 - DNA, 195 bp, Zea mays
cttcgatcctataaaagcgaggcccagtccctccatctcaaaaatttcaatgcctctctagatctttcaagctatccttgcttcctagctccctttggcgtgctgtaccggacgacaggggtaggtaggtaggtaggtgtagctagctcggcgagcgagggagcaatccggccaacagcacacgcgtcgatcgcc

SEQ ID NO: 5008 - DNA, 57 bp, Zea mays
ctggttcgaagctacaagggccgcgcgccgccgagaaaaaaaagaaccgacggcacc

SEQ ID NO: 5009 - DNA, 1500 bp, Zea mays
atatatctacgtaaacaaaaggaaaaggtttccggtccggaagccaacctgtcaacggcaagtggaggaagctctcccttttggtctggacacgaaacgagtccataaaaagctagctccgcgtcccggcgttcttcttctggccggcggaacatgatctagggtttcatccttgctgggccgaggcgagacgcattccgatccactatagcctccgccgagccgatccgacttgtttcctggacctcctcgtccccttcctccgctgaaaggtatccatgcaccgcacctagctatagctaggtcgcaactgcaagccgtcttcttcctccacaatcgcttcatgtgtgttcctctgcggattgattgctgagtttggggtgtttactgtgatcgcttgctcagattaattgggccttaacttatggaaggcgggtagatcgatcgtcggtggtgtgggttggggtcttgattgcatgctggcttgaatctttgtatgtccgtagggtactagggtgcgtgcttgctgtggtaggaagcttctcgatgatcatcgtaactcgctcgagcctgaggtttagtttcgactttcgaccggtttccaatttattttcttgcctgatataatcaacaccatgtggtcagggaacatcattagatgaaaccggatgcaattcgttctcgaaccaaaaagcatgcaataattttaatatggtgtttcctgatcttctcttaatctgtttcgtgtaaagtgtaaacttactgccataatttccatcccaactatccaatctgattgctcggtgtgttcaagcgtgagttgttattgacacggcccacggccagaggtcttgttgtcaaatgaatgcaggattgaacaagcatttgtaggactaggacacggtagaactaaataatatcatgtgcttgctgtacaagcgatcgacagtatatgggatgtggggtatactttttggtcgcagttccatcccttttccccctccatcgtcctcttctgtttacaagcaagtacactgcttcccgactagaaagtctgtcatatttaaatagcctgcagcttacaagcatgaattttttatttggatccacttcctgggcccattgttatttcatgcaatgactgagtgctgtggcacttatgctctgaaagaaaaacgtacttgatgcaatgctgaatgtatatccaacttattgtgcaaatatctgtgacgttttcactagatatatatagtgtgttttatagtttctttaaggccttgttagtttgtatcagattacactgaatcattccagctgatcaaagtttatataaattagtgaagcaaaaatcaagctagaattcgtttcggtattcgtttcggccacccaatccgtacgtaaaaaacaaccattgcctgtgtcctggtttgactacattatgtctgacatgatcatatttcttccgaacagtttagctattattctcagcaagctagcagc

SEQ ID NO: 5010 - DNA, 1500 bp, Zea mays
gtacagagcaaacacagggaattattgctcagtactcacgctactactgattccattgcatgacgcgttatgaacttttgcgagtagtctttgaataccaagtacgtacacgacataagtgaggagctgtctgctgcgcctacgtacgtacgtgctacttgtgcatccatccgtcaggtgtacacacaaaacaaagtttgtgtgttcaatagagtgtcttaaaaaacctgcaacagtttttttccataaaaaaccctaacaaattaattcatcaactagctgcatgcttttgtaggtttatttatagtttttgctatatatatctacatatatatataattactagacttctatatacactagagaaaatggtaaaacgatttagagcatatatatagaaagcatttgaacaatgaacaatgaccccctcagctagctttgacaagaagctcgcagaaaagtgagaagacccatattatgtatacaaaccaacagccacctaactggagttcatcacgcactgaaactgaggcctgggctgggaggacagggcaaccggttgaagcaaagtcgtcaaatgtttgtcatggatatgcaaacagggttgaatgaaacagcaaataaaaaaaggctacatggccctttcgcacaaaacgtacgcagcattggcgtacgttgttcgatgaagcaaatattatacggtgctgataaacaccattaatccaatgcagataaacaaacaaacaaactagttttagtttgcatgatgaatagacaggcaagaggtttctgctgacttgcaagctagctagcaagaaaaacatgtgccaacaaccccagcagtcacgcaacaattaggcagcagctgagctctcaccccacgatgatccaaaaggccttttgttcatgcaagcagggctgccatgcgaatgcaaaagtggtgggttggaatatctctttacccccttccttaagcaagcaaatgcagcaatccgcccccctgccctgccattcaaactgtcatcttcttccagctctgtcgtcgtcgtccagtcatggggagagagagaaaagctagctagtagctagctaccctctgtctctgtgtccgccatgcccagcccaacagggtgttgctgctcagtgctcaggtctactgctgccctcccatcattaactcatcatccaccccccctccctccatagtaaactacgctttgcccatctctctctctctctagcttttaccttcttaccccttgtctttctctctctctacaccccccactctctagaaaaggacagcatccccccgtccatccctctagctagctgagctcaagccaccacaagtttcgttccacagacaaagaaacgggcgagagggaaaggagaaagacagcgctctttgtcactcgctcgtctgcaacaagctaagtgtagagtgtagttgcaaagggattgcaagagagagagagagagtgtgtgtgtgatcgaccc

SEQ ID NO: 5011 - DNA, 939 bp, Zea mays
ctgcagttactggttagtgggaatgagatgggcaccaccaccaccgccgctccaccaagaaaccccatcatttcacatccctcaaagatcaagcagatggcgctagatgagtgcattccttgcgagtcccaaccacagcccagaaagcaattcagataggagtgagggcaaagcaaccaaggtcaagggcctcagccctcggggccaagacagtggaatctaggatgattgcaggggggcggagagggacagagatggccacaactgcaatccccattgccccactcgaactcgagtgcacctcgtcttggtgctccggggaccttttacatgatgtctggtcgctgcatttcccatccccttgcttttttttttcttctcctccacaagccaaaccactagaaatgcgtagaggaaaatataaataaatgcagaaaaaggagaaaccttccatacgcttcttaaatgcaatatttattccatccatataaggatgcatgtagaggaaacggactaccagcgctgagccgttccgtttcttttcaatcttggcgttttgtctccattcaatagggaaagggatgtttcgcttgaggctttcctttgtgcctgtgtcttctctgtagctttcaagagaataaaaatttggagcttctctcgcaccagcgtcctttccttcttccttggtttcatgctgacaactagggctgatcttcaggacggcctgttcttggttcggttcctgagagcgattgataggtctgagattatatattggtgtcgttgttgtttgttttttttcgtgctcatccgttgctaaataagcaaaccatcagcccatcagcttactacaagcactcttttgcctccttttctgttcttggtgttcttggtgagacacagcgccagacggagtttcttctttaggagtcgtgcact

SEQ ID NO: 5012 - DNA, 89 bp, Zea mays
ggtacctaaaacccaagcctaaatttgccttacaggtttatgcatctaggggttcaagctggattatcgacagcggatgcacaaaccac

SEQ ID NO: 5013 - DNA, 275 bp, Zea mays
ggtaccgaccgatccaagcaccaccaccaccttgtctacctcctcttccctgggaaacagtatctgctttgcctgttgagggtcgaatgctttgtgcctctgatgttttaccacttcctgacgctgcttacatgttgcagtctttgtatgctgatgtggaatgcttcacaggtttcagaaaaccttctgagaaggcatgtataaaactttgggcaaaaggagatcttcctacccagcatatcttgcctcggaggagggttgttgtattcaatact

SEQ ID NO: 5014 - DNA, 1151 bp, Zea mays
ataataaatcagcttcatgaaaggcgcatgcaaacgcaaggctgtgtggcctactgggagtagctcttgtcctggcttgttcaatcggtagtcggtactcgactactcggtaacaacagcggttgatcgcatgggtagacagggagaaaaatatgtgcgcgtatgctccaccaaagtcaacatgtgacagtcagtcaccagacaggcaggcacacgtaggacgtgaggcaggcaagtaggcgagggagagggtctcattaacttcgacattcataacgtcacctacctccttcgtgatcctctgccacttcgccagtatatagccgcatgacggcattccacgcccacggtcgttgcatgttgtggtggcagcgtttggtgaagaatccactaggcagctgcagctccaaacggtcaagaggaatgcatcagaaagagtttgatgattgacgagaggagagggctacatcatgtccatgacaggcataagctatggagtccatccctattgattatttctggtttggagggccaaaacgacaaatatacatgcaaaattcgactctcttgatgctggtcaaggatgttaggcacagtgggcagtggcactcgcactaaaaacagtagtagcagcaagcagcggcaacccccttcgtccctagtcaaccgtaccagtagaacgtcgcccagttttgagaggtaccagacctgagtgcgggggcagcgcagtcattaacgcggctcacccaccaacctcaactcttctccttgggatcatccttctcgtccgaacccccacccccacccaccgcctcccggcagcgtagttactcccctccctcgccatcaatcctcctccccctgttcgctgtgcagtgctcagtgcatgccactcccgtttctccctccaccaccattcaccaccaccagtgccactgccactgccacacacccacaccgaattacgcggcggccctgcgcgcaggatgctctttgcctgcctgcctgcctgctactgctcatctctgcccatatagcgcgcggctagcagcttccggatggacgcgtgcgatgtagcagtggccagctactcggcagcagcgctcgctctctagacgcttgggcttggcacgccgtcgccgagatcatcc

SEQ ID NO: 5015 - DNA, 1500 bp, Zea mays
gagattgctccctcctcgagactgtcccctccacctcacgcggcacctagacgagcgacctcacgccatagggccagcgcactcgaccgcgacccgagtttcgcttcgatgctatcccggacggctagcggatgtcatcctccatctcatagtagtataacactcatttgtatataagttattgtgatattatatgttcttattgcaacgcacgagcctcatctattaacacattgattattaaattaaatttgttacctctcatattatgctcagattacttacatatcttctagcaatttcaaatgggatgttatacagaatattggaaatccttcattgaaacgagcttcctactcatgtatctttatatatttttccagcatgctcttatcatattaatacgaggtagtggtgttcgttttaaactcttgcatcttgcaacattactcctgcagaaatgatgtcactgactcattgtataatttctctgatggatatatgattaaagaatggagttgctctggatatcactaagactgcacctgtttttctctactacttattaaggctgcaagggtagcctgcctctctggttctgtcgttctgccttcggtcaatctggaccgtccgatcacatgggcccacagctgaccgccgcccagtaaccttcgagctctgaatcaatcacgcgcaatccttgctccgccagccgcaaccacctccgcccgcggcccacccgcatcgctagggacgctcagagtcttctcccaaccgatgatgtcgatctctggcagcggtttcgtgtgtcgccctctccacgttcgtgcattcgccattcccattccattcccctcgtgatttaacatttatggaaatatacaagagtacctcaacctattatagaaaaaaatagattaaataaacagttatgcttatgtttattttatatttattgatttgaatatctaaactatgatgttctatgaaagatcattcttgaatttttgcctttaaattgtcttgttaaatcttgtatactacactactaggtgagtgctcgtgcgtcacaggcccgagtttctcttcaacgtcatcccggacggctcgtggatgtcgtcctccatctcataacagtataacacacatttgtatatataaattatcgagctattatatgatcccattgcaacacacgggcactgacctattataacaaggagacaacattgtgagcggcaaaaaaaaatctaattatttccacagggtcgtggtttcgtggagagcggatgacagagatttctgacctctggatctctatcaatctaaaccgttggataaagacgctgcaaactgaatagggagcaagacggttccggagtccggactcaagtcccccaaaaatcccaatcgaacccgtccgcctatcgccccaaaccctcgcccagctcgaggtcctcgccgccggccgccggccgccgtctccgtccgaccgccgcc

SEQ ID NO: 5016 - DNA, 244 bp, Zea mays
tatccctttcattactagagtacccaaactagccctacggtgaatkakactgtttgaatcgtacaccttcgcacctggataatggctgtgaatgatatccaatacttttgcatggtctatgaaatcactggccttttacattatagtatgacaattttttattattgtttttaatgttatcttatttttctaattactaaagatttcatttctggattgctagctgttgaactttaaatagaca

SEQ ID NO: 5017 - DNA, 725 bp, Zea mays
acactagtccatgaatagacaccttttcattctgattctcttgttgaaatcgagtgcatccgttcaccatctatatatatatgttagaacacctaatagaatacacatacgggattcattctctgctttcgctctcagccattttactttatcaggtattactactcctatctgacacgcagtggcggagcacccattatgacctatggctaaagctatatctaaaaataatgtttggtgtagtgataagtacatactacttgcagtcaataggttagaagttcgagttctacgtgttgcatcatttttttttcttttttattcttcttcagtcatacctaattattattctgtcctccgccattgctgacacgggccacacggcacatagatgacgcgtcatggttggaacgttcccctatagggcacttgatatctctctctatgtatatagccattgcgcctacgtgtacatgcacgggattaactcactgccgtatgacttttcgtttttgtaacagttgtgctcccctcggccctcgcttataaacgcagccaacctcgctcttcaaagaatcaagcaatcgaactcggcacggctgcaaagcgtaagcacggttggcctgtgacgagttttgtcctgccatgtatccgcgacgcgcctgctgggagtgggagagctcgacggaggtcgtgacgaggccaccactgctgcccgcctgccc

SEQ ID NO: 5018 - DNA, 597 bp, Zea mays
tgttggattcaaataccttttaaaaaaatagaggttagcattccactagaatatatggtcacatgtggctacttatttcctgcattcaaaatgtagtcacatgagcaatgatgaactgacgatgccatatgtggctacttatttcttgtattgaaaatgtggagctaaagtgtgtatgttttgttacacaaacgttggtgttgttgtgcttcttttgctgaagcactgccttttacggttagcgacactcaatgttcgatcacctgtataaaacaagatatgcattttcttttgagcaattcttttaaaatatatggggcaatgaagagcttcatattgtgttgaacctcagtctgtaatattaagttgcaagtgagagttttatacttacgacatgctacattttgttatccttatagttggttagcctattgcagaaggtggttgaacttgtactttgagaccaaatatatattgcatacttgatattatactattatttgagcttgtctttcttattgtactcttatatgttcttatgaagattagaggaatgtgtttggggtgagtaatttttttgtgttgtttcctctatcc

SEQ ID NO: 5019 - DNA, 1208 bp, Zea mays
ttgcttggttgctcccattgcttagcagtatgacagcttttgattgtagaactgaaccaagctataatttctttcatgtatcacatatgttgttgatactcaaaactagaataatcgctgtacgctgtcacctgtcttcttttcacatgtgcgggttttcaacaaaaaatgttactatttcatttgttgttcaaccacactgttgtgttctcagtcctcatacatttgttcattcatgagtagtacttcgaaggctatggcttccgtggaagtactttcgagcagacatatcgctgctatcctgcgtctttcatcgacaaggtttgtaaatccaaatcagatgagatgccatgttttctatttgaatatgttgtgttccatgtcatggcttcatgctgtgcccagcttcatggcacatatgactatatgtcgtagttcgttatgaggtactgtaatcatctcttttattccatatgcacatctttcatcatatgtgcatatgaatcatgttgcataggttggattcaaatgcctattttcatttgattgtgaatgaggaacttctattttattatcaaaatgacttgcgaattgaacaagtaaaatgtttacattatcagtagctaagctgtagtgcaacttattggcatgtttatgttgactctggcctttctaaaggatgtcaccaaattacttttaaccttctaatgttatggtaacagaattgcatgcctgcagcaaattctgtacatctaatgctagaataatcactacagccctgttccaaaataatagtcagtatagcctttttcctaaatcaaaattctctagctgtaaagtatgtagaaaaaatggatcaacatctacaacatcaaaaaattctccatgaaatgtcttgatagtgcattcatttgagcttgtagatgttaatgtattctaaaaagttggcaaaattagagatgtttgacttaggtcaaagctaaagtgacctataatttgggaattgggatggagggagtagcttttaagataatattacatttcacaattttggaatttactgtaaaatatctctttacctttttgcagccacaacttgaggccggtgacaaaagtatgttctctgttccctgagttctgagctccgtatctattttagttgccattggaagtttacaggattattattttgcttctttccagttata

SEQ ID NO: 5020 - DNA, 307 bp, Zea mays
ggtgatggaaaacatattttctaaattatcacccatttgttttctccttttttgtatttacatgtcagttccatatttctttctctagggcatcggtcgaaaaattctaagtgtctattattaagggagctgaagcgcgtaccaatgtataataagctttttttacttggcaccccttctgtataatctagcgtagctctggtcactattgaacttcattttgcccattatattctcatcaaatcaagaacatgtcatgatataattcacacacgctttcctatttgcccctttcagtattttattc

SEQ ID NO: 5021 - DNA, 393 bp, Zea mays
gtcatatttataacctctaaaattaataattcgctattaaaaattatttgttggtttccaaataccatcccttaataccataactaattgttagtacctcacatctaacaattagtttattagctgatttaacccagctaataatttattagctaggtaactattaactctagttattctaaacaaggcttaagcttatctttatctgcacatatatatgttgacacccttgcctcccctccctcagtccctcccctataataaacgggcgccacgcacgccacagccgcggcctgcgagcgaggcatacacatccacgggccacgcccaccggcatctcacggcggaagcagccaagcagccggccgggcgcctcccgtgccgccgctgagc

SEQ ID NO: 5022 - DNA, 1500 bp, Zea mays
ttttacttaacttttctgcctaaggttagttattcaattcgaacgactaaccttaggcaaagtgtggcacatttagccacaaaccaaacaggcccctagtcttgtgttcgacgtattgtgatggccacgtgtaaaccatcgccagtgtttcgctgcatggaccccaccatcggacgctcctccttaactatggcaacgtcatcaccgcacaccgccccgccctcgaagtcgaaggctccgctagtccgcttggagagaagggaacttcaagttgcactggtaagttgcctgcatccgtgcccgtgatttgttacgatttattatatatcatataaataaatattaaaatatatatttaaatataattattatttatttttaaatattaaagtgcgtgtgatctagtggttagttttaaaattttaaatcaggtatgtgagttcgagtgctcgctttgtattttttttacggacgtgagactggagcgyaaagtgaagtcgtgctaacataagtcaccaggtgatcatattaggttaaaaagtgtcgtcgctaaaagctttagcagtcggcatctttttagcgactaaccatcggttgctgctattgtatttttagctaccaactgatggggcaaaacactcatagatgaaatcaaataaaaaccaaacattaaaaaagtatagcaaaataaaccagaaatacattataatctatcttagagcatctccaagaatctttctaaattttactctctatattatcttttagagagttgtttacataaaaaccactttctatatatttctaatatccaacaacttttctaaatcatgtttgcactctagatagtcatccacttcttctatatttggttagtgagaaatacgaaatagaagatggctgtygtcggaaggtgttttctataaaaaaatctctatccttattcattaagaacaatataaagagtctcttagagttgtttcttagcatggttttgggctttgaagctccaaatttgatgtgaatccggatacttgcctccattcactttatatcaatttgcataagaaaacttggtaatcctttttttagctcttatatatagttatatgtattaagtgagcacaatagacggtagtaaaaaaagaagcgaatgaacctatactagaacagccgaactgaaatttacgggcattgacgacggccaacaatgcgagatacaagtttttctccaactaaaattttcgttgtggcccgcgcactgctccctccctaaaaactgttccatcctttcaagttcagcaataatgtttggtccactcaaccacttttcccttgcaaatctgcaactgcaatgcccattttcgccaccaaacacgctctctttaagctaaccatcgcgccccccgttctcttagcacgtacacttgcacacactctgcaaactgaaggtgccggactagtagctccgtgtcactgtcaccaaccagagccagagcc

SEQ ID NO: 5023 - DNA, 1500 bp, Zea mays
atgtatacagaactctaaagagcagtaaagttttttttaatatataaaaagtagcgtgcagtagttggctcgaaggcccagtatgatatctattcagcccagttcttttaaactactgccactttatttgctcatcagtacaaggcctgggcttcactctctttgtccgttcaagctttcagcgaatggatgaaatgaaaactacacctcctcattgcccttcgtgttcgctgacaccatggaacgagctgatcattcggcgatgtagccatcagttgttccagacccagctttcttaggtgttaggatgagacaccaaacatagatttgtcttatcatttagttctaatctgtataattagttttagaattttagaatatatttaatacttctaacgaacatccaaacattcgatgtgacatgaactaaaaataaactaaaaaccatttagaattgtaactttcagcctgttcggttgactttaaaccgtactttcttctactgtttttacaatgttttgtctctatagattatagttgtaaatgcatgtagggtgcgataaactaaattttacattgtaaggtttaaagatcagatcaaattggaattagatctatttatattcatttttaaaataaaatttagttagggtattattattttgtaaagaagtatttgaatcgtgatcattaccactcctactcgtgaggggtgattttgttctttaaatactaaaacagtactccctctggtttcctattagttgtcgttttggataaggttcgagtcaaacttataaaattttgactacaaataactatttcgttatttagttttggaacctaatatttatatgcaccaatttatcataaaaagtacttttataaaagtataaatatattaagagtttatttgtattttaacaaaaaatactggtcaaagttatattttggagaccatgtcgttgtcctaaatgacaactaataggaaaccggagggagcaggtacataataatcctggcccggcacacattgattttcgagattttcagaggatcctagcccaatgcaggccgaggtacgactggcaaacaaccgagcgtaggcatgarggacgcgggtcctctgaatttatgcatttgtgcagttgtgtcactgcacgtgggacccagttctgctcagtcccgcgtgtcagtgacccatccacaaattcagaggatctcaatccaggcatgaggcggcgcgcgccgaaacgagcaggcaacgtgccaccgggcacccaccacgtgtaggctagggcgccacacccccctcctgcgccagccacacgagccgtcgcccgatgcacccgcaccacgtaaaaagatgcacacgtctcggtcgcccgctcgacgcaccgcacaccctagcataggaggcaaagaagtacagagggaggaggcgggcagcagatacgcggcgtgacagacacccagggccaggaagggtgctgtttatcc

SEQ ID NO: 5024 - DNA, 347 bp, Zea mays
ttttatttgaaataaatatttttatagatattactactagtgaatggaatatttagattttgtggcgagaggaaaaaaaatgtgtgtcaaagggtttcagaccacgaatctgcatctgcatcggttgtagaccggcacaccgaccgcgggtctttrgaaagacgagagcagtttccgcgaataaaatgcctgcaaacgcagcgtaccagtggcgcagaagtcgaccggcatcacagttcacatccgacaactaatcagtccatcgcgttcgcgtccacggtcagttgccggcgccatccctgcccctgctcacccctccccgcctggcgtccacgatcggcgacggc

SEQ ID NO: 5025 - DNA, 283 bp, Zea mays
ggtacgtaaccccagaatcccatccccacctgccctttgaattcaattataagaaaaacttagataacaaggatagtctaagttgtggatttaacttaaaaagggcttccttctgaagttgcaaagagaatgacattcgaagagcagttaacaagagaaacttgagtataaagaaagagtagcaccaacacaccttcaagcacccccctccaagggactctacctaaaatctcgggacgagattcccttaaggggggagggctgtaacacctcaggtgttacc

SEQ ID NO: 5026 - DNA, 670 bp, Zea mays
ccttgcggacatggtctgaagctctgtagcttaaccgtgtcatgcagccccctttgaagttctatagcttaaaccatggcatggtgaaagcccaagctcaatggcgctccagtgtctcacgcacgaattgaagatggcactaccaagtagtgtttcgtctaaacaaggaaaagaaagttaggattttggtgatttatgagcttgttcaagaatctgagtggttgaggaagtaagggcatacgtttttggcttttatgcattttatttgacggttcgtcttattaaaaaaattataagcattatttgttttgttataacttattttatcattaaacatagtttaataatgacttgtttattttattatttgtaaaaaaatgaataagacaaactgccaaacatgatatctaaaaaccaaaagcgtcgtctattttaggatggaggttgtagtgcttaattcttgataataatacaacttactctttggagttgtgctctagttcctcttattactaggcctttttgttgtgaaactatgatgtatttgtcagttctgttatgttcaaagattgaatcctattttgatgtcatttttgcgcttccacaatgtcctgattttaccattgccatgacttacagatctcaaaagttcagcgggtagcctatcaag

SEQ ID NO: 5027 - DNA, 1500 bp, Zea mays
tttataattgactacaataatgacacaaaacatcatgggtctttaagtcaatccatctttaagtaggttcggcccttcgtcttgagatctatcattgtgccgaagctctctaggtaatagcttcggtgcttgctcctaagagggtctgccgaaggtgttctctttctttaggatcttcggctacgaagcatacccccaacatctagtacctttgtttagccatgaaacttaaattaaaattattcacttatattactctattctaggtaccaaataacttcggaaaatcataattaattcattttaactctgttttgattcattcaagttgcgttagcttcgtataaatacttactatgcagtaacaacattaattatacgatatcacatacttctataattaagtaactaattggattaatttatgtctattgggattagctttgttaaaatagcgttctggtcttatggttatgatttgactaaaagatgatccttaatcaagtaatgacttagattaatgttgagttaattatttatagaatagtctctcatatgatatatcctaaccaatttataatatagtttaatatttaaatcacatatatcttttataaatcataactccttaaccgtaactccgaatttagcgattcttgtccccgcgatctcgtagcaacgcgtagattattattatgcagtttattcttatgtttggtgtgatgttaattttgcctataccatatttatttgttgttggaacttgctctcagcagcaaggaggccaacaggggtgaacagtggcgacaacagggttacgtgctcgggggcaatagctctgttaatctagcctctcacgggcactgtgcgggggtatttataggtatctgagtgcccaacgccttgtgttaaggacacatgtgccctcagacacctagtttatccccagaatattcccataaagcagggttacaagctgtaattacaagcatgcctttacagattaggcaccgtaacacaaaggcggccacgcagggcccgttacaatgggccagatcgcacgtgggccttgggactgaacgaggacgcgccgtggtaggacgtcgccgcaggccttcgtcaacgtgccgagtcttgcgaagggtgtccctgcccgctttgtctctgtcggaccagcggctgcagcgaaggcctcgagcgaagggtggcgtctttgtcttcgccccaacaacgccacaacgtggagtaggcaagcgttggtcttggcctaaccacgggataaccaccgtgccatctctgtgattgatctttgttggttattgtgttttgttgaggattcctctatagccacttggcaattattgtgctaacaattaaccaagttttgtggcttaagttttgaagtgttacaagatcacctattcacccccccccccctctaggtgctctcaattggtatcagagctgttctcttcactaagggactaacaacccgaagag

SEQ ID NO: 5028 - DNA, 605 bp, Zea mays
ggtatatgggtcattttgtgatttaatagaaacataaatttatatcaggcataactcttggatctggatcatctaacactgcatgaaagcctagaagcatatatatcttcactagaaagtgaggatgaagagaaagaggaaggcgaagaagaataaaaggtacagttaccaattcagcacatccaaattactcgcttcataccagtctactataccagtctactgacatggtcaagaacaagccttccaacctctcatctgacaggaaagaccatcacctcactttatgtagctcacagaagcaaggatgatagcaagtgtatgagtaccagacgcgcagtggaagccaccaccataacttcctagtaagcaatgccaccaccacgacctcttttctgttctttgcgtcatctcattctcatgactgagttggatagaatcgtgagatgtgtggtagtacatttggttaaagtctgtatttgttaggtgactatctatttgttccttcgaaatgtcagggtggcattcaaagagttcatattataaaaggatgtgtagatggatcacttctattagaattatttacaggagatggagaaggaaca

SEQ ID NO: 5029 - DNA, 1190 bp, Zea mays
attgatgcgcaccatcagactcggacatgtaatatacgagtcatacgacgtgtatattttctcctcctgtaaagccatacgtttttcctatacaagccttgtgtcattcacatggtatgccgtttggcccttctgtaaagatcattgcacagaccgactccaggaaacaaaattttatttttgcaatattgcattgtatgataagttctcctgtccccactccttttcatctaaaactgtaaaagtttgcataatttcaccaagaagaacagtacagtggaaaagaagagaccaatctttgaagcaaaggaagcagtgcacgtgcacctgatgaaatgatggctggtttgctcacaatcttgaaagagaatgcaaagcctgaggctgcaagagtggtccggactctggagtactctctctttctctgttgggaaagttggtttcggcctgttctgctgctcaagcagcatacggcagctcacgcctatggtggacaaccaaagattcagtgctctgattcttcttggtttgtctttctccggcagatctctaacgagtagatgttctctcttcttttcttttcttctttttttgaaagcttcactctaacctgaaatcggctttacttaaatttcgagccaacttaatcttcttctttgccaattcttttttaaagaaaagtttgagagatgcctctagttttttttttgggggtgtgtgtttgcgactacagagtctgaaatcacaaatcagagctgtatagggagcaggtggcgactgagtgactgacaaacgtggggaagatggagacaaagaaacgcaagcctgtggtctactaaagacgggggcatcgccatcgagggcaaacggaggccacaggattagcagcttctccgtgctgctgcgtctcctcctcatcgtcctctccagtgtccaggtaacacccccctgccgccaagtgctcctcatcttcttctccaagatttggaagtttttgactgcacacagcaatctccaatccccctgatttctctccctccgagaacaccacttccgattttcggtcgaactattcggcattattagaagataagaagataagatatgctcaggcgtcggagtcgttctcaattgctgaccatgtctgtggaatccatcgtattggcgttgacctccgttgcagctcggcc

SEQ ID NO: 5030 - DNA, 57 bp, Zea mays
ccctctcccaacccgactagtcggactcgcagctccgccccaagtccaggtccaagc

SEQ ID NO: 5031 - DNA, 422 bp, Zea mays
gcacaagattagcaagagatgatgaatcttcaaccatcttagtccacccaatctttgatgaaagggtttcgcctcgcctgaccctcaactcaagacgacaagtgtctcgtccacatctcactcattaatgtgtgagccaaaatctttggaggagcatccctcttgttaatggtcctcgcaggaagcgtccttattgtgatcctacatagtatgtgtcagcctctggacattgagttcatgggagcgatggactacatgtcaaagtcaatcctctagctcatggcagaggaatcattaggatccattaaccccatctatataactatgggtgggattaggacctatgcttacctattagaaggtacgagtgtagtgttccttgaggaagaggtttatattactctgtgctaatatattagagg

SEQ ID NO: 5032 - DNA, 277 bp, Zea mays
tgagcgggagctctgtgttcctatttgcagacttccggaggcgggggtcattcagagcaccacgctgtgagcggtcgcgcagagtggaaggttttggaaggaggagatatccgccagcgattcgacctgtgagcggtcgcgcagagtcgaaggttttggaaggagcagatacccgccagcgattcgacggaggagagccaccaaaggactgcacgctctgaggactgaggtaaagcttgtcaactcccgcggtctttcgcaaaagtttcttgcgggc

SEQ ID NO: 5033 - DNA, 287 bp, Zea mays
ccttcagttcacgaacaagccaatcagtttgtcgcagacgagttattctccgtaggataagttgtgcaatcatgcatggcgacacggcaatatttcaggcaccaattaagagaaaagaaaaaaaaaagagagcaatgctgaccgtaccatccaattgttcttgcacctggagataaggcctgacccgccgccgctccgtggagactcctccggcgcttccctcagatgctgctgctgctgcacaccgtgagacctgggaggcaagggataggaggaccaagacggag

SEQ ID NO: 5034 - DNA, 602 bp, Zea mays
tacccctgttgttttttaatagaagtaaagacaaatttgatgtattttactgtcgtcatgatacacacatgtctctttgcttcatgaaaaataagaaactctggacagatttaagcccacatatttgcattatatgttggaactatttgtgcaagttcgtaatagctaatcaaaatttattctgccttgtatgtgattcagtgatattgttctccattcggaaggttgtaaaacctgattatgttcgactataagtaattcctgcaattagtgcacagcatcccaaaaacttcgaataatgaccgacaacagaaatcagttataacttcgtttgctatgtttagaccttaaagtgccatcacatttggaggggggggggggattattgtacagatgtacggccatctgttcctttttgtctaataatattcttctttgctttatagagaatactagaggatacacatgtatcagcaagtggtggtatagcgcagccatcatcttccaggggacagatagatgtttttggttctattctaagagaaggttcgactgcaataaacaatgttgcattcaacctgcaagagtcagatggtaaaagc

SEQ ID NO: 5035 - DNA, 558 bp, Zea mays
gtttaagaatgcccaatataagtcttgatcgcagttactcatattccagagcttaataccctcaaagctaaagaagatggcatacacattggttctgctgtaagacttgcacaacttcaaatttttcttaaaaaggttgtagcagaacatgatttgcctgaaacttcgtcatgccaggcaatagtacgtcagttaaaatggtttgcagggtacacaaatcaggaatgttgcatccattggtggtaacatttgtactgctagtccaatatcagacctaaatccactttggatagctcgtaggtcgcgaaattccatataatagatgtgaacggtaatcgttagaactacccttcgcaaaggacttctttcttcggttatcgtaaagttgatataaaaccagaagaaatattcgctttctattatactaccatggacaaggccttttgaatatgtcaaagaatttaaacaggcacatagaagggaggatgacattcgctttggttaatgctggaatgcgtgtgtatttacaagaaactgaacgaaattggataatatctg

SEQ ID NO: 5036 - DNA, 882 bp, Zea mays
atctctgtacagatcaaaggaagggcaaaacaaccactttttggcaccacttaactcatacagagttacagaccatcggcagtcggcactcagcaccacttaactcattcagatgaagagcagaccagaaaacaggagagaaaagagggaaacttggggcgggggaccttcacttgaggagctcatgttgtggttgccttgccggagaacaggagccatcatcggtcaactggaataggatcagctgtcgactctggagcaggagaggagaggagaggtggagaggagatcaagagccgcagccaccggtcttggaacaggggcatcggtttgtatccagtgtaacaggggcgtcggcatagtgtgccttttcggctactgtagctgggccaaaaatagaggcccataaaaaaatctggctggtcgaattgctccttaattggacgatttaattgatcaagtcaacgactagtcggacgaccaaaggatctgatcaaggcgtcctcctagtcgaggacttgctggcgaccaggctgactaatcgcgattaaccagacgatttcaaaacaatgaccactctgccatgcagccaatgtatttgggttactgctatgacgttgttactaacaataacaattttgcaattaatttcggatacacatatttgtgataatcataagcagatgtgtattaatttatggtctcatctttacttctcttgttcataatttagcaaattagcttatctatatatatggacttgcacaccaatgttgttcttctattcaattgtgcactgcactgcatgctcctcctttgcatattacattcttttgttcattgtttttagtttatcttatatatttgtgaagcactaatagc

SEQ ID NO: 5037 - DNA, 173 bp, Zea mays
ggagacagaactcgccccatgtttgccaccagacacctcgctttgaaagtaacaaagctggaggggctcgagcgcaaatgcccctggaaccggataacacaccgcgatagcgaagcagaggtcttccaaaacccaacgcggcaaacggcttcctcaccccccctcccctcgcc

SEQ ID NO: 5038 - DNA, 1500 bp, Zea mays
ggggtcgtcgtcaatctccctcctcccttgctcccgcagcctacccctccacgcgtgccctcgctaaaccctagcttgggcactcccccctgccccggcggcgccaccaccgcgccgcaccgaccgcgtgcgctgacacgttggaatgcattggtaaggtgccatttcgttgtgcagagtccagactacagattgattagctgaggttcaggttgcggccaggatcttcaaatctccagcttgaaacccctctccagctaccagattattaggaactcctttccgtagctgcaagttccagccactcgctcaaagcttttgaaattcaagctgcgagttcaagtttccggacgatagtaaaaattttgagctgataattcactcctcagctcatacttttgatctattctaactctagatgcaatttgaaagtgggggatggccaatgagaggtttagagtgatggtgtctaccacttgacttcgaagtcggtgcatccctttcctgagtgttgaattcactttcccatttttcatgtccctgaaaccaacaaaacatagcaaattgattaaatttctcaccttctgtttaggttacgttactctgtacagaagactttattctgaaaatttctacttcttatttgggaacttaaaccaatgttcatacagcagataaactgcacacaaattagagtccatctattcactagtatcatcactgaagatggtctaaatagaggaccgggtgtccgggtggcgtgagaggcgttgtccctccaccaggtggggggggtcaaggtttctcacccatgtgtgtgtgttgggggggggggggagcctgctgccttgggccggtacgacccgcgagtgattggagagggggtttgggattttctcggtcgggacctgtgttaaggtctcttcttcagcccgtggaggggttgagtgtgccttgagtgccggccctgggctaaaaccgggagggcggtctatccctccccggccgagtttttttttatgttctaaataatttaattaattatacatcgcgttatcgtctctcgtgatatatacatagtactttttttgaagtttcaacactctagtgctttcctaattttgctgaagttgcttgttgtgctccagatctgcttgccgatggttgccaagttatcagatgattgtaggaagaatacactttgtcaaatggcatagttgtttgctttctgttgtatttagtttcctacgctgttcgtctgcttggttttgcggcagctgctgctacaacggtttatggtgyaaggcactaattactgtagctgcagtgaaaattgcagctggcagcgctgctagaacaggcagccgaacagtagtcctttaacttgttcactggagaattttgtgtataatttgctcatggtttgttctgatacagactgaagtgtgatcattgaggttctggttaaagaaacttctagtatcgattggcttccctccc

SEQ ID NO: 5039 - DNA, 1027 bp, Zea mays
tcttgggttttggttggttggacgtgcaggtttctgctgctcgatcgatcagctgtgtatatttttctttgtgtttctgggtaagttaaacgattggcgagacaatggttttatatatgcatcccaaggcattaatgaatgagtgcagtagttgtgtcatatgtgttcctgatttgtgaccaaggacgtccggaggaagagtgaagcagttgagctgtgaggaactgaagtgggtctacctgaaccaacgagcctgaaatatgaagtgaaatgttagctggtctcatctcaacgaaaggaacacttgaaaacaaaagctgcgaaacaaatgctgatcccagtgtcttgatttaacgctgaatgctgaagcttgacttggcccagagctaacttgtcggtgaccgttctcgagacgatttcattccccggacgactggaagtctggaactgaaatgcagggcaagattgcggatgcaaccggagtacgtgtctgatcttttagcctgaatccagttaactgtttaatacttctctcaataaataatttattcttagagctagtttggtaaacccattttcctaacgtggcgtttggatcccttcattttaaaggaattggaattcactcaataaagtaacttatttagtttggaatttggcattccaccactttccaaagttcagatataagcctatctaaaattcatagggtggaggataggaaatgattttatgcatgattagaatttgtttctaatctataacttacatgacacttttcgttctactcctctataataaaaatgtagcacataaatatttaggacatcttgctaataatagtatacaaatatattttgtataaaaatgaattagcttaattgatatatgcataaattactattattagaatggaattcaattccagtgatccaaacggggcgtaattgaaaagtgattatttttctgaggcactaggtattagcaaactcacctcttatgtatttgtatcttttagattaggaag

SEQ ID NO: 5040 - DNA, 554 bp, Zea mays
atatagtgcactgtatgtcgcgctgttacctttaactgcaaaagagcattcattctagtacagttcacgatcatagcacagctgatctctctcgtggcaagcaagctccagagtcatcgggttgacagatcgttcaacatggccagcacaacttcaaggtttgcaggtcatctccgcgccggcgcttgcgtggcgacggcccttgtggcttgttggcttgtggggcgaaaatgcaagaaaatggatgtgaattatcttttgtataataaccacacgacatcatgtactgctttaatttaacaattggtagtacaccctgcagacgaggcgaatacaatttttgacccatgcaaacactacattgcaattgcatgcatgcatgcatccaccgacgaggcgacgacctcgacacgtccgaaacaacacagcccaggcttcactgcagccacgacagccgacaagcgctggcttactttacggtcacaacttaagcaagatggacggtgatcctcagcagcgtctctgcgccatcggtgacgtgctggccggaagcg

SEQ ID NO: 5041 - DNA, 254 bp, Zea mays
agtccatcaacgaagacacgacacgattcccgtgccgctcactggccgtgggccggtggcctccccttcattccctctgctcccctccctcccgtccccatttcaaacgcatctcccccctcacctcgctcgcctacgtacgtctctctctctccgccgcgaccccccacaggcggcgccggcgccggcgcccgcgctgcagctaaaccaaaccctaagccacggccaccgccctacgccgcgggctctccgcg

SEQ ID NO: 5042 - DNA, 814 bp, Zea mays
ggacatgtttggcatggctccgctccacttcagaacaactctactccaaaactttggttggagcagccctactccaaaacgagcagctctgcttcagagtttagattgctttcataaccagtgcagtggcgggtaaataattctaaactctatgtttagattgctttttagagttttgagagtagcaaaagaggtactacaaaggtgtttgggcggctccagcttccaacgtggagacgtagtttataatattaatttaaatagttttatttttttaatctaaataataaacgaaatgacttatctaaatgtattctaaagccttacaattccagctccacaattttttggagcacctaatgacatgctccaccaactacactaaatttactggagctagagctatctcaaacatgacctacaaaaatttgtactgtaactctgaaaattctatagagtttgtaactatggagttaatgtgtttggtaggctcttacttaagctatgtttggatagctacaactctataaaatttgatggaattagtgaagcaggttattagatactccagaaaatcatgtagctagagctgtaagtctttaaaaacatttagaaaaatcattttatttattatttagattaaaaataattgtaaaactatttaaattgatattataaattacatctacacactcaaacacccccctctaaagttttgctctggccaaacacgtcaatagtagagattttggactacgattcgtgcaaaacactaaaaaagaaaaggccatcgaaaacgccgccgccgcctctg

SEQ ID NO: 5043 - DNA, 370 bp, Zea mays
tgtatatatgtaactactcacttcgttttcttttatcgcgttctagttcaaaaataaactaatcggcgacaaatattcgaagtatctagccttggcgtctctactgaatgtacctctactgaatgtactcggcttcagttcttaagtttggtgtgttggatgtctgtttcgtcttccttttattttctaacaacaccaggttaagaatccttatttctccaatttatgaaggcaagatacacattgctgaaatgcttttagctggagccagacatgcatgcgaaacaaaacaaacgctagctagctagcctcgagcctctccgtcttggccatcagcgccagcttccagcgtcatgttctgcgtcgactc

SEQ ID NO: 5044 - DNA, 517 bp, Zea mays
ggtacttctcctattccaccttgtgctcctactagtagtgtttttattcttgagtagagcattttcctttcaactagcatgtctaattgcatataaattacgtgttctagatatcaactcaatatactaacgaggaggaaattaaaaggaagagaaagaagcgaaagagagttgttgtattagcctagtgtacaataaagaccaagcaaatggagagggtgctaaaacagcagctgaaagttcaaaggaaatgggaaaagagaatgatatcggaggcaaggatgctccatattctgtatctttctcgagttagtttaaaaagacaaagatcagatgattcatttaactctatatggtgtgataagtttgacatgtatctgcattgaaagatgatggtccaaagctaccctcttccgccgaagttctcgccacattacaagaggttgagggacttgatgaagacacagaacttgagctttatgacatcctcacctctaatgcacgcaagtttgagtcg

SEQ ID NO: 5045 - DNA, 1500 bp, Zea mays
tctaaagttctcttgctcacatcgttttgagtttgctcccaaagtaatccgcattgattgagcaactcatagcaagagaaactatcttccgcactccaaattatttctaacactaaccccaggtatagtgcgtgttcaaagtttataattttcagatttcgcctattcaccctcctctaggtgactttgacaactcttatgtcttgtcttggccgactaaaggtgtgtttatagcccaaaagcccctaattagttgttaggtgagattcaaaaaatctgcacctacctcgaatgcaccagacctctgtcgtactggtctggtgctacaccggcttgtctgatggcgtaatcaatggaaagctgccaagtctggtggcactggactagtctagtggcccaccggacaccgtgatgccagctgccacgtcatctagccattgaagtgtccattgaaacatgaattagtcattgagtccaacgggtctgatgcacatcgaacttgtccgattagtcgaagtcttctccttctctcttgtagccctctctgcgcagtcaatctagtgcaccaccaaacttggtctggtgtgctaacagaccaaagacttcaaatatttctcttggcgcattcgctccggtgcaccaccagactggtctggtgctccaatcgagctaagtgctctctatgcaagtggtctggtgcaccaccggactaaagaactgaaacttgacaattttcaactttggtttttcaagttcaattggctaaccttgagatcatttatatgacttagacaaacttatttagagtctgtccaactagtctaagtcatagttttagtcctttttcaaatctctaatgtagaatcatgttctagcttaaacttagtataaaaacacaacttttccaaaatataactttccaaattctctaaggtgctagaaaacatttctatgtacatttataacttattccaacctttgaattgttttttatatttttatatccatagaagaagtgcatcactctaattttttctagctttgctactgatgttagctgataacctcttcaattatctaactataatttatgaggaaatttttttatatgttactgtaattttgtacagtatcttgtttgccatcgtaaatgtcctaatctcttctatattacttggatgtagtttcgtacctttgtcagtttgtcctaatctcttctttactctcattatattaattgtcaattagtataaggtaataaaatcagtcgttggtctccttatatatctagctaacgtgtgattgttgtatactgtctatatctattagggtttgagagtattttgtgcagacaagcggatgtctgtatgaaatggaggggttcgacattcgctgacaccatcataggcaccaagtcaaccacatatataactagcgctttacatgtcatcccacgatcccaaataactcagtacatccatcagtattctctaacggtcc

SEQ ID NO: 5046 - DNA, 648 bp, Zea mays
tagatgtatacataaacacacatgtagtgtagtggtagctacaagcatatttacttgggggtcgcgggtttgaatccctttgggcctgttttttttaatttaattttagctagacgtgggatgtacgtgaagagggagaatgagaaaagaaacagatcttttactgccttaataagtagtagagataatagaaattatgggcgattggttggtcttcgagtcggcttggactcttctcttcctcgccaactcctccgtggcgccgccgtcttgcctgcagctttttgagccttcgtcatatccacccttctctctgtctcggcatctgtttgagcagtacaaaccctatttttggaattttatagcattgtttcgtgatcagtcagttatatttaacatatggtagaaatctgagcgactttccataatatttttctaaaaccgcatattcgtctcttcgatactatttttctaagatcggatattttaatggtacagatctaattatcccaagcacgcttcctcgacttcctatctcgactctcccaagtcacaaccctcgacctcccccctactccaactactggaagcgccgatccatcaggttctgatcgattcttctgccccgatccgcagcggcaagcggag

SEQ ID NO: 5047 - DNA, 873 bp, Zea mays
tctaatacaagatggaaacaaacaaaaaatacaatgtcatcagataaataagtgatgtgatctgcaagcaagatgaataaacgatgagaacatgtgcatgtcaacagatcaaagcacaaagaagaggaaaagctgtgagatgaaatgaaatgcacaggacataggtgaagaagagcagtatcggatttaggcccgcgtacattggccatctcgatgccatccacaacgaacggagcgtccttctcgcccgtgccagactgctgtgcatcgacgacatgcttcaccgtgctagacacgcctcgtcaccttctcgccacctagggacgccagaacataggtgagcagcacaggacatagatgcagtcactgaaacaagatagggacataacacatgtcacaaagtgtatgattttcaccatgaaactttgagaatggaccctgattgatttaattaacagcttgaatcgacgaacagtgctgcctataaagctacaaagacaaatctagactgaataaatacaaaatctttagtgttgccaaattgcaaaatatctagcacaaagaaatttataggcaggaggtgcttcaggataaagactgtattgttcctgcaattcctggtctgtcccttcacccttacatactctatgtatatagttcatgcaacatttttagtatccgatggagaataataccatcactttgcgtgcagtgttcttcgttgtttcaaagaagtccacattctataaagacttcaaggctggaaactggtctttgccatgaaacagaaccggacactaaggttcagcttaaattgatctctgagacgggcagcatatatggcaagaaagcagaagatgccctcttgtgatc

SEQ ID NO: 5048 - DNA, 505 bp, Zea mays
tgcatgcctgcagacctgataaaagccactccttttaaaccaaaggaccatgatcacaagagggcatcttctgctttcttgccatatatgctgcccgtctcagagatcaatttaagctgaaccttagtgtccggttctgtttcatggcaaagaccagtttccagccttgaagtctttatagaatgtggacttctttgaaacaacgaagaacactgcacgcaaagtgatggtattattctccatcggatactaaaaatgttgcatgaactatatacatagagtatgtaagggtgaagggacagaccaggaattgcaggaacaatacagtctttatcctgaagcacctcctgcctataaatttctttgtgctagatattttgcaatttggcaacactaaagattttgtatttattcagtctagatttgtctttgtagctttataggcagcactgttcgtcgattcaagctgttaattaaatcaatcagggtccattctcaaagtttc

SEQ ID NO: 5049 - DNA, 220 bp, Zea mays
gcggaaaaccaaaccgatagccgagagcaaaagctcgccacggcacgccaaaatactcctccccctcccctcatcgtcctcctcrgctcggccgggctcctctgatcctctcccagtccggcaaaatacacctcccgctctcgcgtcgcgttcctgtcccgtcgtgacaagcacaaacacgtagtagcagcaaaccgaagcgacgcgtgcccgtcccgcg

SEQ ID NO: 5050 - DNA, 314 bp, Zea mays
ggtttatacttactaattcggatgttgtaactcatttcgttgtagaaatccactaagattcaaattataaataaaattcaaattttcatttaaaatctgcacgcatgacttaactttaaaaccaatcataatttgttcaagagaatagcaggattgtgagtgcacctaacagaacgatgtactttaccctttggcagtggagagcaaggtctgccacaagtctaggaaacttcagctatgaagtcggtaaggatggctggggctggagctggatggaccgctggatcgtagcatgaccatgggagtcgcgatcc

SEQ ID NO: 5051 - DNA, 1176 bp, Zea mays
ggggaaatgtggacagcggagcggcgcaggctgatgaaactgaaggcaaccacaacctgaatactgatgaagagaaagcgcgggaagtttgagtttaagtgaacaggctgaggcgtgtgaataagctgaacccaaaatatcttgagccaacttaggtcgtgtaatagttgctgtggcgtttacaattgggccatgtgccgtgtaatagaacggcgtcgttgccatataaggagaaagtcagaccggaagaggtaacgaagaacataaacctgattccttcgcccaactcttccctcttctagttcttcttcttcaatccaccttctctctacccgctaacttaacagtggagtacatctaaactagcttgtcagttgtcacttggagtagaaccaaacagactttgatcatgcatgtaatcatggcccggtaattaatgcatggttgtgtagagcgaccgagcgagcggtttgatttgatgccggtgaggtgacgtgacgacgctaggtagctaacaaggaggtagacgatagctgctacctgctagcaggaggtgtgtgatcgagagttgacagccggtgcaaaaggaggaggccaagagaagaagagaaagcaaaggaggagggagtgtgccggagaagaggatccggaagccaaaaccgtgctaaccgttgtgccaaaagccgccaccacggctgaccgacggacggcacggtggattgattggaaacgcgccgagatcgacccagccggccggcgcttacacccacgccgcgtcagatcacaggggccgggcgcgggcgggcactgcacggcacccacaatacggcacgcgggcgggcgggcgggcacggtgccccacgcctttcacggatcgggcagctgtccccgtccacgccgcgcaccgcgccccgtcctcgccaccccgaaatgcacacgcacacgccttgtccttgcttgcttccttggcaccaccgcctcccctcctctccttattaccaccacctagctagcagcggcagcggcagcaccggcctgttgtgctgctcgctcagacagctctgctagctgcatcctcctaactctccaggtctctctctcctctcccaactcccaagtcccatccggatcgagacgctggaggcggagcgcccccccgggacggcggcggcgacg

SEQ ID NO: 5052 - DNA, 1500 bp, Zea mays
acgtgacccgtgcgcccgcccgaggcgcacaggctcccgccgcctacgcgcgcctccgacgtgcggggcccggactctggtggtcccggatggtcagcaacgtcttggcccacgccgcgtgcacaacgaacaagacgaggtggtgggaaacgtgaactatatttaaggaaaaaacgttgacacgttttatcgaaagaaaaaaacatataattaattaatacgccctcacctatatgcttgcggtaagacggccctgtgtttgttaagctatttcctggctaaattaaaagcgtggtattttataagcaagcaaaagtagccatttgcttatggaacaatgtagggtacctatatattaagatatatggaattggttagtgagttatatttgtacttcttctatcttaaaatatagttatcttgaattcaaatgaatgaatatagacatatttaatgaatatatatttagtataaaatagattatattttaggacaaggtattatgttagcttaaacacacacttacgtccgccacgcaacatggtgcatgctcaatttgaagtctacctaccgctttaaaagcatctacaagaagagccctaaacaaggttgtgttttaaaatatagggctctgtaccataaatcactctcgaatattggttttatttatacaaattcatcaaacgattatagagctcggtctctcagttgctaaatatagtacccgtttgttgaagtcttatccttatttcctcttaatctataactatttatttttctaataataaaatttattttctaaataatactacatcggttcttgaatatttatcgtcgactaatttatttataaactaaaacacgacaaaaacggaagaagtattatttaaggtcttatcgttgaagtaaaaatttctttcggagttttaaacacttaaatggttttagatgctcaggggaaaatgttcatattgtatagctctcaaattgcaagagtcgtatgatattgtgcgaggggtttaagggcatacaaaatataaatatcaggtcttaatagtgaaagagagcagtgggccggggcccgaatcaagtttagtcctcgggagccctcgcgtgcgctctcttttcctgtgtctgctgccgacgaaagggcggccgccgccagacctccatcttcgtgaccttcgtaggcggcgagcacccaccaggtatgcgcaccccttgtctttcatttctcgtgtgcgaaaccgagcacccaaaccctaaccctagccttgtatcccgtccttcctgctgtgcgaacacgagcacccaaaccctagctatctgtattcgaatctgatcttacccaatcccaagtgtatacatatgtattcctgcaaactccttttgttttttttttgtttttttgcaaaaatatcggttgtcgcccagctggccgttgtacctcctttacactaacattgttgctctctgcttgtttgtggactaggagaaggc

SEQ ID NO: 5053 - DNA, 1500 bp, Zea mays
atattcgagagtgatttatggtacagagccctatattttaaaacacaaccttgtttagggctcttcttgtagatgcttttaaagcggtaggtagacttcaaattgagcatgcaccatgttgcgtggcggacgtaagtgtgtgtttaagctaacataataccttgtcctaaaatataatctattttatactaaatatatattcattaaatatgtctatattcattcatttgaattcaagataactatattttaagatagaagaagtacaaatataactcactaaccaattccatatatcttaatatataggtaccctacattgttccataagcaaatggctacttttgcttgcttataaaataccacgcttttaatttagccaggaaatagcttaacaaacacagggccgtcttaccgcaagcatataggtgagggcgtattaattaattatatgtttttttctttcgataaaacgtgtcaacgttttttccttaaatatagttcacgtttcccaccacctcgtcttgttcgttgtgcacgcggcgtgggccaagacgttgctgaccatccgggaccaccagagtccgggccccgcacgtcggaggcgcgcgtaggcggcgggagcctgtgcgcctcgggcgggcgcacgggtcacgtggcgtcacgaggcccccctgacctgacctgaatggcttcttctcttctccctcccggcaggccgccgtagcacacgtggcctacacgcgctgcagtgcagcctctgcctggctggctcgctccgtttccgcctaaagctcgagccgagccgatgaatggcggaagcaagaggagaggagtgaacagtgaagaagcgaagccgagcgggtggaccggtgacgaactgccggctgtcggctgggctcggatccggtagaaaagggcgtgcccttcctcctccgcccatccattttctcgcaaggcaaaggcagccgcagccccgcagcagcagcaccagcagcggcacggccccgaggtcgggtcgtctccccacacccgaaatcccctcgcgcaccacacaaaatcctccagccacctccccaccccaccgccggcgctctgctcgccggaccttcgcacgcggccggagacacagaaagaaagagagatccgggccccgccggctccgatatccgcccctcccctgcccgcccgccgctggattccgcgccctcctcctcgatcctaccgcagggccctcactctggtgaccacgcctcttctcttttccttcccttccatttaatttcgtcgccgcacctccgtccactgcatgttcgccactacactactactagcccgccggacgatacccggatgctcctgtctcgtgtccggaatgcgatggtgattggtcgctgtgctgctgggttcggttgatgcgccccgaggcggccaggccagtgaccgagtggtttgggctgtttggctgcggatgctttaggggcttgattgggctggaat

SEQ ID NO: 5054 - DNA, 1500 bp, Zea mays
cgtcgtgtagccgacccgcccaccgtattccgtaacccggttggtttcttcagtgggagtgcgtgttcgaaacaataaacctgggatgttgttcggcggcaacaagtgcggaccccgtaccagatgcggtctgtacgggttgcgcttgcgccccgtccgtccgtcgggttccatcggcgacaagtgcggcgagtggcgactcggagcggtcgctacgtggctccctgtacgaacgagaatcacgggtccatacgcgaccagaagccaaaaatcagagagcacacggaataaggtttctggactctggagagaaaaacggaggacgacgaatgtcgtaaagaggagtatgatggatcggatcggagctggcacggccaacgtacgagcacatttccgcaacgcgattccttcgctaggacttttgtgtcgcgccgcgcgccccgttcgcaaccacttgcgcagcgccccgcatcataaagccggtaccgtgcaggcgccgtgccacggcccacggccgacgttcgtcaccaggtcaccacaccacacacggcacgaatgcggcacgaaccactggactgcagatgcctgtgcgtcgtccctttccatgtactgcttgtarcatcctaataatacaggtagatgagatatctccagcacgatgagaagataagcgtatcggccatgcatgacttgtcaccttcgccgaccgtcagtgtgcgtactttcgcgtcagcgattttagtcacagcgaaggaagtaccgattcacgtcaaggtgcgcggccggccatcggcgacgcgtcctgcctgcgtcgtcaatgggatgatccgctccggtgccacatttcccttgcaagtatgaggtcgacgcacgtgtttacgggttgatgccgatgcatggtatgttatttagcggcggtaatggatcgtgatttaaatgtctctctataaaatgttaaggtattaaataaattttagtttaaaataaataaaaatatagctcgcttctaattcgatccgatgctttaatctacctcggccttttttttctttcttcaaaaggaggatgtctcgatgactcgatgtggatgtctctttatgactgggcctgacaggttggtattttgcgcaatggcttgcttgcacgcgccaatcgtgggccggtggactggagcagcgcagcatgcattcgatcgggaaaggagcagaccgtttaacactacctcggcccagtggctgagaagggcctaaagcctaacacaaaggcgccattccgatctaaggttctcagtgaagttggtgttgaagcccagcgagatgctaatgaggtttcaactgggcctctcaactgccgcagaggcccaacccatcagccaccgccaagccgcattacaaagaacgcgaaccgccgccagccgaaaccctacggccgccgccagcatcaagctccttgctccccgaccaaaccctacctgtacccgccgccgccgccgcagcagcc

SEQ ID NO: 5055 - DNA, 1500 bp, Zea mays
tcttcctcttttacacctacattcgaaccatctatttagagctttcaatgtgcaattcgtctttggtcattgtcaacatgaaccgtccagtgataatgctttgatgctgactaagaagtacggtctccgttcttaaatatttattgtctaatatttatttttaaaataaaacatgataaataaaaaagaacggagtgagtagaatacattgtgagctgttgttggtttgttgcacattctttacttgtttttttttacgaacatttgttgcaagcatcagcaaagccgtataaacttgtgcagctctagatagcgatttttttaaacaaaaccttaatattagattttggagcattgatttagaaagctgagcaactccaatgggagaggtgtttattttctcgtccatccacatccgccgttggcccgttgtttcttttctacccgcgcctgtggggcccaaccgtccggtcaaccgaccagcgtttcctgttccaccgtacgtcgtcgttctcgttcggtcgttttcgttcccctacctccagtccagtcccaggtccgagccggaccttgatcgccgccgtgcctcggcgcaaggaatggggccttcggtcttacccttgcacgcgccgccggcatcaggagacgtctctgtgtgcttcgccgtgccttcagccgtagccggcgccgcatcagcgtgctccagagaggaccgcagcttccagcacgtgtccctgacaccgccccacactggattgggaagggccgctgaccccacgcacctgcccgctggccagtgttggaaggtttgggaaatgagatgttgattttaagctgacttttgagggttttagcttacagctttttaaatcaatcttcgaccaacggtttgaaattccgtgtttagagttgaattactcgattcagaagtttaagtttctctaatttaagctaaagggagaagagatggagcgcctggcttgagttggccgcacgcagctgggaagaaggatctgaaaacactgtcgtccatgtattgattcacttaaacatttgtccgtatctattattttaatttttttataatctacggtcacaagatatgcctgtgttgtttgtgaatagaaaacactgaacaatgattgtgagtcaacagctatcattatttgtgttttggttatgcgagggtatactaatgtctaatgattggctaaaccttagtcttacatcgctgtctttccttgcgctgtagggcaaggcaaccaccaattgggtaaaagcatataagcaggcttaccgatcaataaatataaaaaagggtagctttcaagaagtctgcttatgtaataccattattttccttctttttttacctcgaaggagtgataatcaccaaaatagcattatattgtcatcatacggctgcactatctttttcttctgtaacatgccgtctaattattatcttcagtttcagactcagttatttgaaacatcaag

SEQ ID NO: 5056 - DNA, 1500 bp, Zea mays
ggaagccctgagaatggtaagcaaccacattagggcttgttcggttattcctatcccatgtggattggatgggattgaaaaaaattgtgaaagattttgacttgtttggaattgaaacccatccaatcccacccaatccacatggattgagagcaaaacgaacaagccctaaaagagttcgcattccaaccagtgcgtagatttcaatactgagtataaacgagcaagcaactgagcttatcgttctttccttatttctttatgttttttcgaagaatttatctgctaataacctttcgtctcagccgccatatattaaacaaaatatccgttttcttttcctgccaatcgtactatttcccttgtaagcatagttttttttttaccgcatgaaacaaagcctttgtcgtggtttacaggttcatgcagagaagcagacaagcagaaaccacaactgagccatagagcgagacgaggaccggcttcattttcattttcatttcacagcgacgtctaattaayttccattccatggtttgcggatggggtttgtcacggacgagagcgttttgttatttttacatgaggccgatcgaaggatattttccattttgtacgtaggaaattgacaaggacgtgttggtgtgcctcagggctcaagctgtcgtttcacttggccatctagtatgattgaagttactgttccggagctttcctgctcgtccttcccggtttgatacttttgattgttagatatcttctgttcgcttggctttaatttgtaccggttttacttttgtactagtaccacactgagttagtgaggttatgtgcagagatggtagtataggaccagctaagggtttgttcggttagctctcaatccatgtggattgagtgggattggatgagtttgaatcccaaacaaatcaaatctcttttcaattttttccaatctcatccaatccatgtgtattgggaataaccgaacaaaccctaacctgtaccagagtggattttctgcttagccttcttctggctgcaagacttaccttggccgcgtccctcgttagggctgttgtgtgcttccggtacacgcggaagcggaacagatcgaagtgtcaggcagcagcaatggagttcagctccagcagcactcccgtgaccgtgagcgagtccgatccgtgatacagcccccactcccgccgcatgcagcagctggtgcagacgacaaacgtaccggccgccgcgcgtccccatccgtcctaaaacaattttctcgtcaatgttgatggcgggcgcgggcgcgggtgcggtgcattatcactgaatacatytgtgcttaacagtataattatgtgtggttccatacttccatcctcgcatgcatgtgagggccatagctcactgtcgcatgccctgctctgcttcagcaccacacacacacaacaatcagtgtggccataacaagcagctagcgagagctccccgcgtccagcc

SEQ ID NO: 5057 - DNA, 262 bp, Zea mays
cggtattatatgtttccgttgcaacgtagggtcactcacctagtattgatatatgaatatacaaataagccgtagtggaaagtgtgatgttgggccaagcctgaaagcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcg

SEQ ID NO: 5058 - DNA, 182 bp, Zea mays
gtcagttcacatgcatctcactgctctgctatacctgcttaattaattaattataataccatggaggaatggcaactgatcgagtgacccggatggataataatatctagttatatatacactaacaagcaaaaacatcgtatcgtcagttctggaagatcgcggcgatctacagtttcgac

SEQ ID NO: 5059 - DNA, 115 bp, Zea mays
ggtgacatatgatacagctgggttcctggagaagaacagagatccactacactctgaatcgatccaactactatcatcatgtaaatgtgaacttccaaaacattttgcctctgtc

SEQ ID NO: 5060 - DNA, 1500 bp, Zea mays
tcagtttgagtacttttattggctaagtacgaaaacattaactcccggtcaagagaaaggtggtgtgtgtttgtgcgtgcgtgcgtgtgtgtttaataaggcccagcagcctccctgagctggtcgttttatatggccagtcaagcgttgcagagtagtatattgtctatgcattactacttgactaagcagccactgaactctgcacaggtctacttggccctcagagtacacattattcaccggccagtcgtcgtgcaaagagcacagtttctgttaccgctgatgattggatgccgtaattaatagccggttcccattcccgtccagatttccatcgcgattcgcgaggaaaagcgtccgtgtgtgtgtacacgcgcttcaaactgttgggcgcatgtacacgtacgtacgctcggacgtaccgatccactgttgagagtgaaaactgaatggggagggggagagagagaagaaagagaaagagaccagtagcaagtagtagtagatcgacgatcaggcaggcgggctacagtgctaaccttctctctctctatctctctctggccgtgcgtcgtccttgcaagccacacatgtggtgagatgacatctacacgtgcggtggggacgcccgatgctttgttaaactcggtgaaagccatgagagatggcagcgggcggtgtggtggtagtagtagacagctgggacagtgacaagccttgcgtgcagtaagatcttctgcgcccttaccttaattacccctcctccgcctccagtttttaccgcgcgaaccctagtaaaataactcccgccagtgtgctctctctctctctctacgactatttttcaccccttctttcccagttccgtgccttgcacttcgccttttcaaaaagcttttgccatatgcagtacacatgtgttaatagagtagtaactttcttttcttttgcaaactgattgagatccaaagcaagcaagcaagcaagctgtatgtacttgcaaacaacacccttggtagctatccccctcccgtgcccgtgcccgtgcccgtgccctgcaatccccgacccggagcagcagccaccaccggcgcggcgtcccgcgagccagcacagacgatccctccccattcccgcccgcactgcccagcaccaggaggagcagctagcctatccaacagtgaaaagcacacacgcgttccggactccggactacgcccggccctcccctcccctccccctcctcctgcggtttttagacaggggagtgcgtgcgcccgagcgatccgtccatctgacgggaatgagagggtgcgtgcgtgcgtgggggagagtgagatgcctgcctccctgtagcgtgtaggagtagctctggcctcttcctctacctccagccgtgcggttttctgctgcggaagaaacgggagcagtgtcgctcgtcccgctcgcgcgcacatcctcaactcgtctccgtctctcccgcggcaactgacgacg

SEQ ID NO: 5061 - DNA, 1500 bp, Zea mays
actcgtgctctaggtagagacatatttttgctaagtttatatttctttgttattgtgtaggacacttggctgaagggacttgaaattgcacttctcttgaggcaccgcaagaagaagaaccgaatgagcaacatttagctgttgcgactgttgaacatgcaagtcctgatcaggtttcttaaatttgaatcaatgaaacattgcccattgcgggactgcagttgtgcaacaaaagtctcatctgctgtgcatatgcacagtactgaaatttaataaagatagatccatccattagctagtatagtatgtgtccatctgcagtgtatgtatgcgcaagcgcatgtttatattggaaacaaagcatggtaggtatcagtcatgtcctaaatcctagccgaaacgaacaacattcagtgaaccaccgtgttttattttagagccagatccaaccctaatcaagtttgagtgaaccagccggatccattgaacttggcctaggaacagaaccgtgtgtgtttttaattccagataatcgaacggggcctaagggatatataggtacttattcccgccggaattcatacatttcctgcgacaagtatataaaacaatattgctatgggatagaaagaaatgcgacagaaagctttagctattttctgtacttgacatgtccttagagaagcaaaggctggatttagatgttgagtgcccccatatttcattttcctctcttttttcttttaaagattgatcgtgacgaactgaactgatgcatttcattggggacgacactatatatagtttgaaaaaagtaataaaaacttttcataccaaccaactagaacatgtaatatgacaaaagcagcttggttttcattaccacatgaaaatactcttgttccaaagtggagaccaaagataatacgctgcaaacgtgccctccaatcccccatgtccatagctagaaaaagagattcagcacttctgaagaaggctgttctatcctcggagggggcaagcttttcagggatattcgctccttggtttgggtgaactttgagttcctgtgagtcaaaattcatgcaatgtgacctttttttagtcgggatttaataagttttaagcgaaataagatccgccctagcgtgtggtatagcagagacaccatgagacgagacagagctggcaaacggagagggggagagagccgtgtgtgtgtgtgtcggccgaaacatcgcgatccgacgtggcccaatggcgcgtcgcggaaccttatcccgcggcgtcgcccctgatccgaactccatccgctgcccggggcgccgcgcaccacaagtaggcgcgccccggcgcgcgaccccaccgccgccccgcctcccatcgttacgttagtcgtccgcccgcgctagtgccatccacactcttctcttctccccggccggaccggagtcaggcagccgaagcaagaaaagcaagcggctttggaagttgggatcc

SEQ ID NO: 5062 - DNA, 97 bp, Zea mays
gtagaactcacatcgaatgatactgtttatcagattgtaattactgatacttccgagctccaccctcagggaaaggtgattgattggatgcctgaag

SEQ ID NO: 5063 - DNA, 1032 bp, Zea mays
tcccttaatctagccactgccccgagcaccccacgtcaccgtcacatcgtcgtcttcaacatttggatcacaaggtcagaaactccgcacgagtagctacatatcgtactgatttaaacaatttgcacagttatatgggtcaatgcaaggttaggcttttattatttttgtttatggagtgagtggaatgttagtaggactattagggattttcattggactgatcgtgtggtgcctactaacttgtcgatgacttaatggctagttgagttatagatttacaatcaattcaagtaagatttggttagtatttatattgtcttcctgtagtgcatagattgaagtatatgtggttgtcgaccattgtgtcgttgatgtatatgtgcatgtcagccatcgtgttgttacttttatttgcaagttttggaaacctccatgtgtgggggaggtgctgccaagtttttttgttgataggcttgtgctttttttgcagaggccttcctagccattgcgagtctgcctacaccgcgttgtgtcaccactgcaccacccgccacagccccgctagcctgacttcaccgctaccctaggtataaccttgatttccgtatcatggtcgtagatgacatacccagttaggcatctccggttcagaagagatacggtgtagatatgcagatctttgcatatctacaaatctatcagtttcgaattgtccacgtttttggacagcccgtggttgcgtagatggtgttagtttccatgctctactccggtccgagatagagtttcggcgtcacctccctgttgttctccggacagtacactctccctgccaggacgtgtatccggagaacagcgggtaggtgctgccgaaattctatctcggatcggagtagagcatggaaactaactccatctacgcaaccgcgggtgggattaggacctatcctcacctattagaaggtaggaacgtagtgtacatgcattacatgtctatattaaactatactcggttatatatgttagagg

SEQ ID NO: 5064 - DNA, 154 bp, Zea mays
ggtgagtgagagtgagaggccggccgcggttgctctgccgctcctctgccccggccacgcacaccatttcatcttttctcgatcagaccgtgatcgactgatggcttaattgacgacctagcaagcatagcaattgttctcttctcgcgcgtgc

SEQ ID NO: 5065 - DNA, 125 bp, Zea mays
gtatatatgtcggaattcgccgtagcgtgtgattaggttttgttgttcttctgtgtcggcctggtcttcgcgtgttgtgttttgttgtctggcggaggcgaatctagggtaacggtcagtcggga

SEQ ID NO: 5066 - DNA, 1243 bp, Zea mays
cgtgagtagcattcctttctcgttttccctctgggctaggtattatgtttctggttggctatagtcagaacacctggtagtttgtgtgccactactgcggtactgctcttctgatgcttcagcatactgcacatgagcataccacgactgttaagactaaactgatagctggctatcccaatgggctatatccatgataagacttaggccttgtttggttctgtgttcccaggaattgagaggaattgaaaagtaatctaacaataaaatgagaagcactttctagatattggtttcaattcatgggatccaaacatgcagttagtgaactgcactttgtgcccattctgttgatcaaacggattggctttggcatctttcattgaagcaatacagcaacacggccagaagttacataccatattaggatggactgtaaatttgttcgtcactcttgctgttattttcgttcagctgcatgcacatgagctcattgcaactgttaacaatacattttctatattggtgaaaagacctgtgactgtgaactgctctaggtgaccattctgttcattacacggatgacggccaacatccttgataaagcaatacattgtaccgaccgtgtgaccgagtaacatccctgaatgttgcatatcatgcaaaactgtcgtcttcaattctgaccttgatccttggtttgtttaacaaccaactgccctagtcatatctcttgttgcaaccactgtgtgccattcaaattttttatttgccaaataatccttacttagctatggtctatgggtattaggtcagttgaccatgtgggcattaatagagctcttatgcagacaacagcttaccatgttgggaaacaaatagagagcctataccctgcaagatggtcatattaatagcagataaccatgcatcaggtgcgcttatattagcatctttgccattgtgttatgtcattttgggtgtctgtggtctaggccatattaatctgtgaaaaatattacaatctgttcagatacgagaacataatatgaaacctatgggtagtgtgaacttgactgcagagtaccgaatccattttaactgaaaattatcagtgaatgtgctttccacacaatatatcttcttgccagttttcttgtgcctattcttttggtttactctcaattttattacgttgagcacttctggactgatgttattgactatcttcgttttatagggc

SEQ ID NO: 5067 - DNA, 376 bp, Zea mays
ggttagcttcttatacttatctaattatgtataactgttctctgatagtgatcatgcacaattacaataattagtctcttgaagtcatggaattcaatcattttagagatcatatccaagagcagcgatgtgagcctgcatgatatctgtaaattagttttcatgtggaaattatattatcacgtcaattgggacggttaattctagatgcaacaagttgtccaaacaagcattctgaatgtcaatgaaagcatcatttcatttggagtcaatggagtctctgtgatgtatagtgattctttactgtcctctaacttgcaacagcgcgtccgattggaaagtgccgactactttcatatatgggcagcaagattgg

SEQ ID NO: 5068 - DNA, 1500 bp, Zea mays
caagcgtggtccaaaatgttaaaaatgaagaaacaatccatgcatattttataagtatctatattggctcaattccaagcaacctttgcacttacattatgcaaactatttcaactatgcactttcatatttgctttggtttgtgttggcatcaatcaccaaaaagggggagattgaaagggaattaggcttacacctatttcctaaatgattttggtggttgaattgcccaacacaaataattggactaactagtttgctctagtgtataagttatacaggtgccaaaggttcacacttagccaataaaaacaccaagttttggggttcaacaaaagagcaaagggataaccgaaggcacctctggtctggcgcaccggactgtccggtgtgccaccggacaatgtccggtgcaccaggggacttcacgctgaactcttcaccttcgggaaaatccagaggcgctccgctataattcaccggactgtccggtgtacaccggacagtgtccggtgccccaaggaagagcggctctggaactcgccagcctcgggaaattgctccgctataattcaccggactgtccggtgtacaccggactgtccggtgagccagcggagcaacggctacttcgcgccaacggtcacctgcaggcgcatttaatgcgcgccagaagcgcgcagaagtcaggcacgcgcgcgctggcacaccggacaatctacagtacctgtccggtgtgccactggacatccaggcgggcccagaagatagaagctccaacggtcgaatcccaacggcctggtgacgtggctggcgcaccggactgtccggtgcaccatacgacagtcagccaccaccaaacgactagtttggtggttgggctataaatacccccaaccaccccacattcaagtcatccaagttttcccacttcaactacttacaagagctctagcattcaattctagacacacccaagtgatcaaatcctctccaaactccatacaacgccctagtgattagtgagagagatatgcttgtgttctttcgagctcttgcgcttggattgctttcttcttcctgtgattcttcattgcgatcaaactcacatgtaattgaggcaagagaaaccaatcttgtggtggtccttgtgggaactttgtgttccaagtgattgagaagagaaagctcactcggtccgagggaccgtttgagagagggaaagggttgaaagagacccggtctttgtgaccacctcaacggggagtaggtttgcgagaaccgaacctcggtaaaacaaatccacgtgtctcactccttattcgcttgcgatttgttttgcaccctctctcgcggactcgattatatttctaacgctaacccggcttgtagttgtgattatttttgagaatttcagtttcgccctattcacccccctctaggcgactttcaattggtatcggagcccggtgcttcattagagcctaaccgctcgaagtg

SEQ ID NO: 5069 - DNA, 1500 bp, Zea mays
aaacaatccatgcatatcttataagtatttatattggctcaattccaagcaacctttgcacttacattatgcaagctagttcaattatgcacttccatatttgctttggtttgtgttggcatcaatcaccaaaaagggggagattgaaagggaattaggcttacacctaattcctaaataattttggtggttgaattggccaacacaaataattggactaactagtttgctctagtgtataagttatacaggtgccaaaggttcacaacaagccaattaaaatgaccaagtattgggttcaacaaatagagtaaagggacaaccgaaggcacctctggtctggcgcaccggactgtccggtgtgccaccggacagtgtccggtgcaccagaggactccaactcaaactcgtcaccttcgggaaaatccagaggcgctccgctataattcaccggactgtccggtgtacaccggacagtgtccggtgctccaaggaacggcgcctcaggaactcgccagcttcgggaattcgcaacggctagtccgctataattcaccggacatgtccggtgtacaccggactgtccggtgtgccatcgaagcaacggatacttcagcgccaacggctacctgcagcgcattaaatgcgcgccagcgcgcgcagaagtcaggcacgcccatactggcgcaccggacactctacagtacatgtccggtgcgccaccggacatccaggcgggcccagaagacagtgctccaacggtcgaatcccaacggctttggtgacgtggctggcgcaccggacatgtccggtgtgcaccggactgtccggtgcaccatacgacagtcagccccaccaaacggctagtttggtggttggagctataaatacccccaaccacccaccattcattgcatccaagttttcacacttccaaccacttacaagagctaggcattcaattctagacacactcaagagatcaaatcctctcccaaattccacacaaagctttagtgactagtgagagagatttgcttgtgttctttcgagctcttgcgcttggattgctttcttctttcttgattctttcttgcgatcaaactcacttgtaattgaggcaagagacaccaatcttgtggtggtccttgtaggaactttgtgttccaagtgattgagaagagaaagctcactcggtccgagggaccgtttgagagagggaaagggttgaaagagacccggtctttgtgaccacctcaacggggagtaggtttgcgagaaccgaacctcggtaaaacaaatccgcgtgtcacacctcttatttgcttgcgatttgttttgcaccctctctcgcggactcgattatatttctaacgctaacccggcttgtagttgtgattatttttgagaatttcagtttcgccctattcacccccctctaggcgactttcaattggtatcagagcccggtgcttcattagagcctaaccgctcgaagtg

SEQ ID NO: 5070 - DNA, 148 bp, Zea mays
gctagctcgatcgatctgaaacagaattgttaacagggggtttatgaaagtagaagaatggttttggtcttctttttttttttttttggattcttagggcagcagtgccaataataaagtgttctgtaggggaaaaaaataggcgtgc

SEQ ID NO: 5071 - DNA, 192 bp, Zea mays
ccgattcggccggtttttaccggttttgtaaaccatcagcaacaatcagctgagcacgaaactatccaatggctgccattcaccgaaagcaccctttaaaacgcacaactccataaaccctagcggacaaagccacttgctcacaccagaaccctctccgcaatctccccgcctcgctcccgcctccaccca

SEQ ID NO: 5072 - DNA, 243 bp, Zea mays
tattgttgagacgtgtcgtcgaactattcttgtatccttagattgtatcctagctagtcgtgtgtaatctttgaactgcacaaaaatgtgtgcctggagacgagcgaatatattcattacgtttaatttgttcgttatgtttaatttacttgctatactttctatgttcgaaattataagtcccgtcattgttcccaacacagtttaaaaatagaagattcatttttttcttgcgctaattgg

SEQ ID NO: 5073 - DNA, 1500 bp, Zea mays
cccattgagccagcgcgcccatgctctccctatgtcactagtgctcctgtgaaccccttgctagtaccatctatgaggaacaccataaggaggagcatatgtaggaggagcgtcatacgacccataaggcggatattcctaagggctactttgggaacctcaaatccccttcgtgattggaggggattgaggtggaaataaactaattttctcttcaatccccttcaatcccgaaggggattttagtttccaaactagccctaagggtatgtaggaggatacaaatacacaaaaggttgtggaggaaaagcatcgatggaaggggcttcaatggtaggaggagcatcagttgttggaggattagtaagaggaggcacatcaacacttggtcggtatggatatggagaatacaaataagaaaagtgaggttgcagagttagaaaacgaggatgagcaggaatatcctctcgccgatgatggacagaagaaagaccatcgaataagacttgcccgacataagcagaggtcttgggatgttgtgaaaattgctcgttgagcaagttcgtgaacatatcaaatttgatactctacatcgaatctatattgaaacatagagaggaaggctacgaatgaaggagaggacacgtgaattagagaggaaggtgtgtgactgaataagtacccctctctttataggggtggattcatgttttttatttatttttttggatttttaaaaattcaatttgttaaaataacgtcaaccaattgatcgacaccacacaaataggttgttggtattgattgtgcctaatcaatagttcaagcgctccaacgtcacagtcggtaccgaccgacccgatctcaccacaattagtatcgacattgatgaccattcgataacccaccaaacgaccaaatcgtatatcgttaaaccatgacatccatcgatccattgatcgaccgaccgagtcacctattattggaggtgtgactgtcgatatcaatcaccggctacaccacacaagtagtggatattggccaatgctatatgaaaccgagccaatggcaattttgccattatcatttgtgggcttcgccagtatgccatcgggcccacaaatcatagacacagacggtcccaccagtcatagacacgggatggcataataacaggcagccaaaattgagagtggcaaaatagcaaatttctcgaaaccttatatagacggtctgtttggttctcgtctaactgtcctaaagattattcggctaaattaaagaactaccattagatagaaaaaattgacaaactgtaatgtcagatggtgaaccaaacgggccctaatccagcggcagtcaggcactcgccaatcgccaagacttcttcaaatctggccccttgacgcgcagcgggagaggctcatcaccccgtgtgccctcgcctcgcctcgccccgccgcccgccccaaatcccctcgatctctcaaataagcggga

SEQ ID NO: 5074 - DNA, 503 bp, Zea mays
gttttccgccattaaaggcatcgatgcacgatcacagtcgccagtctgaaatcggtctctcaggatctacatccgtcaacgtatcttcattcgattcgacccacattctattccaaccgctctgtacaaaatcacttcagccaccaagccgatcgagctcaccggagccggcggccgccctttacgcgctggccgcttaaattacttcgacacacagctctcgcgaccacagccttgagctaaaccgaaagcaaaaccatatgcttcaccacactaattaatctcactatctctcccacctgcagtgacacgtcctgcactaaacaaatccaacacggcgtgctctctcgccattaaaggcacggtctttctctctccttcgctcctttctgtttctctctccagagtggagtggttggtgctctcagtcccaggacccagggtggccgtggcctctgccaatagggccgggccggggctccaccgcacaccgggagggagag

SEQ ID NO: 5075 - DNA, 1500 bp, Zea mays
aattgtgtactgttgaatcctgatggtcatataagtgagatatttatgtgttgcatttttttactatataaatcagtttccacaatcgtttttcccactttatgcaaaatagggtaaaatctcttctctactaatataaaacaagtgtttctcgctttgtgggtcctcccctcaccacgtcccgcgtgcgatacctctccccctcctctcatgcccgaaatacaaaagaaaacatacatggggagattcaaacatgcaacctttagaagctagagttcaaacatggatggggaatattttaagccgcaaccttcagaagctagaatccgttattcaccactacatcgtgcatctgtttgcgttatacaaatgaacgatattttaaatatatatactaataatttaaaagtaaaaaatataatcatatttgaataaatatcttatttaagcaaattctatctacatgatgtataaaaacatagcaatgtatatacaactaagagcatctccaagagaggctctaaacatgatcttattttaaatataagacttaaaaacataaaataccctttcaacaacggctttattttataaaatttcatcaaatgattatagggctcggtctctcgggtcctaaatataatacccccatatactagagctctatccttatttccacttaatctccaaccatttatttcataataacataatttatttcctaaataacattatttaaggcctgactattggattaaacatttcttttgagaccctaaacattctaaacataatcctattttaaattttaggactctattttagggtttgttgttggagatgctctaagtagttgtataaaaatggaggtttaaaccttgattgtggattttgaattttatattgtacgctcaagcataatataaaataaagtttacctatgtgatatataaaaaccatagcaaaatacatgtatctaactagtttcttaaggagttaagggagagctggatagcgatgctataagttgtatactagaaaaatacagtataatgatttatagaattaacttttaagtcctacactataaatttgagatacttatatgtgaatttgaataagttatggaacgttaatttctagaccaaataacgcagttcattatgcaaataaaagatccaaataacctctcaaattaaaatttagatcaaaactgctatgcttctcgctcggagaggattttatatctgttgttctgggcgtgaggggaaaaaccgaaaaagagaacatgttgggcctaaattggtctagaaagagcacaagcccagctactcttccatggctttcatttcaaatcccctttctctctctactcccgtctctagtaatcaattccactgcgactgttgttgaaagagcaaatcaaaccaacccatcgaaaaccaaaatccccgcacgagctccggtttcaaattccctcggcagagctcgccgccgggc

SEQ ID NO: 5076 - DNA, 1313 bp, Zea mays
ctgcaggcggctatcgatcgcatggcccctcccggccgcagctactactcacatggtcaacagtgtgcagttgcctcacacaccagtggtactgcggtgcctacagttagctagtgagaacgtacacaggatcaggagacatgtgtcatgtgtgtataactggggcggattgatagacgctggttgacacaacactcaaggcagaccaggtaacatgttaccccgcccctgacatgcatctcttttgaatcccatgcatgcatggccggggccggcttatcacactaatttttggcaagcactactgacaagtttgactccaagtcgggtaacatgcatgcatgggtggagaaattgaaacctcgccagctaccaatatatagttaactaactcgcgtgcaaatacaagctcactatacaagtgacaaactggcgtgcgtcttgcatgcattggcaatcggtgtatagtttgcacgccgcgccggccgtttattcaaagcagtagagagtagagaccagtcggccggccgagcgagctccgcagcaaccagatcgccgattgcccgtgcgccgtgagagccagcctgctggtggtcctcgccgtcgccgcgatcgattcccttcgactaggtggcgacccatgcaaggacaaggagcacacagagatctccatggggcggcgcgcgccccgaatcatcacccgccaccgcggcattactagattagactattcaatggactcggcaaacagggctcattctaagacatggtgctacgcgacaggacggcacttagatttgcatgcatggctggcgcgaccaaagccgcattatcgatcgcgcgcttaataaggatgtcgtccggctggcgcgcctcgcgagatcgagctagcgttttgctaaacagtggcagcttttgcgcatgtctccctccccacctcttcttctcttctctctcgccccaacgcgcccagttcgagaaagggaaacaaaaggaaagcaccgagaccttcgaatccgctacagccactgccacgagaccacggcctcggcctcggcctcgccactgcccctgagccggctatataaggaccactcctgcgcatctattgatttcagcatttcctctgaccagaggaagatcccggaagcaaccaaatcagaagcagaagctagagctactagtttttgcactcgaccatcgatctttcacaaaaccacacatatagcttgcttaactggcggtgtagtgtagctgcgatcgctgcaaactacagggtgtagtgatcgtcgatcggctacatatcatatacc

SEQ ID NO: 5077 - DNA, 292 bp, Zea mays
gcagtaaatccaatcgggcccaacccattcggctgagtggctgacgccgcctcaccccatgcagcttgctgccccatccggccatccccgattccccgtcccatcgccattcgccacgcctagacccaaccttggttcgttccggacagttatcaccgctcccatttatttataacctcaccccagcctccccttcccagttcccaccacttcaccataaccaggtcaacccggcgcaaggagcacgaacaggaaccgtccagcggagcaaaggcacccgcagccgcaggcc

SEQ ID NO: 5078 - DNA, 484 bp, Zea mays
atacagaggggtgatgctctatattagaagagtgatattttcaaagaattgagtctatgattctaaatctcaattttatgcgcaaacaaacaacagaattttaggtgattcagtatctatatccagataggatattaaagtggccgaaggataaaattgcggtccaaaagtggatagcatctcgcgggctgtccacgacaaacccagccaagccaatactgggctgacccagtgcggttcggttcggttctgttctgttctgttctgtctttctccgaataaaagcctgcttccagcccacgcctgtactccgaaccggcccagcggtggccaaaccggcccgggcacaactacaaggcgtgcggtcgaagaaagaaattgatgaaacggcggctgaggccgcaagcttctcactggccgcaagcaaaccgaacgaacccaaccgaagcgagagctgagcaaggcagaggcgtcgtgaccggcg

SEQ ID NO: 5079 - DNA, 1500 bp, Zea mays
aactttgattacgaataacttatcgactagctagtatgtagtctataaacctgaagacaaagtatgtacagattcgccttttgaaaacgcttccatgcatatataaaacaacataatttcgtttgaatgtatgtctgttcctaatagaaaatttgacactagctgctgtacagtgccagtgttttgaagattggtatcgctgtccagaagagagtaatatttgccaactggatgcatcggatcggagtagatttcagctacaaacaacgagctaacaggtatataggaagcggacgtacgtacgagctctgaacaattaatataatcatcacacgcccatcatcttaatttttcttgttcgttccctgttattgtgctgttcatcaaatattcaatacacaaatgcaaagaaggcgcaattatgcaggcgtgtgcttgttgtcttatcagtggcgagcatcgggcgcgggacaccggccggaaaacttgcgcgcgcccaaccgccggccggccattattagaataaataaactccggtaggttcgcgccctacgacgacgacgacgaccaggacggcggccccgcccgccctaatcatcatcgtgctcctgcatgcactgcgttgcgggcgggcgcgcggccccatgcgtgcgtgcactttgccaactctcccagctcccatttgggcgtcgcgttgcgcaacgcatgcagggcaatattccgtccaccctctttattctaatggcagctgtgaaaaggctcagatgtgaaaaacagctcccatttggttctcgtgtctgtccaaaggctcagatgtgaaacgcagctagacacatctggcatctctcctaataagcgtgcatgaagaaacggtgtgtgatatgatttaaagacgagccagtctatgtctgaactatgattctatgaaccggggataaagctggctgttccgcgagcatgcatgctgcatgcgtgcgttcctgtcagtagaagttcccggttcgttaagattcacattaattgacgcgctcggtgtatttttttgagcttcaatctgtcggcaactgcatgtgctacgtacagtacagtacagtacagtacagagtgttggagcaaaaagacgtggagagcgcgcgagaaccggcggcccacctgtcagacctgtgcaaaccggaccggactgacccaacccaagacccaagttgtcgcgccttttgtgaggtgaggttgccgctttggactttggcactttgcgagaggatttcttttaaacaaacgcacgctcgtaaagcttgtcctttgcaggccgagaggccgacccgaccccctgtccccctcctactacttccccctccctcctaccccggccctatatatgcaaagtgaacccttcttctacggccacaccggcattccactgctgctatctgctccgcacactccattgctagctgtaacgcactgcaagaaagagctagctagctcaccgtcgttacgaag

SEQ ID NO: 5080 - DNA, 1108 bp, Zea mays
actggttgtttgtgcagcaacaatggtagaaagagggaaatgcctctcgtctctttggccagttacgaggggtggagggtaccataccgctctgttgcgttgcgcgtgtctgttgttggatttcaatcaggcaaataacatttgggtacagcacacattcttgtcaagggtggatggctcatacagacagctccgagctcagcgcagctcgcagccgagcgctagcgttctgctgcagctgaagtcactgaactgagctccctcgcgtgtgttccagagacgggaggaagagggtgaaaaagaaaaaaaaaacacacacacacacacagtagaagatatggacaatgggatctctgcatttcggctatgcatgtgtatacataagcccacgcccgctgtgaaataatttcctactgtgatttgtttcctgtgttatgggaagcacactgctagatgttgtgattgattacgctagctagccctttctttgtagtagtgaggtattggtcggttaacgtcatgtatttcgacagcgagtagcatcagcagcatgctgtctggtgtcttgtaatggttttttatctttataagctggggatgtattagcctctgattgacccgccctttttttaattaagtattaatcgtgatggtgatgaaagggttgtagttttcatcagctgtttcgtgtcgcttttgacgccataaaaccatgatgcggatggatgtggtttttgtgaggcgggttctatagatttttgtagattggtcaagtcacaagtcagtcactctgtctctgccgtgcagtgctagaatctaagctaggaaaagcttatgattggcctctctttggccgagaatctggtgttagtggtctcaaggactgtactttgctgctggccaaatgacagcttatctgtgactgcagttgtgtgagacgcgaactaatatactactgctgctaatcagctttccttcctcccggccaatgggaccaccagagcgctagagaacctgattagtttagctgggatggaggaggttgtaccttccttgacgttggtggaggaggcatggctggcgcacaggcaacagtggcggggaagga

SEQ ID NO: 5081 - DNA, 946 bp, Zea mays
taaccctttttgtatgtgacccatataccggtttatataatagagccatagaggatgtctaaatggacaatggtattatttaggaaaggtttttttattgtggatagatcggaaagaacagaactttgaatgtcaaatagagaaaatgaaatatctctagagtcacatgaattttttttctttttttccttgttgcccaatgtagaccaccatgtgaccctcttgtttggtggcaaatggttttccatgcgccccaaccttggccgctgctattttggaccatgccgacgaggagcaaactactgaaactaggcaggcagaaattttgtaaagaagcacacagtatggtacatataataacaatatgcctacataaatatattatgtgtatataaattaagttaaagcggcagcagccgagtctagtattgggagaagcggcaagcaaagcaacggccaataaagataagcggggcgaagggtccatcacgaccacgacgtcgcccctgcgaccacagagaaagtataactcctccagcctggatggggtcgatggccgaacacgcatctcgcgcacggggcaacgccgagcttcccgctgcctgctccgtgctcgctcgagtggcggcagcaagatagagcgaaggagtgaactttcttttgttttggttgagaagaggccaccaatccgcatcgtcgaaggggctcgctggccgctttctttaaagtttaagcgctcccgcggtggaggccgaatcactcctggccacttcggcatctgccgatgccgatgcctccactgcccctccgctccgttgccgctgcataaatacccctcctcgccgctccgggctgaccaagggctcgccgcctcccgtgtcctccgactccgacagggaaaggcgaaaccttgggtcggctcgctagtggagtgcagggtacgttg

SEQ ID NO: 5082 - DNA, 249 bp, Zea mays
tgctcccgagacgcgtttcgcgctcggctgccaaaggaagcaccgaagaaccggacggaaaagcggcgtctttcgcttccggaaggtctggcggcggccggaggtatgatctggtctagtctgatctaatctggtgcttcgccgtcgcggctatcggcgctagtctcgcagcaggagatcgtatcgctgtaccaccgcttctgccagctcgaccgtaacggtggtggcttcgtctccgctgacgagttc

SEQ ID NO: 5083 - DNA, 961 bp, Zea mays
taaccctttttgtatgtgacccatataccggtttatataatagagccatagaggatgtctaaatggacaatggtattatttaggaaaggtttttttattgtggatagatcggaaagaacagaactttgaatgtcaaatagagaaaatgaaatatctctagagtcacatgaattttttttctttttttccttgttgcccaatgtagaccaccatgtgaccctcttgtttggtggcaaatggttttccatgcgccccaaccttggccgctgctattttggaccatgccgacgaggagcaaactactgaaactaggcaggcagaaattttgtaaagaagcacacagtatggtacatataataacaatatgcctacataaatatattatgtgtatataaattaagttaaagcggcagcagccgagtctagtattgggagaagcggcaagcaaagcaacggccaataaagataagcggggcgaagggtccatcacgaccacgacgtcgcccctgcgaccacagagaaagtataactcctccagcctggatggggtcgatggccgaacacgcatctcgcgcacggggcaacgccgagcttcccgctgcctgctccgtgctcgctcgagtggcggcagcaagatagagcgaaggagtgaactttcttttgttttggttgagaagaggccaccaatccgcatcgtcgaaggggctcgctggccgctttctttaaagtttaagcgctcccgcggtggaggccgaatcactcctggccacttcggcatctgccgatgccgatgcctccactgcccctccgctccgttgccgctgcataaatacccctcctcgccgctccgggctgaccaagggctcgccgcctcccgtgtcctccgactccgacagggaaaggcgaaaccttgggtcggctcgctagtggagtgcagggtacgttgatgacggagctgtgg

SEQ ID NO: 5084 - DNA, 1211 bp, Zea mays
ccttggtatatacacttcaacgagccttcttttcgccgagcgtcttctaagttttgccgagtgtttcagacactcaataaagaagctgtttccggtagtgatttactatctcgctcaccaaaggtctcgaccctccccgtgggcaaaaccttggcatcattccaaggttcaaactcactaagaggacgacctggtagggatagttagtgtttggtataaaaaggcgccaacaataagctaagactacatatggaaaagatctaacatcaatctatctatctaaatttttcctatccttcctaagctagctagctagcgtggatactccatgcggattgcaaaaggctagctagctcttgttatttcagacatggacactatcacaggatccagacgatggtgcaactaatctatctctctgacaacacaaggtcgtcatagctaaggccaacattatattaattagtggtgcagttggagataacgaaggtacatacggcgtggtagctttaacacacgtttgtgatatgtctatctcttcagggtctcctgaatcatatatatatggagattcagataaagtgcactgaggggaagcagcgatcgaagttactacgttagaatatatatagaccaagtttccaagtcacctgtgatgagaagacgcatcagacctgctggacctcaggaatataaatataatagaattcttggcaatcgttattcatgcatgagccacctcgatctgcaatcctgtccaccacaagtatgtaaattaaatatatgaatggtgacatcaacagatttaccaacccataataaatacatacatagacacacatgatatggctgcggtgttgtcaaactgagactgtgtcaagggcgtagtgatcaagggtaggcggccctcgactacggagttcgtagtctcctgccgtgtcttccaggaccgaaggttatgccccttacggcggctgggcttgagaggagatagagagagagatggataattgttttcttccctttctcaagtgctgattacatctatatatagcccacggctgaaacagaaaagggtaatcccctcctaaataataggctagataacttctaacagaaaggagtaatcccttcctaaataataggctagatatcttttattgccttaatcctagcggctaattggtttgggcagccgcctcctgtgctgc

SEQ ID NO: 5085 - DNA, 1155 bp, Zea mays
tcgcgtcggcccgccgccgcctcctcctcttcatcagctagaaagcaagcaagcgagcagcagcttcagtgtaccagtgaatatcacccgcgccacgtcacgtgtcggcatggcgttgctgcagcggcggagcaaggagcccgttgcgtgcctcctcctgatacgtgcaccacgattcgctccgtgcagaagctgctcttaccgagaaaccaaatcaagatccgtttcccccgggccagacgctccgtgcacaagaaggcgtgtggccgggtgcatgcatgtctgctttctcgataaggaatggcaaataatcacgagtatttacgggtatttatatcgtttaccccatggatatctgacacgttagtcatccggattccatacactatcttaaacttgcatttttttaaaaaaaaaattcatccacgatatgttgtttggtgttgaaatttccgtttaatgttgctaaaatggtgataattttgaattgtgataaaattattgtttggcgttgaatactgaaaatgtagtggatgggtgggtaacaggtattcaccacataccggatagtagactgatatgggtataagtatagatccatatacacgaaggtatatatagatacggagcatttggcggccgcctcggtggtgggcggcacaaatcctctgctcgggagcagaacatgcatgtatgttccattgaatcaatcaacaaggtccataattcatgaataagcttgctttgttgaccactcacgccacgctaccagcctttgaagccactgcacttcgctcccgcgcgccttgcattgtgttgtccctcctcctggacctgaattgaccgcttccttttgcttgaaaccttgacctaaccaaagtgtgcgaatgatatcagctagctaaccctgctagcctagctagagctagctagaatccagcactcctcgcttttcttgcttccaagccagtatcaaattaaaacacggctccatatcacactctgtctgtggcagcaaacacacgtaagccaaggagaagaagacccttatgggtctaagtgtttaactcctagctccttgctgtgtgatcgatagatgtgtgtatatatgcacatacatgcatggttaattaagttgcaacgacgacgacgacc

SEQ ID NO: 5086 - DNA, 486 bp, Zea mays
tgcatgcctgcagttccccttcctcccctgcgtcatccccaactgtaagaactaagaaccccctcctccatgcatgccgctctccaaatgtcctgcaatgattctgcctgcgcatcgtctgtctgcctctgcccggcacaccgggcgacacgtacgatcggtgttgagttgccaacaagttagctcagctcagctcagctctggcgttcgatcagaaccagcgcggccgcccggacaacatcgggccggggaacatcacaggaggagttgcgagttgcgacccagtccgtcgtaatggcgtgctgcaaaaagtcatcctagtgtaccacatgccaggaccggagcgagtcggtcccggcgtgacgtgaacgtgactttctactctaccttcagattcagaagcttctgttgtctgaccactcgtcaggttccaagttcccccgtagtccagtccaatacctgctgttcaagaggaactgcatacgc

SEQ ID NO: 5087 - DNA, 96 bp, Zea mays
tcggtacccctggggccctgagctgagagcagagcagggagcgaaactttgcgctgagattgagctgctcctacttggaaggcggcggcgtcggca

SEQ ID NO: 5088 - DNA, 1001 bp, Zea mays
tgtttggttgccaattaaaatcgtgtgttttatcttgggttaacagtagcaagctggaaacgttaatttgcattcaagtgcgcatttcgtactcgtattttttatctggcattctggctggaaacgaataactacgaatggaaaatacccattgcgaggagtgtgaacgtgaaatggttggactcttgctgatttaccttttccatctacagattttgaagcattgtcgttgggctgtcttgagattttggaaagttttagttttagattgagttcgaaaactatcttcctttcttttgtgtgacctattgtgagtttgtgtaattctaattttgaggtgaactatagcaatacgaaaattgtattcttcttcattcgacgcacaaaccaaaagttgattgcacatatatttgaaaagatgatcatatatttgcaaaagtgtgctgagaatcgcatcagtctccaattatttggtggtgacccacaccatgtaggaaaaaaaataagcaggtacaaagaggacggcccaacgttggcgtaccccacctgcagctctctgttggccccacctccaggcaccatgtctaccgtctactccccccagtcttgtacgtatattccacgcacctggtccacggctccacgattatgaactgattaactgaagcacaggcacagctttcacttgcggttccagcgacgcggaatggaaaccgcagcagcagcaaaactgtagatacacctggtccatgcacaaccgacgtgggaagacgagctacagggaccgacaggtggacccatacgacgttcgaatccctccaaaacgggggtggccaccttgccaatataactgaccgccccccacgacgccctccgtcccacccgcttcgcttctccctcggcctcgctcgatcgctcccacgccctcgcgccccctccacaaaccaccaccacccaagaccgcagcgcagggcgcgagagggatcggcaggtcgggcaag

SEQ ID NO: 5089 - DNA, 1500 bp, Zea mays
agacacaaatcaggaggcttaaagtgctagtcagcgttaccaaaaaaaaaaaaaaatcagaccacacaagttagctaaaaaattctagtcaattaatctttagtgggtgaatcaaacagaccacgagagctggggctcattgcacaactaaatgtcaactctctcctttagttttggtgtgtgtatatatacgtcgctactcatcaaaactgtacctgtgatgtctacgtcaggtagaacatctagttctgtattagtacagcatcaaagtctgggtgccgttggaaccgaaactctgaactgtaaaagtctagtacatacatgcacatccagcagaaattaaatacgacgaaaaactctgaactgtaaagtctatagatatatgcttcagtcacagcacaggtgttcaccactccagaatacacatggagtatccgggagatgaaaaactttgccaacgctatcacgaaggaatagatcatgatatgatgggaaccctggcagttggcagcaaggcaagggaagattgatttggttgctcctgctaaagtttaacccgggtcgtatcaagcgtttgacttttaaatatgagtatgaaatatagacccaaccaactggactagattcgtctcgtcttttaatcttcggctgacaaattagttttataatccgactacatttaatacctggaacagaggttcaaacattcgattggacaggggctaaattttagcagggtgtaaccaaacaccccctgaggacgcctctgattggcaggacggctaggcctggccgggcgggcgatccaccgaattgtgcctctccttttcggggcaggggcgagctggccacacggagccgcagtttttttcttcttttcttttttgctgctgaccagaccaatcaccatcctgtgctcccggaaaggcagctcccagaaagccgtgtggagcagccattatcatcaatgcaacgctacctccacaggccgggccgggccgggtgagtcacgggtccgtgggcccagatctgcaggcaatcatcaatgcgatgctagcttccacagacagcagtcaccagctgttgctgttggtatgcaacgggcagtcatcagagcaacggatagaagacagagctttgcaggaagattagcggctaaggctacccactgttagctcggaaccagctggattcgcatttttctttccagtttctgccgtgtcagcctcgtccgcccctatctatcccctatatagccgtgcaggtcgtcttcttcctcctctccactcctctcgtctccgtctccatctccgtctccgtctccacaccgtgccgtagctgctgctgtccgtgtccctcgcctcgaagaagacaactccaacactgttgctgcgtgactgctgaattcgctccacacacgcgcgaacccagcaaggcaagaacacgaacgagagagagagagagacagggagggatcatccatccatcagaccatcaccc

SEQ ID NO: 5090 - DNA, 994 bp, Zea mays
cacaaagggtgcgtttggttgcttgcatctgcacgtgcttatatcgtggaatgcaggtagctgttgtttggttgctgtgagctaggttatacgtgtgtaagttctatgtttggttggctgcatgcatatttggatccagactcgtacgatcttcaaagcaccctgaccagggtcaccagatacgaacatattgatcgtatctgcggagctagtcttcagcggtcctagctcacataaccagattgtctagagaaactaaccaaacagacctaaaataactccgatcgtccgtgctcgaactgatggcatgaatgcattcaaaagcaattgcgtgtcatctgtaatcatccaaaacatgaggcgatgaggcaggtggcgtacaagacgaggcgtaccatgagccatggacgagccgacgggccaagtcagacgggagacgtcaacaacgaagcggaacacggagtggtggcggacacggagacgtggtccccttcagtactacgcggcggccctgtccctttccacgatctgtttcttgctcagcgatcagcacggccaggtccaacccaacggctatcccaagacaaaggtagagcatccgatggaagcagcgtttttccgtatagaccctctactttacctagaatcagatacgcatgcgtgcttttccctccgcatactacatcgcgtgattccccgtagctactaggccctgttgtgtaaaacctcccccaacggttcgttccatcccacctcccctgccggctgccgccgcgtcatcatataaacgagcgcgcgcgcctttccgcctctgcaccacacccaaggcagccagtgagccagaaagaagaagaggccattcgaagctgccacgcacgccacgcggaaaccattcgagtccacgaggagcagcagaagaagaaagggcaagggccaggccccaccaccgagaagcgagaagcagagcgaggaacatcctccggtggccgccgcc

SEQ ID NO: 5091 - DNA, 1500 bp, Zea mays
tatggtaggtggtgggtcaattgtgaagaggactcatcaaagcagtacagggggagccggggagggatggaagtctattggaacccgcctgcttagtttttagagatggcctcctgtttggaaggttcctgcgtgtcgcatcgtgaaggagtcgtgttcgtctgatggtaccttacccttattgggctttggcccgttaatttagacggccatgcccatgtgccagaaaaagttagcaaagacgacctagaacgagtgtggggggaggcgggaaaaaagggaggcgagcagatggccgccgaatcggattctgcccggagaaagttttttgttcgggagacgaaagcgcgcggatgcggcaggagaaatgtcatgcgtggctggactatggatgcctcggcctccctccctgtatcagcagcacgacacgaggactgtttgaactgttgcacatgtaatatctatagtaatacaaaaataagacaagtcagtatggattaaatacaaaccaacaaaaatagtaacgacgaccgccggcgatgaggattgaggaagaggaagccacgcccgcccgttgtgttgttgtcagcgctcggcactcggagacggtgcctgccgtgacgtgtcgtgtcacgctcaccaacgcacccgtgccgataccagaccagaccagaccagacccgccccgccccgccgtgttcaatgcatccacgctatgccatgtggggagtaacaaaaacaaaaaaatatgtttctttcaccctatgggtcacactcacacccgtgtttcgtgtgcccatccatccatccatgtttcggagctgtgctaacgcgcccataaatttgatcattttttattagttcgtgagacccgttttcaatcccgtgccaaattccgctgcggtcagttatgttctaaaactctttaatagagcagttccgctctagactttagattctattctcgtaacaagtgtcgaatatatacattcaaactcaaactttatgtttatgttgtcttttttaaggattccggagctgtaaaatagatactctaaaaaaatgtatattctacctctcaaagctctatagagtttacaactattcagttaagatgtttggctggatctgatcaagttctctttggagttttgatccggagtcatagcaaacatccacctttaatggcatgtttggcagtgtgcataaaaacggaatcagcaaaattccttttgtaaagtatttttttattttctattctcaatgtatcttgatgctaaccctatcaaccaaacatcatctttttttttctcacttaaacgatctcatgcaaccaatcaaatgtactgaattatataaaaaaaaaccccattcccaaacgaccacaagctacacagctcagcccagcctccctttcccttgaagcctctccaccaacccagagtcagagagagagagaggaccaaggcaggcagccgtcagcgagccagctagccagcc

SEQ ID NO: 5092 - DNA, 406 bp, Zea mays
tggcgcggggcgagctcagccgcggtggcctccatggcacggtgaaagctccgatggcggcgacacaacaagtgggcgacgaggaacggcggcggtggcttgcgggattttttatttggtgttgggtgttttagcaccggatgatatcactggtcggtgctatttgtcatttctagcctcggttgtagcagctggtgctagaagttgtgagatttagcgacgctttcttagcaccggttgcaaaaaggcggtgtatctctgctagtgactataaatataacatgatcgacctccttgagtgatacgaagcttccataattctttcatggtaatcagagccacctcttccatatgcatctagtttggttagaattgcttgacggtgagcttctctacttcgtcgacg

SEQ ID NO: 5093 - DNA, 419 bp, Zea mays
ggtggctcagcggcttgctcgtcgccttcctcaccgccgcctgcatcttcctcaccttcaccgacagcatcctccacaaaggcaagatctacctacggcgtgggcgctcccggagcgcctcaacgtgttcggcctcaccaagaaggaggagcgccagctgctcaaggagatcgggcccgacctcagggagcgtaggctcaagacgctggactgggtccatgccttcttcaccgccatcgtcttcatctccatcgccatgggcgacgtcggcctccagcagtgcttcgtcccgaacctggacagtcccgatatggttaacgtcaaggagctgctgaggaacgcgccgctggggctggcgctcctctccagctttgtcttcatgatcttcccaaccagaagacgcggcgttggcttcgaca

SEQ ID NO: 5094 - DNA, 1500 bp, Zea mays
tccaaaaaacatgaattttgtttttgcagtaagtcacaaattttatccccaatccttgtagtatgttggaggaagatgaggatgggattgaggactccgattagatgtatataattttttatttgtcatgcacttttattttaattactatgcactccgtaatttttaattcaataaaaaattagtacgttgtgtgatttgtaagcatcaaaacgaatctacgtgaattacttaattctgaaatagaaaagctgatgtgactatgggtcacggataagagtgaagcaaagaactaacgtggtagtggtgagtatagatgttcaaatgggtgggacgtgccggcccgagcacggttaggcccaacacggattgggatcgtgcctgcccgacccggattagttagcgagccgtgtcgtgccgacccacgggccccaagcgaggcccaggcacgacccgctagatcaataatcgtgccggacccgcccatgacccgatgggcctatcaggccaataacaacatatgacatttaaatgataaaaatatcctaaaagtatgcatatttgagggttaaaccatatttattagctctaaacatttatttacacccacaaccaacaaaaacaaatgtttcttttgttttatactctatattcaagtataatatatgtatttatacaaaaaatagaaaaaaaaataaaaacgggccgtgtccgaaatccggcacgggtttggcccgacacgaacctggcacggcccggtgatcgggtcgaactggtacaggcccggttcactacgtaccgtgccaggttcggaaaaaagttctttacataccggatgtaaaagaatctcttttacagcccctcacatataccagatgttgttccatataaatagaagaaaaacaaattactaaagagtttttttgtaaattttaatctgtgtttgtgggccttcgagtggtggatgtgagaggttgtaaaagaattttcttccgtcagattcgtgtcggatcaaactcgtgctaggtttgggaccgcccgataagtccggcccgtctagacatctagagcggtgagagagggatagtgcactgtcagcagccttaaacgtgataaaaaatagccaaacaagccagatcatcactagcatatgcaggtatgctggcgcgtatgggcatcggagaaggcccattaaaagcccaactacaaccaagcgaacgtataactacggccaccagtcttctcccactcccagtgccagccgccttgcgcttgccctctctgcgacgactgggtgcgccgccgccgccgctgtcctacgtcaggtgtcgaagccttcgccggcgaagagcgctcaccaggtatcccccccccttattttccctgtcctgctgtgccagagcgagttttcaagctatttgactatttgatgcctgctcccaaagattatccatctactagattcacccctggtggaggaggagaagaaggtaagcgaag

SEQ ID NO: 5095 - DNA, 799 bp, Zea mays
atcatattaaatgatgattatattttcacatttatatattattaaatcattatatgatacaatattatctatcaagattcaactttcaagctgaaccgaaccttctcttttagctcgttatgtaaactaacagagccgagcttggtctatcaatgagccgcaccaaacgggtcggcttgtttccagccctaaccacccgtgcccgcccgtccaactaaccaacccacggtgtatggccgttgccggaggctctctcacgtcggcatgacggcatctggacagattcaacacgcacgtagacaacaaccgctgggtacatgcgtacagtccgtaatatgccagccaccggacccgcgtcgagtaggtgaggcatcgcgcttggaagccgacggcgcagcgcgacgtaccgttgcgggggcgcgtctcggtcggttgttgatggtcctcgtgcgtgcgatcggcgtgcatgtgtggaccctgggcgagtgtaaactaccgcgcgcgcgtcggtggcctgtagcctggcagcctgctgcgtcgcgtgctccttcccacgtcccaccaaaccgagcgggagcgggagcgggcggatccctttttttttaaaaaaaaaataatgcaatgcacaccggcacaagcgcaagtaaatgagtgatcgaggcgcccgcgcggcgccggcatgtgatgtgagcctggcagcctgctgcccgctgcccgcgtccccgggactagttcagttgcttcactgtggcggtggcctggccctgcgtgcgcgctgcagcagtgcggtagcgggcag

SEQ ID NO: 5096 - DNA, 238 bp, Zea mays
ggtacaggatcagcgagccttaggcctttaagcttgaattccactttggtagaaatccgctcttcaagaattaagtgcttataaaacatatcactttactactcaggtatgtgtagtgacgaaaggttagaattttactgctcaatcaattacttttctcatgcaaatacctccagctgagtactactttggctcctgagcctgatgacatatattggtctaatctttggttccctac

SEQ ID NO: 5097 - DNA, 109 bp, Zea mays
ctttccgagtcgtcacctcacctaccggctaccgaggaagcagaagcgcacgagcgagacgcagccaccgcccgggaggaggaggaagccaagagcaatcggactttga

SEQ ID NO: 5098 - DNA, 193 bp, Zea mays
cctggaaaaaggaaatggaaccgatacatgtcacatgtgtatcaggtgccgagcagaagtgcatgaagtgaggcctgtgagtgggaaggagaaagagaagggacatacttgacagatgctacatctcctgtccatttccgtagaaaaatgtctggggttgaacgcggagtactttaccatcctaaggctttga

SEQ ID NO: 5099 - DNA, 1288 bp, Zea mays
ggtaatcagatgttctgacttggaatatgttgatttgtcattgattcatttgttctggtactactgaaattgtactcagaatagttaatactctctttgtcccaaaaaataaggcatatattttttttggaaaagtctttgaagtgaaactttgaccattatttttttaaaaaaatatgaaatcaacaaatgcaaattaagcatcatattaaagtatttttgaaaatgaattcaaatatataacatgcatacactaaaaacatatgtttttttgctaagttattggtcaaagttttaaaatgttgacttttctaaaaacatgcgcgccttattttttggatggaggtagtagtattttaaaggaaaaatttgctcgtggacattgagaacggccccctttgctcgtggacactgaaaatagtgagagttgctagagaacactctgctttttattaaaggtctgtttgggagaacttcacttcaagaattttaggttcgttctagcttctttcataaaatcaggtcttactccacgagctctagctctgaaaaaaaattaaaactagaggccaacttcatgaaattcacaatactcctctagagggtgtttcacaaacactgttttcatatatcatcatgaagttgtatggaaattacccaccacaccactagttacacaatacagcgcttcggttatctcgtgacaaccattaatcatcatggataattaatgaaactcacataaatcaattgtattacataaattagaatccataatgcaaaccaaacactccttgaatacacttcaacaatttgttggagctattttatgggtgaagctagaatatcgaagctaaaattcttgaaaagaagccctcccaaatagacctttaatgagtatgaaactcccaaagaatggtctaaatataatacaaccccacaaggttatcatatcagcatcatggatgacacaaccaaaagccattggactgattgttttgttggaagcttaaagtaattgtgttggtggacatagccaataactctgttccagacgaccccatctctctccccaaaacggggaggctcccctccccaagatcagaccttcgatccgttgctcctccacggcgccagccgccagcgcctccgttcctcaacgcctgtttgtccttgcatggccggagccagacgtcgcaccttgcctccaccctcgcattccgatcacccgcttccagctcctctccgtctcgctgctcctcctccgctcgcagagctgagctgatcg

SEQ ID NO: 5100 - DNA, 1326 bp, Zea mays
gggaagataatgcctgtgggcgcgaggcgagactcagctgcaccactattttagtcctacctgccatagtgccatgcatatccctctgtcagcggcagcgatgcaaatacctcttgattggttgccggcagccatagggccttgctcacgcgggcctgcaccagtggaaacgggcgcgagttatttcccagcccatgcaggccaaggagcgtaaaatagatttgtttgcaccctcacatacaggcccgggcgcagccgtgcagccaaccaatcagaaatgcaggcgcagtcaacgcttgtgaggagcctgagcgttgggagctgggaaaccaatcacacggtatatagtgtccatgggggatcgagccagctagccgctcggatgtgccgccgccggcgtcctgcgtgcgttgcgtgcaggcaactttttactcctgtgatgaatccggatcctgctcgatccggtgtcatcggatctcatcccatgtctgtctctcttcgatagtccgatccaggatcagctcgctgcgtgcgtcgataaagcaaccaccgcaacttcacagcggcaccaacagtcacgagtcagagagcaagcatccaagtgcagcagatggcgtcgggtttttattttgacgcttgccgaaacctaatgcccaggacaggacagtggaaaggcggaggtgatgacgacgccgtcgacgcgagggattgtgtacttgtgttatgccagcacatcgcgcacggcgtcccgtcgcgcggcgtgtcgttcccgccggcttcgctctccgttccgtttcccgtgcgtgcgtcgtcctccctggttctcccgaggcggggccacgcccacgctgacgctggctggatcccacccgcccgcattatcgtccagataccacgacacctcgctcccgccacgccgtggggcccatgttcacgcccacctcccctgtccgcatgctccgcctcctccgcacgaatcgcggcgcgcaatcgacaaacttcatgcctccacgtctcagccgggaacgctataattaggcctgccaccgcctgctcgcctcgcagaagccgcagccacgcccccacaccaagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaag

SEQ ID NO: 5101 - DNA, 179 bp, Zea mays
ataaaactcccttccccatgaagctcacctaagtgcttcactcactcctgtcctctcctctcgaccagctgacctcgctgacggagcacacagccacgccgcagcgccgcgtgggtgtctgtctatagccttgtaggtcgttcgcaggtaggtaaccgtaacctagctagctcgtcggg

SEQ ID NO: 5102 - DNA, 1500 bp, Zea mays
cacaacagtttcttaggaatcagccgccgaaatgcccgcaagaaatgacaaattctgaggccgacgcccgggcaaacggctctgtttgagtgtaaagctaattcgtacacattaaaaccacactcatgcaatatgcagtgtaaaaaaatgttttgattgaccaaacaggtgaactgctagacatggtgtaataggtataaaaagacttgtttactcgattccgctggttaacgtttaatctgtatcaaattggatttttgaatgtcaattacaaacatcaattagtaagtcttggactgtagtttgtcgtgttgttttgtctttatgttgaacaaaatcctcatggctcgattactgtatcagggttcaacaaaatctttatggctcaattactcgtacgacttaacttgttaatggcttggcttgttttattattttagcagatgaatcggtcttctagctcggttctctgacgagtcaactctcaatgacaagcactttatctagttatcagtgacgcctcacctattctagttttgttctctcgtagttataacatatatatagacatatgtgcatgttccatgtaattaaatttatgtatggctatatatttatattgtttatttaatatttgattactagtgttggttttatgaatttgtgtttactagaagtatacaacattagtgttgtgaaatgaaatattatatatttgtggaatgaatgattgaacccagattggtgcgtacctctttgttgggtgtgtcatatcgagtttttttagctttgggttgtttttgggttgagttagattttaaataaaaaatcatgttagcaatctctttttctatatctttaatttctagagtggtttcctaaatctcctgttatatggcactataacaataaaatattatttgtcatacctattaattatcagttactattttttcttaattaacaaactatgctgcccacggaaatcaagactaggaggccggcaggcgcgtctccaaatatggtggttcgctgtacaaaacgttaacattatagctgttgcggggggaaatgatgaacacaaatcgtcgccagagtgaggtgggtgcgttcggcggtgaccgctgctatgggaaaaaaaagtctcggaggcccactggcaatttatgtgcgacccacaatccggacgaaacggtgtcgcggcaaaacaaaaccaaccttcaccgcaccgcacgtcactctctctccaagtaacattggacggtcaggatcgttgccctaccgcattccccatcctgccacgtcaccgatccgcgtcctcctgtcccattggctatcgtagctatataacacaactacccaccgctttcatagtcctgattacaaacccgtcctctgtccgtcctaccaccacagctcaccgcggtttggctttctcccctcttccgcacccgcttctcgctccggattccctctgctctttccctaacgaaggtagcc

SEQ ID NO: 5103 - DNA, 474 bp, Zea mays
tgcaatatataatgacgatgactccgtagcacccggcccgcgggatgattatttcgttggcccccctttcctaagccgccattagctcactcggtggaaaataaaggatctgccgccaactgaaatgatacgaaatataatcattcatgtgaatggtagaatttgtgtaaaaaaatggatatatgcagaaagctagccttgcaaatattgagcccgacagcgacagcagcaccacaaaatcttgtttgagaccttagagcagttgagttctaccccagaaaacactcgaggacttgactgaccactagcaagtatacgcaaataaataaggacagtataatatgtatgtatcagcgaatgaagagatcttcactccaccacgctgaacaaataccataccacaccattgtggtgcaattcacaagaatctctaatctgttgttgtgcgctacgtacggatcatcatccatggcc

SEQ ID NO: 5104 - DNA, 567 bp, Zea mays
accatgattttgggcacttggtagagatgggacaaacacacatttgattgttgtgactttgtatgatacgtgtgtctagccttgtttgtagcgtagttgtcatcgcagtggagacaggagagtatgtcttttattttatratttcttacttgctatgtatgatggaaaaaatacaatttgtgatttgttcttgatgatttggacaacacagtatatttttttagtttgaccagatggttcagctttggctgggtacaaaattgtgaccactgcaggcgtttttctatctttcagtcttagttaaggattttgtatggaaaatagataattttgctgcaaacattgaaactgtgacaaatttaattaatgatagtttagagaagcccgcccatattaaataattttgaacgcaatgttattagtaccagattgtcaagccaatgtcagttactttactttgcagtttcaggcacagtgttccagaaactataataatttgtctgtgactctggtcattgatgattcataaactagttatttgctatttcattgaatgatgtcacatgc

SEQ ID NO: 5105 - DNA, 128 bp, Zea mays
gtaaaacttgcgagagatctcgcaaagttgaaacaagccaatcaggttgcattgtcatagcgacatggatcacatataaacattgaggcggcgcttcgccgctgacgagttaatgaggccataacatc

SEQ ID NO: 5106 - DNA, 1500 bp, Zea mays
tccatgcatatcttgtaagtagttatattggctaatttccaagcaacctttacacttacattatgcaaactagttcaattatgcacttttgaatttgctttggtttgtgttggcatcaatcacmaaaaagggggagattgaaagggaattaggcttatacctagttcctaaataattttggtggttgaawtgcccaacacaaatattggactaactagtttgctctagtactcaagttatacaggtgcaaaaggttcacacttagccaatataaagaccaagttttggattcaacaaaggagcaacgaggcaaccgaaggcacctctggctgaaggcaccagactgtccggtgtacaccggacagtgtccggtgcgcccagaggactccaactccaactcttcactctcgggaattctcggaagccggcgcgctataattcaccggactgtccggtgtgcaccggacatgtccggtgctccaaggaagcgcggtctccggaactcgccagcctcgggttcgcgcggcagccgctccgctaaaattcaccggactgtccggtgtgcaccggactgtccggtgtgccagcggagcaacggctccctgcggcgccaacggctccctgcggtgcatttaatgcgcgcgcagcgcgcgcagacgtcagacatgcccataccggtgcaccggacatcaaacagtacatgtccggtgtgcaccggacacccaggcgggcccacaagtcagaagctccaacggctagaatccaacggcagtgatgacgtggcagggggcaccggactgtccggtgtgcaccggactgtccggtgcgccatcgaacagacaggttcccaacggccaccatttggtggttggagctataaataccccaaccaccccaccattcattgcatccaagttttcccacttctcaaccacttacaagagctaggcattcaattctagacacattcaaagagatcaaatcctctccaattccacacaaaaccctagtgactagtgagagtgatttgacgtgttcttttgagctcttgcgcttggatcgcattctttctttctcttgtgctcttgtgatcaacactcaattgtaaccaaggcaagaggcaccgattgtgtggtggcccttgcggggaagctttgttcccggttgattgagaagaaggaaagctcactcggtccgagggaccgtttgagagagggaagggttgaaagagacccggcctttgtggcctcctcaacggggagtaggtttgcaagaaccgaacctcggtaaaacaaatccgcgtgtcactctccttatttgcttgcgatttgttttgcgccctctcttgcggactcatttattattactaacgctaaccccggcttgtagttgtgtttatatttgtaaatttcagtttcgccctattcacccccccccctctaggcgactatcaattggtatcagaggaggttcttcattagagcctaaccgctcgaagtg

SEQ ID NO: 5107 - DNA, 130 bp, Zea mays
acggtcagcgaggagaacggtgctttgcgcatggtggagtacgtagatgaacgctgctgcggctagttaattaacatccggacggacgttgtcatccgtctagtagtagtagttagtatatatctatata

SEQ ID NO: 5108 - DNA, 949 bp, Zea mays
gaccaggaagagggtgccggagttaatggcggagcctgggagcatgtgcgtgaatatttgtattcaagggagtgggccgatgggtgcgtgggtcgtgttgggctgttgagtgggccacgggtgtaaatgtggcgttgtaagtgtttggagacggaagccagaaaataaataacagaatatggttatcatamcctatggttatcataactaactcacctcacgtcgttccttgtgttagtgacggtgtgtccaggtccgattgcaatcggtcgttggaggctatcagccattaggctatctttaccaatttatctatcctcgttcctatatttaaacttaaatctatgaacaataaaatctacaatgtaaaataaccgtgttagggcttgttcggttagctcttaatccatgtggattgagtgggtttaaattccaaacatgttaaacgcttctttattttttctaatcccatctaatctataggtaacaggattaaccaaacaaagccttagaccttgttcggttaatcccgttacctatggattggatgggatttgaaaaaattaagaaaaagtttgacttagttagaatttaaacacattaaattccactcaatccatgtgaattgggagctaaccgaataagcccttattttttggtgagacaacaaaaaataaggaaagaaaaagtttcccgatggacacgatatacgcacaagtcggttcatcgatctcaccgacccaaaccatccttggctgccaagaaacctcagccccatatactgtcctgtctcttcagtcttcagttcaccaccagcagccctcagaacatccgattacccgaaggcccccctcagtccccctcagcccgcagtagccgtacacctcccagttccgcggcccaagctctgctcaagccgatcgagcgaggctaaggcccagatcctacg

SEQ ID NO: 5109 - DNA, 1196 bp, Zea mays
ggttccacctatccctttgccatccacttatatgggcttttgagattttcctgggatttatttgaataacttaattgggccaagcccataaatcctaacaacacaaagctactagctaggctcccacgcatgttactagcttaattagctagagtggtaatctctgacgttagagtggtacgtatatacaaagaagaagaagaaaaacctgcagtcgtcggtagagtgcgcgcgccgccaagctagtgtgaattcccaccgctgctgtcctgttcataatcatgcaggcgcatgcagtgcagtacagtgcagcagcctcggtcgatcggtcggtctcgtgccgccgtgggagaaagaacaaaaaaaaaaaaagttgccacggccatgtgcgtggccgccgtcgtttcacggagctagttaggcctgtcaagatctagcgtgcacagagtcagtcaactcgatcgtcggcaggttagattaaaaaccgtccacacttccagctgtggaaaacgaccagacgattacccacatcgatcacctgttgtgacagacgagcatcgatccgtttccaacttccaagtgacagacagactgacaggttgacgcactcggccgtgttgggttttgccggtacgaataatggcagctgtacgtgcaagtcgtcgtacagctgaacatcacgccagatccccacagacatcagcaggatgcttcctcgttcgttttttttagaaaaatggctccctccatcactggcagctgtacggctggctgacccacgctcatgcgctcatccgtccgacgctctgatatgaacgggaaaggtattcaaatgtccaaccacactaaacaatctaataaacaatgtacaaaaaaaacaaccctactaatgcgcaagacgctcagattgacactagcacagttagtatattgtgtcacgccatcctataaaatgcggcatcagtttccgcaggccggcacacaagcagcaacatcactgatcgccgtgcagcctggtacgtaccacacacacacacacacatacagaagaagaacgtaccttgcgctacaaccccgtcgccgccgactacgccgatcgtgtccacgggaaccaagcaaagcaaagcaagcgacgcatcggaagaagccggagaccgaccgaccgaccgagctacctagctacagctcatcagccc

SEQ ID NO: 5110 - DNA, 1500 bp, Zea mays
tttgagttcatgtgacttattttacaaacttgacctcacaaactttctcttatttagtctctatatggtgaaattatgtcattttataatctctattcgttcagtcagtcgttgtgaactctcttttaatcgctcacttcattggccgtgttgtaacaagacatgttggatagagtaaataataacatcagttagacaaatcaaaaaatattatacagagagcggagacaattaataaaaaatcttgaagttttttttggtggatagtttacatggggtattgttataagcagtcacaacgtacgagcaaccgactagtatatataaaatgttttgggttcggtgctagtcaaccatcatatcatctgcaggtcaccaccaccaccactttgcatttgcattggcaaaatagagcagttagcagatagctagcatcagggccagctgggccaatggtgagcacacaaatccattggcgtgggccccacttgttggaggggtaggtggtgggtcccctcgatcacgcgggctgcgggcatcccaaatttctgtcccctccggtcgtgtgcgtgtcaagcatctcttaattataaggtgagattggcaacctaattaaatttgcgtttgcatgcgtgtgacacacacaataacacgcaaaatagttccttgttctgtgctccttgctagctgggggcgatcgacgtacgtacgtgtcatggtcaggtcaggtcgcatgaacaacaacacctgcccccgctcgtcccctcacggcctaaacaacaattaatatgcgcgcttttaatactaatataagctatacgaattaattaacatgcatgcatgtcgccctcgtagagacatatatattctatagtatagtatgagaagtcgtcgtaggtagtactagtagagtatatgcacatgaaatataaacaaaacccgtccaagaacagtagtacgtagtatctagcatatgtacatcgcgtacggtatgcatgtatacgacgacgtagctcgtacgtacgttcacatcgctacgctgcagcagcgcgtgcatgcatgagtacacatgtattttatgtacgtgtgtggagtcgtagagagagagagagagctagctagctagatggcatcgtcacatcgcaaggcggacgacgtcttgttggactaatgcaagctcctaaggtcagcacggagaaagagagtccaggaccttgcttttggacggccgccggcaccacctatgcaccatgcagcttcctcgctcacagcagcccgtgcaggcatgcttttgccgccatgcacgtcacctccgtaccctagctgataaacctctataaaaccccccactccctagctgccatccacccaacgaaccccaccttcttcgttgcctctcttcctccctctcctctcttccttcctctcgatcgatcgtcatagcaatccaagctagcaagcccgtccgtcgtctctcgtccaagaagcatacaactacta

SEQ ID NO: 5111 - DNA, 72 bp, Zea mays
ggtatctctctgtgtctccaccgagtgctcccgttgtagggcgtttgaacatacttaataacactgccttcc

SEQ ID NO: 5112 - DNA, 719 bp, Zea mays
ttgccatctctacgtaggagggattggtgaaaaccttgttccagcggtcgagccgtccgatcgggtggtccggaggatcggacgggcgagcaccggtgcgcgagcccggcggtgatgccaatgattgggctcgcacccgggcgggagctttgaccgccggaaaaaaactccggctggatctcttttgcacattggaccccaacaactcgagtaaacttccaccaaggcctctatccatgtttgaatgttttttgtccacgaccatgcacaagttagttttgaaaaattgagcctgattcgaggatataaaaaagaccagggagtcgaatgcacatctttgccattttggcaaccattaccaacaaccggaggagagagaactcgagtcacaaagctaaaaaaagcaccgagaaatctagtggtgcagcgagcgaatccgtccggccgtccccttcctccgccacccatccccaaaattttcaccgcacgcctctcgctctcctcggctaaccgcgacgacgacccccgaagcttcgcgaagcttcctgggcctcccccccgcggccgcccctccctagatcgccgcctctggcagcggcgaggctgcatcgcgagggcggtggaggctggaggagccgggccacggggtcgacgaaggcgagactagggtttgggtttggtgtccagctgcatcggtcggcgccctgtgagggagaagg

SEQ ID NO: 5113 - DNA, 1423 bp, Zea mays
gactatctgtacgacccaagtgtgtgatcgcggttgtataaatatccccaaaggagtatctgagtaccaacgattagtgtgcgttggtttataaaaaaaaattaatgaggaaacgtcgaacggaatggtagtgtttggactatgcgggggaagctaacaacggcgtgcacgttccagacttccagttagacaaaatctgttgatttcaaaggaaccactttgaataccaaagaacaaagaataatatccattcgagacatggtgatgcaaacttgcaccagcctctctcacagacagagaagcttccgatttcaactcgtccgaatccaatgcaatgacgccacaaacacgattcattctggttctacacatcacaattcacaagccaccacactagcgaccatggaggaacagtttccatgcgaaccagagaacatccagatgacgatgccctcgagctcgtcacacgcatttcttggaccagcgcacgcgcgcgcgcgcgtgtgcctgtgtttgaattgatgcgcatcttgttgctctgttcttgcactgagatgaatccatgaaccacgaaccactggtacaccatcagttagctcactagctgctggacggggccggcggcgaaccacggacgggccgggagggtcagctggacgggcgcctgcgccgccggcgggggcggcacaagggccatggccatggtcgcggcagcggcctcgcctctcttcctccgcttcggtgtcgcagaggaggccgaaggggaggagtcggagctcgcggtcggctctggggacgcccgcttgtctcccgcggcaggggcagtggccgcgacggcggcggccgccgcggcgatctcggagccgatgcggagcgggaagttgaggagcgcgcgggagccgcgcatgcggtacgcggcgcggtcgtaggccacggcggcgtcctcggcgctgtcgtacgtgcccagccacacgcgcgcgccgttcttggccgggtcccggatctccgccgcgaacttgccccacggccgctgcctcaccccgcggtagtgcttccccctggacaccgccgccgcggcctcctcctcgctcccgggcgtcgtcgccgcctcggtcggcgtctcaggcccctccgcgagaaggaagccaccaaggcagggataggatccgcgctcgtagggggagtccgggaacgccaggggctcgggcttcacggcggcgaaggagccgtcggggagccagccctgggaaaaggcgtcgcggagcgcgccgaagacgaccatgtcgtcggcgtcgtcggggcggaacgggagcgactcgctccattggtccgccactaggctgccgaagctcgtgctgcggcagtacaccggccgcggagccgcgctcgcggtcgccgccgccgccggctcgtccaggaggtg

SEQ ID NO: 5114 - DNA, 1500 bp, Zea mays
aagcaaacgttaattacgtacgtaaagaacttatgccaaaccttccgcggataattaaggcaccaaaaattaataggaaaaacaacacactcgccacacttattagtggtccgcgtcatctgacggttctgcgggcaaaggcgctctcaagttgaatattaccgtttttatcaggaacttagcgagcggaatgacacactatcccaaagtagacgtgtggtagagtgagactatccatatagggtgacaatggcttctaaattttacattataaaatttaattactatatcttatttttattcatttttaactaaaattatttagatcataatattttatgaagaagtatttgcatctcgatccattaccactcatatatccatctgaatcaactaaccggatatgttaaacgagggctatgtgcagtcgacattggcatccaattgcacatacaatcacctgtacattaatggaggggacgtgcgaaggagatggacggacgctgggtcgatgctcatttgctcaacggcggctatgggagggcgaggtgacctggaggaagcagtgcgggcgtgtgcactgaagagacgcggcacgcgggagggagacggtcgaacgctggttcagtgctctgcggtctacaagtatacaacgtcgcctcaatgatttgcggcgcagtatttgaggcatctccaaccatgcatagtttaaatcggtgctttacttataaaaaaacagtttcaacagtaacttattttataatttttatcaaaaattatagggcacattataaattgacataaacatattatatcttagattagtgactcatccttgtttcctatattattctcaacattttctttcataaaatatatgatttaaggttttgctattggagatcaatttgtttttagtatcataaacactttcctctcaactcggtcgctgtgtgaagagaagtcagctagagataaagggaacataccgaatgcaaaccacattttggtgcaaacctcattcaaacttattaaagaaagttttaaaaaattctaaaaaaaacatgagtgtacatctgagtttaccttatctatatataaaaattcatggtcaaatttatcttactttatcagttaaaaaaagagaaaaattatgataaaccgtaatagttcaaatgcaccaaaatttgtctttttgtaactgctagagtaagataaatttgacaatgaaattttgtacatacatgaggtaagatcagatatacattcatgtttttttagattttttttaaaaaaaattagtaggtttgtacggaatgtacattaaaatatggtttgtattcggtatgttccagagataaaagatgcgacggttgacaccgagctcagtggagtagtggtcacggcggacggattgggcctctatcgctggtgaccggctgaccgcgctgctccgctccggatgaggtgccccagggtcctctgctcatgtccacgtcc

SEQ ID NO: 5115 - DNA, 1190 bp, Zea mays
atctcaggagctacttcgattgcctcttctacgtccatgacaagaagtgaagaaactatcttaaggtaaaggttatttgattgcctacatgcctgtgtttatgttgcagcgcagctgctctttaaccaatattgaaaacataaaatagtttttgggaacaatgtaatgttatgcaatcctaataaaagctagattgattttaccgtttgcacacatattgattttagattatatgagtgagtttttttaaggtcgatgataatatatgttgtccgtttgtattaaattgtgtacaaacattttagcatgcgtattataatagtttataacaaaaacaatagtttagtacattgaggtactcctagctgtggttctcgtggccacctacacgacagtctgccaattgccggcacagaatatataactcctacaaaatctcgacaaattttaatgaaaaccacggatgggatatttaattgcatttttaattaaccttgggagagaacgcgatgtggcaacagaaactgtcaaacaccacgaccagtgtcatagcgcagtatccctctgtacttgctgaaaccgtacaaccggccggcgtcttcatgaaaaaaccttcaagacgaaaaggagaggaaaaagatacggaccgagaaggagagcgcaacggaaagcaacccaaggtctctccttttccgccacacaggactcacgcgctcttcaatcgctcgctccgtttctacctcctctcgccttccttccttccttcgatcccgctttgtttgtcgtcatcgcccgcccccgaagctccgacctttcccccactttcccttggcgtctacggccttgtccggtgtagaaaacaacgggtttcgtttgtgttgttttgctgcggtttttgtccgctcctgggagttcaatccctgctccatctcttaagagcactcctcccctcccactcagtgtgctttgctgttcactttggattccgcggctttgtttcgggttcttgattaggaaggttcggttcctggtttgggaaggtcccccttccgaggcgaggaatttggtgcgggttgatgcgtcttgccaggaatccgcgatgcaatgataggttgttgaagccgaggtgaatctttgacctgcagaatttcctagctgaagtcccaccgcttctcgatcagccgggcgcc

SEQ ID NO: 5116 - DNA, 157 bp, Zea mays
ctatatgtcatagccagatagycttctaagttctaaacttattttcctgttactttatctatggagtttcattcctagttcattgcacattggttatcgtgacaaatgggggtgtcgctagcaggtctctcttctctggataaccacaccaccaatc

SEQ ID NO: 5117 - DNA, 1500 bp, Zea mays
cccatagaggtctcagaggggcagggtcagggggttggaacccatatgcgtcatagcctaatcacgcgcaaagttctgaacaaaagcgaatcatgggattacaaatgtgcagttattcccttcatgccgaccccatcgtgatgttcgcagcagcgctgaaaccgcccgtgaatgggtcctaagctgcaacagatgaactcaccaaatagaccaatgtcgttccgagaattgccaccaatgggtggttgcgaggtgactaaagctgttaccacaccccgatgaggacccgaggatcaatggtcttacgcacggaggctgagacatcaagaaggcgcaaactataatccccgggcggactccatagtcaaaatcacgcacgagaataggctcaaaaggtagattccaacacgaacaaacatcgtccgccaaaacggaaaatagtaagccaactttccctttatttcaaaaaaatcacaacagggtttatttacaaaacaggatcggaaatgtcgcaaacaatttcattagaaactctcattatactccgtgttatgcgtttgttattaatctaatctaagcagccatgatttataccagctgaactgggttgcaccagcgcaacttagaatttgactatatctcgaagtttttggtgataaatttcacatgtagcctattcaccctcctctagattactttcatatatctaaatccttatacttatacaatgtttttaaaaattatgtttgctgtatgtgttgttttctaaccaagtttgatgttcatttttaccaaaaaaaatcaaagtaaaaaacgaaatcaaacttctcgccttttttattttctagtaaaccgatcggtttttaatgcctataaaattaaagttttttttaaaaaaatccaaacagatgtttaaaaaaccccgaatgcccacccatattagggttgaactacgacaaaaaaaaaaaccaaaataccatcatatatgaatgtgcattactgagtgtttttaataattttaaataaaaacataaaattaaaaggttctagatttatcgtgatctataattttataaaaatatctttattttgactatgtagaatttttttatacgtttaccaccttagaaaaatcatatatatttttacgtagtcaaataaaaatatttcttatataaaaactatagattgcgacgacatttacaactttctagttctagttttgagttttctatttaaaattgttaaaaacgctgaaaaaataatagatctaacggacagtatttaaactttttctaagacagtttaaacactggcagctctaactcctctaaggtatagaagtggtatagagtgcaagaattaaaaagttccgatcaaatggtactgaaactgatccctcaaattttttaatagctcggaaaaagactctttgtttcgttgcagttgcacgggttggcgccggctcctccgatccagtctggccaccgggcaccggcg

SEQ ID NO: 5118 - DNA, 142 bp, Zea mays
ggttcccgtcctcctctgctgactccattcttgagctgggttccctttctcttccattccacctgaatgtttcttggtgttcaagaactgcacgaaagcccaaggtagtgtctttttgacttctggtgcagttgacgtccaa

SEQ ID NO: 5119 - DNA, 323 bp, Zea mays
agtcagtgagtgagtggtggtatccggtttctgatcctgcagcgcatcagcgtaatcgatctagggctgagctgaactgatactgtgaggaggtgatcgtctagatcgtctagacctttgacatttccttggttctttcgattctaagatataagatttgtagcctgtttcttttctttcggtcgaaatgtatgtgtggagagaaagaaagtggatggaagatttgccgtcctcaactgaaggtggggggaaaaaacggaggacaaaaggaacaatgaaaaagagagcaattgtacagagtatgacaacatgatgctacattt

SEQ ID NO: 5120 - DNA, 523 bp, Zea mays
aattttatgttttgattctttttaataaaataccgtgcttcactttaaataaaagtttctaaaagaaaaaccgatatgacattaaaaattgtgtattatagcattataataggtaagaattaacgatagtccataggcgagttggtagcatggatgtgcccgccggtaaagggtgcaagcattttatcttagccttcagatcgattcagcacagggcagcgaggtgaaccggtgaagtctcagtcagctgctgttatcctataatagtagctgcctacctgacttgaataatcagcatcgcttttcctttgcaatcgcatcctacttagctctgttccgtagaaatgaaatccagattgctcttgtactctttccccatcttggccgactcaaccaaacgcctgcattcagataaagtctcacttccgccgcagccacctcgaccactcttcgagagtgcgagctagttgtagatcggcgaggccgtctccgttcgcacaagccagacctcttcgcgccggca

SEQ ID NO: 5121 - DNA, 626 bp, Zea mays
tcatcactttcactttagtataaaaagtccaacactaattatgtatttacaaaattacaatccgtaatgtcgttgtcaagcatctcgccacgtatgctctcgatactagggacaatgggacagaaatcaggaccgtctgtccgtacctaccgccgtgttgcggagtgaatgaattttttttcttagggctattttgggtatttttacgagagatttttattttctcacggaaaattagtttttttgggaaataggaatcttgagaaaacggatttccgagacaaaattccggagcgaatgaatttagtcgtcagacgcaacgaacggcgggagcagacgggcacgacacgaaattcccgcgcgcgcggaccatgatgcgcgagaccaggagcaggagggcaggcagggctccggcgagaactgccgcaggcaccaggaccacacagcctgacagacacccggcgatcggcgtgccacacacgtagaaaccactgcagaagtggccaaagcgctgtggccgcagcccgcttgcgaggcgcactggcactccgcagctgacgacgacccggcagtccggcacaccgcctctttccgtgtaggctggccgccgccaccagctcgaaacc

SEQ ID NO: 5122 - DNA, 350 bp, Zea mays
tgtaagttgcagcattctgtttctcaacattcttatttttacctcgattagttaacggattgatcacttagctcggagctaaatttatttagttttacatttcctacattcattacgataagctcttaaggtctctaacagctccaaatatcagttgggaggcatttgctttagcatgtaattattgagttgggaggcattcgctttagcatgtaattattgagtttgatgcgcttgcggcttaatctgcattatgttggtgtgctaaactcatcattgagttatatgataagaacgccattctttctgagtttaccttcctgatgccctcctgcagaacattggcttct

SEQ ID NO: 5123 - DNA, 444 bp, Zea mays
gtgttttttgctatattttacatttgttatcttgtaaacttcaaaatagtgcataataatttttatatgtcaaatatttgataatatatgtataattatatatatgtgtggatgggtctcgatatcggatttcgcactgggcccctgaaaagtcagaaacggccctggcacgcaaaacacacggcagcttcgatgacgaaagcgctcacctcagtggctcagctggaaacgacgctcagaaaagaggcagctgtgtccggaacatgacgcacgcaacgacgtctagatagcccgcggccgtgcagagaaagagaaaagaacgagcgcgagctcgctgctttgttatataaatcatcacatacaacttctcctcaggatatgtcacgactcacgacgacggaaacagtagtgctgccagtagagctctcagaactcgggaaaaaa

SEQ ID NO: 5124 - DNA, 1500 bp, Zea mays
tttcaatcagtgcctgaaaactgaagttgcactgtttggtgtcagtttgggaacacttttgtgaccattccaccaggtgttaggctaagaactatgtaacaaggttggagaccaagtaaagaagtacaagttttgttatgtgggtctgacttggtgcttaacaaactttagagtaaaatgcacctaaacttcctctgtcagactgtctgggggactgtttcacttcagctgaaactgaacctcttagtgtttttgctctacttttgtgtcccataatttttgttctatgtggtttcagcctaggggtattgtaccaaagtggaagagcaatgattttagagtactttttattagggaagaaggggccgttgttgaggaagtttgtgagataaagtagaccaaactgggagctgtgcaatgggacactgatgtcagggaagttgattcagtgtttgggataggaaattgaggaagatttttctccctttcctgtgctccactggtgtgctcgagttgggatacgggtggggtgcaaaaccaaggatctagtgacttcagctctgcttcaaaatatctagttttggattgtttgggagatgtggacaaaagagatcatatctgttttgtctactatctgcagatatctactacttatagatttggaccaagtgatatttgtgtgttgggggcattaaagtttgtttgctggttatttgagggaataaaatgggcaacaagggttctagaggtcaagtttttgttgtaggaaatatcagctggactgttgcatacctattaataaatgcaagcttatctgcttgccttgcccatataaccagcccaggttcaaagttggttgtgcttgtggctagtttggtgcttgggcatgagagccacgtgtactagccatgctgctctggcaccctcagagctcaaccatgctgtgcccttgacaagcttagtcactacccctaccctcttattcagtcaccatagggcaggttgcagtgaagttgctctcctatcctcgagcttagttgatctctcgggtgtctttgtggttgtgcctacaagcttgagtttccctcctcaaccacttagttggtcagctcctgtatcctgtggtgttttccctttgtctggtgaccacgcagccgattcacccacctcgctgtggccagagatttccagggagtcgcatgcccgattgcccgtgtaatccttgttccaagttctccaaaggtcagtgaagcttacagagttgactgttctagctctactattgtgtgctgcccggaacagtgcggcgacgccgtgaactggcgctgcagaccgcctctgcgtcgacccgttcacccgtgccgtcctcggtcggtttcacgcgcacaccgtagccttgttaggtcgttgaagctctccgcgccattggtttgagctctaccgcgtcgtggccgcggaatcaagctcgagtttccaccgccgccgttggtagctggatat

SEQ ID NO: 5125 - DNA, 1116 bp, Zea mays
ctcaaatatggtataaatacgggttaaataaaaaaacgatcctgtaaaaacggacgggatagaccctttcccgttttcgttccatttctggatttttacgtatattctgtgaaaaacgatatgggtccagacgtgattttatctgtccgtttttatccctgccatatcctaacaggtcgcacgtgcaaaaaaacaatatagagtacgctaaaatccttttaaggatttggtccaatgtgattttttcaaatggggctggcaatatcggcaaaaccaagtcaaccaagcaatttaatgttcatatcattaactccaatccacattgaatgtctgcctacaattctgttacagacttacagtgagctacaggcacctaggcgactggcctgtgccgtggaggaggaagcctgcagagctgtgcagacaagagttgacagttccacgggttgcctctgaagctctcctctctctccgtccgctgaccgagaccacctgacatccgaggcttccatcccagcagtagtgacgcgtgacgagcagtgaacccgcaccaacatcacgtcacgttgaaagcagcagtcagtttgggggactagtcggacgccagtgcagcaagcaaaccacagggaagtgttcctacttccaacgtctatatgctgctgctcgcttcatcagacctgcgaactggttggcagttggcacaacagccgtcggattacggatttgcgcgtgtcccatggccatggccatgccaaatgctgcgtcgcttcccctggccctgtccatgccactcgtcgtactcgtagtcgtagccctcgcagcggcaaaaggaccacacggtttccgcagctctctcagcctcccaacgaagggaactcccaggaactttcgccaacccgtgcggcggcaaaatcagctgccagcctgccacctctacgcgcgggcgcggcgcccgctcccgctcccgctgggacgccacgccaaggcacaccaccaccaccctacaaatacgccccgctccgcacactggaacgaccacatagaccaccacgacacccttccccacaccagcagtcgagctgagcacgacacaaagccggctggggccgcctcgcc

SEQ ID NO: 5126 - DNA, 722 bp, Zea mays
tgcatgcctgcagcggctgatggtcttgattccatgtgtcgcaatttaatttagtaaaacattaaatccttgacagcatattcagaattccacaatctagattgatacttaatcctaatcaaaattttaccttttcaagatttgaggttatgattttattaaagtcgaacccatgtgtgcaaggtcatcctctgacagatcatctagatcgccttatgcgtgctcggcctttgacaaccttcctatgacaattgacaagagatttatttcctttttaaaaaaaacaaaagactggtctttctttaaaggaaactgatgaggatcctcctggaccaatatgtgttactgagacctgagaagttagtacagttttttccacttgaaatatttcggtttagtgtgcttgattgggtattttttgtcagggtggtggtccaaacactgtacaccagcagaggagtggggtgatgacttctgagtgtcaatgcaagtaagatgttgcactttttttttcaaatactggcaggagctctgcctgccagttaaaagtaagatgctgctagttgttgcttcctcagataattgcgagaaacttctccctattgcgtcgattcagttttattgtcttccctcattttgctctcactgttcatagcaacaaggacattgacgaatcatccgccgagaggctgtacgacgcagtgaagtacaccacggccaac

SEQ ID NO: 5127 - DNA, 225 bp, Zea mays
cctatttatataatatataaaaaccatagcaaagcatcatcaactaggtattacaataaacatgctcatgatccaattctctagatgcaaaatatgcaaaaaaaaaaatctattgcctgactccttcaaaccctgcacaccccacctgccttgtaccaaattcccctgacccgtcggtctgctatcccatctgagctcacggcgatcctctttctcctcatcggc

SEQ ID NO: 5128 - DNA, 1500 bp, Zea mays
gcctaatcaacgatcaacggatcgatcttgcaattcttatagaataaaactattgtacgaccttataagctagctattgaagtttccagtttctgttatatatacacagtatttatcgaaacagtaaccgagactgactagtgggcctgccggtacacatagggatggtcccacttggactctatcatccatacatagccctaagccctgagtaccatgaaagttattatttggaccttcgatttgaggcctcaatttatttcgcagtctgatgtcattataaagacgaaataacaccgyaaggggctactgttgggggcttccttaaccgaaggtcctcaaaacaataatttgacaattgtttctaaagtatgttttaggtataatagtgtagttggcgaaggatacctttgtttgagagcgatgtgcgaccgacaatcacacgcacacggagacaaagcaacaaactttggctctgcagtatgaacatgttaacaaaaggtaagagatgaaatcttcaaggtttgcttaacactgctacgaatgaaatgtcgatagtgcccttagttgattttgtagttcatgtgtatagaactaaggtcatgaatgtaattttcacaaagttgtactccaccactataaatagatgtacagtgtcatgcacagggatagacttctgagggctgagatttgaatcgttctgccttcgaagctgtgatttctccatctttgtattgttgcttctaccttccaaggtatatttgtaattgtttgtaatgaagaagaagcaataaaggaaacatagctataattgtcttctatatgtactttcattttatccgaagatcatttactcttatatatttactcttatattcttcttcttttaatctatcactgattatgttgccctgttttggtctccctttaggaatcagaacaggtagccaacaatactccaatcttaatctgtaatcagtcagttcaaaaaataaagctccatatgtggattgcatcagctatcttatctgaataaggyaataagctatcactataacactcagaatcttcctacatactatgatcagttaaatagtaaacaggtacagaagtccaaatttatgactcacttaaactagagctactgtccaataccaacgacatgcaccagcatcagggcatttgttgggacttcttagccggcttacaaaacaagtagacaaaagaatagcttctaaagccaaaaacggtgaagtagcagccgttttgggtggatttttctggcttctctgtttttttagaagcccaagttccaccaaagagggcctatgatagctaattcgacatatccaatatctggatcggaatgaagttcaaatccatgctcatttgaagcagcatatagtttgtcaagtaaaatcaatcaaacatccaaatgatcatccccttactttcaacatttgatcctcactgcatctccaaggatacataacacaatgc

SEQ ID NO: 5129 - DNA, 1500 bp, Zea mays
tttagagcttgttgctggagtttttcttagaccttgctcttaccctgcacaggcatgatcatgccgagcgggcgcataaccctagctcggtgacactagcgaaaatgataaagttgtaagataattactatttttctagcaaaatttagagttgtctcggtaaaatgatgatataaccagggatcaaaacaattttagaaattttcagaattccagaaaccgttttccatttttcatcagtaattttcgaaaacaaaatcgtttattagaattttatatcagaactgatatcgaaatcgacgtggcgtaccgaccgtttccttcggttaccgaaagtattccgaaattttaggtctttaatttttctgaagaatggtttcagaattctagaaactgttttcaggtttttgcgaccgaattcgtcgtaaacgtatttttttgaaatggaaacggaatcgactatcaaaattttgtgaacttattatatgtaaattgtgaacttgtggtctttgtaaacttgtcaatttgtgaaatttgagtaggtaaacttgtgatatttatgaacttgttatgcatgtgaattgtgatctttgagaacctgtcaacttataaattgtaaacttataatctttatgaacttccgatctttattttattttttatttgtgctcttattatattgtgaacccgttagattttatattgtttgtttattgatcgtattttaaattctggtcacattagaattttcattttcgatacttttaaaatatcaaattcgttggtgtttctggagttaatatttttttattttgtttacgattaaaaaatataaaaagtagtatttaataataatttttatgtctatttagttcgtgactaactaagttacactttatttaaaattagttagaagtaactttagaaataaaagttagtcaaaatatgacaatttaaacagcgcccttcgtcctaccggccaccgtggcgctcgcactcgaaaccgctgaacggcagaaaacccaggcctttctagcttctgctatcctgctgctgcccctctttcccccaatctgcaggctgcaggcgctgctcctttcgccctccgctagcgagcgaatcgctggctcgaccccgcggcgggaggtatcccgccttcgatctggtgcgcgccctcctcgaactccccctcgccctcctcatctggcttccgcttgggtccggtcagcgccaagctgtgcgctgggcgaaacttccggaagcttcagggtttatccggcattccgcttcccgcgacggcggcgcgaccggttcgctggtctaacggagtttctagctgagtagctgggatttcttgttggagcgtcgctctccggcgcttatttcatttatatttgtctgtgcctcaggttcactggccaattcgttgcttcgtggggctttggagtttggagccaatcttgccccttaaagtgtcggtggcagcgttttgtgatcatc

SEQ ID NO: 5130 - DNA, 1500 bp, Zea mays
acatgaacttggttagtgttagtgagatggatcttccttctttttgtcagatatggcacggagattccaaaccgttgcttgcaatttatagaaacaagcagttgtgcacgcatcgagtcaattcaaggtactgactgcgtgcttggccagcacatcatgcatacatatatataggggatacatatatagctgtataaaacgaacgtattatactatagactatattatttataaaataaagtttaaaataagaaataaagataaataagctattagagataaatagcaggagaccgtatcctcacaccatgtgtcaccgcaaccgtgtatggaacgttaactttcccaagtccctgaaaaaatattcgggacccttttgtcaacgcactgatctgaagtcaaaaatcattgccgtcctaaagtttcccaccttgagaccctttttgaaatgcagtgattttttctatactctttgtttttcccgcgaaaataaattatgtcaaattactgtatgatttctctaaaattactacctctcaagagggtcttcttaaacttatgagttttctttttttaaaaaaaatcgtacaaacatatagagtgacaaggtcacgactcgagacgtaaatctcaaactgacaaaataaatacacgtgtaaggttggcttatttcgaactaaattttagcccgaaatcaaacacgttgtaaatcaagaataggactaataaatagtcgacgatcgtacggctgagaacctcaacaagccagtacgccgcttgcaagtgacgagcggccaacaagacgttcatgtctccaacggtccaacctcggctgctccattcccatcgcatcggagaagacaggagacgattagagggtgtttgaatgtattaaattaatagttagttagttataaattgttagtagaattagctagctaacaaatagctacctaactattaactaatttaccaaaaataattagtagctaaactattaattagaatatttaaatgtcttaaataattttagctactgagtattagctctatattcaaacacttcttagaccagatagcttgcccgcccggtcacacaaccgcgacgtttcacgatccgtcactccaccaccaccaaccaactcggcctacaccgcgccgcgccgcccggctacacgtcactcgctcatataacactccatacggtccaggaagccaatcgccagccagtcagagtcaggaagcgcggccgcaccaaccaggccctgtacatagcatcggccataacacaggttataggattctcagtccggccgtgccggccatccatccggatcctgagaagccgtgcaagtttcctgcttcgcggaggatttcagtcatccgcctgccgagggccgagtttctgcggagagtggccagtgggcagattttctcggccctgaatcgatttgcctgctactcgcggtaggcgaagggaaggattcaaatcaacataac

SEQ ID NO: 5131 - DNA, 568 bp, Zea mays
gactaaaattagttcctagaaaccaaacaccctttagtctttgcgtttgataatttagggactaaaatagagagaccaaaaattagttcataaaaaccgaacactctctaataattagctagctaattttacgagaagatttttccagtcaaataaccattagctctttcattcaaacaggcagacgtatcaaaaatgttagtttaattgtttgatacatgttacattattatcactttcatgttttttagggctagtttgggaaccataatttctcaaaggatttctattttgcataaaaaaatgaactaatttcttttaagaaaataaaaatcctaaaaaaattggggttctcaaactagcccttagaaatataaagaagcaacgcggtcaccgttggttggtcagctggtgtgtaactttttggtgttccaagtgaccaagtcagtaaccagacaaccatagaccgacgaggtgtgaactgtaatttcagatttcagagcgcgcaagaaccctcttgaccaccgccgccgccgccgcgaagccaagccaaactgagtaagcagct

SEQ ID NO: 5132 - DNA, 797 bp, Zea mays
gaaaccgatatgattattaaattatatgtatcgctatataaaatactgtttatagactaaagtttgaagcgtgatattacgatgtaggagatagccttatcctctctagttccgccataacttctgttatgtgcttcgtaaaacttctgcagcctgtgagagttagtatgctgaaaaaaatcgagaaaattatatttttggacttcaaacaatgtgtaaaaaatgatcgaaatgacattaaaatcaatgatatatttttaatcttaaccttgcgaaatcgatgttagaaatgacaaaagtatggagcacattgtttgactccgaggacacgtatcgtttcactcgaaactgctggctgactgccggtcgccggcgcctcgcctctccactctccttgcgccgctgtttcgcgagccacggccgagaagagaagcggggtggcgagttggagacttggagatgtccgccgggcccggtggagacagttttgtggcttttgtaaatgggccatggcccaatagaaacgaacggagtcctggtccgttttagtgccgaaaaccctaatccccgtggccattttgggcacgtagccgcctcgctttctcctcttccgccccaccccggtgaggcgctgatccatcgcctcggacagcggctccagaacctccgcgttgcaggtgagctcgcctccaaactcatctcctttgggcacgtacgcgtctgatagttgcagtggttggggttggcttcgtgctattcagaaacacagtagcgagaactattcggtggggccgaag

SEQ ID NO: 5133 - DNA, 295 bp, Zea mays
aacttgaagtgctacttcaggtccaatcgtgcgtaaggaaagcgagcgagggcgcctgcatcggtacgcccggtgacttctttcggtttcatgcttgacgcattgcatcggttgtacaggtggaagaaatctggcagggtccaagaaacaccgaatgtcttttttggttgttcgccgaagaacaccgtatggcacttctttcacggcaatggaagcatgtttctcaattgttacctggtaggctggtactatagcttcattgcgacgcttgaccagaactcatcaggcaggaggc

SEQ ID NO: 5134 - DNA, 1500 bp, Zea mays
tttttcgagaggggataataaataaacaacggtggcgtgaataaagaacggaacggaacctcctctccacacaccccttgtcccgaggaaggcaacggctcgccgcaccaccaccccacccaggcaccaccacctaggcacctactggctattgcacaccacgcaaggccgcccacgacgggtggctgcctgtgcctgtgcctgtgctgctgcagtgcacgcaccacagtgtcaggatgcgtccgcttcgtcagctgcgtgcctgcgtgctacggttactactgccgcctgggattgggattgggcacccacccccagtctccacagtccacaccacagcccaacgcagccacagccagggggcaacgagtgaagaccgcggagcgggtgaggaccctttgacttgtttttcctggatgtgacgactgacgcgcgcggcctcggccctcggccggcattcccgcgtcgcagcagcgcggagctgcgtgtcccacgagcccggcctgctttgctccaatccgagccagcctttgcccccctccgtgcgcccacacaaggagagcggagaagaagtgaagaacccactgggcgcccggatttccgccgcgaggttcgcgtccccccgattcctcctcctcctcctcctcctcccccctgctccatgattttgttggccttccctttcctctccgagcgctctgccttctgcggttctggctttgcgtttgcacgataccgacgctagggcaaccagcggtggtactttcctcaagattttctttgtcgagggtaaagtttggttcggggacgacgccacacaggaccaccgccatggtgacttcttctgctactggtgtgcagtgcagagcctctcgtgtggtgtctgtctgttgagcatgtttcggactggaccgagctcacttcgtttcctttacaagcgaagacatgtattcccccacgcgacgcggcgtactgcctctgtagttcgcatttcgagcgggcatttcgagcacagcctcccgtgccgcgcccattcaggagggttctgtgctttctgtcaatgaactgcagttacagtagtgttcatcttcaatagggtttctgttcgatttccttcatccgtgtcttttctggaatcgccgtcttgtctccgtgcaattctttaaggtcccatgcccgtacccgaatcaccgtgcggcgatttcttggtgccgtatgagtaaatgccaggtttctgcacatgaacaacatccgcgaaaaaagtcgcatcctttcactgcattcagggcctgagggtcagggggtgctggtctcactccactttcgttaggaactgcgaggttgcctgccggatttttacctcttctttcttgttttcgttccaacttgtcccgtacgtgctttttgacgtgaaagacgatgatgacaaccaaccaatcaatcgcgctgttggacaaatgcattgcagagtgatgcgctcaaggatccgcatccgcgaca

SEQ ID NO: 5135 - DNA, 311 bp, Zea mays
tactctctttatgttatcatattaataaatatcaaccatgtgatggtgattgattgaaatgtttgatttggatctttgtttgagtgcaatggtcttatggaatgatggccataagaacatataaaatttttaaaactcaagtcatttcccctctagaatctttctactcttctcttctctaagatgttcactttctaaccaatcagatggtgaatcaacgtcaaggacctaacaaccggaaccagcgtggacaacaagcaccaccgccaccaccaccaaatcccaatatggagcagttcatcgccgcccaa

SEQ ID NO: 5136 - DNA, 55 bp, Zea mays
gtgagtggtactcactcatcaatcctcgaagctgggcggcgcattggtaaactgt

SEQ ID NO: 5137 - DNA, 413 bp, Zea mays
gtgaaaaaaaaattcaaaaattttgaaaattggcaaactctgtaaacttaaaagtgaaaaggaaattgaagaagtgaaattaaatctagttcatcgcaacgaaggctcgttagcttgtcgtgctagtccatctcaccgcactagccgccgctgtccgccagtgtacagtggacagggggtgatgactggatgcgggcgacgcgataaacatgcacgtcgagagaatggctgcattttccacaccgcgaaaggagcccatcactcggaaaccgtaagccgtgcaaacaacaggcgacgcaccggcgccgcgcgcgcacgcctatttctagctcgatcgtgtcctctcgccgctccggagtcctcaatccacacgcttgggcgagcaagccttgttccggaagcgcgcggacgac

SEQ ID NO: 5138 - DNA, 178 bp, Zea mays
gccccacttctcttctcggtgtccccatcttctggaccaaatgcccgcccggtgattccaaaatatctttgtgtggttaagtagaaagtttcggctcgcttcgtagttttactcgtaagtctgatgctgcgaataagtgaaggaccaactgtttaatttttgcttgcttgcccgcgtt

SEQ ID NO: 5139 - DNA, 1146 bp, Zea mays
tttcgactgcgggggttttagagtattatgggccctatgtttgctggcccattagggttccatatttgtacccgttactgtagctagggtttcaattcagtcttgcaacactcagtaaacatgattttgctttagcatcatctttatgaacctattcgttctgccaaaccatacttctttaaacttcttgggaatgagtatatctatggttccagatggtaccttggggtttataacagaatactgtctaactgcataaatatcaagagtcctgattcatgaattacattgttcttcaatatattcttgtatttttcccgaatattgtccttcgaggcttttcttctagagttatattattaatccattagtggtctaatgtgaacttatctgctgcatgcttgttcaggttcaaattgctccgatccttgcaaaactgtgcttagagttttctgatgtttatataggtacgatgcatgaggggatctcggatccccttatttttgtgtagcttatgtgcccttgtgaccctcttgattatacttggtgatatatttcatgcagggttaaaattcatgtcaatttttctacaagaatagagattctctgtttgcgggctactcatttaggaaggctagcctttgccttgttcatcaaatttttggccacttcatcactattttcatgtgtattgatgaaattactcataacaaaaataataggcataatatgagagcacttataaaaattttaacagaaatggccatagtaaaatgcacaacacactcactatcaaacatagaaacccaaaagacaatggcagcttcgttaaacagtcacaagctagaaccagcatttgtagagacgacataagctattaaaaccaggttttatctttaaatgttattaagaaacacacgtaccgacacaaattttttagatctaacttggtccatgctatgtgggttgaatcatgcaggtgcattcgtagatgaaatcagcctgctacaataaagtcactgttctgcaagtctataaggtggaggtctgaggggacagaggaagtagaaggagagaatgagaaggagaaagaggtggggattcaccattgacatcatcacgtagctgcaggaccagctcgacgag

SEQ ID NO: 5140 - DNA, 475 bp, Zea mays
aatggtgattaactcaaaaattgccaatccaagtgttgtgcttcatgcttttgttaattgtactttacaaatcatgtttccgtgtgtttaatgatttctctcttctcctacataagatgtttgggagcattacttggctcacatatgcttcatgcagcacattctctgattcagatgaaatcatgatatagttagattgctgttggtagtctcagaaataactcaagatcagtaactaagtatgactccaaagagttaaatctgtttcacgttgggcatggttagtccttattgtgaagcttttagcttgagactttgttttttaggaatttttagcttcagagtgaggcaaagattatatgtgattcattggatattacatccactatgtgcatcacagcgaaacactatggtccctcttatttgtgagcatataacttgaactctacgctgtcccagtggatttgggactgcg

SEQ ID NO: 5141 - DNA, 323 bp, Zea mays
cttgctgcctgcagatgcttcctcaaataattaacaccactgtcattcgcacttgcgttatccacggttatagtcattactctatccaaaccccaatcagctaagcatcttgtcaagttcttcccaatatcctcccccttgtgaccttttaccatgaaaaaacttatcactttcttgtgcaagttccagttttcatcaatgaaagttgctgtaacagtcatatatccatcttgaacctgagaagtccaagcatctgttgtcaggcacactctctgacaagaatctttgaacaacttcttgagcttggctttctcttcaaagta

SEQ ID NO: 5142 - DNA, 368 bp, Zea mays
ggtcacctgtcaccagccaccggcgactaggggattgaaggacggcagccacatcggaatcgtcgtgcaatgtatgtatttcctagtcccagcctggaacccccctattccccttactattttttagtctgtgagtgacattgttcttaaataggacaatttattgttcttgcaaccccaacctgcagcctaataataattttggaaaatggtcaaaaggaacactgactgaacaatttaagagatagaacttamtaatatgaaaagattgtaatttggcctgtgatgtgtattttatgatatgttcttattgtatttatattagtgaatgattaattgattatagtgttcaattttgatttatgtag

SEQ ID NO: 5143 - DNA, 1500 bp, Zea mays
agaatttacaaaagagtttgcaaaaacaaaacaaatggtgcatgcattgtccaaaacattaaatatgaagaaagcatccatgcatatcttatgaaatgtaacattggtttaattccaagtaacctttgcacttaccttatgcaagctagttcaattctgcacttatatatttgctttggtttgtgttggcatcaatcaccaaaaagggggagattgaaagggaaataggctcaaaccttttcctaaatgattttggtggttgaattgcccaacacaaataattggactaactagtttgctctagattatatgctctacaggtgccaaaggttcatttacaactattctaaatcgactgtccggaataccgtagattattccggacaggagaagctttttggaaaaacagactaagcgcggaccgtccgggcccttgcggcggaccgtccgcgacaccaggatgaccctcggacagaaccaatgcaaaaacatgtgtctctactacggaccgtccgatggaaagagcaagcaccgtccgagaccatgcgtggaccgtccggcctcaggcgcggaccatccggtaggtgaggaaccgagaaacccaaaggtgacgggtttggtaaaatgaattatagcgtcctcgtggaccgtccggggtgcacgaccggaccgtccgcgattgcctttatctgacatctgatgacacatttaatgcattatagccgttgatatagccgttactgctgaccgttgcgttttcagccgttgatctacaggcgcggaccgtccggaccaggcgggcggaccgtccgcggtcggcagaatggagcaacggctaggaagtggttggtggctataaatacaaccccaaccacctccattcacttcacccaagcattccaaccttcaacattcaatacaagagctagcaattcattccaagacacattcaaagcctccatctctccaagtttcacaattgagaaaagagatcattagtgattagtgacttgagagagaaagtgatccgtgtgttatttgtcgctcttgtcgcttggctcttttgcaatcgtgctttctttcaatctttcattgcgatcaaactcacttgtaattgaggcaagagacaccaatcttgtggtggtccttgtgggaactttgtgttccaagtgattgagaagagaaagctcactcggtccgagggaccgtttgagagagggaaagggttgaaagagacccggcctttgtggcctcctcaacggggagtaggtttgcgagaaccgaacctcggtaaaacaaatccacgtgtcacacttcttatttgcttgcgatttgttttccaccctctctcgcggactcgatcatatttctaacgctaacccggcttgtagttgtgattaactttgtaaatttcagtttcgccctattcaccccccctctaggcgactttcaattggtatcagagcccggtgcttcattagagcctaatcgctcgaagta

SEQ ID NO: 5144 - DNA, 496 bp, Zea mays
gtcgtagcgttaggaggggctatggcccctatcggcccccggctcctgactccagaagttgatttatttttttaggatataaaggagtaacttctcgagttggatctattcgggaatcctgcatgaatttttttctgagttctatgttcctatattagtcataaatattttcgagaaagtaatgcactttttatttgcagaagtatttctcctccatcagttctgtagaccaccaccaacgaatagtaccccatatctgtctctcccaccaccacccaaacgcctcgacccggacgaccggaggcagatacgtgtgcgaccctggacgcgcgagaagatccatccctccacacggatctcctcctgtccaccaggctacttaactgatgagacggcacggccaaaagattctcgtggacgtctccggcgcccaattgtatagtagcccgcgcgctctagcgagaagctagcgcgccatcgccgccggcgtcgtgtc

SEQ ID NO: 5145 - DNA, 1092 bp, Zea mays
tggatggtcgtagtctcgtagagcgtgcacagtgtgagccccgtcgtggactcatggtggtctcggcttggaatcctggataaggaacgacgaacgagacgccggtgtgtgggatcggacgagggttggctgctcgcctgcacccttcagcgcgaaagagaaagatagcttcggttggctacaagtgtgtctcgtcgtctcattcagattagagattgggaatatggtaatttatccaacctcagaggatagtagcatcgaagtcgttgtagtatagtggtgagtattcccgcctgtcacgcgggtgacccgggttcgatccccggcaacggcgttttttagtttttagttttatttttaattaattttgttattttccaaactttacagcttagcccaagctttattgagcaggccctacctcggcccatttataacaaattacgaggcatgctcttcccgatcgtagctaggcctctgacagaaaataaataagggaaaaaaagcacacccctttggttggtgctcttttgattcgcttcgagacaatggtcgaggctgcccgctagcgctcgcgattgacttggactctgcagcaaatacgcacaaggtaaaggacgaatgtgcagcaccccctgctaaaccctggcgcgtgtatgtatacacattacacctcatcccttcccctccccccgccacgacccctcagccctcacacaagagacgcagctgcgagtccgccagccttatcctcctccccgtctccggctccaacccgcaagcgcggtaaggtgagtccccatcccgctccttccctaccaccctaattcgcgctctgaggattaggtggaactggaactggatgcccgcgccgcgcagctccagtccggtgggtcatgggtttcggcgcgaggttggctcggggttcgttctcgtagaaagacacagattggtggcgagtggatctggtacgggatgggatggggagttattgtctagcgctagcttcacccaaaatgctgcggacagttggagctcgtgaatctcgcggggtctgtactcgtgtggctggcgtgccactgtagttagaac

SEQ ID NO: 5146 - DNA, 1380 bp, Zea mays
ggtgagcggcgacagagcgaggtgtttgacggcttctctcactccggctggttgtggagcactggagcagcagggcagcagctcgagcaagcaggaaaactgcggagtgcggagcatgagagttgaaaggataaagctttcggaccgctcattttctcccactttttttaacttgtggagatgtggctaccgtttcgtggaagtctcgtttcctccttccagcgccacgtgtgcaggagtacgcacgggaggagagaagtcgcgtccggaggcaagagccttccgcgccgaacgcggctcgccgctcttcctcctcctccccctctcccgtaggcgtcctcgccgtcctagcgtctgcctttcgacgctgctgccgtggagcgcagatcaaccctgactctgcccgatttcttctctcgttggtaagggaactcggctagaaatgctcgttcattctacagattctccttttcttttcttttcttttttgtcgccatgcttcaattccaatgccttcttttctctctgaccccgcggatttgtttgatgcccacatttctagatttttaggtttctagtcacttcgatcgcgcgccttattattgattagttagaaccatcataattcctaactcataaggtgatccggcatatttgttccgccaaaagaatcatttcccgcacaaaatatgatagccaagcttgccgcacagagaaatgtgtggccacctcctgatgcatcggtaatacattaatgtgagaaatcggttgcaatgtgactctttggggatcaggttatttggaaacgagggcataaaaatagtacaatacactttagatggcttccccatggtgttttctttgagtgtgcacagagttttgcttcggttgacgtagtattctttgatgctgctaatgccaatattttttttaaaaaataattcttttcaatgggtactgatggtactttaaaaaaataataaaaaggatcagacattagttgggagcagtactttttaagttcactcacttgatcacggtttgaatgggttcagttcaaatcagaaaatttggcacgtaaaccccaagtgtgcaaataaatatacaatcaatgaagattgagttgggaacaggaatgtgattgctttactgttcaaaggaactgtaatcactgttttggtgcaaagcagtaatcacataaatagtgtgactatttattagtttgcttrtgcaaaatgtgcaaaatctgagatttatcaccataaaataatttgtttcttgttgtgctctacaaatcttttcagatgctgaaggtcatttcttacatgttgcagagtgtggaaaaaccttgcaatgaaatggaaaaatgttttgaaggaa

SEQ ID NO: 5147 - DNA, 144 bp, Zea mays
catcactttaatcatttactgcaacttctgcagattgttgttatgatatcatgtttttagtatgatctcaactctgaaggtaactggtttactactagcaggtcagatgaatggacattggagtttgttgatttcagtggggag

SEQ ID NO: 5148 - DNA, 297 bp, Zea mays
gctggttcaagacggttgaagcgactcatgattttcttgaaggaaaagtccacgtaacaagccacaaaatgatagccataggagattacgttatcatattatcgaaatccaaatgacatcacagttcatacatatatagaacaacatcagaatataaggaagcctctcagttggttaagacactccacaagcaattcgagcatagaataagaccgtctgatcctctcatccatcattagttaagtcataacttagcttcatcactttcacggctcccggcctctctgcgctgcggcg

SEQ ID NO: 5149 - DNA, 1500 bp, Zea mays
cctttaactggtcacatgcctcgtcatgggtaagccttgcctcgggcagactaaggccggaataagataacacgaaatgggcgtggagcggtggcgagagtagcgtgtaccctccgtggcaagaggctggacggtggtgtatctgtgctctcggtttgcgtgaacctgatccggtcttaagaaccccggtggcgggttgacatatgcaagggttaagtgctacatatgtcgtgtgattggagatcctcagctgagtataatcgattcggatcgccgtaccttcgcggttatgaagacttggtcacttttctacaacctagagtcaggatgtgaacactatggataaaaatgatgttgtattgatgagatgttgaaattagactagatgcaaatagagtctattaatacttaatatggcgttaaaagattgaaagtaaggactcactttagtaagctacttctgcaaaagtataagttgatttttgctaaagcctctccttgactcctatttatccagcatacccttgagagtcttttccttagtcgggtaagacttgctgagtaattccatactcagggttttattccctgttgtttttcaggttctaaccttgtgctgttgtgatggtgttaagtgccggtgggctcggccttcttatataagtataccccgtctttatcttcttattgaggatgatcacttgagctagcatatatttcaaacttatacttttgtaatcactccgataaaataatgtaaaatttttgtaacctgtaaaatttggtaataagatttccgctgcaaaaatgttgtgtgtgtgatttgtgttacttaatcccgcggttctggttgtaagtggtttatccgatgtccttggggcaatcggacggatcctgttaagttatttggtgcacatgcatagtcgtctgaggtctttgagacaaggacaggtgcatgtgggcccaataacttgggaggttctgccacactctccaagtcccaaatccactccaaacaaatagtgactagagagagagttttgctcgtgttctttgagctcttgttcttggatcgctttcttcttccccattcttgttcttcaaagcacttataatcaaagcaagagacaccaattgtgtggtggtccttgtggggtctaagtgacccatttgattaaggagaaagctcactcggtctaggtgaccgtttgagagagggaaagggttgaaagagacccggtctttgtgaccacctcaacagggattaggttctttggaaccgaacctcggtaaaacaaatcaccgtgtcatccgctatatttctttggttgatttgttttcccctctctttcggactcggttttatttctaacgctaaccccggcttgtagttgtgctttaaagctataaatttcagattccgcctattcacccccctctaggcaactttcaattggtatcagagcccggtacttcattagagtctaaccactcaaagtg

SEQ ID NO: 5150 - DNA, 750 bp, Zea mays
tcattctattgggcgtgctcaaattctccactcatcaaatctgtcacgctagctagctcgtaggtaaagctgccagacgtaatccacattgtttgttggtaaagctccactaagtgatggattaagctagtagctaactgacacttaagggataaggacatggcctttgttaccttgaagtaattattaacagtttgtgctatatatatcattaagatgtatgtatgtataagggtgtgtacacctcatttaataccctgtttcttatcgtagacggtctcttcacaaagagcatgtttttacacgactctttatacatattatctcttaactacatttatcaaagacacctcattatatcatacaatttcttagtcatctattatattgggcatgcactaacttttgtaaatcgaacatctcacctgtctcaaaagaaaattacaggcccccacactaatcgtttatcgcaaagtttggatttggcaacataaaacaatttccaccattgatcctttttattttttggttgccctcttcttggcatcaacttcacaaacatcttcacaagcctatgtgtactgtccaggcttttataaatagaccccccttccctctcgccgtctccacaccacctccaacctcaaagcacccctgatctctcgtccctctcattcgtaacactactacagcaagaacacaagctaggcgcggtgggtacggtgcaagtgagctagcagctctaccgcc

SEQ ID NO: 5151 - DNA, 179 bp, Zea mays
gcttcaagggaattgtctcttttttttactacaccccaccaaagggtttttgagttttgacaatcagaacaatagcctccaccgtccaccctcacgcaactgcctcttcgcggcggcgcaaaacaccaacacgtcttctctccggttgcgaggagggtataggatttcgccgcggcgag

SEQ ID NO: 5152 - DNA, 418 bp, Zea mays
tgcaggtggaaggggctacggtgctcacagcgctgcattaggagatgaggtgtcttcctccgtctccaggcctggactgggggcaactgtacatggtgcctggtggtgtaatgtaacataacggcaatggcatatgcagctgatcctggtctgcctgtatcatctcctcccacccgtaaagagaagttctttctgccgccatcgccatggtcagtcagagcttctctgctatagctgctggatgtgttgtgtgttgcgtctgtatcgtctctagtttgttcgacttacgtggaaacctgagatcagaccgggtatcgagcggctgcttgcatggatggaatgctgtaatcatctgtagtgacaactccattttccttgtcagactgtggcgcatggtccttctgtgcctcgtggatgg

SEQ ID NO: 5153 - DNA, 1500 bp, Zea mays
agtggaactttgtaaaggcctcgtagtgttaccctgcctcgcctcctcggtagaggtgtatgggattggccatctcttggcagatgggtaacatgacttgtgggtaaagatgcgcaacctctgcagagtgtaaaactggtatactagccgtgctcacggtcatgagcggctcggaccctcacatgattaatttatggaacttaaatttaatttgacatttgcatcgcatttgggattattttactattacttttctttattattattaaggtttggtatttacttacacttagtaattgctaataaaattttgaccaacttataaaagcaatgctcagcttcagcctttatttcattgatcagccttacacttcatgaactcccacctttggtgagttcatgccacattattccccacaacttgttgagcgatgaacgtatgtgagctcactcttgctgtctcacaccccccacaggagaagaacaggtggtcgaagaggagccgcctaacactgaggcattcgacttgatctaggtggcgtttctcagttgacattggcgccgacgatccttagttcgttttatggttattcctttattttgtaataagtcttccgctatgtaataaatactctgatgttttgtgacatttatctctatacactctgttattatatatgttgtcttcttggcgcatgtatgagatgcacccggctttgtcctttaaaaccgggtgtgacagaagtggtatcagaggaaatgttgactgtaggacgaaacctagatagaaatggacaaaacccttacctacttaccttactctgactcattctatacttatctcatcttgatcttgtctcaccttctactgttctactctgatcattcttatcgtttctactctgagacaagatggatttcacaccttggaatcctacatttatgacctttttaagagataggagacctaagacaaaaataaaactattttctctattttaaaaatgttgggtatccacttatttattgtttagtaaatagttagatattttgttgttagtgtttattaaaatagttagctagtttgttgcttagcatattgttagtgtttagtaaattcttagtgattatatagttagcattttgtttagcgcattgatattacatgttttctgtgttggcaaccatcgtgttgtcgtttattcgcaggttctataaacatcactttacaggggaggtgctgccaaattttttactgacaataagtttttttgtacgtaggtgttcgtccgacttgaccttctccaccgttagctggactcgtacgcgttctaaggtatacattgttttcgtacattatttatagattatgtaatttcgtttgatgtgtttatttaatatttactatatagttattagttaatatatatttattacttagtaagttagtaggcttaagtatatagccattattgagttagtaatccatttttgcaatag

SEQ ID NO: 5154 - DNA, 337 bp, Zea mays
cggcgccgaagcaaccgcggcggcgtcaccggcgggcgagcgcgatgagcaggcaagcacgtcagtacgcgtgcgggtctccgctattcctttcccttccctctgtccttcattctcattcggtcccgtccccgcgccgcgtggcgtggtggtggtggtggtctgattggggcgccatgcgcgcgcgtgcctattggttttcagcagctcgcgtgcgacgacgggttcgccggccgcgcctggacgtccggaggcgccgagcgtcgctgggaccgggagagacggtggcggagggcccgcggggggcgacgagcgtgcgctgctggtcgtgacgacg

SEQ ID NO: 5155 - DNA, 1500 bp, Zea mays
tcgttggtcaagatatagatgtttgacccaagacaaacctagtacaacatgtaataaaaaagtaataaatagggattcaccaacgaacaacaatgattgagactagaatatttatatatacatggctagttactagtttgggtaaaaattacatcaacttacctatagttagctagctaattgggtaacgactagttaaaaacttgtcttgaaaaactagaccaccacttaacccttttatttggatgcaatagatttaaacctggtctaatttttagcaagttagcaattagcacttgaatctaaacacacccttaatatatgaagcaaaatataagccattaaacttaaggagtctaatgatatatatccacactcaagtactccttctgtccttatttataatttgtttaacttttttatttcgagtttggcaggctcgtattattcattttttcgagaaaaatgaaaacctcaaagtgttgattatattatatgttaaatgatataataataatataatataatataataatagtaataataataacaatttgaaataagatgagtttgtcaaacttttgataaaaagtcaaacacattataaattgaaactgagggagtaaaaccagatacaatgtatctaaatgaaataataaatcgttccgattaaccgttttgcgcaaatgccattccatctgatgaatttatcttttgttagagcccggcccgtcggaaaggaacattgaacattcatgagtggtagtacagtactcagaacttgcattgctgaagcgtcgcatttgaaaaaactagtggctggcggattctgaacgaacagtgcatgtgtttgcatgcacaaattaacgacgatgggttgcgtcggatcagacagaggacgacgagctagagggagatattaatgtcgtcagagactcagaggcaatccagaaagattttactgctaataataacaaaggcgcatgtcatatatattactgttgcaaaacatttaatttggtagaagataagtattgatctactgaagcaatcatacattatattccatatcaagtcgtcgtgccagctagcatcaaatccacgagatatggaattatggaaaacaataaacacagacgccgcgaatactcccagcattaaccaccaaagatcgcatgcaagcacaagggacaacagcgtagttaattagctccggttggccgcttccgatccgcaagccttcaacgtactgaaaccagcggcgggccgggcgctggcaacgtcgcgcccgtccgtgtccaaacccatctcctcttctccgatgatccactctccgttgtccgttctataagtagctgtgtagcgcgtgctctccacaccaacaccgtcgtcgtcgtctgtcaccggccacaacgacactgataaactgatgacactgtgatcggtatcgacacacacgtccaaggaaacacagtattatattactctagcggcagagag

SEQ ID NO: 5156 - DNA, 1065 bp, Zea mays
ggtatatttgacagcttttttcctttttgttgttttgttcttacatgagaaatgttgtctattccaggcttccagccatttacctggtcagcattgcatagatttctagtttcatgcctctgccatacacttttttattgctcagtatttcgcagtaggtgaatatatggcatcctggtgttatatgtttgtctaggatagatttaaattttaactgaattgcataacacatttgatgtgttcatggcataaaaatatttattgttagcatgtgccagaaatatttctattgctcgcttttcacagtaactgaatatatgacatcctaagattaaatatttgtctaggatatatttaagtgaacttgaagtctataatatagtattgatagttgtataagatgtttggtgttacatgatataaaataattgagagaaagttaacagaaagccacagaaacatttagctgttactcaactgttgaattttgtttcactcatagttatgttgttatgcagtagcagttctatgtatcaccaatacaccagggagggtgccgcacccatatcggatacggtgatacatcccgatacgcatgtcgcgaagtattagggaaacgagataaaaaaactgaatggtttagctcacgatacggtgcaatacgctgtgccgatgcatgccagcccaatagtacctcattttacagcccaatgcaagcccaacatcattagcccatcaccatccattctcaagcctcacccaagaacaaacggtgcctcgtctccaactcccacctcttgcttcttggcgccaccatggacagggagtcagggagtgtcaccacctcacatggagcacatgccacccggatctagcgctgccaactactagtagcgcatgccgtaagaagctagtgccactgcctcgctgggaggcacgtcaccactgggtgtgctgatgtcctcaatcctcatgattgagtgctaccgcttggatctgaactctgggacttggaagatcatcttgcgcagctgctgaaggttctgagataggtgcactctagct

SEQ ID NO: 5157 - DNA, 1366 bp, Zea mays
aatatctagctagcatacactacactgaccccatccatcgctaaccttaaatgaaaactgaggtccaccctgctacctattgactgatcaatcgagcgtttatgagcctaaccaaccttaaccatcactgttgccctacagaagattctagttgatgatgacggcaatattgcatcacaccaccattagcctaattttgcgaaaagcaatagcagagttgacgaaagtgtagctgcaaccatgcataaaccttcccacaacacaacagagtagtagcttagctcatgacttggggggcaattccctgcgaaccttacattctcagtgtcatatctccccgtcccccacagaataataaggtccataccacctcggagaaaatctttgcgcagagaatctggcaccatttcactgaaaacgactccgcagcacatgccgtttagctcaggagactcgcaaattgacagctgcaaaagctgccgatttcattagcgcccactcgcgcgcgcacacacactcacattccggggggggggcatgtgctccatagacgtgccacatcggcgctaacctctctgcgcggacagaaacaagatagagagaccgggcaaagggctagagtccatggcctacgagtacaacggacagcagacctgcgtcacgcattcatgctttctggccggttttccaacgctgttctttcaatcagggccctgcggctccatgtagtacgcatacgcacaactcgtggcgtccttttcatgcgagcgacgttttgggtggccgccgctcccggcgctgcatgctattgttctgttggcgcagtggtcatggacatcgtgctgttaaaaacgaagaagggatgacttgtactgtcgttgtgcgacgatgcacaggagaagtcaggaatgctcagaaagaagttcaggtagtgtgatgattcatttcagatgcatcgctctctccttttttttgtgtgtgtgtgtatgcgtacggcgcagaggcacagtgctagctgtgtctttcgctaccttgtcgattagattgcgtccttgggcttggaatccctggacgacgacggctacctggcatccatgccccaattcatggtgtgcggaggtcgccacagacgctcggctcaagaaaaaaataccggctgcgcactagctagctgttctcttctgttcactccattcgcccatcacatgccacatgccatgccctcctagtagcagtagctctccaccacctacgtgaacttctctgttctactactatatatctttctctctctccctgcttctgctgcttgcttcaggcacttgagagttgagactcactcagtcactagcaagtgcctcgtcac

SEQ ID NO: 5158 - DNA, 741 bp, Zea mays
aaaagaatattacattttttacgagtgtgagatcagcaggactctttataggcttcatcgttactgttgtcttacacacatgacaaataaagacgaccctcaaactctttggacccatttaatcattttaaaggacaaatcattcagaataaaaaataatatgggatgaaaagttaagaatctaatctcatattacatttgcaatattttatattgttgactgtactatttataaaatggagtttaaatataaaaatgaggattagtaagctactgaatagtcttaccagaaacgttggaatgtttttttgatattctaaatcctcttgtttgtttcttagctggaagggatacaactttaaatctgaatctagattatagggcagaccactacggtataatatatttaaggtgatgctttataatttttttgaccaaatttaagacaccagtttaagatgcttttagtttagtaccctactaatattttctatactgttcttccgtaataatataatttacttcctaaaatatatactaaatttatttttaatatcctaaactctttaaacaatataacactcaccgctgcctataaaaatccggcccacggaccgggcgacgggccacctcgttccccatccgctcaggccaatcaacagaagtgacgcgagcacgagcacacatcccctcccttcttcggttattcctcgccgcgtgccctcgccgcagacctctgcc

SEQ ID NO: 5159 - DNA, 655 bp, Zea mays
cgacctgcagagacgccacgttgcaatgcatgcaaacctgacctgacgtggtgacgcccccctaataattcactgcctcatgtgggctgtgggccatcggccatgctgtcacttgtccagatacgtgtcatcagtacgtcattaatctgcctgccctaaacccgcgcccggtcgccggaaaccacgtctcgcccaatctaaaaccctttcccgggcggcaatgatacgcattatattatcctaaacgcaagaatcttgtaaattatctttttgattgaggggaattttatacattatgttagttatttcgacagggggatatcgaatcattgggcaagtacgtagtgtgtgattcatcggagtcggggcatcttgaatcctggattgtcagtcaaaatcaacctccctgcctgtgcctgcctccatctccatgccaaaacagcagcagagacagcgtggaatattcggatcccttggggaggctgggacccagtcccaccacctgaacaacacgaagctgcattaaaaggcgtccggcgggtggagaccagagcagcgcacaagcagcaacgccaacgccaacccaacccaaccctaacccgatctcaccgaggacacacagacaccagaccaccggagcggaccaagtacgagc

SEQ ID NO: 5160 - DNA, 1227 bp, Zea mays
acgaactaaactgttcctccagtcgctgaagccttgcctcaactgctaaaccagaacaacttacaaatccaacaggaattaacaggccaaccagcattgcttccaagtttatatcatacaaagatgtggctagtttcgccccctggcacagtattggacatgatacttatctaacactgtcatcctgcaagacagtagcaaagaggttctgaaaactgaagataagttgtcatgtagaaacacctgacagcaacagtgatgaactgaagctagctgaaaatatgtggtttctgaaaactgaagataagttgtcaagtctagagaaagtacttcaatacattacatcacaaacaagtctagagaaagtacttcaatacattacatcatctgaaaactgaagctagcctggaaactagtttaagacatgacatctgtccttattttctagacagcgttcatcttcttctttggagtcagttttttgacagcacgcctcactctcttctgtggggtagtaccaactgtttcttgtggggcagtctggagcgccggcgaggggcgccacggagctgtcgggagcgccggcgagggccgggagcacggagcagtcgcgagctcgtcgaggagagagcaggagcgcccagttcagtcgaggagacgagcagcgctcgggtagacggacagagagggagaggaagaaaggagcgagctcgcgatccgttttgccgaacgggaaatccttagtgcaacgtaaatgcagccggaacaagctaatcgatagcgcgactgttaaaagtgcccacgaagacaattttccaaccggaagcctattataatactaagattccaattgcaaggttggggataccaaacttccgaagcccgcagttcgggatacctctgctccaaataactcatcgcccgatgccgaatctccaatccatccgtcgtgtgctcgctctagccttttccttctccctcgcgacgcggcttcgcctccctattctggcacgttcccggttcaacggaccacgacgcattcccgtcccccaactcagcagcaataacacgccgagggcgcaaatccccgcgatccccacgccaatcggagaagcgagccgtcgccgatcgattcaccaccggacccaatcacaagtaaacctgcgccgggaaaccaaatccttctaaattccttcgcgacgcggaccgcaagccgaaggcgcgacg

SEQ ID NO: 5161 - DNA, 1079 bp, Zea mays
ctcggtacccctggacagtacctccgttggttcgagatagcttctccatggtatgttccctctcctgcttcgctgatgttctgtaagatattaggactttgatgtggttgttacttgttagtattaaatacacgtatgtttctatcttgtggcagattggttcggctcttgggggtatagcaggagcgttttatggtttcaaccatggtatgttctcttgtgcaacctgtgacaaattgagttgtttgagcactagtcgatgtgtgcctgccagacgattagattgtcttgtaactaaattagtatgggattcacttgctgcagctcattacgtctatgtgattgtgatttgtgagtgatgttactagttgacttagtaatacttgccatctatactagtagttgacttagggcctgtttgtttcggcttctggccaccaaaagttgctgcggactgccaaacgctcagcttttcagccagcttctataaaattcgttggggcaaaaaccatccaaaatccacataaacacataatcagttgagtcgttgtaatagtaggaatccgtcactttctagatcctgagtcctatgaacaactttatcttcgtccacacgtaatcgtaatgatactcagattctccccacagccagattctccccacagccagattttcagaaaagttggtcagaaaaaagctaaaccaaacaggcacttaaaatctcaatgcaacctctcctcccctggataaaagcaatcctcccgcagaagcagaacgattccggaaagtgtctcgaatcttccaaattctttcccgagacctaaaattctctcgacggattcgcctgatctgacacgcgatctctcggctcgccccaatggccgacaaggagaagttggagtctgaagaggagtacgagagcgacctcgacgacgcacccctctccgcgttgcggcgccgggacgctgcgagcgatgacgaggacgaggatgaggacggagggatgcccttgaggcggaggaaggctggatccgacgcagattccgacgggcagggcgccgccgaggtgtacgacgagg

SEQ ID NO: 5162 - DNA, 1500 bp, Zea mays
gcgagtgaaggggctcgcttgtgttagcccacgagcgtcgggaaacgcccaaaggtgtagcgttgagtgggctaggccgggaaggtcgctgacagtaggttatagatctactacctgtataagtacacttaattgtagcattattggcatccagtcgcgggacctattattcttcctttgaatagttatattaaaagatactggggaaggtcttggggatacatatcttgaaaaaatccagcattttgaaataagtattatacagtgctatggaccaaccacttggatgtacgcgtacaaagagacctctggaagatcgaaccatgactctctctgtttttcgtcgtatttcgttcatatatatgcgaactagatcatttcccacgaacgcacgtaatctcctttcgatttaaaaataaaaaaggacagagaaacctaataaagtgtcatcgtctaggctgtacaattcaatggcaagaagcaacagtgatgttcctatgcaggaagcctccattgttttggactattctcctaggttgatcatgtctccacgcatctgtcacgtgtacatgctagatagttaccggtgcatgttgctttctagtttctacttccatgccattaccatcaaataattttcctgttgacgctattcatgtaccccttcctggcctcctgtctctctatcctctacaggcttctagggagaggtctctttaccaatccatgacggaaccaacaagaacgataataatatcatactacaagttatcagcatcgcacacgagacacgacgacccatctgaaacacacaaacccttggacgtctaaaaaaatgcctcatcttggagcgcaaagggccaacggccaaagatagaaagggatcaaaaggtgacgtggcaagccagcacctgtgggctgcctgccagccttgctcgcatcatcaccggcaacaagaacaagaaaaatcttttctttaattatgggccaatatcttaggttgatcgcggtgcatgccccgtgagacattgggagttgactgacccacgccaagtcaccccgtcgccgaaacccacggccacaagagtgaggtgatgacgtttcgtcgtactggcagggtagcaagtagtatagtatagggataggaataggagtgtacgtagggtacatgcatccaatccaacgcagcaacatctccaagcaccggaaaatatcactagaaaacaagcccaaaacacggccgcgaaggcgcaaaccatttgcccacgcagacatggtatagcggtatggctacgggctacggcatggcagtccccagaagaaaagaactacgccgcgctctcttcactctcctccagtgagtctccacccacccaccgagcctatatatccctctgcatcctcccttccctcccagcctatcctacaacacctcccgcaacagaagcatacgccgtgcccagctatctatagctagcactagcagtggtgcacactgaa

SEQ ID NO: 5163 - DNA, 1222 bp, Zea mays
ttttgtagaggtcaagtgctactttcactagacacatctaaacataaaataattcaaaacacacggaatagacaatgagtgaaaccaccatttggattaaagcatctttgtttaaaatgcacaatgcagatgcatttaatgttcaattggaagacccttggtctttatcgaaccatacaacactagtgttcagcctcactatggatacggtatgaaaataataggagatgaaaataactttctaaccaatggaagtactatcaatttgagctaacaagtcaggcacaataaagtttctacaaaacctcagtgctttctggggtgccacgctctagatcaaggcgccaaaagtaaaaaatggcgtgattgaacttttcgggagtgggaaattagttgctacatgtagagaccaaattggctaggatagcaacttagtaaatttaccaagttgatttcaggagctattggagaggggattttataaaaactctctaaatttcttgtttagggaattctttaggtaattactggagttgctctaagcctctaaccatgtagcagataccaaatagatagaaacagcaggggaccattcaccgaaatttagagatctttgttatttccacctgtaaagttcccacagaaagctacgttttctgcaccttatcgcaccctgctagcttacggatctatttccgatatacagacgttgttggagatgcaactccattgccaagttgatgctgttttgccccttgttctaaaggacacattcatgacaaaatactgagtaaagcccggaactggatgctcaggtgctgcagcaactccagctccagccttgaaagtccatttatatggcgagccatccatttttaaaacaacgtgcaactcctcttgcttcttcacagccacaaaatgcttgaacattgacccacttccacaaaatttgccatcatatagtgaaatctcctcatcaaacccactggttaaggcactgattctcacatcggttggttgtttggcttccgcctctacctctataagagtctcaatgctgtgacccaggaaagcaaactccatgttcaagccaagataatcgccctgaaaccttcctctcagcattctttcaaatccagcccaagaagtgtcgatttcaacataaccactaaacaacagtttgtcagcagatgcttctccttcctcttttatccaaagctca

SEQ ID NO: 5164 - DNA, 542 bp, Zea mays
ccttaatggggtaaaaacccatcggatttcggatttcgggtacccattgccatctctaagcccgcgtcacacggatcgacccctggcggcctttccgcacaccagcccatccgttcgcgcgcacgcgaaggagccgaaccgatcgcgtcgtgcgagtgcgacacgtaaacgaaagaagaagaagaagatggggacgtgagcgtggtgtggtatggcccacaggctacacagacttggtttgcgtgtaactcacgcagcggcccatgaagcgctgtcgcacccgatccccgaacagccgcgcacgcgccgtacccgggaggcaggtgcccactggctgactggccactaacccgaggcgccagttcacgcgggccacaggacgcccgcgcagtgacgatccggacgcgaacctcgtatcaaattcgcatatgggcagccgtcctataagaggcgtcgagtccgccggcgcatgtcaaccccaccgcagcacagcgccggcaaccgccgccatcgatcgatcgcccggaaactgacctctaccg

SEQ ID NO: 5165 - DNA, 596 bp, Zea mays
ccaaaagcaaaggtggcttgctgcgtgtcacccccgtgttggcctggcagcacgacctcatcacggcacggcgtccttaagcttcccttccggccttcccccacctcccacccgcgatctccgcgaccgcaagcagctcggcaggcaggcctccaccgctccaccacctccactcggtctacgtgctccgtcaccaaacccacccgggccaacgccgaagcaaccccccctccgtcctccccagatccggcgccgcctccgccctcacttacactagcacgcacggcggacacgtcgcctcccccgcgcgatctgatgcaggcgcacgcggtggccaggtaaacaagcctcccacagtcccactcccgattaatttacttaaccgccgctattaatacaccgtcccgcccgcccgcccgccccctcctcggctcctccttcccacgtcgctcaccttcctcccctgggaccggcccagatctctcaccccccgagctgggtcctcattcccgaaccctccaatcccttccccatggtgcactggttctgcggccgaatcgcttaatcgcttattggtctctgtggaatcagcggcg

SEQ ID NO: 5166 - DNA, 813 bp, Zea mays
aattctcaacacaatttaaatcgacacaaatttatacaaacatcttgccttttcgatcgcaattccgatacccagccaaatctcaagtcgactatttttctaatagtgcacgaaagagtttccgagcgacgccaaaatcaaattcttggtctagttaatcatctggtctctcattcgcctgaacactggttcttcttcgttctgcgtgtcggtctcamccaacgagagagcgtcgcgaaatcgaccaacagatgatcactcctcttcaaccaattaatcatcaccgtctaattcgaccaatctatggaagcattttcctttaaataaagtttgcctaatctaaaaagcaatctattgcttctcttctaagcaaactaaccccttttttccttcacctacacagcacctgcctttttattctccccatgccaatattccatctccttgtctcctctttgttcttccgtgaagcagccgccctcctcaatttcctcacgccgcgctccctggctccctgcccagagcgctggtctgcgcccccctccctgcatcgcccccaccagttcgccctcatctggcatgccgtgccgccgccctggagctcgcccctgctctcaacccctctccccttcgtccctgcgtttgaccgcacctgtcggacccgcccccttgcccctgcgcgcttgccatgggtgatgtccactggcctccctggcaagctcttcctcacgccgctccaagccaccgcgaccccaagtgctcgccaccttctgcagttcgtccacctcccagcgttccctgctccttgtttct

SEQ ID NO: 5167 - DNA, 1240 bp, Zea mays
gttttaaaatagttattattcttatttctgaacttttactaagctaaatatataaaataaaatattaatgtttacaatatttaactagtatcattatatagagacgcatatgcatgcgtttctcggtctccgctactgcaatcatagtgctggctgctgagctagctagagtgacctgcaacgggtttttctagtctccggtaagagcggcaaacagtttagggcttgttcggttagctttcaatccatgtggattgagtaagattggatgggtttaaatcccaaacaagtcaaacttcttctcaatttttttcaatctcattcaatccatgtgtattgggaataaccgaacaagcccttagtctacgcaaaattttgcgatggattattggatcccaattcccaacatcgcccctggagcctggagctggacctgtaatgagtatgcctgcgcgcgtatctacttcttccactggacgcgcgtttaattgcatcgcagtttcagacatttaacttaggcgcgattattccctgcacatgcatgcctaatagatgcttctgtttcatctacttacattgtaagcaagcatgtctgtctttttcttcctgacgaaaaccctagcacgagtgtatgtcaagccggcggtacgtacggtggtggtcgaagccgaccgacatatataaaattaagctgggtaactgcagcctgattaacatccagtttagtaagggatcgcgtacaactgtcgactacctgccggctatctaagcaagcactgttgcaggacaacatgcaccacccgaccgagctcagtgagatgcagtaaataacgtctgtctgattcttcttcccgaaccaagatatcgtgcttaataattagccggccggcccttgaccaggctcatggcccttcaattctaaacattgcactcatcagctttctaattcccaccgtaccagagttagaggtagaagaatcacacaccagctcctacccggccggatatgtttcaccagataataataagctcctgcgcggggtccaccgcccctctggctagtatatgtatatgtaaccgcaagatgtggtggtgcaatcgagtgcagtaaagctagccatgctgtagtgggatatctcccccatattctgctgcgccaccattgctgcaaggggagggtagcagagcatcacacatggagatcaaggaggtagcagcagcggaggcgatgacgatgggc

SEQ ID NO: 5168 - DNA, 546 bp, Zea mays
aacgggacggacaaatcaacctgtgcagattctttcgttctttccgtccgccccgccacaaaaaggctctcccaatttgttcagccactgcagcattgtgcagctcgatacatttgaggttcagacagacagactgcagcagtccacaagtgccttgtacccttcatacagttttgccatttttttaggtcttttcttttacattttactttactcggtgtagtttgagcttcctacagatattgtaatgcaatagacacatcaaagtgagatatacagatacagcatggttcagaaacaagttcgtgtactttccgattcccgacccactgaaactcgccttttgtgcattcaccagtttgggcttgcttcattgctcatcagatctggtccatgaatgcccattcgaggcccatcacagcccaaacccccactggtcctaaacctctcgccgtcacgcagctttaagttccgatacccacaagcacttggcatcaaccctaaaccacccactatacccgcccgcccggctagggttttgccacc

SEQ ID NO: 5169 - DNA, 1500 bp, Zea mays
aaacgtcaaacgtacgtggaattaatgtgcgtgaagattaagagattgtttggttcatggacatgtatggaaggcggaaaggcccaaccaaaatttgatgttatgatgggccttggagttttgcatgcccataacttggtctatctgacaaaattttagcaagccaaaagtatattttagcgatattcagctatagcacatggaacaacgagggtcgagccgacgatttggtttggacgtgattggttgattgcatatgcttcaatcaggttgtatgttccctggttcctttgtacgacactctcagcttggctcccgtgacgtgcaaactttgggcatttctgtaaggtcaggttcgccggatgcgagaaattaccaagacaacgatattgtcagtgcatgtgagggtatattaattaatactaatgtgtttccaatattaagaaataataaaacatattgagagcaacaatgatgcatggtagttgcatataataaataattttaattatatttatatatttactaatctaggtaacatgttttgtttaagtaagccaacatcatctcaactcggtcagactagaggcaagtgaaggcaactagacaagacagtgttgcatgtgattagcttgccttctttgacggcctgcctgcctcctagatacggaccaggtcgacttagctaatacacaaaacaaatcgcattacattcacccgaaccaacaaacgctttgtccattgagatttcagaatcgcatcagatatggaagtgataaagtccaggactccacacatgcatgatctttacacttgcttgcacacatgccgcgagtctggaacaagaacaccccggatcgatccctaggctgaaaaggatcatatatatagcgtctcctttctggaaaaaggcgatgcaaaacggatcgatgagctctcaccacgtcacccgtgcgtgctgaggagctccgtcgtcctgtctgcgcgaactatggcaatgcatggcgaccgacctcttccgaaccagaacggcatgtctgcaggctcgatcgctgcaagcatgcatgcccgttggaagacgccggaacgaaaacgggtcgtcgagctcgaatcgatggaggaaagaggaaagcagcgcgccgagcctacctatggcagttagcaggggaggggccctctagcggcargggtggggggctttgcccaaaaccacgacaagcggaggttgcatccagaaaagtccacgccctttctctcctttctctctctctctctagcatcgacctgctgtcgagtcctcactggtcaattcagctgagcgatgagagagacggagtgacgggaggctgacacatggccgggtattgaggcgcggaattgaatctgattaaataatgcaaaaaggtggcgtgccaggacggaggacagaaagcaatcacgagacgggaggggttggcctttcgcctctagggttccgggtcgcccaccaccttaccggaa

SEQ ID NO: 5170 - DNA, 1500 bp, Zea mays
acggctcgcccccgtcttttcttctcgtgttctcccctccccgcgtgcgctccctttcgtggcacgactgggcgaccgccgctgtacgccagctgctcagatctcgtcgggccccttcgccggcgaccatcacctgttaggtatgtggcatggccacccctttttcctcttcctacctgctgtgcgaaaccgagcactcaaaccctaacttaaggtatctgtgaattcggatctgatctattttttaaatggctgcgcaagtgtaaacccatgccccttactgcgttagaccctgccacacggttatttgccgccggcggtggtctgtgtagccaccataaccatggtagaggccagatacttggtgggattttatgccgttgaactattgaattcgtgaaccctcgtagcaactaataggagattattgggcaccaaaatagtccggcacggttttgtgcctaatagatttgtcctgtgccaagagatggatccggatatttattcagatgttattttttggtcttttttcttcgattgtgaacaaataacatatataatttgctattatgttcttatttttagcattgagcctattaatctttataaaaagaaaacctcaaattcgttatatatctttttaaataattgatataaaattcggatacctatcggattcggatgtttttcaccttttctgttgtagggagaaaataatacacacaaaatatacaaaattttatttttatacttcataatattgttaataacattgccaaaaaatagctttaaattttatgtgtatctatgctaaaatattagatttatcatataagttggatgttttaggaacatccctcagtgccatgttgattatttggtggaatttgttttgtttccgcaatatcagggtagggtatttcttaaataagtttacccctgttataattatgtccctaggttgtggttctcggagtagttctgttataactctttgtgctaggttgtgatgctcgaaatagttttgtccttgtgcctgaattctagctatcatgtctaaaactcgtgatcaagcagaagttagtttcatgatatcaacttttaattcagcttcattacacagctcaaatttcatttacgggataaggttccacctccagattaagctctaaatttgttcatgcatgcttgtgtactggatgtaaaacgatcaaacaacccaagttggaagcatgccatttaaatgttcagagaaaatttctaggcgtagctaaaaactgattctgcctatttgttgcaaataattgctttattgagactcaaatttcatggttatgtgcagcttgcttagtattgcatattatccttcgtatcagctctattatgtcttttctgcacaattatatttatatttgggttattatttgaatttgggattgagagatggggggttattctccttttcttttctctttttgggactggattatctgaagggca

SEQ ID NO: 5171 - DNA, 64 bp, Zea mays
acgaactcatcacttgctagcttgtgcgtacgtacgcgctgcacgtgtgcgtgtgtatgactgt

SEQ ID NO: 5172 - DNA, 330 bp, Zea mays
ctttaatcatcaaaagctttcgccaaatcctcaagcaacggagggggaaggattacaaatcccgttccaagaaggtttcgctacaagtgtggtaagcccggtcactttatcgctaaatgtccattatcaagtgacagtgacagggataatgacaagaagggaaagaggagagaaaagaagaagtattacaagaagaggggcggcgatgctcatgtttgtcgggagtgggattccgacgaaagctctagcgactcctccaacgacgaggacgccgccaacatcgccgtcaccaagggactcttcttccccaacgtcggccacaagtgcctc

SEQ ID NO: 5173 - DNA, 823 bp, Zea mays
caggcctcagcatatatataccaaacagcgcaccaccagctcaacgggggaccagcctaaaaatatgcctcaaagaccaagacaaaaaagaagaagaggaaattaaatgcatataaatataaatctatagtctctcttttgaattcacatggcatactggggaccagtaagcagtcaaattaaaaccaaagcctctctctctctcttctctccatcttcctactagcttattgcatgtccacctttcatatacccacttgttagcttgctgccctcctcaaagctcagaccaaccagctcttctcctccttgatctctccaatcaagctctctctctctctctctctctctcaacacataccaaacttccactcctcctagatagctagctactagctagacagaaatcccccatgtaattggagagagaacttatgtgttctatgatagattagatatgatgcttctctagctcatcagatcaaattagtactcgaccgataccaagttaattaagaagaagttctctcagcaaaggtaaatttactataaattatccctgcatccagtccagatcagatctgctcagatataaacatcaaaatcttttcttttgttgctcgatcggtacctagtttgtttcgtttcttgtcttgtcgatcgatcgtgtcgtgctacaagatatatatataaagctcctccctgttggttgctacatacaagaggcgtcaagctggcgaaccggtggtggagcgtgcccggtcacttgggcctgccggagcagccgtccggcggccccaaccccaagacggagcccccggcc

SEQ ID NO: 5174 - DNA, 1500 bp, Zea mays
atgcgcgatggaccaaaccaacgtgaacaaaaagaaaagaaaagatggggataataggaaacaaacaaatatcatataaataagaaataatctgagaaagaatggaatgtgaaaatttaaaaggaatattacttttctttctttggtaaagatagggacactagcggatacaacatacataaaaagaaaaaaaaactcaaaaagaaaataaaaatatgtcagaagtgggatttgaacccacgccctcgttagaggaccagaacttgagtctggcgccttagaccactcggccatcctgacttttgatgttaatattttatttcatttatacttatggcaaaacttcaataggaacaaatagatgcaagttgataattggacagaggcatccaatactgtgagttttttatgcaatgctagaaaacattttccagattatagcacagcgctttgtcaattgcacgatgaaaattaaatcaccttattatgcctgaaaggctgcaaccgcagcaaatcagcaactgatggaagatcctaccgataacaaaaaaaaaataccatagctttaagaaacttattgaccaccgcgaaagaggaagcaagataaacttcctgagtaatccctctctactacaaattatctggcacggcgctcggcttttgagccagataacgtttggcacgctcgcgctgcggattgggtgtatctgggttgctccatgttggaccggttgtagtgggcttgatgagcaggccaaaatgggcttcattttgtaatgggctgacacatgatagcatgaaccatgtggttgtcgattgatgccgacgttgcagtcgctcgggcgggctggcatgggccgcatggctgttctttgcttcttcttgcacgcacgcatgcaaacatgccgacgtcttaccgaatccagttgaacaaattcagctagcagcggtcggtatcaagagtagtagctgtaacaataactagttcgaaattgcaggcttctgattactccgtggaatcaggagtagttgttgtgggtacaaactgggcatcttctactccaaacactagataatttgatatcgcgcactggaaaaagggtgcagcagagcagaatcacaaatactaaactatttgtccggtcccacccgtcagggaggcagacacggtgcacgtcctgattttccaactccgcgagtggccattccgctacccactcttttgggttggtgcaggacagcgatacctggacccgtcctaacacatcctcatggaccagtctctcgtacacccaccacgggtacctgcgtccattatcccacctgtcattgacaggagaccaccgtgggccgcgggctcatccaacaacgcggggttggtgaggtcagatctcacttctcagtataaactcatccgcaccacctccccctgtcccccgctcctgcctcgcctcaccaccattagagcgcgcgcgccaagctcgtggtgaggttttcgag

SEQ ID NO: 5175 - DNA, 1500 bp, Zea mays
tgttttggaagataggctctgataccatatgacaatatgaaagttgtggacaacacgatgcctatattggaggtcgctagcagtttatatattgaactaaacttatacacaaatcatatgcaacaaggttacaataataaaaaattctaaacttactaattgtctatgttatacataccaaaaaatttaaacttcacatacttatctgtgctatagatataatataaatctatactattcatggatataatttttttatacaatacaatgtaatctcttcatttgatgtatttggacattactacttcccaatacaatatcaatatagagttatatgattatcatatgttttttcctgtgtggtatctagaagatgatatctgacacaaattaaccatatgatcaaggtgtttctagattaaggctctatgtttatatagaagggtctaataacattgataattatacatcatggtgtttcttatttttatttagtttcaaagagtgttttttggtatactgatattatctggattttttcacagggtttctaaatatatacaatgatgcataatggattaaattaactgcggagactacgaagaactaattaatcaagagagtattgagatttagtaataattgctaaataggacttaatcttaaaggatgtctttttattttcttaaacttataagtgtatataaatgattcgtatcttaagggatatttaatgaggtaagtgaaaaaaaagcttaagagacgcggtgaagaaacatctttaagtttaaaatacggttccatccatacaacccacgtaaatgagctgtgttgaggggttctagtgaataagataaaatatttagatacattaaattgtatgaacgtgtttattaaatatatctagtgtttagagaatcgtaatatattatttaggttgtactaaataaattatatagagaattattcgtacgagatgatgtctggtaacgttcccgtcgtgctcgtcgcccaggtatatatataaatagagaccccttttaatttatgctagtttggagatcaagataagagacccgcactgctttaccatgagaagaagaatagtcacacatgcaggtaactgtcaccatctgataacacatctaacggctcagattatgccgttgtttcactataggcaaaggatcggaatcttgaaatcgcggctcttgttcctggatcgtacggcgcagaggcgcccttcgctgggaagcttccaacgattccacgggcccacatcaactccttccaatgaagaatggtgagccggtgggatccaccttagccgatggtacaggtgggcaaacagtgggcccagttgcctacgctcacgtcagcatctacccctcttttccgccgtatatatacctgtgcccccatcctgctgctccttgcatcgatccctaccgaataatattctgcagtagtttctcgagctcctgtagcaagaaagaaacc

SEQ ID NO: 5176 - DNA, 638 bp, Zea mays
cgagcataagtccattgactcaattcaattaatccgcataccacctcaaatgtgtgtatcatgcgacaataacaaatcaccatgctataacatgcatatataagtaatacatgcacattacctataccaaaattttaatcattttgaaatatcaatttcatcttaaataaaattttcatcacttgatctcacattacatcaacctcttatgaagacaaatagcttgtcattaatcaagatctgaattgttggcacaacgttcctctttgcttggcgacctctcttaatgataacttcccaaatttctacataatttgaaatttgattgaatatatttttttctcttgtgaagatatccaaattggagccagtccattgtttgttttttctctggattcactacacaagtaagcattcgacacaatctatcaagaaagatcgcagagatcaacttaaggcttgaagacatcattaacaataaggagaaatacaagattgaagctgcacccaatgattttccattggtgacatggaaaccttctayggacatctctactgtggcaaaaagtttgtaagttcccacaacactactctctaaagtgtcgttcgaggagttgagtgtaaatagaactttgtta

SEQ ID NO: 5177 - DNA, 247 bp, Zea mays
ccgtgacgccgcccctgcctgatggtcttcgtggcgacgcaagctgctgctgtgtgcctattagcttcgtgcaagctcgtcggaccggctggtactggagccctatcgccgccgtatcaacatacgtgcgcatgtattgtatgtttgtgattggtactgatcgagtacttacgtgtgatttgcatggcgcagcgcgttcgtgtggctgcttcttgcatgctgtcctactttgtctgccgccgaataa

SEQ ID NO: 5178 - DNA, 1500 bp, Zea mays; identical to SEQ ID NO: 5175

SEQ ID NO: 5179 - DNA, 637 bp, Zea mays
caaaattcttagtaatttttttaatcccttccaatccataagtcatcataagtcatggaaataaccgaatccttactttaatttgatattgctaaaagaaatctacccaccatcggcggccgtgtcggcgctcagtttcagttcatgtccccgtctctctatctcctctccgcgtaatctaatccggtggttgcttcggtaattaatgccaaatcccatgcctctcaatagtgcttaatctaatccggtggttgcttcggtaattaatgccaaatcccatgcctctcatctctcaagtctcaactaatcaccactaccactaggccagttgccgcgcagacccgacccggcacccgatccgatccgatccgatccgaaacaacgcagccacgccattttgcagtcacacccctcggagacgcaggaggactcccccgctttcggctttccttcgcagttcgcactcctcccgtgcccccccatccccagtcgggccagtccccacctcctccccgcttccaccccctcgcccgtcgcttcctcgtcacgagtcgtcgtctcctcctcgccgaccgggacgcggagacgatcgacgcaagcagaccctagccgacgagctcgcagggagccgggaggg

SEQ ID NO: 5180 - DNA, 839 bp, Zea mays
attatgtctccgttgcaacacacgagcattcacctctttcaaaatgaaatgcatagtaaaaactagccataaaaagtaaactagatcaggggcgaaaccagccgggagatgtgatcgtactagtcgatctatgggctgttagaagagacggttgggccaaaaaattgagaggtgaataagagttttctagggctaagcgcggggccaaggctgggtggccagaggctagtatacacccctgaactggataccatatgaaaaataagcatataagaaaggtaaaatctttgacgcggtttgaaaaatgagttttgaccaaccatttattatggaaaaaataccgggagcgtggtatcatcttatattgacatattatcaatatgaccaaaccaaagttcaaaaagtttctgataggtaagaactaatctgaactatatggaggagatcaaagcgacacatctttctttaatcagaagggagtagtacttatgcaaaggtcaactacagctacaagagcatttttcatgtcgatgtttttattctctcatgagaaaaataataatttgtgagcacggaacttacctaggctcgcgtagtgcacgagcttttgtttgagtgctccgcccacctccgcccgatttggccctacttttcagtggccgaggacaagtttggcaggattcacaagtgctcgtagcaaatctacaaaatccccaaccgcctctcaacaaagtctccccacggaggtacacagctacgcgcaaaccgcgtctcgcgcgaagaatccgcatttccccttccccgcaccgcaccgcacccaacccccgtcggagagagag

SEQ ID NO: 5181 - DNA, 145 bp, Zea mays
ggtatgtaatgcaagccccaaccaccataggccaaggaattcggatatatcgcgacaacaaaaaggggggtcctccagaggaaaaggcaagtcgtaccaggataaagatgactctgagaacattgatgaatttgatagtgatatc

SEQ ID NO: 5182 - DNA, 774 bp, Zea mays
ttgtttgttactattgcatctggtgaaagaagcttctcaaaattgaagttacttaataattatttaagatcagcaatgagtcaagaaaggttgaatggtttgacgcctttatgatcgagaagaagctattgaatgatatcgatatcaatagtataatcgatgattttgtatcaaaaaatgttagaagaaattttataagatgagaagtgacaagtaaatttttattatttcagccaatgttattttataaacaataatgtgtaatattctatattacagtaacttatatacagtttctttactgatatgtatttagtagatatgtagatgatatatacatatacctagttatatggggcctctatataaatttttgcttagggcccccgaaatgtcaggaccggccctgcacacaatacaggcatctctctcctcgcgaagtcgacgctcgacgatgaacatgccattcctcactccacttgtgcgcctccacgctataaaagcgcacccgatgaacgctagcatgcatccaccatcacacagcaatccacacaagcacttcgacgtcgcacgggcgctgcacacagacacaccaagcgtcggcaccaatggcttactaccaggaggtggactactgctcggaggaggtgaggtcggtggccccggccggcttcggccgccacggaggcggcgtccagcagcacgtcgtcaaggagaagttcgaggaggtcgacacggtctcacgcgccggcgccaaccaccaccaccaccacc

SEQ ID NO: 5183 - DNA, 399 bp, Zea mays
ggtgtggatgtacaggccattggtctcgcacttgtcgcacagaaaaacacctggtcgacctataccaaatagatcgagcggccaagtgtgccgcaggacatcttcacgaataatgtccattgttttttgatgtttgtttcaagcttatttagggccaaactttcaatatcgaattggctaccaaattataaatcatgatggactattggagctcttttttgaaatatttgaatgcttgtttaaatttacacgaatgtcatcattattgttgggggactttctgttccgaaagtcctaaaaacgtgattggccatatgtttttagtatatggattattacaggaggcttctctcatggcaaagacatacgatgtgaagatgtaaccctaaggtgataaga

SEQ ID NO: 5184 - DNA, 425 bp, Zea mays
tttgaattttccacatgtattttttcataaatatattactataaatttagatctaatgtattcatgagcaatctgttatataccaatagctaaaaattataatgaaactgtaaaaaaatagaaacagttttgaaactaaaaatttagctttgagcgaggtccccgtgtccgttcacctctccggctctccctcccagcctcgccctcccaccgtcccacgttgttcctcccgaccctcgccgtccctcccgccgcgacccgccctcctcctcccgaccacgccgcccagcccgtgtaccactccctcccagcctcgccctcccacgccgtccctcccgccgtgacccttcctcctcctcccgacctcgccgcctagcccgtgtcgccgccgtcgcccgtgccactctgctgctgcgaccacgaca

SEQ ID NO: 5185 - DNA, 190 bp, Zea mays
ggtggtcgtttttctttgttacagaagtgttcaaggcttttcaagttctcccctagaaaaaagggtgagcagtcatcagaacaaccatcagagaggaatatatcttttggtgcaagactcgaggaagcaacacatagcgatggagattatgtgccaactcctgtctatgagatagcccacgattctttca

SEQ ID NO: 5186 - DNA, 1027 bp, Zea mays
gctttcgcgcgcgccttgcatgtgcggtggctatggcataattgcatctcctcatgtatatccttgggcaattgggagttaccttgcaccaagactaataaacttttgtttgcggcatcaacagatattgtgattggtgatggctctaaaatatcattctgggacagtgtctgggttggtgggattagggccaaagatctggcgcctcgcatatttaccatatcaagaaataattggagcaaatccttggcagatgtggtaagaagcaatgcctggatcactgatcttgacttgctcagatagaacaattacttttcaccatattcttgagttctacactctttggtcccatgtccaaaagatccaacttcgaccagggtttgaagatgtcgttaactgaaaattcactacaaaccatcgcttcacagtaaaatcggcattaccaggcccaattcttcggataaacttgcacaaagtttgacatgttcatatggaaggtttggacgcctcctaagtgcaagtttttcagttggctagctattcaaaatcgaatttggatagttgatcgtttggcaaccagaaattggcccaatgcaccatcttgtgttctatgcaattgggccatgaagaatcggctccctctccctcttaatctttgacttgataaccgtagcaataagaaaaaagtactcgtccctgcatgcaggttagactttttgcaagtcgatcactcattccttctgaacgccgttactcaaaagttccttctctcccgccatcaccacaactgctcaccgaacccagccaacataattgcactcactccacgtccatgcacgccaccgctcagcctgaaacctctccctgtccctgccacccagggaacacacgcccctttttatctgcatgcgtccactctatatattgcgcgctccctagctcgccaatggggggagacgtcactaaacatcggagttcaagctaaccaggcgccaacatatactgcgttagaccttagacgacggcc

SEQ ID NO: 5187 - DNA, 1212 bp, Zea mays
ggtacagattaaaggcgagataacatggctgaaaatgtcaaaatcctgcaattccatctaaacgatctagaattctgtccgcaccgcaacatgcccagtcggcttacaattggttaccaggcaacatccatgatttgaatacgataaggaaagtggtaccttgccgcgttgagattaccgctttcgtttatcccatcgccgtcgatatatcttcttttcagaaatgcgactggatccatcacgcttccccgatcgacatggcttggctgggcaagcagcaagcttcgccctgcctttctgccgatttgccggattcgaaattagtaggccatttttgctaccaaaactgaactaagatttctgtagatgcaaatatcgccctgagtctcaaaacgatgtggagaagagtagcatcccttttctgccaaaactataatacaaacaracgagtattctgcaacggcaggcgcccgagggaggacggaagatccggacaaagcttcattcaggacggaatccatgcccataatctggttttgaaaatggcgaattggagagatcaagatccatgcacaggtcacgcaacttcgaattgaacacctacttttttttcctgggtcctcctcctcccggacaacagtgaaaataagaaaccaaactggtatctgcacacggtcattgatccctcaaaagtctgcacactgctttgcctgcaagtcttcaaagccccccaggccccagctcgacgctcgctaccctaccccgcaaggccgcaaccccgagcagagtcccaagcccaagaaaccaacccccgacgcgcgcgagacggcgagagagggagagataggtgtgcggcagtaatatagtgggtttgctctttgattggccgcggctaagcaccaaaccttggggaaatggagctgctcagtggtgcagtggcgcagcgggagcttggggaagcggaagcttgcgagcagccagagcactagccattacccagcgctaccatacactgacatatctatcgatctgatcgggctgctgctgagtgcagtgtgtgtacaaaaggccctgaaggcggtaagaccgagctgcacctgcactagaggtgaaggggtgtgagggagaagaaaagcgagtagcccgtgagctgctgcggtgcgagggagcccagggtttcgtctcgtctggccctcttctcttggcgcggcc

SEQ ID NO: 5188 - DNA, 496 bp, Zea mays
tgcctccctgtgcttatctggttggtgttaccgtcccagcagggcagcaacgaagcaaacggatttttccagccaaagttaaattaaaaacgggaaaaaaccacacgcctgcatctttctctctctcgtctctagacgtgcggtgcagcagctgtattcgccgcaacctcctcccatcccttgcgccagcggattccttggctgcgcggaattctcctagcctcccgagcctccccagctcgagaagggagctcacggtgacgcggcgcgaagggccgggtcagatcttggccgttggccccgaggcggcggtttcgcgtggggtccagcagagcccggcccgcgcgggagccgctctgattcgccgggggacgccgcggggaatgctctacctcaagctgccggcgggggatctagggttccgtccgggggcgccgaggcggggatccggcggcggcggggcctgagggtggcgcgggcgtcggaggcggccgcc

SEQ ID NO: 5189 - DNA, 1279 bp, Zea mays
gcgttgttttcacccgtctaccgtctcgtagagttgtagtgtagttagagatggcaatgggtgtcgaaaacccgaatacttatgtaggtggatatgagatgatttttatattggtggatatgttaatgaacaacaatccctgcccgttggataaacggtacgatacacgcaccgtatatccgtgagtaaaatatatctgtaccatacaactattattatctaataaaattaaaataaaaccctttttcgactatcgtttatttaactttcaagttatgtaatcatttggtttgttatatttcaggttaaacttatttttatgtatttatttgacatttgagtgttcggaatattataatttaagatcttcttagcgagtatgggttacccatggagcatggggtataagtatgagtagatttagtactaagagcgtatatagataatccgataataaatatatacctgttgccatctctaatctctaattgttgtagcccagactccactaaacccgctcgctgaactcgaggcggtttaagtagcagttgctacgtcaatgtttagaaaacgtaattgcagaaattaaataattaaacggaatatagctgcagcctgcagcctttccaaaacttctacagtttaatcaaaactagtcttggggcaactttttaggcaaagtggagaccacggcctagtaaaattgcagtaagctgctccgtagtttccctgtcatttagagatcacgcttcgctgtttagagtaagcttcttctttgtgttttgaagaaccatattatctgtttatcttgtagtaataacatttcacaaatccatttcccacccaccagactggtgctcttttcgttcttttgtatttgtttgtgaaaagcaaaagtgtggttttcgtgaaatagggtgaaatataaatctgtaacactttatacatactcctaaaaaaatgtttgctgttgagaaataggcaacaaaaatgttgtagactgcagtatttgacatttttcttttaaaaaaactttaggattagtttggaagcttaaaccggattcatgaagattgagatgaaatcaatgctcaagaatctcggatgggatttaagtttcggtatatttatttatagcacgtgaagtccggaacagtcggcatgtgaaaatcctcttcgtctgcagtctgctcgctcgcgattgcgattcccactcagccctccaggctcgaaacctaacccacccgcccggggatcccaagcggcggcggcggcggcc

SEQ ID NO: 5190 - DNA, 544 bp, Zea mays
ataaacaaggaagttagattcggggatgcccctttcggggggctttccgatttagctagtaccatcttttttgccgcgcaaatccagattgagattgaggaaagggagtaaattaagttttcgaatcactgactcaggcccattgtcgaatcctactcagcaattgtcgaatcctaccagccaaaaaagggggtacttatgtatggcagaacgggccaacctggtctttcataataaagagatagacggaactgctatgaaacggcttattagcatattaatagatcattttggaatgggatatacatcccatatactagatcaaataaagactctgggcttccatcaagccactactacatcgatttctttaggaatcgaggatcttttaacaataccctctaaaggatgcttagtccaagacgcggaacaacagacttttcttttggagaaacactattattatggagctatacacgcggtagaaaaattacgccaatccgttgagatatggtatgctacaagtgaatatttgaaataagaa

SEQ ID NO: 5191 - DNA, 247 bp, Zea mays
cccatgttgttagatgatgtcacgttgttgatgtaaggactcctcgtccatcggttccacacagttcgctgcgattttaattcacccgcttttgctttttctgcagtcaaaacggctttaatccagcatcctaacagcctcaggattgttgaaaaaaaactaggtcttccactcttcctccactagtctactcggcagatttcactgactctcaccggcggtctttgtgcctccaccggccgccgcc

SEQ ID NO: 5192 - DNA, 406 bp, Zea mays
agtcaaccatagcttcttcttttcatgaagctttgtttcatatgatatggcgtgatgtttacaaattcatgtaagccttatttatgaaatatggattgttgacagagattgacaacctgattgtgtactggggtatataattcttaaatggcatgctgtagtgatttaagaattacaactgaagtcattctttagttgtcttgtttctaggataaattcttgttgaagtgctagtaccttgttttcttgtatgttgctctaatttatcttataaaaatattattgcacagaattcgccgagggcatcaagtttacacacaagtttgtgcttcttgtcactccatgtccttgatttccatacgtgatttgggttggggtggcctatactgargaggaaacaaaggca

SEQ ID NO: 5193 - DNA, 564 bp, Zea mays
ctgcagggatgcaaatcctagataccaggaccagaacttcttaacgaccgccggtaaaatttactccggttattctcgtctaaaaagaattaagtaggattttaacttgtttatgatttaatctcactcaatctgctctaatctacatgggttgggtataaaacgaacatgccctaaataaattagaaacactacatacatatacatctccatgtattaaaggcatgcgcttgctactgctacctgcgaaatattatcaagaatggcaagtaaactcccctgcttggtgctcacagcaaattcgtctcacgcatattcgtcatccagctccgtttaaaatgcgtgctcattatccctcaagcatgcatatactatatatgatgcagatcatatatgacctttatacaattatcaccacctcgattcctcgcggcacatctttgcaccgcagaacgaccgtgcagtattttatacaaacatctactctcgatctacccatgagctaactcccaatatataagcgagccgaacttttctcctatctgagcactgctgctgctgaaa

SEQ ID NO: 5194 - DNA, 609 bp, Zea mays
ggttggccatccataatttgagtattctttgtacagttacattagtctttaaactacttttctcatcctcactaattatattgtcggcaatatattgtcgacaagaatggttctggatatattgaatgttcaatggtactcctattggataatcctatcagcacgacaagtgcttccatagcttatgatgttgaattttgctgctccatggcagcagcagcagcccctgccagttgaccattctgacgccttctcctagcattatgctttcttgtagcttcatttggaaaaggcagattgctcaaggaatttcatgcttagttgcaccacacyagggtatcatcaatcattcagccccattctacwgatgtaaattgtgcaaatcctttttctttgagacttttgagagtggtctgtcgattacttgcaagaaatrtgaacctttgtttctgtgcrtgggcataaaacaaacagcttctagcctcttttacggtacttgcacttgcaagaaatgtgaactccttttcatttctgtatgtggacataatgccaaagcatccaggmtttttcatggttgttgatgtctttacacagttcatctccaccagt

SEQ ID NO: 5195 - DNA, 464 bp, Zea mays
tgtaagtatactttcccttaccatctttatctgttagtttaatttgtaattgggaagtattagtggaaagaggatgagatgctatcatctatgtactctgcaaatgcatctgacgttatatgggctgcttcatataatttgaattgctccattcttgccgacaatatattgcaaggtatatgcctagttccatcaaaagttctgttttttcattctaaaagcattttagtggcacgcattttttgtccatgagggaaaggaaatctgttttggttactttgcttgaggtgcattcttcatatgtccagttttatggaagtaataaacttcagtttggtcataagatgtcatattaaagggcaaacatatattcaatgttcaattcatcgtaaatgttccctttttgtaaaagattgcatactcatttatttgagttgcaggtgtatctagtagttggaggagat

SEQ ID NO: 5196 - DNA, 672 bp, Zea mays
caccagctttgctccagagtcctgactcctcctagccttctcctccctctctcccctaccaccacacaacgggataaaccccagcacgaggccggagctgctgctggaaccgtcaggccgtgaagagcctgcggttcgatctgctgcaagagctcctcgtcgatctcttctctgcgaggtttcggtctgaggtactggctgtggattctttgatccgagacccatcccctatctctctctctctctcctatgggcgcggctttcgcccgattatcgggaggtattgtatttgggacggattgacccgcttatctgagaggatcttcactccagtttcgagtttgatctgccactatttggagaaagccacggctgttcttctgcttgatctctgggtggttggtgtagcagtgcttctagcgtgttctctgaattggttgaatcaccagcacaagatttgttgcgtttccccccctccgctctatttctgcgattttgcacgaaaatgatcctgtcatggacatttttggttgtcatttaatttgcctggcattcgaattggcaacatgatcttccacaaaagcgaagaaactgcgcgcccagtatttgcccatcttgaccttggtgatctcgattgagccttaccagttaccacattgctggagtggaggt

SEQ ID NO: 5197 - DNA, 112 bp, Zea mays
gagacgtggcaaaactcaaaacacgaacctgataaatcaatttcagtctcgtaggatgtaggatgaatttgaaaagacaacatacacctatgagacttcaactagagcatga

SEQ ID NO: 5198 - DNA, 342 bp, Zea mays
gacaccgccgaggcgcggccccacctgggcggctccgtgggccccgctggggggtggtggtgggtagggctgcgtcctgcgtggtggcccacctggccctgcgggtataaagcggcacggcgctatataggtccgccccatctcctcccgttccactcgacgcccaccaccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgcc

SEQ ID NO: 5199 - DNA, 269 bp, Zea mays
cgccgaacttggcgctctgtcacttgcttcctcctccctcgtctcgacccggctcgcccctgttatccgtctcgtctcccaccgctgcgcgcgcgagatagactctgtcgcatctcgatcaccaaccgggccattccattcgtgtgggtttgctcattttggctgggatttcacgcgggaccgatcaccgcacgccggtgtgcgcgtgcgtctggcgcacggccggcgtcctcctcccaacgcgccggaaataggcaggcggtgcatgc

SEQ ID NO: 5200 - DNA, 1143 bp, Zea mays
ggtgaaggaataaaacgcctaagaggatgtgaattagggcctcgaaactttcactaatctagaccacaaatgaatctctaaaactaaacctatgcaaataggcaaactagaatgtgaaaactaggttttatctaagtgttgatacctctaccgcaaaaggagtttcacaacctaaattccaatcccaacaaaatctaactatgaacagagagaaatgagcttaaatgagatacttatttaacgtggtcatattttttaattttccagttattagtatatactccttccatcccaaaatatagttctttcgaatgataatgaatatacacatatatgtaaactacgttcatatgatacttaatgaatgtatgattagtctaaaacgaattatagtttgggacgaagggaatatataattagaaggctcaattcatcttataatttgttcgaaatatgctcatatattatgtgactctagattgcgagttccataggtcataggaccactttcatcatgtttgagaatcatttatgtgctaaagtggtgtttgatttgatttctaatgactaaactaatttttagtctctttactttattatattctagttattaaattgataattacgtaaactaaaataaagttttagttttcgtatttaacaattcatagagtaaaataaataaaatagatggatcaaaaaaaagttctagaaattaaacaccctaaatcctaccatagcttcacccttcacggtgacactctggagccgcttcacacgcattccgctcaggtagctaccacactatgcaaaaaaatagtgtaaagcaagcactcaaaaccacactccataatttagaaaattgaagctaaccactatatttaaatattccaatacctataatgacgaagagaggaacatcgtagccgttgatcgcaacgaatattggtagcggctcccccagctctggaccttctcaaacccttccccgtgggccgtggccgccgtctgcctgtctccttccactcgccactccgatttccctcggtcagacgccgaagccgaaccctgactccaattctctcgtgcgagtgacatctaggtttccagacgccttcggtgagtacagggaaggaagtcgcc

SEQ ID NO: 5201 - DNA, 143 bp, Zea mays
gcttgcagaagcattaccttcacatgtaacagaagcaagctccaaaacagaatccggcgaaaacccaacatgtagcatgacattgccattggcattgtccataagttcagaagttgacagtttagcacactctctgtggacgt

SEQ ID NO: 5202 - DNA, 1500 bp, Zea mays
gctcggtctcctattcagagcctrcatcggattggtatgcatcaccgattcactctaaagaccttgttttcattatttttctacttgcgctgccttaatatgaaatgcatcattggctaatttattaatagtagctgctatgcttattagccaggacatcatggcgtgcatatggctggaccaaatcacctagctgacaaaaggtcgaacaagtactccatcattttcaataacatgtattttcgctatactgtttcagttatatatctgttgcctgaaatttttgtagtgacaataatttagacagaacaaattatccaagaacattaatactgcaaacaactctgctattagtggagaaattctacacgctgataaagtgttagatgaaatgtcataatggtgcagagagaaagaatctcttgtggtttttattgatagcgaggatgagatcaccttttcattacatctcaatgaaggttcagcgaataaatctgctcattctgatgccataaatacggttagctgaagctatttcaagtgggaagattttttacagaaataatacggataatgtgtgtcagtgaagaagccataaaaacaagcggaaggttatcaatttgacacctttgtttaattacatcctattatgtatttcaaagctgaagttggtatactcatagttgttcttatcattattggttacttgtgcaaattttttaccaaccggtttatatgctacatttatcttctaccctccttttattcaacaattaccttgcagctctgcagccaaggattaatttgtgacatagaattgggactgctctatggaaacaaagtcacccttgtctgaattttcctcaactccatctagaggtaacgattcttcttgtgcaaccccttgcacttcagccatgttgttttctgaaggagagacttctaatgcagcaagctgaaattctctgatatccaaagcatagcccccatctgattttacttttcatcgtgtatgcttcttttgacttcatctcttttgggtttctctagagactcttatgatgcaacaagctgatgttctccaatagcctggacactgtccccagctgatgttaattcacccttaaaagaagttaggggaacctgacttttagccgaaccttcatgctgcatgacattttgcacttcaactgcactgcaatyaggaggagacgcttctagaacagtaggttgaagttgtctgccatcaagaacatgatttcatctgctttttaatgccactgatgagaaggagttgctgaatgcaattttcaagyctgctgttgagtatcctcacgcggacaatttagctagcgaggagacaaggcagtgattgagtaccaggatgaggtgagatggggaaattggttagtggatgattagttgagtacttcaaacttgactgtgcataagtatgggatcttcattttcatttctgttgtgggctgtgcagtctattca

SEQ ID NO: 5203 - DNA, 911 bp, Zea mays
ggccgtactttaaatatcgcttggtctcgcgtgcatttcctctcttttttttcgctacccgcatgcgacagaaaaggaagtgttgggtgacagtgyaatctactaccaaggatgaatatatggctgtaaatgtgttctgaagatgcgtgtggcagttcagttacaacgatcatctatctatctcgttacacagtttatgatttatttaaacctgggaatttatgtatgttttttttctccttccaactgtcctgatacgtggtatgattttcctgtcacctcaacggctacttgattaaacattccggctggcagtgatagatgtccccaggcgatatgacaccggacgccctgcacttgcacagagaaggcagggcagcccactaagcaagcaaggcatgtgtgccatgtccaaccaccactccagctaccttcccatcaaagtcacccaaaaacaaaccttccgttcctcgtccccatccatccaccaaggccatggcgcgccatgctctccctgcacagcccatccatacgccggccaatggccatggccagccgcaaacaaatcaaacggtgttgaatggactgcacgtagagactagagagagatttattatttattttttttaaaagaaaagaagtataaagggcctaccccagaataaacaaacacagcaatcaagcaagcaaacagaggcataattagcaccaccgtgtagcaagttgcaatccatgtgcccctgctatataacaatccaacccctctcctcagcattgtcgtgcgtagcatagcagcagcccttgcctgcctttcgccttaccctctctctctctctctttcacacaaccactcacactgccggttggtttcccttccgttgtggttggtgcgtacttagtggcggccggcc

SEQ ID NO: 5204 - DNA, 127 bp, Zea mays
cctaaagagaagagaaaaggttttaacacgttggtaatccttgtggcttggtggctgtggaaacatcgaaacacttgtgtcttcgagggagcttccccgagcactagagatatcctgcagcacatcc

SEQ ID NO: 5205 - DNA, 232 bp, Zea mays
cgtggtatcaacagatgcttggaaagttttctgtcgccaaatgggaaacaagatattgtaggcctggagccgygaaacaacgacaccgcaagaccgtacarcagcttyaggtgagcagccatctatgagcagccctcctgccaycgaggcctgtgctggcaacgacggaagccatttggcgggatctcagccagatgctacgccatatgcttctaccagcacaacatagtgg

SEQ ID NO: 5206 - DNA, 469 bp, Zea mays
cgaaccagaattcataccctgaaatatagcacatattaaaccgaatccggtttaggttcggattcatgtttcggttttaaaatgcgcacccgtggccagcaggcagccaagccaacgctggagttggcggatcgcacggtgatccgacgccgactggtgggacccgaccggcttgtttggcagcgacagcacggtccaagtccacgtcggatccatccgccaactgccaaacggtcccacaggctcccacggcccgcatgccagatagccagctcaacgtggcctcgtcgctgcattcaactcaatacagaaaccctggtctgaaagccctcactccaaatctcgcgcactgtcagctgacgccaccgcctgcgccagccctcgccaagccggtgaaaacctcgtgccctccgccgcctccgcccgcctcttccagagtaccgcggtctcatctcctcccgggacgggc

SEQ ID NO: 5207 - DNA, 1310 bp, Zea mays
gtaagttagaattttgtgaaaatttgcacatttagtaaagttattatttgttgattttttttaaaaaaaacttgagtcggtgagggtaaaatagcccttggcatcatatatatagagatgaccttctcgtagtattgtacataaaaaatttgttacggtacaccctatataaaaaaatctaggtccgtcacttccggagaggggtatgagcgacaggggagggtatataaaattaatatgaatgaccaaatatttccatcatcttacaagagatgtcttgtcataacaccgggctatattaatctttatatatagtgtactgcaaacacaccatcttcagaagtcctgtgtccatcgatggccatcagtctgtcaggtttcagttgttatttggagctgtggttaatacatttcaacgctaattaattagatatctccgcgcagctgcgaaacactagctagctagctgggtttgtaagatgttgcccagttctcatccttcggttctcttcgatctgtgtgcgcgcgcttagaaacagtcatgcatgccacttagaatttctgtgatcaattaatcatatatatagtacgtacatatataatttctgtgatactctatgaatgccgccagtgggcagtggctgcttctcccgctcacgccagccgtgcccatgacattgcatggttccacctgtcgtcgaccgacgacaccgactgcacacgtacgggcatcgtcgtcgtactcgtgaagactcggaagatgacagatcgagcaggtatgtgctagacagagagagagacagagagagagtacacgcacgcgtggcgtctggagggggagcgagggccggcatcgatggagcaccgtcaccggacgtacgtacggagaggacagcgctgcaagcctactcacccatggcgacaaggatgcttcacgcgccacgctgctcatcatcactgctactaaaactgtagtgtggtggtgccactggcactggcagtgtggaaagacctgatggatcacctagataggtggcgtggcgtccaatgggatctcaacacagcgatcgagttgatggatcatcaggtgaattcgactagattttaattactcgcgtgtggtggaaattaattaaaagtgtattatatattgtaagcatctgcttacttatatattatatataagagcttattgatcgacatatatattctttataagcacaccaaacccccatacgtgaaacgaatcaaacacctacacatatcaccaccaacacacacacaggcaaaacacatcaagctcaacacac

SEQ ID NO: 5208 - DNA, 807 bp, Zea mays
atctgaactcgcatgcccacatggatgtctcctccattccactgacgagtagttgagcagcaacgaacctaagtgtgctgagctgtgctgtgctgtgcttggacatgtagagaaagagaatcaccacactcagtgatacagattcgtcatttcagtaatataatttacagtatcaaccttcaatgctctcaataaaaatgggggcaagcatgtgcatctgcatgttcgtttatgcgtgtgtccgattctgacctcgcggtgtgaatgtgatgctgcctgtagttttttttttaagagatgctgcatgtagtagtagagacaacggaatggcgttggcacttggcaatgacatggacccatcaactaattgttataggaacaattagatctataccattaaaagatccaatctttagatatataccatggaccccacatgtcattgactcatgtggacccacatgtaagtgagatagtaatggtatggatccaaagtggtgatcttttaatggtatggatccaaatttcccttaaaacaaacaacacagtttcccgaatcattgttttgggccttggtgggctctctactttctgccttccggcggtttcctttcatcctcgtgttgacctagccaatttcttcgaccgaacgaaaacacagccgtcgtcgccgtcccgcccgcccacggccgccgccgccgccagctgccgtttcccaaaagcgagcgaacggcaaaccaaataaaaactcctcgaactaccggcttctactaaaaccctcgacgtcggcagcgcggcgtcggcgag

SEQ ID NO: 5209 - DNA, 455 bp, Zea mays
ggataagaacaaagtatgccatcatcattacgacggaaaagcgagacgaaacacggcagtttgccgtgtgcgtgcatgatagcaaaagacgcacgcgctcattttgcagcttagtggcttctggtggctccacgtcacgaaaatacgtgtgaatcgaccatgacgtaggcagacacagtgcgcgtgttatcacaacattagagacagagagcactagagcagcttgcttcttcctccactccgtccgtcaccgtcagcatcggcatcggcatcaagccaccaagcgcgtcaactcgtcgattacgcgtcgtcgtctcgcgctgctgctgtcgctggattttgttgttattatattcccacttccgctgccattccgttccagactgcctcctccactccagtgtggccgttcgttcccctctgttccgcgccggcgcgccgcccaactctgagcg

SEQ ID NO: 5210 - DNA, 1500 bp, Zea mays
gtggtgcaagcgtggtccaaaatgttaaaatagaagaaagcgatccatgcatatctattgaaataattatattggtttcactccaagcaacctatgcacttacattatgcaaactagttcaattctgcacttatatatttgctttggtttgtgttggcatcaatcaccaaaaagggggagattgaaagggaaatagagtcaaaccttttcctaaaatgattttggtggttgaattgcccaacacaaacaattggactaactagtttgctctagattatatgctctacaggtgtcataggttcaacacaaaccaataaaagaacaagttagggttcaaaaagaaaggagcaaaagggaccgaagacagccctggtctggcgcaccggactgtccggtgtgccaccggacagtgttcggtgcaccacaggacagtgtccagtgcaccagggagatcaactccaaactcctcagcttcgggtttctggaaatgccactccgctataattcaccagactgtccggtgtagcaccggactgtccggtgtgcctagcggagcaacggctactgcgccaatggtcgtctgcaaaaacaacagtgaacaatgaaccatgcatgtttgcgcgcgtagagtcagagcagcgccagaaagcgcaccggacagtgaacagtgcctgtccagtgcggcaccggactgcccggtgccccatgaagtcagagctccaacggtcgaaaccgtcagaaccctaacggttgggtgacgtggctagcgcaccggacagtgtccggtggcgcaccggacagtgtccggtggcgcaccggactgttcggtgcgcccatcgacagacagcctccccaacggccattttggtgggtggggctataaatacccccaaccaccacacttcaaggcatccaagtttttcagacatcccactcaatacaagagctagtgcattcaatacaagacacaattagattgaatcaaagcctctctaagtcccaattccactcaaagcaattagtgactagaagagagagttttgctcgtgttctttgagctcttgcgcttggatcgcttttcttcttcctctttcttgaattcaagacacttgtaatcaaagcaagagacaccaagttgtggtggtccttgtaggggtctaagtgacccatttgattaaggagaaaagctcactcggtctaggtgactgtttgagagagggaaagggttgaaagagacccggtctttgtgaccacctcaactaggagtaggtttgcaagaaccgaacctcggtaaaacaaatcaccgtgtcatccgcttcattttcttttgatttgttttcaccctctttttcggactcgattttatttctaacgctaaccctggcttgtagtgtgtgcttaagtttataattttcagattccgcctattcgcccccctctaggcgactttcaatttgtatcagagcctggtacttcattagagcctaaccgctcgaagtg

SEQ ID NO: 5211 - DNA, 368 bp, Zea mays
accaaggcctacaacaagcatattggacccctgattctagcaacgaaagacaaggttcatcttcacccctgcttccctatgtcaattatctggttggtgaggtaacacagcaaccaacgaggtgagtgtacgaatgggaggaccctgagtactaccaaatgttggtggagtcgtggagtacgacttctgcgtggaccagtcagacttgggtagagtacaaggcccagttgatgcgtgaccaaggtattatgttgctatcaacggaggagtacaatatggcacaggcacaatatcagtggaatgccccgtgggaatgatcttcgacggaggatcaactgtgaactataaaacatgtatctgtatcttcg

SEQ ID NO: 5212 - DNA, 262 bp, Zea mays
tatgcaatgcgttgtggaaatatgcaactacgtgttgcaatgtggcatttcctgatccacacatgagtttcatgatcactttcaggttagttccattgagatcgagaggatctgcaacagagtacatgacgccatccttgaaacagcagctatcggggttccacctgtagggggtggccccgaacaactaaccatagccgtcgtgttgaaggaccagagctctcaaatagaggacttgaaccagctgaaactagcatgcaac

SEQ ID NO: 5213 - DNA, 292 bp, Zea mays
gagaatgctagagatgaaaaagatatagagatgtaatttttttgaaagtgctgtaaagaacagtaaatatatattttttagaagatgaaatttatgagacgtcgcatgaaacagcctcaaatcatagcacaggacacgcagagaagcatgagccgtacacgactgactgccacctgctgtcgctggctctgagctcattacacaaagcccaacaaactaacaaacacatgcacggtatctcatcagagtcgactgattgaacagaacagagcaagcgaattcatttgatctg

SEQ ID NO: 5214 - DNA, 115 bp, Zea mays
tcttgcatgcctgcagccattctcccctggttcccgcatcccactcgcagcacgagcgctcaccgtctctgtctcctcctcccacaaaaagcagctgaattgctccgtcggcgtc

SEQ ID NO: 5215 - DNA, 335 bp, Zea mays
ggtcaggccggaaatgatgcttttgtaacaaaaggtttctctttctggaacaagaaagatagattagatgttcaagcaagcaagttaaaatggttttcataatgctactgtgaaaaggtgtaacaatttgctaaagcgagaccaatcaattattgttggccttaataagcagagagatgttgcaaaagaggattattttattcgactaagtacctccataaatgcaactaggttcctactccatcaaggattagcattttggggccatgatgaatcagaaacatctattaatcgggggaattttctagagttgataaagcttttggcggagcaaa

SEQ ID NO: 5216 - DNA, 218 bp, Zea mays
acggaatggaacgcaacatgggagggagaagcgtcaaatcacgatcagtggttgtcgtcgtggcccaccaccactactaattacttctcctgattgtggttggggcccatcgcgagcacccacccacctttgcttgcacggcccgcccattcaccggttgaggggagaagggagaggagaggtagctcagtcctcctctgaccgccgacccatccgcc

SEQ ID NO: 5217 - DNA, 1500 bp, Zea mays
catctgtcattctgtctccttgtattgtcaatgttttgctccttggatggttttcaaggtggtttagtctgatgtgggaccatcttagacgctcaacgtggcgtggcgtggcgccatatcaaccaccacgaggaaggtaaaatggactacgttgagcacagttcacgggtcaaatcgttttaccaaaaaaagttacaaaaaataatctaaaaatttatccaaacatttttatgaaaagcggagttaaaaaaaatcagaatatgtttcgtggaaaattcataggaagttatcttacctcgggggaaaaaatgaaaccagttttagtcccatatttggatcttatattgtctctggttgatgtccagtctgttcgtttggttttaattcatactgatttctactacttatacaatacttttttctctataaatcgtagatgcaacagtccaaactaccatctctaatacgtagagaacagcgccgcctcgcatatgttcttgctatctcttataattagcctacgttgatgactcatgctacttagaaatttgagtgacttagacgacagtayaactgttatgcaactaccataaactccatcctattttgtataaacacacgtgcacatgttaagcatgggccgctaggtacgcttgatttgatcttgcgcacgcatgcaggcaagagccttttttttagcctgcactgagtcaatgcatgcgaaggatctggctgagcgcgtcacgcaaccaaacacgcagatagtaataatttgatctagaagatggttatggatgcagcctttataaaaaaatgaacaatctaactagtaagctacgagctacgtgattgacggttgacgctgacttgtataggtcatactagctaaatgtataccaccaccacattgcaaagaaacatcatttgactatacatgatgtttttttttgcttgttgttcagaaagaaacaagcatatgaactatgtttagtgaaatttagattattagcacaaaattgccacataaaaaaggtttatacctggaggtaataaagaaaggacttgccgtatgtgctggtttgggatgctggcgagagatcccagcagcctatattttttatttatctattctgtctactttatatatttgttattatttattaatacgttttccggcttttctgtcccagtttcagtttttaacaaatgggctggtaattccggaggcccatgtacaattggcccatgggtggcgcgtatagcccactaccacacaagtccacagcccgtcgttctggagtctggacccacatggcatggacacacgccgcctccgtccaatgatccaattcaatccaactacctaccttcactgcactgcacgagtctcgcactgcacctacccggctacccctgcggccttgccggggagtcggggacggggaaggaaacggcaacgagcctgcagctccagctaccccgaaaccccgtccaacgtcc

SEQ ID NO: 5218 - DNA, 532 bp, Zea mays
attttatctaaccatgtctaccacacgtctaactctgtctccgtcttacactgtctcgtgcaaccgtctcgctcgactagaacgcgatctacaacaaatttagtgaccatctcccacgccctgtggcccagccacgtcgcgtgtcgagcgtgctggcacagctgtgcctaggtgctccttgccccaggccctaccgggcagtctccctcgctggggcgtggtactgcgccatggggcccatttgttatctccctcaaaactgtctgtccccgtccatcttgcccagatgtagaaaagcaccaaccgcccacccatgtcgaccatttgaacaacccctgcatctccctcgccccgctcccctctctctagcgcctccctgccctcgggcacgaccaaccctttycggcggcgcagctccgcccttggctctcctgcgcgcagctcggcgtggcgtggcccggctccggcgagcggtcgaagaaacccggacgccaagcaccttccccaccggagcttcgctgacctgctgtcc

SEQ ID NO: 5219 - DNA, 1500 bp, Zea mays
agaagctagctctagaaaccgagcaaagccaagagcccaaaaaagagacttcacagctctctctctcattctctcctccgctgtgaaaataggagttggagtaagagcactaaactactactagtagtatttagattacaaacaaaaaatcaaccaaagtacagccccaaataatccccggcgacagcggtagctagctccagcagctctcgtgtgacaggcacggaatcgyggtgtagctagctccggttccaaattgtgcagttcgtgatctcgactcccagccagcttgattgctgtccgtctctatccggccggtttacatcccagcttttgagaggggaggtggttttctacggaagcttcttctaaccgcgcctctctctcgctgtcaagagctctcgatccgccctggttcgcactccactctgattttttttactcgttttatttgtttatttatatatatgatatcgtgctttatttccttccacgtcatacctgtccgccatctactagtagcatacagatcccaccttagttcataccaacgacttgggtgcgtgtacgtgtgtattcaatctatcgcgcgtgtgaagtgcaagcgtctactctactcgcgattagctttccatgaatggtcttgcgactagctttatgagatagagagagaaaaaggaaacaacctgaaaggcagaaatggttatttcgcgctaaactcacttgagcataactctgacggtgatgctagatggtagtagcttattagcaccagcgagcgcaattattatcggtgatggcagcacagctcgggggttcatctcctgtcgttctattcctttcagctaagctaatccagcaggttgagtgagcagcaagccttagatattcgcccgtagttttcacctctctctctctcctcccctgccctgttacggatcgcactaaagcatgcacaagcacaacacaacagctcgcgtctgctagaacagtctaccaggagctagctcgatgatcgagtggcgaatgaaggcacaagtcctcggtggtggcgggccccagagaccatttgctttcgcgcccttgtcacctagcagctagcagcagagggaggaaggacaagcccacacacaagctctcttcttttctctctgccgtctctcctccttcgctgccgtttggtgctcgtgtcgcgtgtggctgcgctcgtatatagcgtagctttctaggatcccaccagcagagtagcagtagcaggcgcctggtttccggtttccctgcagtgaaggaagaggaagcccaaccccaaggacagcagcgtacaatcaggctgatgcttgttggaactcagctgttgatgcttgtaagcctcgctgcctggctgcgtcctgtgctgtagatacgagatcccgcagcgttcgtttgttgcacttgcaccggcttgctgctagcttgcgacaggactaggaggagctagccgaggaggaggtgtgtgactcc

SEQ ID NO: 5220 - DNA, 1061 bp, Zea mays
agactgggcagttttatttgtacaaacaaacttgtcgacgatgatcagttaataactggtttaccgttaccgtaccgagtaccgaagccgcgcccttgtcttggacggcctggatcagtagttggctagttgcacgcatgcgtgcgtgcgtgctagtacaagtatgtatcgaccttttcgctttttccggatcagtagttgctgtggccgacagtttaacccactcaggacctccatgtctttaatttgagtgaattgcctgtttgagcaccgcagattccattccaccccatctcaatctctttcggcgcctcccggttcacctcacatgatccaacagtgaccccaacggcgacgtccggccgtcccctgcgtcgccgttcatggcacgagacgactactgcactagctagctgacacttgacagccagccaacagcgcgcgcgctctcgcctctcggctcacttgctgctgcagggatttcaagcaccgaacgggggctgccggctgcgtctgcgtgcggccccgcctgtcccgatccgcgccacggctggcgcgcctccacggcgacggcgaccgcgtcgcgaatcgttttccctttcctctgcctccagctcatccgagcgcgcgccatgcacgagtccacacgacggctttcgcgcgcgggcgaacgccaaggactggactggactggtgggcggggtccacgcgcttccaccgcctcctgtcctggcgagtcgctgtctgaaagagatctttttagggcatgtacagtggcgtttaatatggaggctcttaaggtgtttaaggggtgtatttgcaaaaaaatcttagagtcgtctctccgtgaagagacgcctctggctcgtaaaccaagtagtaacagacgcctcacttcctactgtacgaatttatcgtctgttctatcgatctgctgctgtacaaatgcatttaattatgtatttattagtagactacatttatagacactccattgtataatagagtctcttagttgtctcttgtgcttagagaaccgttttggtgtctctccactgtac

SEQ ID NO: 5221 - DNA, 561 bp, Zea mays
aagattagcactaaattatacacctatttatattaaaatattatatttgttatataactcatgttttagtaagatccgcgcacgactgagaaaacgtcatcgacaaacaggaatcccgtgcactagcggagctgttactctgttaggttggtccctccataaacctgcctcccaacgaaccggacctgccacgtaggcgggctccaacgcattcccgctgcaactggccaaccacgtcgcgccgcgtggcgcgcgtgcgtggaatttgacctaataaatccaaccattaccgcgtccacgctatatgacgaccgcgtcctcgtctaatcaatctccgcctccctgcctccataccctgaccggaccccgatcccgccggcgtctcgcggaatcgcggcggtcaaagcctatacgccaccccacctcacgtcgcgccgcatcgccgcggtttccgcgtgctagtgctctcgggagctcggatcagaggggcgggctagggttcgccaatcgccagcgtgggtactgccgtcgggcgccggcggccgagtagtacgaggagag

SEQ ID NO: 5222 - DNA, 1082 bp, Zea mays
ccaacatgcgcagctttttaatcctttacaagaagttttataagatgtttttagttcaacggawgtaggttctgtatgccgtctaagttggcgtagttggaggctggtttaagggcacgcgtagctcaatcaacacgtgcatgacgcgttccgtgcgcacacacaggttgatgagtttttacccgtggaagtctaaatccagtgcacgcagtagcccgtgcacctttgcctctaagctttgcacacaggaacagaggaaatatatacttatttgcgctagtttgataactttttttttaaaggattcctattttttttaaaaaaaatgaaaatcacttgaaaaaataatgttgccagataacaatcggaagttgctcttgcttggtccggtacggtagcgaggtattgcacgtgctcaataaagatttgatatttgaatgtattatagctaatagttagcggttaaaattagttagagacatctaaataccttagttaatagtttaactattagctacttttagtaaattagttaattagctagctaatttcactaacaattttttagtcaagtaactattaactctactacatggaaacatcaccataggttacgtacattagatttttttattttatttccatcttattctttattttatattcaactctataaacagtgttaaacatcattatcccttattttacccaatgtgttagagatgggccgccggctcagcagctcaggtccccgtgataaaataatggaccctgccgtgttaaaataacgccgggctgcttgcctagcccgcgcgaaccaacgcagcagcggccaccgcccgcatgtttgactctcccatgccgaacgtatcgctttctctgtctgcctgtcctactccctataaatacgctccagccactctctactcttccaacgccgccgatccaatccatccttcttccagctctgctaccgtagcgtagagacgcgtgcggagcagcctgagacctacagtagaactagaagttagcctgagaccagcgagttttctcagcacctgtcgtcatcagatcagctagcc

SEQ ID NO: 5223 - DNA, 314 bp, Zea mays
ggttgctcactccctcagctctcgatttaatatttgataatgttaaagcatgacattcctgagaaagcgataatattgtgtcaacaatctgcgagcaccaaattgtgttaaaaaaacatgccaggagcatgactgcggccttgtatatcaaggttaaaacctgaaatagtattcaatagccatactcgtgcaaaccatmcasgatggggattggggaggacagtatctctagataaagttcaaagaaccrtgggtcatctggcaagcaacattattccattcttatggytgtattttgagagctccttccctaa

SEQ ID NO: 5224 - DNA, 324 bp, Zea mays
ggttgctcactccctcagctctcgatttaatatttgataatgttaaagcatgacattcctgagaaagcgataatattgtgtcaacaatctgcgagcaccaaattgtgttaaaaaaacatgccaggagcatgactgcggccttgtatatcaaggttaaaacctgaaatagtattcaatagccatactcgtgcaaaccatmcasgatggggattggggaggacagtatctctagataaagttcaaagaaccrtgggtcatctggcaagcaacattattccattcttatggytgtattttgagagctccttccctaaatgttgcacc

SEQ ID NO: 5225 - DNA, 740 bp, Zea mays
tacccttggtactaatgttctggctttagtaccaattaaagccaacactcgatactaattatatgctcgagagtttggtcctagtccatgtctagaaccgatattaaagccagaatattaattattggttgtatctgccaacatatgctcctcttagggtcgtaatcaaaaccggtactccagcagcttacatatatttatactcatatttaaactgcactctacaaatagtataaaacggtgcaaaatgatgtgtttttgatatatgggtgaactattgtacattgcacctatatggtcatccaaaacaccgttttgcatcgttttgcattatacattgcactgtttgtatagtatagtttgaatatggatattggtatgtgtaaggtgctgaagatagttatgcggaaagctcaattatataccagtgcttttacaacttcatgcataacattagtgagagaggacacgttatggttataggagcagcaataactgaacttttgaaacttttacatctcccctcgtaattactactaagactctctccaggctttgtttcgtgtccaacaacaaagggtaaagcgggcactaaaatatagaggcaatggagcgtccgctattcctggagacgtcctgtagcagctactcgttggatcttaatttatttgtgattatgtctggtcattctgcactattccaggtcttctaaggactttgctgatgtccatggacttgtc

SEQ ID NO: 5226 - DNA, 1500 bp, Zea mays
agactgttctttatattcagtatgatcatgcgtgtatgtattataattctgcacaacatgatcattgagggttagtagggatgaaaacggaaatgataattttcggttaaccacaatcgtgcaccttgcgcataaaactcgtgtggtgttgatagtaacaggccctctcacgctgcaaccttaacgagagtggcaagtttggtcatctgttcgggcagacctgcaaccacctcacctacaacttcaccgccccctcggcctgcctgcctgcctgctgcatactcgaactaataaccagtcgccatcacaaaacttgaggacccatctccaaccaaagaaactaaacgacgcttgcgaaacaaacttgccccgcttacaaagatggcggatcgtcgtcgtccgtttcacttcaccgcgcgcgtctaaatcagcctcgatctctccccatcatcaaccgctcgatcagatagatcatcatctactcgatcttgcgacggtcgacactaattctttatcatattttaactaacgtgtaccatgcggctccttaattcggttggccagttcgcgtttcatctgaaattgaaaggtcgtcgaccgtacgtggacagacggattgaaaaccgagaagagatggatggattgcggggttggttggttcagcacacaagaaactcatcactgtggggcttgacggcttcctgacaacggctacattgcaaccaccgccaccgctcctcctcgcgcgtccacctctctctccctccagacgtccacgtcgccactcaccagttcgccacggcagcaccaccaaccaaacaagcagctctccctccctcccacttctcattcaaacaacaaagctccctgcgataaaccgtcgtcggtttcggcatttcttggccccaaagcacgcgcgcgctaatgccttcgtcgccaacatcgcctactcgcttcgcgttgtcgtcccctttacttgttggacagcacctttaggtggcgcgtctcgtcgtccttgcttcccaagagaccgtcgccttacatctatcgctcgctgccttattgcctgcacctccgtgctgtgctgtactgcacctccgtgctgcgctccggtacgtcctcctctcatccttgcgtcgtgtcaattatattgcgatcctgtattcttaaccagatcagttcatcagcctagcttctggtcattttttccgcgttcataatgtgttctttttcggttttatatatctccaactggatggattccccgtgcagaggctgctgctgctgcagagcaagtgcttctttcctcacaaattaaagcgtatagtcctgtgcgacgcgtgtgccgacggccggagcaaggaatagatctcgggtcctggtcacgggaaggtatcttggaagagctggatacaaggaaagttgtgagggcggccgccgccggccttggaattagttcgttctttcaactggagctatactagtaggagggcatttaag

SEQ ID NO: 5227 - DNA, 62 bp, Zea mays
gtcgaggttaggaggtggggaggagccagcaaggggagaaagcatcccctcattgaaaaaac

SEQ ID NO: 5228 - DNA, 1248 bp, Zea mays
cagaccctaataaaactaaccccctcccccccataaaaaaaaaattgacgtaggacgaacagcagtgaaaactttggtcaattgttccctaaagaatgcatgcaagctgcatcagataagatcggggcggcagcaatggagatgagatctccaatcatagagctccagcaaagcaaatccctcccccgaccacgtgagctgcacttgggcccttgagaagctgatcccgtcgccataattctaaacactgctactacctctggcagcccgatctactctttatatagttaatttaagccgtaaggtgtacagtgccgaccctaatcaacaactactccttctccttgcattgtcaggactcaggaacatctccggtgcactgcatttccaggtactccggcagtccggccgctcccttccctccgtcccaaacagatgtctttacgacacaattggcatcgtaataagcagacagtagtgctaaggttctgcttgattgattattggttaaaactcaactggttaatatctaaaattagctagctaattatcacgtacctgttagttggtattactattagccagctgctaacattacttagcaggattcttttaattctctatcaaaaatagctgctactatctgatgtggtctaacaagtaagacagttgttaattgttatttcgagatctggttaacaattagctagtttattatctacactacttagataaaaactatggctgccagtgccatgggtcgggttcgggtccgtccgcgtcctccgtagtaggtagcgtaccccactcgtacacggtacacagtacactcatcaccctcccctaagaacccggaaatccatggccaatcacatgatggcatcatgcggccatgacagcccggggagaaacgacgctcgcaggcgctgcccgagatctcgcggaccgatggcaatggcatccatccagtcagtgatccactctcactctcacgccacgccacgcctcggctctgttcgatctatttctcctactagtcctgttattattagtatataatagcatatcccgcggacaccggccacccgatcaagcactgctgctcatgtgcgcagcgcgaggctcgagccgccaaagcagggaagcagagagcaagcttaataagcaaccgcgtttcccagattccttggcactgcagcagctgcgtccaagcttgctaggtggtggcggcagcagcagcctgcgcct

SEQ ID NO: 5229 - DNA, 211 bp, Zea mays
ttgtgtcgagtgcccagaatgccatacagatatatgtatcaactgaggagtgccgtggcacatcatgttgggctgtgacgagtaccagagcttgcccggtgtggaaagagatgctggagacctatctttgcatcggcttgcacataacaatctgtggaggcgtagccagagatgtcgacgtatgattgaactgacacagggctgataccat

SEQ ID NO: 5230 - DNA, 536 bp, Zea mays
attaaacatacatttaaatttaaatggttgttttcttcgtcgcgaataccaataaattaatgactataaaacattatgtcaaaatatatattttgcacatattcacctgtcgaagatgatgatggcacccaaggcatactgacttgtagaacttacggatgcattggcttcaatctatttccttgttattattggtacactcgtcactagttggtaagcacgatggtcgcatttgtgcggccgtgaggcctcgacgcctcgtccaacaggagccggcgacgtcgcccccttcgtcccctccgctgcgcccacgccacgaatccattccattcccattcctccccacgccgcgcgcctccataataccacaccgccacccccatgccgctcgcccaccaccacaatccccagccctcacgcgccattggaattgacattcgattcccagcgcagctatcgagctccctttccccgccttgttggcgcgcgttagagcgcgagagagaaccggctaacctccggcggcgaagaagttc

SEQ ID NO: 5231 - DNA, 1500 bp, Zea mays
atttttccagtggattatctctctttatgcccaaacaagcgagtttgaattagagataggaaaatgaatttgatttgcaaaaacaaaccaagtggtggcaaggaatgatccaaatatgccaaatttaagtcaaaaacaatttggtcttcaatttgagtcaatgttgcatgtattgcattgctttttgatgtgttggcataaatcaccaaaaagggggagattgaaagggaaatgtgcccttggaccatttctacaatgttttggtgattaagtgtcgaacacatagtgagtgagatattatgtgccaaatgaagagagaagtgcaaatcatgtaataaggtatgtttctagacttagtacattggtttgagtactaacatattttgtctaagtgctagaaatagagaaaagagaaggagaaaaggacttggctctgagcagccaatactcagctcagtctggcacaccggactgtccggtggtgcaccggacagtgtccggtgcgccaggctggcttccggcgaactggccgctctcgggagaatttggcggcgtatggctataattcaccggactgtccggtgagccaacggccgccagcgcaacggtcggccgcgtaatccgcgggcgacgcgtggcccgcaccagcggtcggcagggggcaccggactgtccggtgcgccaactgccacgaatctgcaacggtcggctgtgccagaattggaaggagatcgtgcaccagacatgaacattggctgtccggtggtgcatcggactgtccggtgcgccacccgacagaaggcaaggatagccttccttgttggcctccaacggctcctagctgccttggggctataaaagggacccctaggcgcacggaggagtcacccaagcacactctaagcattccaagacttctagtcctcactttcacgcaatcgttcatcgttcttgagattggagcacttttcgagttgtaaactccccgcgcgtgttttgtgtgctcatcttctcacttgtgtgcgtgtttgtggtgtggttttaattctagtgtgcgttgctcttcccaaccttactccgtgctttcattgtgatctttgttgtaagggcgagagactccaacttgtggagattcctcgcaaacgggaaaaagagataagcaaagaaaagtcgtggtattcaagttgatcattggatcacttgaaaggggttgagtgcaaccctcgtccattgggacgccacaacgtggaagtaggcaagtgttacttggccgaaccacgagataaaatcacgtgtctcttgtgttgatctctttgtgattgtcttggccacaagaactcgcttcgcaactacttagtcacactaacatttatataaccaagatttgtggctattagttattgaattttacaggatcacctattcaccccctcccctctaggtgttctcaattggtatcggagccgttctcttcacgtaagggactaatcgcccgaagaa

SEQ ID NO: 5232 - DNA, 997 bp, Zea mays
ctagattttttacgcagtgtaacgaattgcataaatatctacatcatgtagtataatttgtatcagtatatatcataaactagatctaatgtgtttagctgcataaatacttacttggatcatatgttgtcccaacataccaacacgagtcttttgtgcgcactttatcctcactcatacgcacccgagaaaacttcccgatcggtcacacatcccaaattgctccaagccatgcacgcttaacttggaggttctttcgagataggcttccgaaaaagaagatgcatcttattggtatggatactctattaattctattaagccttgggccaggatatcaccatcccagggccaggatatcacaatccacctcccttagaagaccgatgttctcgtcggtcaaccccaatccaggaacctcccctcttagccacgtctgtgtgtctagtgtcgtcatatgccatgccatgtgaccactctaggcccacatgcgccatgtgccatatacccgaaccccctagcccacacatgcccgtggaacctcgagggtcagctctgataccacttgtaacatctcgtccaatccctggaccaacggtacttactcatggcagctctctaggatcatacatcgtctccacagaccaacacgggtcttttgtgggcactttgtcctcactcatgcgcacctgagaaaacttcccggtcggtcacccatcccaaattgctccaagccaagcacgcttaacttggaggttctttcgagataggcttccgaaaaagaagatgcaccttgttggtatgattacactattaattctattaagccttgggccaggacatcccatcccaggggccaggatatcacaaaaacttaaccaagttttgtggctattagttgttgaatttcacaggatcacctattcacccccctctaggttctctcaattggtatcggagccgttctcttcacgaaagggactaatcgcctgaagag

SEQ ID NO: 5233 - DNA, 1500 bp, Zea mays
agaattaacaagcaattgattatgttatgtatatgcatattgtttttatatgacccgtgagctaaatgagtgacctcaagctcgcaaacgaaccaagctaaacttatgaactagcttgatatccaaccctagctatataatttagacgggcgatacaaattataagagaacaagcttacaaatccgtaggattatgtttcagaaaaatgttgctagtcaaaaacctcaattttaaaaagtaaaaaaactcgtagtttctcaaatctacataagattattgtaacaatcaatgaatactagtattagatcgattgtgaaatatatatttataataaaaaatatatgagacataaactaaaatattatcttatattttccctctattctaagttgtattgtgagtcgttttagctttataggtttttttatatctaaagtgatttataattcagaatagattaagtataaatttggtcaattttaaaacaagatttgttctaaatttaaaattgttttttttgaaaaaggtggagggtggcaaccaatttatttttaggggtggacgttagtaaataaaaaagtaaaaggcacacgggggcacaaaacgacaaacatttgcaccaggagatgtcgcgtaagcccagatagtcgttctccgtaaaacgacgcgatttcggtcaatgttgagctaagctgcagagcacccagcattctacaccgacattcccagtctcggcggcactcacaagtcacaagaaccactaccaacaccggccagcagcttcgccgttccccctccggcgtcggcggcatccgccacacgcgttcgttcgttccttcaagtcccatgtccacccccggccgccgcaccgcgcgcccgtggtggagtcgagtggaggggtagattttaaaagcccattccgtaccgatgatatttcacttgtcaccgcccctatcatcgctaaaaacctttctttttctcccgtcacatcacctttcactgcatactgtctcctccctctcacccattcacttgcagtcctgcagtgtgccacagtccctcccctcttccagtctcgccgccaattagtactcaccccctcccttgcattcgctccgctcccccctcctctcttccccccccgacctcggcgccgaggcatgctgttgccgtgagtgagcaagggatctttccggcgatcttggaggcggcgagcctggtgccgcatgctggctgtccggccggccggaggctagctagctctcgcctctcgaccgagaagtgaagtgaagtgaagcgaggcaagtgctgtccagtagtagtggtggtcgcgaacactatttatagcgccccggcccccgcccccgcgtgcggcgctctcttctctctcacaggaccacggctcgcgcgcgcgggcaccgactccaaaatagatagatctcatctcatctccttcttgctgataggttgtttggttgcttacttagcttgcttgtcag

SEQ ID NO: 5234 - DNA, 569 bp, Zea mays
cattttccattttttcctgtatttttcgcccatctttattaaggctgggatattcctaaattcttaataaaccgaataaaatttataaaatataaaatcaagttttattagcttcgaataatttattctacataatgaacatataaaatattatgcttaaatacaaattactcgttaaaaatattaaatctagggtttattatgttaacttgataaagttagtttcgatggtccagttcatttgaaagtagagagacatttttcactacagttcgacatcgagtcaatagtggatgaaatagcgtgaatggaaaaaaaaaatgtttggaccggtggcactatgatgagtccacttttctaatgattttatatggtacctttaatcatttaactttttaattagtttataaataattataaacttttataatggcagaggtaaaaaagactggttccagaatcctcggccctcagactaaacaagacctcggtcctcgttttcactcgcttgacctgttgctgttggccatacctcctgtctcgcctccggtcagatcagattagcctcc

SEQ ID NO: 5235 - DNA, 116 bp, Zea mays
cgcccgataaatattcgacccaacaattagcccttatcccctgtgttttggtcttcgcgcagattcgtttcgatcgtggtttggtgacttggtaagaggggaggggagaagcggcg

SEQ ID NO: 5236 - DNA, 174 bp, Zea mays
ctcctctaaaccattgctataatcttcgtctaaatttaactatcatgcatgccttcttataaatatagagcatcccccattgcaaagctgtctccacacattcaagaacctcctcgcctcctccattgaccaacaattaagcctccccgaccgccacatctattaggtgcagcc

SEQ ID NO: 5237 - DNA, 441 bp, Zea mays
cacatggtaacagatatcaatatatttatttacattaacattaccattaccagcgctcaaccaaacgccacctgagatgtttctattatcgtttctacggatctgtatgggccaggcctaacgatcgattcaggcaaccaataatttgcatgttgcatctacgaagcctggctgagctatatgcatttagctctacatatatgaatccctcggtctccgcgatagggaaaataaattcgactcagacccaaccccaagcagggaaaacaatggcaatggatgaaaggtgaaaaatgttcccggtctatggcagcaggcccgcagccaagagccaacgttgccacgcaggagaatatcagtgcgcacagcaactggctctaagcgctctgcgcctccaaaaacgcgtggaactccgccctggccctcgccagacgcggcgtg

SEQ ID NO: 5238 - DNA, 946 bp, Zea mays
attctagtctaccttagaaagagaacatctaactgattataattttttaatcttatattccctcggcatccgctagtttatttttggattaaaacgcggcaaataaaaaacagagggagtacaatatatgttactatctaaaaaagatattcacataagattgaagaaacatgatcattattttgtgtattccactttagtccttgtccgttttgtacttaaatcatatggattgaggggtatatattgagatagatcgaggtggatttcgactagttgtggatttattccccccacaatccacataaatttgaaaaaaaaaacgaacatgaccttaagtattttatttggtttttgcgtatatatgaattctcgacaaaaaaaaggccgggagtctgctgttgttgttcttttaagaagtactgtctgactttgaacgtggtttgattatgaaatgacattcgatcgagtaaacgtttctgttgtcgtctttttaatcatatacaagtgtatggtgaaacacaaaggccgtgttaccctcgagattatataatctagcttaaataagttaatagttaaacaaacaatatagattgttaggtaaattatataatctagatatctagattataataatccataagtagattcttaggtgattatataatttatataagctgaattatataatcacgaaggaaaggcaccaattcatgtaatgaccggagtacatgtaacgacgatcacgtaccacgttctgatgcctttttaatcatagaagtgtatggtgaagcactaaggcgccaacactagagattagagtaatggcgatcacgtatccacgttaccacgtaccacgccctgatggctgatgcctttctttctcctgtgtcatgccctccactaccactacttactagctcatcatcgtccaccgtccttgtag

SEQ ID NO: 5239 - DNA, 825 bp, Zea mays
gccaccgataaattagacatagggtattacctctcaagggagaccaaaccagtataaatctttgtgtctttctgccttactttctgatctagatcccgcaatactcctatatcaaacccactgtcaagaaatcctcgacaacaaacatgtgcaatcaatagcatgcacataacaaggtagggtggttgttagattatatagctaaaagtaggaatgtttaacgtgtggccattatgagggcccggggtgagtggcaattatacacatgaagtccaataattcctcgataatcctgactcctgcgcggtggtagctagctcatggattctctgctcctctcattaccatcacaacacatatcattactttcccctgaatcctgatgtcagatatagctaggtcgtccttcaaaaacttgaataatgcatgatatattggaattggttatctaatatacatggaccttggtgctgcatgatgcacagaatgttcttaaaaattaaattacatagcatcaaggcatttcattattagcacaaatcaaatatatggccgatctttaaaaaaacaagaccttgaattaattaaaaaatgcggcctttgacaattaaagagaatatgaaatggcttttagcacagccgacatgactcatcacgagagaaaagccaaaccaaaggacgtgagacatgcaggcagctgacatcacattcacggatcatcgcttatatttatacaccacgtattagtgcagtggatcctcctcctcaagaggttcacccactcgatcatatcaccacctccgatcctatagagatagagagctc

SEQ ID NO: 5240 - DNA, 194 bp, Zea mays
ctgtgtccggaacatgacgcacgcaacgacgtctagatagcccgcggccgtgcagagaaagagaaaagaacgagcgcgagctcgctgctttgttatataaatcatcacatacaacttctcctcaggatatgtcacgactcacgacgacggaaacagtagtgctgccagtagagctctcagaactcgggaaaaaa

SEQ ID NO: 5241 - DNA, 632 bp, Zea mays
attttatgatatattaagtgtagatataatttatttggttgatttagtaaaggttatgttgtgagggtgattttttggattaattttgcaaagttaaactaatggattatataattgtatagaggaattgtaataagcttaatgataaaaataaaaacacacagattctatattttatttatttgtaataaaaaataatatccgtataagtatttagatccatctatctagggatcccatctatctatctatagttataagacggatagcaaacccaatacagagaatgcatcggaatggagcgtttaacaatcgactgatacagagggaaacgtggaatttaatccatattcatcatattttgtgtcaataccgtttaaattttgtaattttgcagaagaaaaatacaagtcagggcacgcgttctcgcctccgacaaagctcgccggagttcgtgaaaacaatttgctgtttccgtgaccctctatgcaacccaaaacaacatggagaaaaaaaactaactgagcatgactcgtcatcttttccaactctctttcttccccttgttctgctgacgcgccggtccgttggtcgcctcctatctgctcgctcgcccggtccggcctccgtcc

SEQ ID NO: 5242 - DNA, 1500 bp, Zea mays
attgatgtatgctttgcttcggccctataatattggaccaacttattatctcacatgttttataatccaccctagcatgctagaaatttatctgcacaaatgtacatggaagcattagtcataagattgtagtttcctgtaaaaaacattaggccgattgcagttatctcacaggtgaggtctgctgtgccaggtttaacatctataagtttgatcaaatgcacaatcaaaacatgacatatttgatgctatagatgttagtgttagcagaaacggcaagaaaaacgaagtagatcaaccaacaaatcacagagcacaactcacagatttacatggaaaacccttcaatgcgaagggaaaaatcacgagcaccagccatgcgaaacattcactatatgtggagtgtttacacaacatcgtccgtagacggcaacttacaagagtaaaaataacgacgcaccacaaaccctaattacgcttcggcccaaacctcctgatgacgagcctccgctccgctcgccaacatggcctccatatgcagaatttggaacacaaactcaacaattagtgcatttttatatatactttgttgaagttaagtaagataatttaatataacgctaaaggaagctataatttgtaacaaaggtaggaaatttcagtatgtcatgcttgctagagtgctacttttgttggtcgtttttccaatatttgagcttgaggatgtatttgtttgttcaatttggcatgtggttccttttatagcccgtttgggtgcccttaattggaatgctttttcagcatgtttgagcagccatgctcactagtgctcctaccagtgtcatggactcgttgttgttcaatggcttctaggaatatgttgcttctgttagagtggacatattaactaagttaacctaaaagtataggttgttgggataatgtagataattcacttatacacttcaacaccctcactcacatgcactcacgtgcaacccgagagaaaggctctaacgtggaaataaagggcgcatgcacaaattaagcatctatcagaatttgaactcaagacatttgactttgataccatgttatagtggatgcattaactagcacaacccaaaagcttaagctattgcgagtaggtatgcaatgcayttgtayactttaacaacttcaaaggatgggtacagcaatcgatctaatagtagaatacaatagaattgtgcttttcactttttcaagccacaaaccttagattggtctattgggcataactagaattgattagaattgatattttagttttgaacagcaccaaatagaccgtccaaacaatatgattatggcccaatcgaattctagagatcaaaacatgcttttatattttttctcaggggcggagctacttgtagttattggggtcaactgacccctataaaacatgtcaattcctgtacaaatatattcttaactaatgtatttagatgatgatta

SEQ ID NO: 5243 - DNA, 100 bp, Zea mays
tcggctttatgaagtgtgaattgagggggcggcggcgcgggcgcgtaacgggaggcggcgtctagggttttggttttggcggaggatttaatggagcggg

SEQ ID NO: 5244 - DNA, 369 bp, Zea mays
tgcagtgtgcggcagcagaagaatccggccaacatgtctctgctccccggcgccgcagcccaccggatggcgggcagagacgacgcatgcacgctagagcccagcagctccggacaaaacgcccccgccgccagctgccgctgcagctgttcggctacccagcggcagcggctgggctttcgacctccggccgacatgcggtccccacgtcgcctcccccactcacccgagtatcccctacattatatatagccactcttcgcctcccctgctctaccattcttcaatcccgcgcgcgtcggctgtgttagccggtagccctccccccgtccgaggtccgagtccgaccgaaggagagaggcagcagcc

SEQ ID NO: 5245 - DNA, 1126 bp, Zea mays
ccagctgctccatccagcaggggcatatttcgcttctattggtcggatgcttttagtagaagctgtaaaatagtcttacgaagtgtttaaatgtattataactaataattagttagctaaaaattattactatcaaataaatagatacctaactattaactaatttaataaaaatagttaatagttgaactattagttagaatatttgatgtctttaactaattttagccactaactattatttatagtgtattcaacattcctttagaagttaataaatatctctttcacggagaaaccacatcgtatttgtcaatcctacgaaatagagaactttctcttggttaattttgacttgttgccggaaactaactcggtttactcgtttttttctctagttggtgtggcggtgttctagagccccactctgtttcgctttctacatcgcttccacgatcatgctgacctgcatgtagctgtgaaaaccggaaaccacaagctttaatttaccggataaaaacaagagcgccagtcgaagaacaatgcagatattatcgaagagttgtattgggagaataatttgtttttctttctctctgtttcagcgtacatagaagcactcgtccagattccagagaccttattattaagtgaagtgacgaaaaaaataaaataaaactataccaatgccaatcgaaccaaaatcaaaccaacgagccaaagcaacacagcgttcatgagctgcaacaatgcttcgtctactctatctaccatcggaatcgcagttcagcaggcgtagtagtcgacgagctcgtcgagggactccggctgcgggtcggcgtgctccagcatccagaggaggtgctcgaagaggacgacctcgcagccgacgatgacggtacccgcgggacccccggcgccgccggcgcggtggacgagggtctggaacagcgggtggcccacgagctcctgcgcgacgaggtaccggcggcgcgacctgccgacgtacaccgcgtgcaggcccttgggcgcctcgtccgcgccgtggaacgacgcgccgcgcgcgttgccggaggtggcggcgacggcgtcggcgtgagccggtggcgacggggcgcgggagacg

SEQ ID NO: 5246 - DNA, 313 bp, Zea mays
actctatacatatcagcatgcatgccgcggaacgtaactaataagcaacaatactaataataatatgcacttatatgccatgtgctgaataattaataataacctactctatgtgtagagtattacatcctgtactgaaccttgtttgtgtagttatgtattgtctacaagaactttgctatatgtagagggagataccacaaatagccattcctatggaatttgggatatatctcaaataactgtgtactgtcgaatagtatatagtatgtaattatgcatttaatagctccctacattaaataattgatat

SEQ ID NO: 5247 - DNA, 1500 bp, Zea mays
accgtcgaaaacccagaaacgaaactgagaccggtcggtaattccttgggtaggagtaggaatgcacatgggcttccggacagatctgtttacactccacagggacagggtggtggtcctgtggcaatttgccatggaaaccgcacaattaatggcctaactgatccactgttcctaccatggctccactgtatgcgttgtattgtaactgggcatagttttcacagaggcctcctacagtcctactccatctgcaaagttctgacctcagagttttttttcttctttttgcctttctttgttttttccatatataacaacagaggaaaagaacgctgctcagacagttgtgctttcaggattcagagagcagggaaaggcatccttcccctcatctcttcatcagaaaccgaggagcagagcggaacgagttgctgaaaatgccgagagggtcagatcaattgcgcagcgacacggcgcgcgtccttttcacctgcaagcggcaatcggcttcaccataactcccgcgcgcccggaacagtgtagggccagatgaagagcggagcaggagcaggacgctgccgcctgccactgccactgccaggcacagtaaactgccccagaccaacatgcatctcaattctcagctgtggatgctccggcagccactcaagatgagctcgcgccagatgcagtcaaacatccggattcgtaccgccaggaaaatttaaaaaacctgctactaagctaggcagcagcagcagcacggcgcccgacgcggccaggagacgacgaccggagaatgcggcacgggcgagagccatgggagtttaagcgcatgcatgaacacgcagctcggccggcgcgccgtcactatccatctgtacgagtacgacgacggcgaccctgctgggtagccgccgcgctctcccgtagcccgcggcgaaccaagccggccggccagccgcgcaccaaccgctgtcgccatctatctgccggagacgtaccaccacgtacctttggttcgtttgctggcacccgggcctcggtcggccgcccggcggcccaacggtggcgcacgtgcagcgcgcatgacgagggggggacgggaaaagcggggtgcgccgcctgacgtctgggccacccttggccgtggccgcacggaaagccaggaagattctcgccaacccggccggcgctggcgcactgccgcactggtcagtcactcagtcagtactactactggggtactctcggtctcggctgcacgcacgtacgggaagtcgcccaggccccagctagtagctagggcaccgcgcacgcggcacgccccggcccccgctctatttatgccgctagctagcgacaccgaccaggtcacttcattcccttgtcactagctagatcgactgactggagaggagctatcgtctacctctgggcgagctgcgtgtccctgccgtccttctcgctcctgtggtcgccgcgcgcggcgctgcg

SEQ ID NO: 5248 - DNA, 263 bp, Zea mays
ggttctccgaaatgaccaggggcttctgagggagaatccaccctaggcacgtcagatctatccattctactcagaatgacgaaaggggaagtcagcaacaaaggccgcagtattcctcccaggcttcggggcagcaacagaactatcctcggcccccagctccaaggggcagaggcgccaggggcttcggaggaaggtttggggatcagccaaggaaaatttactgcctattctgcggtgaggacaagggccatactaccagg

SEQ ID NO: 5249 - DNA, 676 bp, Zea mays
cagtgttatacttgaagaaccattttggtgtgactccaattccactgtacatgtccttggtccaatcgacgtttgttctggctcgccgccacagactcccccatcgaacaacgaggcgccaggcgccagctcacgcgtgcccgcaagttatggcaggcaggcgggacccggcggtgcgggtgcggcggcgtgacaggcactcctccacaactcggcacagctgcacagacgcacagtgttgggactgacaagccggtcccacggagcgcgtggcgaccaccgcggcccacccgtcatgcaacagccgcgcgtggtcgcggcgtccaacggctgcacaccgccgtgcgccccactggtctcccactcatcccgtctcgtttcgtctcggtctcgcacctctcacgacggcaccaccccagcgcggcgcgagtggagacgccgctgctccgtgcttcgccgcgcctacctaacccaagacctgctagacctgagtggctgagtgttcgtgttcggtcaaaacccaccgcgcgagcgcctccagagtccaaacccgctacaaatctcgcgctgcgcattctccccgtacgatacggcggcacggcccacgagccaggcggtggcggcagctagctagctgcggagtagcaccagccaccggagggaagtgggcggcgcg

SEQ ID NO: 5250 - DNA, 134 bp, Zea mays
cgaccagctgaactaatcatctaatttagttggatggtgatagatttgtaacacgcgcgcatgccatgttgttgttaactttcttttaacgtttttttgtccaatatgtgcatgcatgagagaccatccatctt

SEQ ID NO: 5251 - DNA, 1500 bp, Zea mays
aaatactaaataagaaagaaacattccatgcatatctcgtaagtagttatattggctcaattccaagcaacctttgcacttacattatgcaaactagttcaattatgcacttctatatttgctttggtttgtgttggcatcaatcaccaaaaagggggagattgaaagggaattaggcttacacctagtccctaattaattttggtggttgaattgcccaacacaaatttattggactaactagtttgcccaagtgtatagattatataggtataaaaggttcacactcagccaataaaaagaccaagttttggattcaacaaaggagcaaagtgggaaccgaaggccctctggtctgggagcaccggactgtccggtgcaccagaggactccagctccaactcgtcaccttcgggaatttccagaggcgactccgctataattcaccggactgtccggtgtacaccggacagtgtccggtgcgccaggggaggtcggcctcaggaactcgccagcttcgggaaactccaacggctagtccgctataattcaccggactgtccggtgtgcaccggactgtccggtgtgcaccggactgtccggtgcaaccccggagcaacggctatctccgcgccaacggctctctgccgcgcatttaatgcgcgctctgcgcgcgcagatgtcaggcgcgcccattccggcacaccggacaaggaacagtagatgtccggtgtgcaccggacacccaggcgggcccacaagtcagaagctccaacggctagaatccaacggcagtgatgacgtggcagggggcaccggactgtccggtgcgccatcgaacagacagcctcccaacggccactttttggtggttgaggctataaataccccaaccaccccaccattcattgcatccaagttttccacttcccaactactacaagagctctagcattcaattctagacacaccaaagagatcaaatcctctccaaattccacacaacacaatagtgactagagagagtgatttgcttgtgttctttcgagctcttgcgcttggattgctttcttctttcttgatcctttctttgcaatcaaactcacttgtaattgaggcaagagacaccaatcttgtggtggtccttgcgggaactttgtgttccaagtgattgagaagagaaagctcactcgatccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgctctctctcgcggactcgtttctttattactaacgctaaccccggcttgtagttgtgtttatatttgtaaatttcagtttcgccctattcaccccccctctaggcgactttcaattggtatcagagcccggtgcttcattagagcctaaccgctcgaagtg

SEQ ID NO: 5252 - DNA, 1500 bp, Zea mays
caaactcgtcgccaacagcttcgccgccggcgctgcacgtggtgattgttgagaaaccctaaaaggggtttaatgggctaataccgaaactgcccttagggggtacacaggttatatatatgtatccatacccatcataataaagatagacagaaagagcttccatccactgtgtctcttgttcctctctgtgttgggttgctgggaagggagcgggcttctacaacttctcacgtccctactgctgttgggagggttcggagtccggatcggggatctgcgacaactacgttattcaacaaactcgattaatctgatcggattttgcacataccacgcgtataagcatagatcatcgccctcaataaaaatcactacgtttcgagtaaatctttgaattatatctacttatccaactacaagcgtacaaatgcacgaatgatctatcgcgttggcagcaggatggcccagacgtcccagagccacgtgcccatgctccttcgtcttcactgtggcgtagcgtgggcagcgcgtcgcggaccctggccagggaacggattcgctcgcacgtctgaccgcgctctgcttacggcgcagggtttgcaattaatagcgctcctttcttcctttgtcccgactcccgagcgactgggcagcatgcagcctgtcgtaacgtgaccctttctctttctctctggttccatcgtgtttttccctgtccgcactgccgtgcgagacgaatttatataatttatacgctggcgacgaaaagaattaaattaccctgcaaggccagtccgttctaggttttttttttgaatttgcggctatcttgctgctgtcctgctcaagtagtgcccctggaacgatgtgctgtgtttgtgcaccgccgctaacaaccacggcggcaagccagccagcagaaaaaatctacggagatggtaatcagcttgttcgctgcggcttgctgcggctgcaatccggctgcggctgcggcttctacagtatttttctctctatggattgcagctgcagcagtccaaacagctgcaacagtgtcggcttgcagccagccgaacacgcccactaacaaaagctccagtgttcagtacacacgatacacgccagtacaacagtaggatcacgctcgcgggagggcacaccagcgtatcattgcactcccgggtgttggggcgccacacacgcacacatcattggcacgttagtacgttacattacaacggcatggcggttacagcagcagcagcaaatgatcttgcatagccttctttgcgctcaccttaattaagctcaagacctttggcactaaattcatgcaactatgcaagatgcagctcgccggccggggacctccgataatagcgtcgatctcggtctcgcgtgagctgcttttgccttctcgttaatggtagaaatgacctttttttctgggtggtggtggtagtagtagctaaagctaaatctagtggttcatacagt

SEQ ID NO: 5253 - DNA, 1138 bp, Zea mays
ataaataaaaagtgttgagatctttttggttgatagattacatatgtattattgtgagccgtaacaacgcacggataaccaactagtatctatacgtgattcgtaccattaccattggcgtcatataagatgtgacaaacaaagcacggatccatccataaaaaaagagacaaaaaggttctttgttagtactgcagtactgataaataaaacaaatcagcggtgcacgccactaccacagtagtacaccactgctatctgcgccgcagcccgcaggccgcacacttgcgtgcgggttcgctataacacgcgcccggcaggtctcctgtcctgtcctaccgccgcactctggaacccattcttacagcgaacagccaaacgatcccactggctctgcgccacgcgtccgcagactgacacgttccggtcgcgtcccggacacgtgtcctgcgaacgcacacgtggtgccacgggagtggctccctgacctgtcactgagcccgccgataccacccgacgcagccgcggattctccgtgtggacccgggcccgcatggaagcggcacagacgaagcttcatgggttggagccctcgggcgaaaagtatgattaggagagtggttagtgagcaggttgataaggttgaaaaagatcatcgctgcctataaaagagcagccatggtgccccactgagctactcaacccaaacaccacaatccccttcaacaaacgcaccgcactccacggcagccagaaaacacaatccacacagtctccgtgaggtctgagcgaggtaggactagctctgagcgagttcttccgtcttccaggtataatccttgcaactctcactatcctcttcgcatcgctcgtctctttttgagactagttggatttctcttctttttccttggatcctactacctactagaacagagctccggagccttttagtttctggtatctgatctactcattttcttttcttccccttttggtgacataggtaggtctagttaagatctgtcgtgccagttctttgattttagctaagaaccaggcgatttagtcttcttccttacaaaaaaaaaaatccccagaaaaaaaagttgtgagtagtatattcttgtaccatttg

SEQ ID NO: 5254 - DNA, 341 bp, Zea mays
tcagcttcctagtaaactcatttccccactgcggctagtgcagtagtgtttgagtctttgaccgaggaaggataggcgaccggcgaccgcaagcaggagtagccatcatcaagcagtcaggaaagcaagcgagaagtcgtcgcgctactcttcgttgcctatatactccgcctccgcctccggtggttggttggtccctctaccatcgccagatcgcctgccttccctgctctccccgtcggctcaccgcgcgccccagatctccccgtccaaaggggacccaagcatcgcatcggatccgtcctgcgctttgccgccggcaactgcagaagcgaccagcc

SEQ ID NO: 5255 - DNA, 235 bp, Zea mays
ggtatgacatttagttccacgtcctaaccaaaatgttgtaggaaccaagtgggtcttccgcaacaagcaagatgagcatggtgtggtgacaaggaacaaagcccgacttgtggccaagggatattcacaagtcgaaggtttggatttcggtgaaacctatgcacccgtagctaggcttgagtcaattcgcattttacttgcctatgctacttaccatggcttcaagctttatcaa

SEQ ID NO: 5256 - DNA, 291 bp, Zea mays
tctattataagattctagcatacgcgaaagagctagcatatgggtcgaggcactgaaatattttcctcgatcgccccaggccccagcagggcaacagctaagcccagaaaagtcctagtccgacccaccaacgcggctcttcccgcgccagcatgggcccaggaaaacaaccactacacataaaaccggcccacccatcgctagggttcgccccaccaaagcctccgcccccttcttccctgacaccctcgccgccgcgcacgcacgcacgcagggaaccagcgaagagag

SEQ ID NO: 5257 - DNA, 1318 bp, Zea mays
gagacagagttaagctgcgtgtgcatggttgctgttcggtcgtgtcgcgaaacgtgaagagctcaagcggcctttttgttccagtcccacatgtgagagcttgatacgttgtctggaatgaaaaattttctccaaaattcacgaatatatattgcgtacgcacaatactgtagattaaacaatgacttgtgtagagctgtaaaatcgacgcaattatatgaaagcagcactggagtttcaaactgacaagcatttacatcatcacaaactgtcagattctgagtcagctatcttgtatgctgctgctgtcctccagagcacagatggattggcagtagcggccactcttgtccctcgggcccactcgcctgttgcaccgaccaccgagggaggaccggagtaggtgtggggggaaaactgtagaacatgtgggatgtaaaatctagtctagttttgggatcggttacgaatttgtctaaaacaaatagtttggatgagacgagtggaaaacatgggtggtgttgatttcagaaacgaatggcgatatgacatgtgttttgggatcagagtattttcgtatttacatcctacttgagttatcggttccgtacgtcgccggttggttgtttcggagtccgtagaagaaaaatagcctaggaatcgtgctgcggcgcgcacgtcgcacgggacgggatgaagaggagaagaaagtctggaattctctctcgattcctccaaggaacgtaacatcgtgtcaggacctacaaccttgtgaggagattcagtctactgcactctctgtttgtaaccctgtttcaatcaacgaactgaccctttctcttaggaaaaaattaattttttttaaaaaatattatattatcatataacatattataatataatataatgtattatagtcccgaaagcaaccgcgtaaaaaaagaatacctttttgtattagtgcaatgaagaatagaattagcttccttgaccgacctcccatttgatttgggtttcctgatccggtccacactcttgcttgcttgcccaccacttctacctccaatacttgtaccccaagtcccacccaaccgagaaccgaccaaccaaaccaccggtgcggtgcggccatggttggccttggcgactccaacacacttgcccaaccatccacacgcgcatggtctgatggtcctgccctttccccttgcttgtatagttagttgccaattgccatcgccaactacctcctctcctcgctcctccaaccaaacaagccaccccccacgaaacccgcaatcccagccgaagccggacg

SEQ ID NO: 5258 - DNA, 349 bp, Zea mays
gcacttggaccacgattgtgctgcttgtttgttcttagcatttctttgtttctattgtatataggaatgccttgtgaggtttctttttctcatttgttgatagtttgatcgattgccaagataccatgttaacatgtaaattcctggattacttttggctgtttgtgtcactaggaagcatattgaactatcactctaatgcaaaccctatctttagatttaactctgcattttcatttctaagttgcgcaccctacctgtcactgttttttggtggctcatgagactttcttttaacgtttctaagtttgttcttttgtttgaatttcaggtgctatcaatttggaag

SEQ ID NO: 5259 - DNA, 165 bp, Zea mays
tatttggcaatttagatactaaaatagaataagatagaaggactaaaaattagtccctagaaaccaaacaccccctaagactaagagttaccttttcaccaaacaccccctaagactaagatttaccttttcaccagggtttggaggttagagtaatgaaataaa

SEQ ID NO: 5260 - DNA, 137 bp, Zea mays
cttgcatgatgttatgtctttaggtgtaggcacggagatcttgatcacaccagacaccactttgctgctggagttatttgatatcaagaaaggcaatcgaggaaaagcaatatttcaccaygaggcaaaaaatctgg

SEQ ID NO: 5261 - DNA, 1500 bp, Zea mays
gcacaatcaactgagtagtgaaattgaatctggttagattacaaatcaaccatggtattgaaatgggttgtgattctaattatattgtttggatgtcactaaattggagtttggaattgtgtcgtctaattccactcaatacaaaggattgatgctctgtattgagagagtgagtttctagttatagtccaatttcagagaattgatatctgattataaatatcaatttcatatgcaaccaaacaatataattctggaaatctgattctaattcataatctcgtactccaacatctacatccaaacagggtattatctttctcccccgttccatgaggtaaaacattgctatactgtatagcttaagcatgccccctcttggcccacacacccttctcaaaactttctcaaaacttggcatgcataactatttgatagaacgatacttatccatcaacttacctattttaggcgatacatgtgaccggctgactgcatagtacaaaatgttcaaacaaatgcagcaatgttggattcatataaccataaatagaaatatcaaaataaattttaattttagcatacatctagaagtgataaataataaacactcaccttatgtaacttggctaggtgcatcacaatgtccctactgaccccaccagaaaaataatcgaacacattatctacagttctacaccatcaccatcctcatcctccgcgagacgatccacatctcggaacctattatgccatgcacgttcccgacgatcaccacataagtacatatttttctatattttttaattaaaaacttttaaaataatttcaaggaaaaacgaggattttgtttttatgatgggagttagggagagactgaatttccctcttgcaattttggggagttttggacggagcgagagccagaattcgacgctggcggcggcgcgtcgccaatacgcagcgcggatgtggagccacatgcaagcgtgtgtccgcccgcgtggcgtccactctccctccacgtttcggcgtcctcgtcgccttcctgggaaatctccagctactgcccactgccccttcccttcagtccctttccccgggctgtggcactagtactagcaccagcatctcttcaggtctccaccaagcgcagacaccgcagcagcggcagcggcacgatctggtgacccccccgccgcgtcaagcctgctcctccggtgatcgccggactggcggggtaggaaccagcggagcgcagcccgcctccttccgctggtaagagtgacgcccgcccgctcctcccttcgctcgcttccttgctcttccgattctggcgtaccagtctcaccgcggcttggggatttgatgcggagctagttaaccarcagagctagtagcagatgcagatcacttgcttctctggtttgattttcggagtcaccatttctatttggttcgtgtgcctcagtgtctgacagcagcagattctcgatggag

SEQ ID NO: 5262 - DNA, 1500 bp, Zea mays
tcacatgtatcgcctaaaataggtaagttgatggataagtatcgttctatcaaatagttatgcatgccaagttttgagaaagttttgagaagggtgtgtgggccaagagggggcatgcttaagctatacagtatagcaatgttttacctcatggaacgggggagaaagataataccctgtttggatgtagatgttggagtacgagattatgaattagaatcagatttccagaattatattgtttggttgcatatgaaattgatatttataatcagatatcaattctctgaaattggactataactagaaactcactctctcaatacagagcatcaatcctttgtattgagtggaattagacgacacaattccaaactccaatttagtgacatccaaacaatataattagaatcacaacccatttcaataccatggttgatttgtaatctaaccagattcaatttcactactcagttgattgtgcattgctatattatatgagcggactttattttaataaggcataaaatatatgtgttttattggttaagtgggtatatgtgtgaagctagtgactaaggttcaattcaaatcccatcaaatctcgtttatgcacattttttactttatttttgcattaagtgtaaaggatgacacgtgactgatgctttatttgggggtgtttggttgctcctgctaaagtttagcccgggtcacatcaagcgtttgacttttaaataggagtatgaaatatagacccaaccaactggactagattcgtctcgtcttttaatcttcggctgacaaattagttttataatcagactacatttaatacccggaacggaggttcaaacattcgataggacatgagctaaattttagcgaggtgtaaccaaacacccctttacagagaaagagaaattaaatcaaacgacactgaatccgtagatataaatcatgtttgctatattttttatatagttaattaaataatttagaatagtaatagttttttaattaaaccgtaacaaataaaaaaatggaggaatacttttgtcatactttagctttagcatcttcaccatacagttgagtgtctctcggatccacctgtttttgctctgtacaaactttgcttaaattacgaaagaaaaaggaaaaggaaaagtctctcgagaattcgaaataattggaattagatcgtcgtggggattccacatcgtaaccactgaagacgaggcggcggacgagacggagagcagaaccgcgcagcgaagcagcagcggcgacaagccctcgcgtcggtagaggcgccgtccgccgtccgccccctcaactccggtagccgctggccgctgcaggtcgagtcccgtcgagccgactcggtaaaacctccccaaacctccacttgtatcacctctttggtctacatcaggacacgatccgactctgggtagctccgcagcgcttcccgatctgggtggccgcggcgccggc

SEQ ID NO: 5263 - DNA, 293 bp, Zea mays
aaatagcagaatcaaactttcacttaggacctctatatagattttcgctagtcccctccaaaatttcagaaccggccctggtggcagcgtgggtgtgggtgcatcagcgtcagaatctgttggtacacaggcacaaaagctgtccgcttcgaacccgggaaggcgatcggcgtaagaatccattggagcggcagcggtttatatagaggcaaaaacccgccggccgtcaacgtccgctcgaccaccacgagggagtgggctgtgactcggacagcaccaaaacctcgcccgcc

SEQ ID NO: 5264 - DNA, 1500 bp, Zea mays
taaagtcagctttctcgcagtgcaaaactgaaagcacctatagaaatgcttttagcggctttcagataaaattgtgcaaatatatatgaaaaaatcttttagtggtttttagtggcttccactagatggtttttagtatttttacagctcacaacccactatcgttttttatagttcacaatccacaacagcttttcttacgactacacactaaacaaatagacttatattgtaactttcatatttgatcgcaagttgaaacacactattaattttcctaaaaatatgtatacaaaatgtatacatccatataatttttgcactaacattttattgaatattttgtatcgttgcaacacacgagggatgtactagtttagattcataaccgagcaaagtcgaatttagtagatgcgaaaatcgaagccaaacccaaaaaccagtacatcggtttagtgtcagtttggtcgattattcactggctgttttgagtttaaaatcagcattttaaatatttgtctatgatatttagcaatatatttcctgatatataaagcagccggctacagtggcagctaacagccgaattgtatactgaaaatagctacatttttttctcaaaccgttatagccggagatagcgacaactattactaaagatttaaatcttggttaaaatacgtccrtcctaaaaattctatagacccttatttcggttttcttccatttctaaatgggtgcaaatagagacgtgtatgttatttcagagaaatagagagggaatatgtttcatacttatttcaaccaaacgtactacaattttttatggtgtcgtaattacttacaacttttataaagatcatgatagttttttcacacctcacgattaaacctttgttggagattgtgtacaaatatggtctttatctctttactaaaaaattagtttgaactctttttttaaaaaaacaacaatagttatataacttagggaaaatttgaaaacaaagtattttaaaaaccatgattttagaatatgctatggttttaagatgacaaaaatacaacaatagtattctttacctcactccatgtaatacttgttttggaggtaaagtataccgaaccatgatatttagcatacaggtggaagaagttagtcatatacaaaaactttggatttaggtggagttattttaaataatccaaaaatactatggtgactaacaaagtcatgatattgaaaacaaagtaatttaaaccttgagacaaaatacgatgaaagattatatggtattctataatatcatggttttttccaaaactcaaaaaaaactttgccttagagagtcgacgtatcactgagatgtatccaggaaagatatcactgagggaagaaagaatgagatgtatcgctataaatgtgccatctcgcagttagagtccgcaggagtgtatcactgagggaagaagtgaagcggaatatagacgccgtcgaca

SEQ ID NO: 5265 - DNA, 1500 bp, Zea mays
tgcaccggactgtccggtgcgactccagagcaacggctagtcggcgccaacggctacctgcggcgcattaaatgcgcgcgcagcgcgcgcagaagtcaggcgcgcccatactggcacaccggacagcaaacagtacctgtccggtgtacaccggacacccaggcgggcccacaagtcagaagctccaacggtcagaatccaacggcagtgttgacgtggcagggggcaccggactgtccggtgtgcaccggactgtccggtgtgcaccggactgtccggtgcgccatcaaacagacggcctccaccaacggtcaagttggtggttggggctataaataccccaaccaccccaccattcattgtatccaagttttccacttcccaactactacaagagctctagcattcaattctagacacaccaaagagatcaaatcctctccaattccactcaagcctttagtgactagcgagagagatttgccgtgttcttttgagctcttgcgcttggatcgctttctttctttctcacttgttcttgtgatcaaaactcaattgtaaccaaggcaagaggcaccaattgtgtggtggcccttgcggggaagttttgttcccgtttgattgagaagaagaaaagctcactcggtctgagggaccgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcgcggactcgtttctttattactaacgctaacccggcttgtagttgtgtttatatttgtaaatttcagtttcgccctattcaccccccctctaggcgactttcaatagtcataaaaaataatgagaccataaaatccacaggatgtcaacgtttcttctattttatttcctcttattgcatgagttacacgtgaaatcactctaagtatccaattttcaacataatcaataattcactttaccatttttatgtgggaacttgagattatcttttattaaatgtttattagtattaatttacttgcaatttcgtggtcgaacaagaatattttatgataaccaattaatgcattatccgacaagtatccgatatccgatcaaataatatctgtatctgtcacttatccgcccggataaatatccggtcgctgtatccgtattcgtcccgtttctaactatccgtatccgatcccgaatccgttttaaatacattagggtaggatacaggatgagctaatatccgtccgtatccgtccgttttcacccctactttcggacttgtttatatttctaacgctaaccccggcttgtagttgtgcttaagtttgtaaatttcagattcgccctatacaccccctctaggcgactttcaattggtatcggagcccggtacttcattagagcctaactgctcgaagtg

SEQ ID NO: 5266 - DNA, 191 bp, Zea mays
ggtagttgccaaatatgttgggggcaaacacaagggatcaaagacttgtgtttgggtacccaaggtgcttgtttctaatgtcaaagaacccaagaccgtttgggtacctaagaacaaggcctaaacttgttttgtaggtttatgcatccgggggctcaagttggataattggtagcgggtgcacaaaccac

SEQ ID NO: 5267 - DNA, 1168 bp, Zea mays
ggagccatatgtgttttttaatttcagctagacgtgggctgtatgggggatgagaatgtgaatgggctttacagaatgggcggaatgggaaagacagaacaataaatgagaatgacagaacaggtaacgatgacagaacatgagaatgagttatgcggggagggggaatagaaaagacataacaatgaatacgaaagacagaacatagaatgatgacagtatacggaatgatagactacccttgtagccttaataagtagcagagattttgtatatagaaatgtcaaaaagacatctttaagatgatctctacaatatatttgaggtaacaaatttacttttttttgccgctcaagtttgtccacgatacattaaattattttaattacttgatatattgtagcgacctccatttataatctggtcttgggtccttaaaactcagaaacggtcctaacatacgtccacatgtgttaagtatatataataaaaaagtagcgtagctacttcgttaatatttgcatttgcacaacaaatcgtatgtgccattacagattgtatgccccgttgactgttgtgctagtcccatgtaaaaaggaagaaaggtaacattggcacctttcactacaatcattcacgcaaaatttagaacagaagtacagaacacgcgtagcacgtgcgtgggagtggcaagcaatcgctctccaracaccacagtgcccagtccaccagacacccatatacgctatccgaattccgaaccaccgggcgactgcgacgttataacgggccgtggtgcaaaaattccaagggcttacgcttaccaggctgggcctaatcaatcagtctactacaagcagcgcagggttcgctcaaaaaaggaaaaaaagcagtacaggtagccggttgggccatacgcatagcatcacaggcccacacatgactcgagccagtttctctgctgtcaaatcgccgccacactgccgagtgccgacggccggtcggccgccagggcgcgccgctcgagctaccagacgatttcggctgataaatttggacgcgcgggcggragaaggggagaaaacgcggagccacaccccgtgtcgaaaccccagggcgccaagcttcccgcgggccaccgccgctgccgatgccggtgccgaagccg

SEQ ID NO: 5268 - DNA, 85 bp, Zea mays
aatatattgttttgttgtttgctgccttgttggactcatcttgccgtcgtgttcgttttattattgtacgtgaaagttgagaact

SEQ ID NO: 5269 - DNA, 424 bp, Zea mays
cgcctagacgacaagacaactaagtgtcaccttataaaaacatgatcaagggtacaccctcatgtaagtactgctaaaacttttttggggatgatctagatctcgttatgacagtataatgcaagatgcatgtttcttttgttgtacttggcagtaggtacaaagtactggcaacaatataagcgattaagttcactgaagtattcaattggaatactggaagcaacattttcagtgcaacctttgattgatattactccttgttttctagtcggttgttctgtagactttcagtttttttattgtttgaattgtattaacgttttctggtgtgcaattacatgctgaagccacattatgctaactcatagtttgtgtaactttccttcttcaatattaggtcactccaactggatactcttgg

SEQ ID NO: 5270 - DNA, 310 bp, Zea mays
gcagcagcagcattttcaaaggcagtatccttagcatcagcatcagaatcgccagaacaatcagtcaggaggaggtcagtttcagaggcagaatcagcaggcacctcgtcttcctgccccagcaagccagcagaacaatcagatagcaccagctcaggttggaaacagagcatgtttccactgtggagggcaaggccattgggtgatgcaatgtccgaagaaggcagcccagcagcagtcaggccccaatgccccagcaaagcagaatgtgtctcagcctggaggctgaagcagtttaggagaccccggc

SEQ ID NO: 5271 - DNA, 1390 bp, Zea mays
gccttcaaagtggtagtgcccccgtgccgaattataatattattttttgaggcaattaattataacattaatttatattattattagtagctggtatagtatgggagtatcctgtttcggtgcccgaatcttttgactttgttgggtttacatgtacactacgcgtacaccaacgtcagcacgggcacgtgaaacggctttgcatgcaccgcgcgccctgtacgctgtgtgccgatgccgatgcagctcgtcgcgtcaagccatgcatgcaggctttagatcatcgttctgcgagcaatgagcaattcttttaattctgtctgcgacaagtcccccttccctcctgtcgtgtcgtgtcgtattatgtagcagtatactcttagcagtacgtgagttgtgagatgacattgttcttttgtttgttttgttttgacagagatgagagacgagagcagtacgtactgttcagcgcggaggtgcgtgccagtcacattattcatcgcattgaatccgctgcaaattataaatagctgtagtatgtttttgctgtcgagatgagctatagtccattttatgattatgtacagtatagagactagagagaggggaggcacactgtatacgcactaggactgtcctgctactgcctctgcctggaccagcgtcaggggggcagtgcttgcccatgcaccaccgacgcacttgcctcgcaaattgcaactgctccaatccaatccaggaaggctcatgaatgaggcatgcagtgcacagcaagaaagcctggaacgcaggccggaaagcaacgccactgacacgttacattacgtgctgtgctggtggatgtgacggtgtcggtaacgtgacgctgcacgtgctgttaacgtgggcatgccgctgtgttggcccatggaagccttttcagcccgcatcgcgcccatcgtccctcgtgactaagacaacacggcccgtcttaaatgttattacagcagccgcgtttttatcagcccaatactacttcgctggcccaggtttcctttttttggtagtcaccccagcccacatgcccccccgctttgccgccaccaccgcctcgaacgttcctgatgaaatggcgcgtctttctccacggaagactcgtgtcttccacctcattcgcgattctccccggagcccgccacgcgtccaccaccctcccgctccggcacacctctagacgatcttctcgccgccgggcggcggatatgactatatatatacgtatgtaacctatcgccgccgcaggcagggtaatgtagttgtccctagcaccgccgagctgatccatcggaaggaactagtcttgcaacttgcaagcagacaagtcaggtggtcctagactcctagtactagg

SEQ ID NO: 5272 - DNA, 150 bp, Zea mays
cggcctagcaaggagagggtcgatgatggtgatgtggtcgtgggggaacgggacctcgggtaccagtcccccgagcaggtcctcaaggacatcctcattggagactccgactccggtgacgataccgaccgccgctagaagttgtacgtg

SEQ ID NO: 5273 - DNA, 461 bp, Zea mays
tcagaactggattcatattccttgtaatgtctgcatggaaaactagtgctctcactgttccaaattacatttcactttagctctgtctaaagtcaaatttctctaatttagatcacatttatagaaaaatgcaccaacatcaaattagtttcattaaattattcatggaatatgtcttgacaaagcatttatttgaatttgtagatgttaatatgtatcatttttaaaacatggtcaaagtaagaaaactttgacttaagataaaattaaattcaaatgcaatttgaaatggaagaaccaaaggagtaactgttttatagtttttacttttgtcaaaacctccagttactgtatttcataggctgagaaaccaccgtggtaacttttgtgagcattagtttcatatctagtcagaaagtgtcaaacagtgtgttgaatcaaatgataatgttttacctcag

SEQ ID NO: 5274 - DNA, 1500 bp, Zea mays
aagttgtggcactagatgcttatattagatttttaatagagtaatatagaagtatagattaccagattacatgatatgcaaatatcgattccaaagaatatgggaagcagatattgacgatgtacgcccaggcttctagtggctcctccctccaagcagcccgcaaaacctggctccccatgcccaaggcccaaccagaccttattccctcccctcccctcccctccctttctcccctgactcctgctctactggatcctccgcctccatcgcctctcgcgcctccatcgacctcggcgcctcgtccgtcctgctccacctcttcttacgccggtacgtggctatagctcagtcgctcccacggatccatctccaggactccagccccttggctcagctcatgcattactgaacgcagttgataaaccattcgcgtgctatgctagatccctccggtgtcgccctcgagccacctaactgaaatatcgtcgtcgatgcgtgggtctgctagcagatggcgcgccggccccgcactgaccctccccctatccggagaccgccactgccgtgtcctgtctcttgtgttgatctccacttgtcgtcctgtatgggtagcaggcagcttgttgattcgactgcgcgtccagcagtagcagcttcaaacaagtacctgtgtccgtaggaaaagcaaacagttgattcaaccgtctgtttgcagacaccgccgacagccgactatttttctgggttccaacatatccaatagaagtgaacaacaacacttgggctgtttatttctatcttcgctgaagggactatatgacgctaacattggcacctcgtctagaacagattattattcttcctgtctcccttgccattaggtgtccacaatgccagtgagtacaatcgagatcggcacaaatggctgttgccagtccaatgtccgaatcaccaaatttattccaacatgttcattttagaaacgtcaagaagtatttgaacgtagctccatgggacacccttttgcatgttttttgtttgtttgtggctatagactcaattgctttaactatggtacataggaaattaggaatatatgatgaccatctccaaatcatataagatgggtttggctgtgagtagcaatgatagaggggtcctcctgtcactcatgtaggacatttgtattctttttgttcagtcaagttgctgacaaaaaagaaaagagcacctaacggtagaatgaaagaaaaacgaattcagtgatgcatatggaaagtgcttagttcccgccgaaacagaggtttcccttactacctgctatcaagttaaataaataacgaactagcaaatctctttgaatttggtatccaaccttcaaccatttctctgtcctgttttttttttctcgttcctgacaagctgtagtaacgttgctccatgacagtgcaaaaactaaccatcgtgctacggcttgccagggttaacatttgaggc

SEQ ID NO: 5275 - DNA, 525 bp, Zea mays
acggatcagtcagttgagcatccgtgatgtgcttctcgtggttctgtgtctgagcagcgtagcgtgactgatcatatgggcacacaatgcagttgtgtaccatgtgcatgtatgtgttcagaaaattttctgttgacagattgaagctggagagtacgctcaagtttgacactgttacgtattctcttttttttaccgtatcactcatctactctcctgatacaagacatttgggcaagtttgtttggatactaaggataacttattgcacaaatcaaacagccacaagttcatttgatttcgtggtgctgcaaaattgtatttttgaaaaaaataataatatacttactttataggaagaaaaagcctggccttccaagtcaccaccaacccaacctctgacgatcaccatcgccgctagcctccaccaccaacttcccatcgcctccccctcatctccccacactcctgacctcacctctccgaactgcagcacctcccctcccgccacccacacgtgctccc

SEQ ID NO: 5276 - DNA, 1500 bp, Zea mays
gacatctgaattcgagctttatatctgaaattgctagtcggtgtgtgatttgtgatgaaccaagcagcgccggtgctacgactgatgggaacctgcttacctgccactgtcgaacttaacacctgtttttttgactgttcgtccacctgaagatctgaaccgctgatgtgcggattgacgtctgtgcgttgctggtgcgattatgctcccggtctcgggtagtatccatgcgggccagggaaaacggatggggattcccccaaccagtttcaaatgctattttaatccaaaattaaaaacggcaacggaataaaaaaacccaatagtaacggcatgaaggtaaacgatataatcggttgggtaattaaaattaggaatatctttgcatttaaccactctaaatacatcattacgacattacctacaaacttaatatattaattattatatataagtttcaacatgcatgataattcatcatttcaagatgccatgaccatacgacaacggctcaacaacaatagcacagtttaacaaacaagtttataaattacaatcataaataagttcctaactatcaagccatagcatgaggagatagtagttcataaatttaaaaacaacatcaataaatgtgtctcgactgcagtaacaaacgcaaaaacaataatctatggttcgtgggcttgaatgcttggatacgtttaattttctatacaaataacacgagaaataccaagtctagatcatttgtatggggttttggatcgagtgtggttggtgggcatgaacggatgtgtttaattacttatacaaataaaacagaaaatatcgacatgattttcgtgtatagatacagaattcgtaaatacggccggaaaactggctcaaccgtcttctttctcgttactaccactttctctcgagaattttctcatttatattttttcgaatataacatgtcgatttttacagcgtacgacatttttctatcctgttgctaatccgggcgaactagcaaagcagtgcaaatctggaaaccgcgacctgatcgcagaacgccagaacaggaggctcgggcccgtaccgtaccgcatccctatcattgccaggtcagcagcctatccgggtccgtcttccctaggccatacctacctgtcccctactcgcactccacgaatctcacctccacgtgggccacaccgaatctcacgctcttggcccgcggtgtcagtgccagggacccacaaggcggcatcgcctcgcgggccgccaggcccaggcgtggcgtgaccgaaactaaggaacccttttgtctcggccgggcgccccggtgtgcaaaaagattggcgacgaagcaaggaacgcaccccgaatcccaactcctgtgtccgccatcgcctcgtggcggtcgctcctgctcctgctgctgctgctgctcccccagccgcccccgcccggagcacgccgccggcgccgacgtcggcgcgtcgcatggat

SEQ ID NO: 5277 - DNA, 340 bp, Zea mays
cgtctgcttctcgcagctaatgagactgcttgatccatgctgctacattgagtaacaagtggaaatgtggtgacttggcaaaagttgttgattgctaaatgtttgataccatgtatgattagataggtatacatttagtcttaagagagtcacactaaaacttgaaaaagctaaaacttgatttctagactcagctagtgcttttggcaaccaaacccctcagccaaatagctgcatgtctagaggtagaggagtagactcctcacaccgggtaagtctagctaagtattagtatactcagccttgctagtggcataattttacaggttctctggaggac

SEQ ID NO: 5278 - DNA, 1500 bp, Zea mays
ccgaaaaaggtcacgaaagctgccccctcgtgcaacaagagggtccaccccctataggtcagatctttactcgtgttttgagccctcccagcccctacacgaggatctgtccccataggtcagtccatctcatgtgcacagaactagaagaaccagcaagtgtgagcttttttaaccttagcctgaaattcgctcacactggaattcgaactcatgacctaaggactgctactcataccgcctaaccaactcggctagaggcccttgcgtaaggattgtttgtatcttataatgctaattaccttcaaattttatctggtttactcagtttgcatatccaattaatctctttagattgttgtacttgctgatattagcattctgccctcatagctatttgatgtgacacttacaatttaattttatattcttagtttttatgaaagtaagcgtctattttgtactgtcttgactcttgcacttttttatcctagtttagaatactagaattatatgtcgtagctatcatgcagtttgcatctccatttctaaaatttgtttaggatgtaattagaaactctaaagtgcatctcgtgtattgttctgcaaagctgatcatggttttagctgattgctttatcctaatcctagaatttactagtaattccttgtctagagtacattctacgtttaggataaaatttatagaatgtactctaattccttatcgtacaargaaaaaaatgtcatagttatcttgcagtttgttggatttgtgactattgttgaattgtgttgtattactgtttgctaacttcatttactagcctgtacagattgatgtgagattattagcacaagtagctctttttttttccaagtatgaaatgttgatctatttatgttacgaccaatattggatatgacactgtactggattggaagaatgcttcgtagtgttgatataagtgcatgcctgcttatctttttgtttatgtttagctagtaattcctttcctcttcagccaagtgtctaacattaacttttacagtttgaatttgcaatcaatcgacattaggtgacggaatgcggttgatgattttttttatgctgattgcagatgttatcttacctcctgctgtccgcatcttcagcagcaccatctcgcaatgatgcctggatgtcttgatttggaggggatgaaacaattcaccgaacaccaaacttatcaacgccctccatgtcattccaaattttcgtctggaggggattcatcttggtcttgtctcaattatcgcagctgcgttttcagctctattttgtaaacatattgatgtacgatagctgatgtgagtgctggttcactgaaacgattttctgttatggcatatgccattttaatctctacagtttcagtatattgcacagtagattgtactcaaacatttaaaatttgattgtaccaaggattgagaccagtgttttaacactgaaaaatt

SEQ ID NO: 5279 - DNA, 1500 bp, Zea mays
gcaaggcgcgtaggtacgtacgttgggccgatggatgcgcggtatcgcaacgcattaacgatccatcatgacgccctgtcgtctacactccacagctgacaggtgtgtgttgatccgaaaacaaaccagacctggtgcaaatgccatgccatgcattgatgtggcaatcaggcaatatatatattcccctcccgtcccgtcctcctctcgcgatcctgcgacgacgatgacgtgataacaattactactcctataaaaaagagtcgtcttccattccaccgtggaatcctcccaagggagagagataaaaaaatgtccgaatttactgggagtatgggaatgtgatgatggtgtgtgtacgactgtacgttcgtcgtctcccctcctctgtcctctcacatggaagctttgttttcttctccatttgataagtataaataaaataccatggcagtcgtgctgccctgcccgcactgaatggtgactccaatttcgtcagtacctcgccggtcgccgtgcatccactcaatgcaaggagcgacgacagatgccctgtgctccacatttacactccctcgctagtcctcgtttcccgaaagattagaacattttgaacctgcttttattgtggtgcttctaatctaaacaaacatatccggtcaataaattgattaaaaaacattgaaaatatcctagttttgtagtatgaggtagccaagaacccttttcgcgaaacgagagcaaggacaaaaccgagcacgagaatggccgccaccgtcacatcacatatgcggttgagcgttgaggtttctgttcattgtagaaattgaccgcccacccgccgggacaaggtgccgtacagataatccggtggaacgcgatgttaattccggcgtctatcttggctgcctcttcctcctcccgattcagcgtgaggggccagggccagatgcggggcctcccttcccttcccttccgtccggtccccatgggccatggcgtcgcccgctatgatttcttggcaaaccactcgcgccgttgcctcttaagccggggtcgccccctctctccagtctccacacagtccacacgcacggcttccctctcctcgccgccggaggcgcgccgcggaagacgccacaatgagtttcgtcccgtccgttggcgcactagaggatgccctgcctgaccctgcactgcaatccgtcgccgggtgctgaccaggcgagctcctgattcggagccattttgcggggttcttttggggggccccatcgccgtgcttcgtttccctgcccgccttggccgtgcattaatacccgcttccttgtgatagtcctctccctccctccctccctccgccctcacttcccactcacctcgcgctcgtcgcctcggctggttcggttcttgggagtgtcagtctgctgccggttgcggtgaccggcaccggcacgtagacgcagcacttctcggagaccatctgtctgcgccgttccg

SEQ ID NO: 5280 - DNA, 251 bp, Zea mays
ataatttaatttaatctttaaattttataatgtaaaatctagatcatattaccatctttaatctcataccctatatatcatccctatttaaacttcaccataaaccgtgtgagactgttttacaaaaggcactaggcaccacctttcgtggcttcctctgctctcctccacaaaggcagggaagcagcaacactgtagcagggaggagagggtaggcagtctgtccactgtccacgctgcagaagagagag

SEQ ID NO: 5281 - DNA, 265 bp, Zea mays
atggccgtgatgcgaacttctgatcctgctcatcgaattttgactacggattactactttttaagactacatatccagtcttgatggctgaatgacgaccctagttatcgagacgcaaaaccttttgttgtatgtgttccttttacagacttccttggcttgtcatgaatttctgatgtgaacttgtgctgtgaacttgttgcaaaacctcttgaacctgaagcattcaacatgctgtgaacttgtgcagctgctcttcttctgc

SEQ ID NO: 5282 - DNA, 1500 bp, Zea mays
tttaggtttctatttaagataaagaaatgaacccagttgaagaattgagctacaattggatattaaaagattcaatccaaaacgcgtgacgccgccgatcccaaacacggccaacgaatcaaaagtggtaagaacccgtgaaaacatagcaaatgtctgatcaccgtgcgtctgggttcttggtgcacctaccaatattcaaggcgggtgacgtgtgagcaccgagcagcggagggggcggcaaaacatttcttgtttgtttattgcgccgaaaaaactaacagacccagaaaaggacagaaagaggctgcacagtaggcgcgtatatttggcagcaggagcggcctcgtcgtgccccgtatcctctcctcagttgcttcgacgtatttctctctctatctatacggttccgaagaaggtagagagagaaactcgaaggggagaggacagaagagggagatacaggtacactgctcctgacccytcctcgattggtcagttctgttcttgagcgcactgccaccacagattggacggcttgtctgctctccgttcccggagtggcgtcgtgctcactctgctgggttgctttgccttatagtcttgctctgcggtttgatttgcttcatctttttttttcttcaatcttgtcactcctaaggtttcccccctctggttttcttgattccccgcttgggaatttgtgaagtttaacaggattttttttggctgagttcgcatgtttctgttcttggccatgcccatgctatgcttgcttggataagctttggcttcagcctagctcgcattgcacgatgcgttgttcctacttcctagaatccgatcgcaagtcctatgagctgaccactatttcgtggattgcccggggcgtgggctgctgatggtttcggcaatttgggtgggtgggaatctgcaatcccttttctattctagctaggattagatggcttgaatctaaattgtgcagactctggtgattataactgtctgataaagggtcatcttgagggtgcggatatgcatgttagaacttcaggggagtgtcgagtcaggcttatcagtgcctaaacttgttgatacgagctaaaagtttgctgaagcatctttcctgtgaggacctgacaactgacatgcacaaaattagtgggataaaatgctgatccactcttggtaaaaacaaaggttctctatagtgttttccagtgtccaaacatctgagatgggaaaaaataacttgccattgatgataatgagataatccactgaaagcagataccacttggcactctgcctggaatagatgtcaatctgtaactgatagagtagggttccgtcaattacccttgttctttagcttgttactgtgaattcagctaattcaatgcgggctacttgccacaaaggttaatttttaggtaccagatcatctgatttctcagaagcaaaatgttgtttggagctcagtgacaccatcttgta

SEQ ID NO: 5283 - DNA, 1500 bp, Zea mays
catgggctcagcggggaggcaggggcttgagtgcttcaccagatgcaagacagtgcctgccgaggcaatgaccgcaaaccggcgatcgaagatattgtttttgacacattgaacctaaagcaaaaaacctctaatatagcaggttagagacgtataagacctatggacgtgttcttaatagactccaacgtaatatacggtccaacaaaacaaaacatggtaacatagtatcagagtagaatctggatgttgtattgtttcgacaatttccattggttccaaaggagttttaaagtgagactagttaggttaaaaagtatatccccttatctttccatcgatataaaaatcgttgaaacaaagtctatatgcatcataagcatcaattttggtgagaactagtcctgaagttcgaagtcgagttgggtttgactctcgcgtgatgtagctgtcctatccaaccctcctcaaccttctgatctttacaagtttgtgtcggtccacttaggtttttaatcaacaaaaatgctctccactaacactaagattagaaaaataattaactagaaaagaatatacctagagattcaaatgacatgctcgcactattgtaattggaccttgaaatgtttctataccactatataatccaccggtttaaattttgcaaaacacacctaatcaaatcatccatgcacccataacctccactaaatccaacaaacaaatttcacccagacttaacatgccatcaaaaccaacgattcagatcgctgcataatccctatctcttacccactcaaatttaatgagcaatgttatttagatcacctctcatccctccctctccctagtgaccccgcactcctagcctctcccttcctttgcgtcccactgcccctctccctcactcgtcaccgtcgacgtccacatctccccttgcgtcatcgtcgccgctgacccctcccttcccctctgcgtgatcgtagcgttaacacgtgttatatgctagttagttttcaaagcaagctggtaacgaactccaagattgattgtgaacgaaagagatatcaagtattaaatgtacaactagtgttattgtaagactatagttttagttggctatatctgacatggaaatattataaagtctattgttggctatattattgaacttgttcgaaaactccaaattgctcactctgccatttttcatgattgttttactcttttgtgatgcaagtagattcgatcgactcagccgaggccatccaaagcactaatgaccagaccataaggcggcccgtttgaagacggcccatcgtacttcacctagaaacatcaccaacggcatctccaagcccactatataaacaaccgcttcgcccacccctagggttttccgtgccgccacccagccccttaaccctcgttcctctagccgtctcgcgcagccacagcctccatttctcctccgacggcggtgcggctagctcaacc

SEQ ID NO: 5284 - DNA, 346 bp, Zea mays
caatttctctttcatttcccatcccaactaccacatgctgccgccaagtgctggaattcttgccgcatgcacgttcttgcacatatttttttttggaaaacgttcaaccacatgttgtcgcatgtgaaaggctgagacaaaatttcttttcgcaaaagccagtatggtccaaggctgccaacttttatttttacaaaagcaagtgtccttctactcacggatgcaacagcaacaggtgacaaagtttgtatgcaagtgtctgtataaaaggagccggggatactacaaattgaagccaaagctatgacaacacacttgagaacacactgcatccatagagtttccc

SEQ ID NO: 5285 - DNA, 1500 bp, Zea mays
ctacgccctagctagctaactagctcctgtggattcactcacgaagcaagtgatgtccacacgcattcgggtctgaacgaacgcatggcagaacctccgaattcccggcgttcttccggataacggtcaacgataaccatgcgtgttcttgttccagcataacatatagttgttttcaataaagcagggccgaaataggtatggtctaacgaaaacgaaaagaaagcaggagtaaaatcggaaagcctataaaatgaaatgagatatcctgccgaaatcggtactcgtgagtcccgatctaggttgtagtggtagaaactctcaaacccagtgggttaagcaacttaacctcgcactgagcccggacaaacagataacacgaggtcgcttagtctatctccaactatttctccttccaaatccccctatttataccttctattcatatttaaatatcccttcctcatccattcttgattcttcctcctattttttgtcctctccaaccaatccatccattcaacttcccttcactctttaactgaattatttatcttttatatatcagttttggaattttaaaaaataatactatatttgtagtactataatacacattgttatatattaattatactaaaaatattgattttacagttaaagcactaattaacgaaacggggagatgtgcagtggagcacgtggtcacatgcgctagcccgcacaatgggctccgttggagcggccagcactccattcctacaccggccgagggacaggaggaggaggccggtgtggtgttggagactatctccagcaaattttatatctcactctttattttaaattttattttacaaataatataatatatagtgtaaaataatattttataccgtcatttgcactattgttagagatgaacttatctccactccccacccgaccccggaaataaagaaagctcacgcttcaaccaacgctgcgtgcgtccccttcagcttcaggtaagcgcgcgcctaccattcggaccaggcattcccacggggcgaccgtgtcttcctcctcggtcacacaccatcgccgtcgccacctctatctccttctccgtctctcttatctattctctgcaggggcatcagcaataagttcgcggtcgcctttctctcctctctgccccagggcgagagacctaagccagaacagcactaccaccaccgccggtatataaagaggctcccttcgtcacccgtaccggattaccaacccaaccgaacctgtaccgggcggcgggcgcaaaaccgcgtggagcaccagcgaggcatcggccgacagcgttgaagctctacctagcgggatgtatttcttcatgtctggtagtataacaagccactgaggagagcgggcacggagcttcgatcgagcagtggcgttgcagcacctgagcgagaaagtgagctgaggctgggagagggagggaggggtcatcacagttcatcc

SEQ ID NO: 5286 - DNA, 651 bp, Zea mays
tggcgcagggccagcgccgctgagcggaacggcttctcgtgcgcgacaacggccacggcggccaggtgcaccgcgcattgcagcgccaggaacaccgtcaccgtccccagggcctcgccctctccaccgcctctgttgaccaggcaaaggacgagcagcaagggcgtagaacgcggcgagggcaccaaccgtggcgacctctgttcatctacatctcagacggaggagaggtagctgacggcgtgagcatcaggaaattaatctgtgtcggtagcgggtaatagagaaatcttttccattccagagtttggcctttctttatttttccaaattgtcgaagccctcccgttcgtcgaatccacctctgctgtgttttataatggaaaatttctcccagatgtgggagggagcagacggagaagccactgactctgactagagagcggccggagtgaaagttgttgaaagcgggagcgggagccttaccaaactgggctggcaaggcgtcgtcgcaggttgccggttcgccgctgccagcgaagcactcacctcgccgtcgtcctccggctgccgttcctgcggtcatatgtgacgccttacctgcagttctcctcgtccctcacgcctcaactcccgcacctctgagtctcg

SEQ ID NO: 5287 - DNA, 609 bp, Zea mays
gatctcgcgagcggtgctgataacgtgttgaagtatactcagtggcaaatgagaattgagagagaaacaaatgacagaactgtttgtattccacagatcattacacttatatacaagtgaaggggtgtatcccaaaaggggtgtcccttgggaaaaactgtcgcaccccttggattgatcacatatgtaatattttgtaacattcttcgcgccggattacccccaccaaccgcagcccgggtcgggtttcagcagcgcttgctttgcttagcggagcgacaccgccagtgatggatggccacgtaatccggtgtcggctcgttaaccacaaacgtccaagcgtcagagcgcgccgacctggcgtcggctggatggctgcggggactggaatggatggaacaatcaaaatcactcggcccatacgcgttgcccgcccatctctctctctctctctcttcctgcgcccacacgcacgtttccactccgaccgggccagagccccgccgggcagtttccgttcgctgttgcgatccacctcctgcctgcacatcccctcccccgagttcgagccggagggccgaagagtagatctgcggcggcggccagagg

SEQ ID NO: 5288 - DNA, 394 bp, Zea mays
tctaatttactctaggttcgccactacctgtagcgttaaggaaatatatctatttggatgacaacctctagttcgtcctcgggaaaaaaaaagctcctctctggactcccgtttgacaagtgtcacctattgcagaacgtgtggataagttaacgacgagtgatcgtgcgagtgcaacgtcactgtacctggtaagcgaattctcaactcgcaaaatcaacacataatgaattaaatctgcttcttaattaattacaaagggtggactggatcatgtagcacagcagaggatgattttgcaaatgcaagaactactacaaacttgtatgtatctatgcgactatgcacaagcaggaaggattcaggcagcaacgatctggctcttgaagtctag

SEQ ID NO: 5289 - DNA, 808 bp, Zea mays
ccggtaaccctacggaacttaaacaggggtattcttcgtatccatgactgtcaaatgacgatgggcagagacattctggatctctggaattaattattttcaatggcaaagacagacacttaaaataacaatttctagagttattttctaagacttatttctcaccggtgaaaataagaaagtaatgttaactttttgatgtcgaactttagacggtaagatgccttagaaaatgacactaacgccgcgaaaaataagtattttttacgtccactaaccgtaaaaatgcctattttcctatagtgataaagccttagctaattgatagttacgtttctccaaatcaaactttcatttttcagaacccgttggaaatgcacgcgctgcgctaagagcaaattaggacaagcaatcgcgtcatatgccaagtgcagtgtatatatataacaaaccttagcatggacagaaaataaaaattgcaccgaaaaggggacagattccattgcacacctaagcaaggtagccccttggatctccctataaatgcgcaggcagcaatcccattagagtgtggaagcagcacgcaacactgtctcctcccctcttctacctcgacccatcacctttgcatagcatatatagcgcagcagctcactgcaggcagacgaaacaccatctcttcacatcacatcagagcagagcagagcagagcatcacccgatcccgatcccgctattcccagcctgcagtagaagtagcagtcgcgccgccctgcccatcgatccatctggctatcatacctgtcgac

SEQ ID NO: 5290 - DNA, 691 bp, Zea mays
gataggctcagccgctcaggctggcacctgtgtcgccactcgcagctagtttcgccatcgtcaccctgtccctgcttcgccgcatcgatgaagccgctccctcctcacatgagctagctctcgccatcgcaaccagcaggcgcgggctcgtccggtgcgcgcggccggcgacgcagccgtggaccaccggcggccggccggatcgcaaattcacaaccgtccattccccggccgtggtgtcaccgtcgtgtctgcactgctgcccgtcgtcttatgcgtgagggacgacatgccactgcccacttgccacatccacatgcatgcatgtaataactgtatcggacccatcgtcatctcgtgcacttcagcacatgaacaaaaacacacatcacagtctaccactctaccagtctacctgcatggttcgctgcacagcagtgcgacaagttttacggatctactactggtaacgcagcgcagcaccaaaaacattttgtttcttggcacgtttgctgcgtaccagcgtacgtacgtacgtgcatgctccgcgcgccatatatacatgggaagttgggaacgaagaccccccaaggttataaaaagagcacgagatgcgtagtcgcgctcgtaacgtgcataccatttgaacgccgagcgatcgagcacgttagagggtagaaccgtaggagta

SEQ ID NO: 5291 - DNA, 680 bp, Zea mays
cccgcatcaaaattgacaggcatcatcgtccttggaaaacaaggatgctgacaccgcctcttttgtaaatcctttgacccacattaacattttttgcctgcttgtcattctctctctcttttttttttggtaattggccctgtaacattgaagttgatattccacacaacacggtggatgaaaccatatttgttcgctcttggatgagaactgagtttggcatgtactatatatttttctgtatgaaacctctgggttctgaaataagatgatgtgtatctgaagctgtgaattgacagaggggctctatacaaataatggagcagaggcttttgtaaggtcagatgttgtcatgtagtgtacttgttatacagagatcggtatgaatggttagcagatctttcttttcaacaatcataatatgaggtgtctggtcctccaaaagctttcggccacaacctgaatgacaagcactcccctgcctctgcctgctacacaggatcactcaatcattgaggggcgatagtgtcttgatggtttgaggtcatggtacaatgcaaaggatagtgtctcgggactaatccatttttcttacaatcctaaattttgtacccctaactaataaacatcaaggacaatgcaaggaatcatgtgagctccagcagcttgctgagctggat

SEQ ID NO: 5292 - DNA, 431 bp, Zea mays
cgcatcatcagctgttgcttcctgcggataagctccaaaaccctttcttccatccatggtcctctccgccctaatttattgctttccagcgtaccccaccatagtccacgctggcatggcatggcatgcgcgccccgcggtttctccgtttcaaacccgcgccgccgcccgaccggtccacacgccaggctatacgctccccctgtcatccacctcgtctcgggcggcacccacgcggctccagtccaccatcgaacgacaacgaccccagcagccagcggagcactcggtataaaatcacgccttctccttatcgttctcgaggccagccaaacccaaaccaagaacctgatcaatcaacttcagtcccgtccgtaggagggttttgaaaagccaacgtacacctctgagagagttcaaccggagcctga

SEQ ID NO: 5293 - DNA, 1500 bp, Zea mays
acggctttgatttccagggggcgctgccagagatggagcgggcgcacgaacgcggacggtaaccgctagtcctcccaacccccacgamcttcgatttccgcgggccaagatactccatgtctatgctccgacaagtggtgcgggaaaacattttttaaccttgcaaaaaaaaaactaggcgttctattgccgtccgatcaagaacttacgaattgctacccttacaagttccaaccgcctatgtatccggtaaaagtcgatttcgtcttgtttgcatttttcaccggaaaataaatcaaacaaaggatgcaaagtaacttcggagtacgtgctatgtggaaacaaggtgaaaatactattggggaattaaaataaacttttgatacgtacaatacaggtacatcagtgattttattactcctctccgttctcatgacgacacatgcttattcagtctccaacaatcttcatatgtgtatataaccgtgtaaaataccactttgcactgtaaaatacattatttacaaagtgtgatataaaaataagagataatagtgagtaagttgttgagataacttaagagaggctttgataagattttcccctccaagagctctctaagagcatctccaaaagctcctcagaagtctcccctaaatctattttttcgggaaaaacacaaaaacatgtctccaacagttcccctaaagcgctcccaactttttcatagcccttaaaacttcctcatttgtagctacaaatgaggggttttttgggctccctataaataatttgccgctttaagggatctgttggagaaatgattaaaatttacgccacaaattttttagatatcctttaaaactgatttttaggggtcattttctcggatattggagatgctttgaaagttaacttttgtatggaattttgcctctttcctcgcaggtaacaggtgcccagcgtttgcggacccgtttcagcccacgggcgcctacggtgcttgaaatttaggtccagtatcaatttatgcccacaaaccacaatgccagcccatgtatcaaaccctaggtgtcatcgagtccagcgtcaacaggcaacaggtgtcccagccgcgcgccgcacgccctgttgccttctctcgacttcgagagcaccgccgcacggcataacgctcgcacggccgagccccgacattctaccgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctggtactgactgcgctggcttaaattgattacgtctatttcttgtatcgttggcaagtaatcctcgccttacttgttcgtgttgttcttccggcagttatttttcttaacccggctttctctcgattgctgcgtaaagttgaag

SEQ ID NO: 5294 - DNA, 1500 bp, Zea mays
aaacatgcgcataatcaaaatggaccaaggtaataagtgcatgacattaaataagtgtttatcgatcggatttaccaattttccgatcatgaaacgtgagatcccggcaggtggagtcggtttaccgaccacgtgggcgtgggagcgaaatggggcgtagtagacgtcgattgggatcgcgacctagtacactaggatcggtcgtatcccggtcgagaaaccgggcacgggagcgggtttcgacgcggcggcggtggaagagtgagctccaggcgtgtctgggataaggggagcggatagggctaacatgtttaattgttttcttttttaccaacctaaacgagattagatttaaatatatactataactgattactcagaaaaaacatgtagttttttattttacgtgctcttgtttttataattgttttaatttttgaattttgaacgaaattttacaaaaaccggttagaaaaccggatcctagactagaccrggaacgagaaaccgacctgggatccgtggttcctgatcaattttgtagtaggagctatacatagaggtagactattcttaccgcctttgaagttagtgattatcactcactaagggagtgtttgaatgcactagagctaatagttagttgctaaaattagcggaagacattccaaacagtctaactaatagttcagctattagctatttttagaaaattagctaataattagccagctatttgttagctacctaattccacaagcatttttttaaccaactaactattagccctagtggatttaaaacaccgtctaaatataatagcagaaaatggccacgtacgatacaggtaagagtttttacacaagatcccttctttatttaacagttcatttttgtcttcctccagagttttttctattgtgtatgagtgtatcttacaacaacggcaaatggcggcaccaagagaggcggcttctcccctcatttcgttgttttttctgtgctcatgatcggcatcaatatgcttaagatccaccaataacaggacgtgtttggtagatttctaaatacagtattttataccatcgcattccacaagatttttaaagatctagtagcacttatgttgtcatttattcggtgttatcaagtcattgtcagaatgtctgtatacgctcattcgcttttaaataaataaataaataaataaacagaatgatgactatatatgttttttctaccctgatgatatgtctgtattctcaagatgtatatgtttgctgtttggagtagagataagttttacggttgtcacttgatctgtgtgttcaagcgattggcagaaggtgcagactcttccacgtggaagatatcaaagtaatttagccgctacaacttctgctataaattgttttgcatgtttcgaaatcactcttcaagagctagcaggctagctagcagccaccttgataagtaatttactcgagctgtcggtcttcc

SEQ ID NO: 5295 - DNA, 104 bp, Zea mays
tattatatatatatatatagtacgggcaatcggaattgaagcgacgggcaccggtaagcagtctccccaaacccaaacgccgcgactacagcaaccagccaacc

SEQ ID NO: 5296 - DNA, 1181 bp, Zea mays
tgttttgtacggtcatatacacgatagactcaccatatcctaatatatgccacatatctgaccccatgtgcaaataaataaaatggaaactgtaaagttagcatcatgcatgtcagcatgtgggacatatatatatacacttctgaaagaaacaagagaatgatgagctacaggggaaggaattccgattggatctaggcaggcacgatcgtcgtcgtgtaatatatagtattatatggtaatgtcaatggcagccaataaggctcacagtccatcattaaaaaaatcaggcagggtcataccactgatttgagatgagcagttggcgtggaaagcgtgttggtttcagatgtaacaactaattaaccgaaagtggttgatgggggatggaagacgagctaggagatgacagaataaaaaatgaacagtgacaataatggcattgtgacgatagtgagaaagatgtacgcatccgatccatggcagaattcaggacgaccatgcatgacagtaacaggatcagtactcatcagcatgcatccatggatcggcggcgttgtgctcgtgctgtttgttgcctgcctcgcatggcatggtatccttgcttgttttgtttctgttgccgcaacgcaaccaaacctctcttcatcatcctctcctcctcctttccttccttcctcgtagtttccgactcgccgtaacgctccttgtgtcgtgtcgtttcttgcagtcctctcctccctgcctccatatctcccacctcggccctctctccacgcgtttcacttcatccctgacgccgacgacttcctccccggcccggctgcctgtcactgtctctccccccttcgttcacgaagcagcaggtacggtacggtacggtatggttcgacgtccttttcatgcgactttcttcttcctcgtgcttcttcgtcgtcgtcgcagctaacaccctaggctggggctgggcctgggcgtgcgtgtttcttgattcctgctacctgctgggagctcgacgttccagcgatttctctctttctttgacccttgctacttttttttttttgcctcagaccagttggagaaagacgcgatccatcagatttcttcccttgtatgcctgccagttctgaacacgtagcaactcaatccttgttcatcgatcttgcagcagctgcagg

SEQ ID NO: 5297 - DNA, 1500 bp, Zea mays
aggtttttttcattaattatgtattcttctatcatatatacacacgtatatatagcatctatatacggtgacatgcacgatatatacgacgcgtgtacacatacctggattattaattaactaattagggtgttaaaggccgggaaagagtgcatgcgtaatgcattttcctcaaacacgcgcgcatgcatgagaaacacgtccacgctctccactgacactgcgtatgcaagtaaaactatataatgttgttcagttttaggccttcgtttatgctgcttttttcaggcaacatgatatattaggccaaaaactcgaactcaaaacctgaatctgcctacaactcaaaaccaaacgctacttttgaagaaccccctgcagatcgatccatatatggtggaactgcatgctctgatctctctgcgtggatatatatagagaaatctggtatctaattttacactttgaactcgtaaatctctatcaaacggaccctaattaatttaggtagctctagctataaccaccttcgtgtccatataaaaatacgcgaaaaataagctttgcatcctaacaactagctagctagctaggcatgtcgtgtcctgctccttcgtttgtttgtttcctgatgaatagtggcttgtaatttaacagccgttgagtccagatctgccgcggacactggtttatgtaggcattcaattgcaatacattactatctggkttcatgtgtccatggttgtcatatcataataatctttgcttcaatcagcacgtacgacaatcacacagtcaaacctcatcgactgactttctctgtgatgaaatgaaatgcagttagagattacctgccgagggcagcgcctccaaccgacgatgaccctgcagatgagcattgacaaaatttgagcagctagcggccgtcgttttcaaacgaagcgtgatgctcttgccctctgtgtctatatataatctatcttgttataatatagtattccacccgttcataaatatatgatatcgttaattttttaaaatattttcaccactcgtcttattaaaaataatttattatttattttcttgtgatttgttttataacttaagatagtttgtgtttaatttaaaatattatatatttttaataaatattttgaataagataataggttaaaattttcgaaaaaaggtattatatatttataaaatgaggtagtactagttgagatgacaacatgaaaaagaggtcaaatgacaagctggtaacgaaaaacgtctggttttgtcagaagaagaggagccgcccgaaacacaccaaacagcagaaaccgtcgtggtacaatctgtgacaagtgtcctttggcttggcatccataggccaccgccatcagcagtccaatacagtgacctgacctccacgcgaagccaccaccacaactccacaagatctagaacctaagaacctgcagaggagaggaagaggagcttggggaggag

SEQ ID NO: 5298 - DNA, 1500 bp, Zea mays
aaacacccaaaccctaactatttggctattggctatttgatgcctactacgaacattttggcaaaagaaaaaggtacacccatgttcctttactgtgttcgcccctgctctgcgcacttaatgatctgttgttgggttggcgtcatataggcagagtcagttagtaatcgagagagactagcacgagggtctttgttggtctgtctgattttttactttgggtttggttgcagtgaaaaggaaaaatccgtaaataaagaaatcaggtctagcattcttctcgtgcaactacaattggaaactagaaatgatatcgtacccatgttttttttccgtattaatttgttcggttgttccattacttctcatcctctccggtattatgctgggatagatcaactatactacactaataraatacaattgtttgtactccagttattgctgcagtgggcacgtccccagagctggtggatggggcctttaggtgttatgtcctcagaactgcagtgggttcatatccgtactccttgctgccaccacatagttttgcagtgggttcatcctctccgcagaccatgcatatggtcgtgcaaaacactgtttgctctccgcagaccatgcatatggtcgtgcaaaacactgatttgcactactgttttacagagtatagtttgaaataggaggtcgcataggaagtccgcagggaatagcctatacagttctgtgaaatctgtttgaaatgaggaaagtgtaacatatgaaccataccttcttataaccccactcgaaagaactttattttgactaatttttcatgagaacttctctgggacacagtatagggtgggctgtggggaaacaacaattgttagtagataattgatgttagattatataatggctaggttccagcgttgttttgattctagtagcttctgtaatctgtaagttgttaataagaggggtcctctacataaatctagagaggagagctgtatcagactataagcctaggttccagcattgttttgattccagtagtttctgtaagcttttagtaagagaagtcctctatatatgcctagaaaagaaaactgtatcatattaaaagctatcctttccctacatggctacatctgccactaaattcttgtgatgatgaaggggatgagtcctcaaccaacagtaaatgtgcgactgtgcaaacatcctccaaccttttgatatttcctataatcataacggaagtcatgctacataattatgtcttgacattcaaattttagttaatgtcgcctcccaacatagttttgttttatattattcaagtttactgcatgacaatacttcattcgcaattgtacgtcttctatgaaagaatggtttaccccaattttacctgaaatgatctaaataagcatgtcgttttgttccagcttaattttaccaatctcctaaaaggtagatatcttgtatctttttagcaggtattcagcc

SEQ ID NO: 5299 - DNA, 1082 bp, Zea mays
gttcccattatgatttgacctaaatcgacaatgttactgcagcttgataaggagtcacaaaataggcaggaaacataccacggccagtaccaatttcatgaatacatatgatttacaaacacaaacacctaatcttttggtttgctttgccaatagagtagcacaatgcacaattgacaacactagcttgatgttggcttatcacgggctggtaatgttgataatgaacagaattagaacctaaataagcacaggaaaaaaactgatggatgatggtattaaactaatttctaatttgtataaataaaaaatataaagtaaggcaattgacatgaaccagaatacaggttgaagtgttgaacacaacatggccttgttctgatggcattatgttaggttcagaacgttgtatatatcctgaattggggattggggggcgcattatatgactagtacatactccacacagctttaggcaagagagaaagtgtgagagagagagagagttattaatcaaagcaattaccagtcttccattctgtgccaacaatccatacaattgtacatatctatacaatttcaccaccattgaacgaatgtttaaattaccgttttatgaacactcggcacataccagcaaaaacagcaaaaaactgaaagggtaaccatccaggaaaatgcactacttttggtacattaacatagttgaagtgttgattactcaaagattaaggccctgcaactaaaaagacgcatttccatcttcaattgtattaatgaatacagggcagtaaaccacatctgtaaaccaagaaacattcagtgatggaggcctataagatgcgtcaacaaaatttgagacccgcaagactaactgcacagaaggttaacagcacgtcacaagcagattctccacaaaatccaaccatatgtgtgctttggcataatttaacatcatcgacatgtttttaacaaaatcctctccaagatccataccaagcacgaagccttcatggaaatagcaaaacagagataccttaaagggtttcaggtacaagaaattgacaactaaatcagacact

SEQ ID NO: 5300 - DNA, 531 bp, Zea mays
cctttgtgttcacgatcgacgattgacaagcaaatatactgtattacatatactttgtctgaacctttctaactatacgtgttctggctcccaatcatatctagattcaacacgatcatcgacatacgccctacaataccctaatatatctctctttacggtagtactttcgtttacgtaacatggttttgttactcgattacacaatctttcaactgtcttaaaaatattttggtgcattttaatttggatagttgttccatcttttatctgtctcagggttatttgagtgaagtaactcgtttctcaccgccattgaccaggggaggggggacaatctgatatcacctcggagcccggttacagcagaaccgtccgatcccggatccaacagctgaaacccggcatcttcgaagccctagcaccggcaccctatataaacctcgcccctgtttcaccctgcgtttccctcttccccccactacccaaacccaacaggcggcgcagcagcatcgccaccaccgtccaaag

SEQ ID NO: 5301 - DNA, 538 bp, Zea mays
tgttaggcttgcagttgcagctgccgttgttttgcacaaaaaagaggactgcacctgcccggtcaggtatttcacagaagtgtcggtgatgctgtgttcgggtagagatggccgatgaaggcaggcagccatgcgggcagatggatggagactgatgatggtcttccagactgaaattcgtactgcaccctgcgagtgctgggtccccatgcagatgagacgacggcaggcaagcaaggaccgatagagacaggagctggccccgacgacgatgagtggaataatatcagcctccacgggcccggtggaatcgctgtccaaacacacgcctgctgaaaggccccgcttctatttttgacgcttataccctcgctctgctcatcgaaccaaaccctacaccgcggcgacaggtataaaagacatctcccgacccgtgccctactcgccgccgccgccaccgccaccgccaccgccacctacgcaacaccaggcgctccagcagaacagcactcggagctcgcctgcccgacggcccacc

SEQ ID NO: 5302 - DNA, 1500 bp, Zea mays
tagtactagtgctctgaatttggtgtcttcatgtgatttaatttgctggtttcgaagtcgtctttgatatggaactgttgaagttttgacctccaattcaacactcatgttagaaatttccagtgcgcccgtgcaatcctacgtgctaataactgcgatgcattgggcagggaaacacgccacgttagcaaatatcctgcatggttgtcggtttttttttttgtacacaagacaatacaggtgcaacagaaatacatgtgaaaacaattataatacttccaagcagtgcctaacatatggttaacccgttgttttgaaacattcggagtgcgaagagacgtgtagacaaatatcatgtgtgaacgaataaccaaaaaaaaaacccgacgcacacctacacgttcgtacagtacaggagtgctttcagacgaccccagtttgccatttttgtgtatgccgcagcaagtacgaagcccattgacatcttagcgggggcaaagacgcaaatagtaagctgggaaggtatagtagggacaaaaaatgtcactttccatatagcgcacacaaagtttctacagcaacggcgttggagtaggatacgtactcattggtggacttgccgacacgaggaccatggaacgactgagggctagacactacaacccactcgggttttatagctcgcaaattagtctcgataattttttacaacggaaattattagaatatctgctacacaggtttccttttgaaagaggagtgatcccgcatgttctggaaactcccgcgctggctctggctctggctctggcagctcagcagctgctcggcctcaggcctcagccaagccagtcagccagtcagccggggaccgtgggtgagaggttttgctcgcgttcgtcgtcgcgcggtcgcaccaccgcagtaccggggctgcgagcggcgagcccggctgctggggtgctgctgctacagcgtggggcgtatgggtgagcggcagagagaaaaaaaataaggatgggggactcgggcggggccgcttttactttaggcgtagccaacatctgggccgccaattctcagataggagaaaaaaaaactactgctacaaaaacatgcatggggtgccgcgcagtgagtcgggagtccgttccttcctattcgctctgcgtctgcggctgcgagagagtgcggcaggggccgtcgcctttcggtttactctcccactgcccaagtttaaaaatagcaagcagagaaagagacaggccgcaaacggagggagagaagaagagacacggaggagaggagaggagcgggctagccagtctcgatctcaggttctcaagaaagaccctgcagggagagcgatcaaaaaggctgccggcacggccgggtagcagctacaactacaagctggcctatagctagctagctagctatagctgctacagccgccgagctcgatcctcggactcggactgcaacgaggaaggagaggaa

SEQ ID NO: 5303 - DNA, 170 bp, Zea mays
ctgcgctgcattcacgtcacagaaagccaaggcaaagttgccattgtccgtcctttaggctcgtccgcaatcaagaaaccaaaacgtcgccgtcgcctccaaaacaaacgatggagaagcaacaagcctcctttcctccgcattatctctattagcaccggtacgcgtct

SEQ ID NO: 5304 - DNA, 180 bp, Zea mays
cctgaaaacatgggagcatccgcaccaggtgcatcagtgcaacaaacaaatgggtccaattagacatgatttatgcatgaaggaccagcaacttattctggagggttcgagtggcaactcagttcgacaaaacacccggatctgccatgattcgaattgcacacgcaacatacctgtaat

SEQ ID NO: 5305 - DNA, 1500 bp, Zea mays
tgaaatttcccttttgttcttgtactatgtaagttgtaattatccatatgcttgtgaggttcacgtgcatgttttataatgtgcttactgctttctatgtatggcatcgtctatctgagaacattttgtgttgcagttaatgtatttatttttttagcagtgcattaacagcttgctcaaatatcatagacaatcaactgtaaaatgaatctgtgttccgacttccgagtagttgatacagtgaacagccttatagttggttctagtaggtgttcattgttcaactagtttaaaggaaggcaacataaggaacattagatttcaacaactgaaacctatccacctggcaaaaatcctcacttggaatggcaagccaaagagaagtctataataataagggttttttactgctcattgctaaccttagtttttattcctcctcaattttgtccacgaacccttctctccgctcagaaacgcgcccgcacgccgtttccgtctgcgttggcgtccctaacagcacggtcccacggctttcaacacccgaacgcgtgggtccccatcgagccccatccctcagcgcccgccgccgccagcaagctccaatccgctctgctctgccgccgccatgtccaagccacccmgccgcccactactcgtcggcctgctgccctgtctctagcccatctcagcaccatctcctcggcactatgaagccccggctccgctatcagttcttcaccggcaccggtaggccgctccaccgtgccgcgtcgccgccagggcacgctcttagtcgtcaactcctcctcaccgtctccatgcgcccccgccgtagtagatcggagagtagcctgcgcatatcgtcgccctgtccaatccaccgccaccgtgtctaatccactgctgcctctcgtccatcccacccatgctcccgtcgctgactcttgtctagcccacgctccggcaatccaccgtcgactctggtctagcccgtgctcccatcgtcgccctctctaagcccctgctctacagcgcgagctcctgcctgagcggcttcctctcgaggaagagggagcatcgatgctgtcaagctcccacccgtcgggcttccattagcagcacaaacgctgccattacagaggaggagcaactctccacggcggcaccagatctcctccacgccgggtcttgatagcagcaccaacgcatcgcgtactccgagcatctctccacgccagcgaggcagcagcacctctcctccaggctagactctcaaccgcactccttcaggtaagtagtagaactttctcctcttgtctttgtgtgtgttggctactaatatgtggtggattgtatatgttggataatatgtggtggattgtgtatcgagttgtatcaatcaaatttggtggacgctttgtgttggctactaatatgtggtgcatcatatgttgaattggtatgagttcttaccgcctcattgttttatgaaatagg

SEQ ID NO: 5306 - DNA, 1330 bp, Zea mays
gactttgttttataaaacacaaaaatatgtgttctattggttaggtgagtgtgaatgtgtagctaatagctaagattcaaacctcgaatttatgcataatttactttatttttgcattgagcgggaaggagatccgtgacgcaggacgaccgttgaaactggtgttttatatagtagagataagttttacgcgcaaggctttcaatgcatggtggaaactggtgatctaagtagagataagtgtaagggttcttttgcaaaatcaacaatcgtaagaaccgttgaaccatgtaaactagtattttaatattgaagacatatgtcatatgttcattatgcatattctactcggtaaggctaacataattaatttttccattttatttctgtgatatattatgatttttataaattctgacaaaccaaacataaaagaagaagaaaaaccactgagagaaacatccacgattttgatagatgagagaagaactatttttggtcttataatttctagtatcttggatcctttggaagcatcacaatgcttgtgtttttatgaggtttttcctaatatttccaagctctttttagaccttaaaggtgaggctagtttataatgtatggctggtgaggtgaaggtgttggagttgtagcctttttagagtttttgggttttggtgtctgtttgtgcctgccttggtgcagtttgtacttacttatttttaggcttcttttctttttaatataatgatttacatctctgtttgagaaaaaaaacttagaaaaactgacttttttggatagttgagaaacacaaaataaactttttttttgttaccccctccctcctccgctcctcgtgcggtctgccggccttgcacgttgcgtcccagcgccctaggttgggccatcgagacgttattgggctgcaaaaaaaaaatattgagctgggccgctggtgcgtactggcaccggggttgtccggcggagctcccactccgccaccgccgcctcccgtttgttctcaagattctctcccgccaccgctccgagtcccaacctccatcgacggggaggcgtcctccatccgggccggttagattcatcgctttgtagctggtcctcgtcgtttccctctgctgtggtgggagaagcgactcgcgcgcgcgatcggccaacaaattaagcacggggcagggccgtacgcaggaggcgagctctagggctctccggggagaaggttgccaggcacgccaggtgaacgccgtactgagtttgcagtccgggacgtagcgcgttctctggtcgggaggtggggaagcggagagcg

SEQ ID NO: 5307 - DNA, 1500 bp, Zea mays
aggagctcggccggagacgaccacgagagcggtaggcgcggactcgcttggcggcagcggcgtggagaagctcggcggctgtgctgtggatctcggtcggggagtacgcgcgcaggcgctctgctgcggtgctgcggcagcgcttgtcggcggaggtgtggagaaggtcgacggcggtgctctgaaactcggctggcgcagtcgcgcggaatcgctcggcggcggcggagtcgctgctccaactggctggacgagcgctgtacgaactggaaaaaaaatccattttccccactttgagcaaggctagaaatatttattcgtacgaataaacaaacttcttctaatatgtataaatacggtttgggaaatttgtattaatatggtagtgaaaatttagaagatgggatatagaggatgaaatttagtgtacgttgttgaagatracgaagatatagaggacgaaatcttttagaaggtgttgtaaaggagagagaatattcttttagaggatggaatttaggggacgttgctggagacagccaacaatccaatcatattgttgcagctgtagaccaacccaggatagacagatgataccataattcgaatgtacaaacacaactaaacatgctcactactcacaagaatgtatctctaccccttaaacccacccgttcaacttaggctaagtacaccacacaaaacatcccacgcacttatgatcccgctaaatccacacagcgttttaaccccagacaaatcccactgtcaaaaaccaacaaccaacgttccagatcaatttatttgtctactctctcttactaaaacacatccgacggtcattctttattagatcatccctcaacgctactcatcaatcatcaatcaatcaatcacccccgcgcccacggccgccaaccacccctgcctctaccacgagcaccctgcaccgccaacgcggcagcatccaccgcgaagccctgggccacgcgacgagcctgccgccctacgccacacgaccggggcaggttgcgcaagacgctcatgctgctcttccagctcgacgactccaccggcagaggcgtcgcgcgtccgtccgaggggccccaatcggcggagttccagtccgtttccgaaggaggaggccgagggggcaagcggatctattttcccccctggcacgtctctctgtccaccgatctccgccgcctcactgctcgcatcgtcggcctcacccgccgcaggcagctcgcccaggtttgcctcgcatgctctccttctcgatccactcctccagcagttgcactgttctattttttttttgcagtgctgagtgctgacctggggtgtgcggcgcagatcatggcggaggtggaagcagcgcggtgtcgtgtgcgtgggggcgggttgctcaacaccatcgtcatgaacgtggttctcgagccatgcgtgtgcggcggcgacgtcgatgtcgaccgagcgctctagctgttcgaggaa

SEQ ID NO: 5308 - DNA, 177 bp, Zea mays
cgttccgctccccagacgacttcgccttcctcgccgacgccgcgcatcgcggttcccggcgcgcccgacctccgggtgcaccgctgcgtgctctgcgcgcgcagccccttcctgcgcgacgcctttgcgcgccgcgccgccagcgccggcgaggaggagaaggacaaggacagttac

SEQ ID NO: 5309 - DNA, 1500 bp, Zea mays
tatatattggttagtgcaggtagttacagatgctgtttttttacttaaaaaaaagagagagaagaaactagacgtggtttagttggccacgataaaaagcaagcaaagccaccaccccctcttctagctagaaaagtagtttgcattcgttactttcaggtgcacatgtgaactactcacaaagttcaagcgaatgtgtttgttcactcgtgtttgttagcgacccatagtttgacgaattcaacgcacccacttggaccacacgtttttttcttcttttttcgcccccagattcgcatcacgagacgtttcaaacttgtctttgaaatgcccaagtctaccatcatgtgttccagtactgcttatggtcgattgaccagcggccaaaacgaactgcccagtaacagctcggtctcttgttgctgtcgatcggtgcaggggaggaagaatttcctgagctatttccagtgctgtaccagagcgtgaagaaactcccaagacttcttcttcctctgctgcgcaggtagctgcatgtttgggtttccttctgaactccagcagtgtgcgactccgtatccctaaaacgcgcggccgacacattctctctcctctccgtatccggctccgtttccagcaacactccccatcccactccgcatgcagtctatgacacctggggcccgccagcaggcgcgcgcgcccgcgagagagctgcggagaggagagagaaagcgtggaaatggggagtctgggtacacgccgtgcgttttacggagccggatacggagcctgctggactgatgaatagtgtgctagactccgcaaaatacggatacggagccgcatgcggagtgctgctggagatggtctaagcaacggagaagacacgatagcaatggtgtagattggtctggtcggtggtggcagcacatgttttcgcatcaaaagaggcacgtattttcgacttgcctctgcttgtgttgtatccttcggacatgaaagcaaatgccaccgtcagcaagcctgcagtccacaaggtaccaggagtacgagtacagcacagcggcacaagtactctagcaggtatacagcagactagaagcgctgacaaaatcttcgagagcgatgacgcaacagctgaccgtaacgtaacgggcactcatccatccaaccagagacctccaccccaccccaccagacatgagcagcctggcagaaacccccggcggccggcgaggctccactttgtccgacgcggacaccgtctgaccccgtggccccacctagctccctccctccccccctttccctttccatcctttctcctccggtcctcccatccccagtccccacgcgcgtggcgcctctcttcctatttatgcctccggtttgtgtttcccctcctcttcgtcagaccaaccggtacgcacaagtgcacatccactctgagaagaagaaacccaaacgatccagagaggactcccagtccagtctccgtcc

SEQ ID NO: 5310 - DNA, 1500 bp, Zea mays
tagttgaaatgggctgcgccacggagcttccaacgtttgtcacaagcttgcctctttaaattttgcaaaatttagtccttggttctcttgaaacattcaatcttcgccacatatttttctaacacctcttgagcttctatcagatattggtcttcaccaattactacctgattggatacctgcgtgtgtgcaaccggcctcacgcgagcctactcccgcagatacggaggtttcacgcatatcgggggatgtagggcaaaggcctcccgcggttcatgcatgtctggtcacctgcacacgggcaaacaaacacgcgcggcacatgccagcgcccaggctacccagctacgcgcaaccaaacacacagttagtcttcgccatatatctatctttctatcagctcttaagatttcattagttaatggtctccaatggattgttggtcttcacaaatattgatttaatggcactaagatttctatagatattaatcttagcatagggtttcattaaatgctagattattggaaatcatcaggacatatcaatcaccgttcttcagtatagtggtcactggtgatcttcaccagccaacgaacttcatcaacttactcagcttcgacagccatcaaacctctcaaccttctaacactaacgctttacctctttgtgtagattgtattgtttaaatatttttagttttttataatacatgacgagagtctaacataggggtatgttaaaccctcagattaaggacatcacggtctagctaacatccctgaccgattctcctaatcaaccgagggctcggatgttagattcattgtgcacatacactctctgggtcatcaacgggcggcttcatcgaggcgtagaggtcgtgctcgacatagctgtcgtagacgacgagaggaggatgcgtggactccaccacctccacctgcggctgtgggtccttcaactcgatggtgctggacaccgtcgcggtagacgtctgtgacctctgtgacgaccgacttcccaccacggcgaccgcatcgtgggagactcctccaccgagacggagtagagcgacggcggtggcagcggcaggaggtcaaggatatacgtctgtaaaccgcggacggggctcgggcgtgcgcagcggctgcaggtctcgccagcgtcggcgtcggcgaggtcgccgccatgggcgcgcggccgtgtggtcacagtcacagtggtcggagtgtgattggttggaaatcgaacgcgatgcgggcctgccttttgggctcggtgggccgtgagtcccattttgtttgggcggcaaaggaaacgaattgatcctactgatcatattcgtttggcttcaacggtcaggatttggcttccactccatgggcctttcgctcgacaagctcatcaaagccgccgccgccgccgccgtcgcctcagctcgctccggctgcctctgcctcccctgcctctgaggatttgcttggggagagacttatt

SEQ ID NO: 5311 - DNA, 655 bp, Zea mays
gacggtgatttggagaaaactaaatgaactcgacacgatgaatggtactaggtagcttgtcttgaactatttatgtggccaccaaagtatcaaatgtttggattgttattgacgagaagatgcactgatcagcccggtttttatagttatttgaggtaatttagtagcacttataacttccctatgatttagtcattcaagatatgatgtttaatgctagatttaggtactgagtttggatgacagaaaaagtgcaaatgccaattgaaaccaggagaatacagaattgcaatggcgcagctgaacatttcccaatctgactaaaggtgcctacagaccccaaaaaaatggagactaaggccttgtttgtttccccattagattatataagttggattgtggtagaaagatagaagggtaaaatatcactttgagattacaaataagctaaaataagctatttaatactagcttatttgtggtcacaatgtgatattttactcttctaccttccaccataatccaacttatataatctaggagtaaaacaaacccaccctaaatatatgggaaatttggatccataccattaaaagatcaccactttggatccataccattactatctcacttacatgtgggtccacatcagtca

SEQ ID NO: 5312 - DNA, 521 bp, Zea mays
ggtatgttaagccgaagcctctctctatataaatatatctggataatgtatgctggacacccgtctattgtaaagtttactgttactggtaatggggtttgccgtcctttcctgaatgctgctacagtcttcttgtcaatggagtagcctgctactccaactccattggggccctgcttctaaaattctgatagtggatgtcggtcagaattttgtgtgatgacatgatcttttatttggtttgggatctgggcaatagacgaataacttttttttttacgtgcttttgatctgcaacagcaggttatgctgttggtttgtatcgcagtcagtttctgaagtcctgaagtcgtcttcctccacctcgaagcaaaccagcaagcagtgcgaagttagtcgccggccggcagcgtccccctcgccccccaagtccctagtggttgacactgacagaggtctgcagagactagcggcgatggcgccaccctgccccgaaccctaaccccactccaccaccggcc

SEQ ID NO: 5313 - DNA, 1184 bp, Zea mays
tcacttcgagttgttagactctaatgaagcaccgggctctgataccaattgaaagtcacctagagggggtgaataggcggaatctgaaaattataaacttaagcacacactacaagccgaggttagcgttagaaatgaatccgagtccgaaagagaggggaaaacaaatcaaccaagaaataaagctgatgaacacgatgatttgttttaccgaggttcggttctaaagaacctagtccccgttgaggtggtcacaaagaccgggtctctttcmaccctttccctctctcaacattcacttagaccgagtgagttttctccttaatcaagcaggtcacttagacccacaaggaccaccacacactggtgtctcttgctttgattacaattcacttaggaacaagaatgaggaaggaagaacgcgatcgaagcaacaagagtgcaaaagaacacgagcaaactctctctctcaagtcactaggtggttggaatgaattctagacttggagaggctttgatcttttggaaatgtgtcttggagtgaatgcactagctcttgtattgaatgtgaagtgctggaaacttggatgcttggagtggtggtggttgggggtatttatagccctcaaccaccaaacaaccgttgggggtggctgctgtcgatgggcgcaccggacagtccggtgcgccaccgaacactgtccggtgcaccagccacgtcacccaaccgttaggtatgtgacgtgttggggacttgttctcaaatgctaagaattaagaacaaggcaacacaaaaaatgttaagtgttaaggtccttcgtcctccataacgatatatcccttcgggatataaagcatctcggacgaaggttacgaaggacataccttcgtaagcataacaacgaagaatgaagcattcacataaatcatagaatatgaaataaacatttaaatattgtcatagaattatctctacttgtattaatgaatataaatgactttgaattacaaatgtaccttcggtcctgcggaaggcaaaagtacaagcgtgatgtgaaagcaaatgacaggttcacgtgaacagtacagaggtactgttcatctatttataggcacaggtcgcagcctgtgacaaattacaattatgccccttgcgaaagtttacagcattgactcagacctat

SEQ ID NO: 5314 - DNA, 181 bp, Zea mays
ggagctatcacatcattttttttaatgatgaacgcatataaaaatggtttctgaagaaatgactctgagatactttcatccttgctacgtgtttcctaacatgaattggtagatagagcttcgcctgttattttcaattgtagttgatatatccctataactgttaggtgccgcgtctgtt

SEQ ID NO: 5315 - DNA, 326 bp, Zea mays
ctgcagtatctacattctggtcggcagacaccatgcatgtctctttcgacgagccatctgtactgtactgtactgtactacatgacgcagaaacaggacaggccaacagcaggaaaacgaagggacggcagtgcgacagcgcggccgccgtggttgttgcatcgtgcggtggagcttcggtagcgccctcgttatttaatggctcgcaggaccgtgcatcgctctcgctccgtgtaggtttattgcatacgtactagctaccactgttggtctgtcacgccggaggcaggtcgcagttattactttaacccggggccccatcggcg

SEQ ID NO: 5316 - DNA, 1125 bp, Zea mays
caccggacagtgtccggtgcaccagactggctctggcgaacttgctgttcttgggacttcaacggcagtgtacggctataaatcaccggactgtccggtgagccgttcacaggcgaactcgtcgctctcgagagatgattaacgacgtacggctataattattcaccggactgtccggtgatgcaccggactgtccggtgagccaacggtcggctgggccaacggtcggccgcgcgatctgcacgagacacgtggccgagccaacggctagaaggaggcaccggactgtccggtgtgcaccggatagtgtccggtgcgccaacggctctcaatctgcaacggtcggcttcgccaaataaggaaggatatccgcacccgacagtgtccggtggtgcaccggactgtctggtgcgccaggcgactgaaggcaagaattgccttcctacaatgctctcaacggctcctagctgccttggggctataaaagggaccccttggcgcatggagaagacatccaagcattctttgagcatagttgatcactcacacttcgttcttgcgcacttattcgacattcttagtgatttgagctccgttctagtgagaaactcgtgatagtctcgtgagctcaagtctgggtcttgtgtgtgcgtatttgctgtgatctttgtgtcttgtgtgagttgctcatccctcccttactccgtgcttctttgtgaacttcaagtgtaagggcgagaggctccaagttgtggagattcctcgcgaacgggatatagagaagcaaagcaaaacaccatggtattcaagtgggtctttggaccgcttgagaggggttgattgcaaccctcgtccgttgggacgccacaacgtggagtaggcaagcgttggtcttggtcgaaccacgggataaaccactgtgccatctctgtgttgatctcttgtggttattgtgttttgttgagactcctctctagtcacttggcattattgtgctaacacttaaccaagtttttgtggcattaagttttcaagtttcacaggatcacctattcacccccctctaggtgctctcaattggtatcagagccgttctcttcacaaagggactaatcgcccgaagag

SEQ ID NO: 5317 - DNA, 1005 bp, Zea mays
tcgctggttgtctctccctccttccgccgcaaccccagccgggcaagcaaatatccccgccgccggctccaactcctccgcggaggtcgtcgtgcgccactcctcgcggtcgcaggtcgcagctgccgcggtggttagcctctcctctcccttcttctctggctcgtgagcgcgggcctcgtgtgagcacgccgcgcccccacgcgcttaaaagacccccgcggcgcggtttccacttccacccaaatcccgcgactaaaaaaaccgatcgctcgaaattgtttatttatcctcgttttcgctggcggaggcggaggatgatgggaggataaaaaaattaatttaatggtcgggggtgtgggtggggcccgccataaatgcttcgagagaaacatgcgcacgtgcttcgtgtggtgtgggggtggagtggaagtggggaggaaaaaaaaacggttttctttttggacattggccctgtttggcacagcttattttcagcttcttcacaaatttaagcagaagttctgccaaacagtcagcttctgcagcagcttatcagttcagctgcttctcagaatacactaaaagcagccaacaagcagaagctgctgttcaccagcttctcagataagctgctttttcaataagcagcagctgtgcgaaacagggcctataagttgaggctgtaactgctagtcgttgctgatgtgacatggccgatagagggatggtggaaccggcctaaaagagacgggccacaccatgacgaccaacgacccacggggcctcgggcacatttggtccaaggcaaggcctacattcatccagcacagcctacacggcccagtctctccggagaccggagcgacgagtccgcgagaccgccaccgccacccagcaagccgagcggcgccaattctgcgctgccatcgtcttcctccgtcacacccggctcgcaaaccctagctcgccccggccccacctccggccccgttcgtcggtgct

SEQ ID NO: 5318 - DNA, 444 bp, Zea mays
caatatgatatgtcaaacttttggttttgatatttgttggcacatgatcaattttagccctatatattttcgttttttatataaccgcctattcagaaaagaaaaaaagaaccattatttctgattctttcaaccgccgtttcaaaattcccaagggcaagtagagaagaatcgaatgctgtgattataatccaatcgaatccaaagaagaagaaaaaaataaggcctttccggcccggttatagtattcagcaggcccggttcaggaccaaaccagcggcccaccagaccaagcacgctttcttcttcctctactcgcgccgccgcgtctcaagtctcaacgctgcgccaaaacggcaaaaccctaccctgacctgaaccccaaacccgccgcgcctcctcctttctcgtactgcaattcgggactagccgccgccagtctcg

SEQ ID NO: 5319 - DNA, 97 bp, Zea mays
ggtatatatagtctatttcttgacgggaacattttctctagattttctctgtataaacattaatcacccatagtgttctaacaaggcttcactttag

SEQ ID NO: 5320 - DNA, 511 bp, Zea mays
gttagcagcaggggtaaagaattttaaatgtctcggtgcctgctcaacttatctcccataacccatgttttttcaaaactgaaatcacgaggaaacttataattgcccatgctcctgtccagccggtcccacatacagccttaaaaacacaacacctgccatgttggccctttcaagtttcaacccccacccacagcggcacagcgcgcacacacagtagctttggatggaaagcgaaaaccctccaaccaggctccagtaagagccacgtgcaccggctatcattaaagcaatcagtccaggcgttaagacaatcagccctcctaatcccaccctaatcagctcctccacctcccaaatctgccattatatcccaagattccctgctcactctatttctacagcttctagtactctccgcacaagcagccccatccatgatagtgctgcctctgagctaaggtgctctcacctacccacccgctcaccctgaccccagtccccgccggcg

SEQ ID NO: 5321 - DNA, 168 bp, Zea mays
tagagacgaccgtgcccccagcctgtcagacgccaaacaaaaccctcgcgcgccaaaggccctctcaccaattccccaatttttttgtttccattccacaaaaccacaaccgcgcggttttctccctcccccgactcccgcggcgcaagcgcagcccacccaagcgcc

SEQ ID NO: 5322 - DNA, 619 bp, Zea mays
gtcgtcgtcaggaagcccttcctcgtccctcaccctcctctctaggtctaccccttgcgtcgcccgtttcgtgcttctttagccacgttttgatcagatcgtccgttgccctctaataaaagcgaacattcagttaatcgattggcgtaagaggcaggtggcgtttgtttgaggcgttccagggtgtggtttcgtgaggcaaacgcggattattggtttactcgcagttgtgctagggttcagtagtttcttccggatcgatacggatgctgctagttggattcagttcacatggcgtattggcttgttctgtgtagtttttgagttgtcaatttatctcatctgtttgcaaaatctgtaatctggtttagaatgaatgtgtggatctcagagactcagacctgtagaacttgcactgatatgctactgatactctccttaggtagttggtaaaccgaagcttgctgacaatttactctatgtctattgtcttggcaacttactctatgtagctgtgcaccaatgtattgaagttgacttttaattcagtcccacaatggctcttttctttatttttgatttgtacatttatttttatgagtatcaacataagcattga

SEQ ID NO: 5323 - DNA, 1500 bp, Zea mays
acttgttcatgcagtgccctctttgtgatcatgaggtggaaaccatcgaccatctcctagcatcttgtgtctttgctcgacagttctggttctatctgttccaacacgttggtatccaccatttgtccctacagcttaccgactctcatcctttgctttgtgtcgggaaagatcaagcggcgcttctgcggggctagcaaagaaagggataaactcacttgtgatcctaggagcttggaccttgtggaatcttcgcaatagttgcgtttttgatggagtgactgctagcttggctggtgttatgggctctgctttggaggagtgttgattgtaggctttgacagggccttggcccttgggggctatccttcttgactacccgtgcccctcttcagtagtctcagccttgaagttatctagctttgatcgctttctttgtttccacagacacgttgtaaaaggtttcttgtagtggcgtgatgtcatgtgtgttrtatggcctctttccccttttttcttaatataatgaagcacagttctgtgttctgagaaaaaaattctttcatatgtcacatcttttgttgttaaatcttcaaattgattgctctagttggtgttccaaatttccatctgcaatctatgagatgttagagggcaaaagcatatcgttaccagtgattctgcaaagcattcaagatttgttcttaacatactttaggtgtcctgttacaggatcatgtatgaaactagaacgttagaatgctgaaattacatgatttcagatgaaatgtaacaaggcaggcaaatatgaatatgaatataaatatgcttatgttctgttttcataaaggaggcctgacaaagcaataggttcaagagcggacctgttctcatggcttctagttattttaaggatataagaagggatgtgcaacaagagtttatattccacaattatctcaatgtgttgaaagctcttaaaatatgaaagaataatacaaagacaaagcacatgtctgtaagggatcattttttgttccactagatagtgaaatgaagaaaaatgaaaagaaatcggggaaagatcaacagagtttagtaggacttcacatggtaaagacaggagctagaactcacataatccattctattttgttcagtaaacaaatcacgatattagtagaagcaattaacattttttattgtgttttattgatattctccttattacttaccaaactatgggattttattctctagagtaaaggctttgtatttaatttgtatgctatttttgaaatcatgtatttttactttttcatacccagttgatatgttttaaagtgataatgtatcacacattggtatgaatatcccaattctatgacctaaccaatctcttattgcttgtgcaggatcttgatgaagacaagtgatatactttgatgttagaatcctccacaagattaataaccaatccctcttcggtagttcattaga

SEQ ID NO: 5324 - DNA, 603 bp, Zea mays
ctgtgcgattctatttatcatgtactacgttttacaatgcattttttttgttttgatacatttatatataatcttagccaaatttatgatggattggtcttcaataaatttagggtagtgttttttttttggaacggtgacgggggcacatgaacagctcacacccagttcttccccttccgggctaggctaatctgcgagcgtacaaacaaacacccaataggagcgcgcagatattgttgcttgttggcaatccatctcctcctagtcctggcgaggatgtcacgatcagaagcttcgcgcccgcccgacaccgcaagcgaaaagggggacggtgccgcgttgccgtgccccacgcatcaacaaaacgtgtggcccgccctctcccgtgggccgcggcccgtgcccaaaagcagggcatccagcagtataaagccggcgccacatcctgtgcttggccgcagcaccagttgcttcacggcttcatcatcactccactagccagtcagctactggcctacagctagccgcctcctctcctctcatcccatcccatctcatctccgacaagcgaagcagagcactggcatgagcatggaccgc

SEQ ID NO: 5325 - DNA, 58 bp, Zea mays
gggtatttggctggcatgtttgcttgctgaactgcgaggagaagaagctgaaccggtg

SEQ ID NO: 5326 - DNA, 1500 bp, Zea mays
ctggactccgtctcctgacgcagcggcgggaatattggagcgcggattggggacactgaggaggcgccgctcaactgccgattgcgactggatcgacagcgagcggcgaggggagcggagtcgtcggggatggttgagtccgcggagattcctggagtcgcgcggctagggctgggcattcgatttttttctaaacttcggttcggtttttcggttttaaaaaacttcggtttttcaaacattagaaaccgatcggttttctagaaaatgaaaaaccgagaagttcggtttcggttttttacttcggtttttcggtaaaaaccgaataccaaacttataatcaagacaatacatacaacaagtttacatgatagattacacataattttaaaaagtaaaaattatataggtacaaatattgagatatatatcatacatcacatacaaataagtgaataacaatttaattgtatcacacaattagttcacataatcgaatagtcaaatttgagaattgataaagtttggtattcggttttttcggttcggtatacggtgaaaaccgattacgataccgaaaaccgaacttcttagatacaaaaacccgaaaccgaaccgaactaccaaaaaaaccgaaatttcggttcggtggttttcggtttatggtaaaaatgtgcccacccctactaaagacacttggttcgaactaataagagctacatgccagaggatatattttttatgtctaatgctagaggagcttcataattttggaaagggttacataaagttaagcatttgtttatttggggagaagcgaaccaagttaagaatggggaagacaccttgttctggaaagatatttgacttggtgatgtttcgttaaaaatcaaataccttatatttttttaatatctggatggacaaggatgtccggttgtggattattggaaggacggagaggggaacattgattttgtgcgccctctcacggagaacgagttcgagtcatggggggaccttcggttggagctcaatgaccggcacctttctcatgggagagacatagtgctctaggccttcgataagtccaatgtgtttactactagatctatttatagattcatgattgatgggggaatctggaaaaaatatctataaaaaaattggaagtccaaggtgcccttacatatcaaagttttcttatggtaactatacaataggaaagtttaggcaagcatagtgcttaagcagaaagcctggaagggtagtgatttatgtcccctgtcaggatcgggagacaattgatcacattttcttccaatgtattttcttgttttgtttggtgctgtctgaaacattttttggttgggttaacatccctagaacggtcgatgagctctttggtaatggggagaagctgaccctaaggggtctcaccacttaagtgtattcttgctcgttggcctggtgtgggtcatatggcgtgatagaaacaag

SEQ ID NO: 5327 - DNA, 1500 bp, Zea mays
ctatctcttgtgaagaccgattgactatacatgtatgaccattcaataacgatgccaccgaaattttgtttcgattttgagagttaatggtaaaactacactttgcaatacaagcttgtcactgttggttacaggttactgatagagctcaagtatttgattttgtacatatgtaatatattcaaaacattaagggagcttctctatgttttgtacatatgtaatagattcactaatatttgagctaagttactgacttcattttctactgtttatagattgcgaactaaacttaaatcaggcattcggtattggtctctagagaggaagcactgccaagcattactaagaactgagaaggtctggacacacatatgttttgttgtaattttaaacaaataagtatcctgataatagtgatgttttggtagatcatctgtcaatcaggtatttttttgtcttgtcatttggatgcacgacacatttttcttcatggcatctttaaacgcatgagttttcgagattatttatcctatctctttacgtgatcaaataatttgacagcaaaacaaggagataactccaatgtcaaaaatataatgcttaatggggtgtaaccacaatgtcttctatctcaaaatcaaagcattttgctgttgggacagaaaaaggaattgtaagtaatctattgtgtagtttgtacagaacattctttttttttgtgactgtgtaatccctatgcgctacgaaagggcatctagctgagttgggtatatggtctgagtagcactccttagatcccgagctcgactcctcgtgaaaatttcaggctagggttgaaaaaactgccgtatgttctacaccaaagtacatgtctaaggcccggctccgttgtaatccctatgcgctgtttggtcaacaagctggacgacccagtagcccacacaattttagagcgtaggtttgaatgtagactagtagagttcatccacgtatattctagcattgatgacagaaacttattttctcttgattaataatattcaaattttaagggtttttatagtgccttgaaccccacatgtgctgttccatgtaaatagataaggcagcctcctctgtctcaccaacatgtttgtgattttgtgtcctagtttctgaaacaagagtcagaaccatcaaatattggtatgtggttgctatgctacatgagtgaagtgaaactaaatggttacaaacaaggttagcagattattgttctttttttttaaaaaatagcaaccatggaatctcatgatggccacaataaattaacatccacagcttgcaatgatcagtatcacggatatcaatatgtcactgctgaatccatagagataaatgatatatttaagcatatatctcatggattttacttcatttatacgtggctcagatttgttaggctctatctgatcctaatggtctaagccaacaaaatcctatgatgtcacaaaatcc

SEQ ID NO: 5328 - DNA, 1027 bp, Zea mays
ggcggcaatgatttcacagtgcgattgacacgtgaaatagactattttggagtgtaaaacagcttaccaagtctagcgaccggatatagatacttagggcctgtttggttcagtttttttttctaaagagtttttttaaatatggattcgtggataatctagttgtcacgagaatatgaatattatagagcttgggtgcggaaaaagatgaatggatctgtactcaggggcgaagctacgctctaaccagatggtgcaaatgcaacccctaaaaatacaaaatctatagaattggttgaaattttcactatatatgtacacctaaaataaattcttatgcatccataaactaaatgcaccacctttaaatttgctctagcttcaccactgtccgtactgtttagaatttaggaagccatgtatttctcttatcgcgacgacttgtcgaattctaacgttttttttacagaagcgattttcrtagaagcagactaagaagcaaagtgtttggtggccaraatctacttctagcggtagaatagaatgttggtatatttagagagctcgtttaagacgttgttggagcataatttatagttagctctaaattaattttatgaatagttctctgccggcccgcgtaccatttgcaattcgcaaactttttggaggacgtagcggcaaactggcattctggcaagtggcaatggcaagttgacaactgcagagtgaggcgatccccgcccccaccaaaccgccgcgcctatcgacccagtctgtgaccacgtcccacgcctagtcccgctggccgctgtcgccgaaacacgggcagcaggagcagtagcgtccgtccggtccgcgcgcgttcccctccccgaccggcaggttccccggccattcatccgtttcccactgctcctccgtggctcagctctgctccctgtatcggtctgcccctctgccctcccggtctctcctcttcccgtcccgcccagcgcgtccaccaaggaagcccccacgccacggc

SEQ ID NO: 5329 - DNA, 238 bp, Zea mays
agtatgtttttaatattgtgtatagctcctgaaatctgaaaactcttgacgtctgtaatcatgtgaaattttcgtacaggtaaaatatgttagtggctcctatgataggggggaaggatttgagttattaaataacgcaatctctgagtatgaaacttcaaaaaacaacgactcgggaagctaccgcagattattttatttggcattgcctccatcagtctacccatcagtatgcaaa

SEQ ID NO: 5330 - DNA, 788 bp, Zea mays
gtcattggaggaactagttagagttatacaattttattttaattattatgtacttttctagttttttatttatcacgttttaatttaaaaacgaactagcgagcgataaatattcgagaacagaggtagtagttttagttttataaatatcatgttacttttatttaaaattactgtatagttcatcaatgttttaattaaattcagtaaaaatatttagctacatcattttacgtgtttaaaatggaagatataaaatggtcaaatctaatgtatctgttgcctgctaataagttctagattttggagagattgtgccactgtggcaacaacatgtaggattgcggtatccagataatacgatagcaaattaggcctttattaccagtagcttggatttccgaaaataccccggacaagtcagggcgtgactcgtcaactgctttcggcccaaaacacttccctgctctctcggtctctcccagagtcccagctccctcactctactctggacgcgactcgaacttaaaccctagagccgcagccccggtcgctccaccgaccccaaatctcaaatcagcgggagggaactcgcacgcgaaggcaaatacgctttagatcccccattgcttctggctactaggccagcgcgcctcgattttcttctccgttttggtctaattcgtgaggaatttgggttttctcggtggagcttggttccgctccgccttggagtggatttcggtgacttctttgttcagattgtttcgctcttgcaggctgaactc

SEQ ID NO: 5331 - DNA, 1500 bp, Zea mays
tgaagttgaagttattatgatagatggcaagattgaatcatgccaataggtctgaactgcatccaacataatgatgttatcttctgatctggaatttgtatgtctatgatctataaatgaaggttcttgtcaggtgatgtcagaattgacaaaattagctcggaatcatatttcatcaacactatagatatcttaatactggatgaaatagttcaacctttttcttaaattggttgatgccaatatatttacttatgtttgttgttgaataattgaattttgacaggtttagctgttaccttgtaacttgtactccctccagtcttaaaaaacaagaccttttggacaaggtttaagtcaaacatataaaactttgactactaataacacttttgttatttagttttgaaatctaacagttatatatatatatagatttatcataaaaatacttttacaaaagcataaatatattaaaagtttatttctatttaaaaaacattggtcaaaactatattttagagaccgtgtcatagtttgaaacgacttgtgttggggacttgttctcaagtgctaagagtttaagaacaaggcaacatagaaaatgttaatcgttaatgcccttcgtcctccgaagcactatttcccttaggacataatgacttgcggacgaaggttatgaaggacataccttcataaattaatcaaataatgacgaaggatgaaatatgaagaatgtaaaggaaaacatgaacaatcatttattattattgagcataaacaaaaatattattgaacaacaagtgtaccttcaatcggaaggaaatgattgtacaagcgtgacgcaaaaagcgaatgccaagtcagcgtgaacagtacggggatactgttcacctatttatagacacgggacacagcccttacaaaattacattcatgccctttacatctgacaataactctatagtaatctattgaggtctgaatagccttttcatctttaagtcggttccactctctgctgttacgccgaagctttcctgctcaacaccttcggctctgtatcaagcttcgtattagtccggtctgctgcaatgccgattttagtctgagggtacctgttcacatattgtactacagaaatactgttaaatcctgtttttgaggaccttcggagccgaaggcccccaacagtagcccctcgcaatgttaatttgtttgaaataataaattcagattgcgatatgaacgaaggctttatgccgaaggtccgaaaaaacaccttccctttgctagaatagcaacattcaatgacaagtggggtctttcaactttcaacgcatcaagcgtataaatacggccataccgcaaacttattttgcacgctttctggccaaccactcctgctcactcattttttagctcttgtgcactgtgatctgctaagtttttagctttgaagcttcggcttttagaaacagttttttagcgcttccgaag

SEQ ID NO: 5332 - DNA, 554 bp, Zea mays
cggtgacctatagagtagggtataaatatattcctctgtttcgaaatagtatttattttagctcttaatttttatttttatatttaaatatacagtgatgaatttagacacgtttataaaaacacatacatcaaatactaacccattgtaacctaaaacgaattttaatatggccagaaagaaagtactttatttattatatgtctaaaagtatactaggtaaaaaaactaaaatatgttattaaaaaatcggaagatttgtgggttccgggcgcgcaacccttggtgctcgtggccgccacgtcggagcccgagcatcgcgccggatcacacgtggcgtcgcgtgtgaggctcacggagatcgcgagcacctcccacctcttatcgacttgcccacttcagacgcctgattccattttccggaaaagaaactagacgcaaccagtttctctttccctcccgattttctgtttttcttctcttggattgggctcaccctgctcaaaacttcggcggcagcggcagcggtagcggtggcggcgccggctttctcc

SEQ ID NO: 5333 - DNA, 442 bp, Zea mays
ggtaggtgtggaggacgcagcggccgatactttcgccggaaagcgaggcagcggaggaagcggagaagaaactatgcgtggcccccaagcccggaatattccttacgaaccatcggacccaaagggccatgttttgggcttgggccaaaggcccatgtacgggcccacgctatctagcacgagtccaagtccacttgcaggcccggacgccgcctccgctctcgtcttcctctttcttctagtttcatctagtcttcaaggaagaccggaaccgaggcgccctggccgagaactggagccaccggacgcacggctgctgccgaaatccacgggagaatgtttggaatccttcaactcggcagctaacgcagtttatttcttctttgctgtttgcctgacacgaggggtcgctttgctgttgttgccgggtgtgtgcaggacg

SEQ ID NO: 5334 - DNA, 438 bp, Zea mays
cctaataccttatttggatactctcgtattcatctcaatgtacaaatgagtatgaaagtatctaaagttccaaacaacaaggtctaaggtcatttataagttgtcgtataaagggtcgtacaaagtgatgttttgcaatgtatattatttatttggagagtgtattttaaaacatagataacataagcgacgtgcctgattccctttcctcctcgcaggtcgcggtccccagtcccctccctcctctcccatgctcccggctgactcacgcgacgcgcgcgacgacgcggcagagaaagccaggaactccaaaggtccgagtttgggttcggaagccaacccacaccactccaccacaccctactcgagcgaagcgagccagcaatggtgcatcgcagccgtgggccgtgaccggcgtcgccggagactggaacaaca

SEQ ID NO: 5335 - DNA, 976 bp, Zea mays
atttaacattgatagaaaagaataaagaaagaagggatgcattgtatgcgacaataagggcacttaatggaggattgcccaaacaagctagcacccaaggataaaaaagaggtgttgtcaaaacttggtatgattcattaagtgaagatgaagctcatgataagagatacatccacaaccgctctctatcacgctcattttacaagtgccttatgacacgaggtaactctaaaaactcatcctagtgagagtgaaagtgatattaaaaatgaaaatctctcaactaaagaacttgcacaatttgaagaagtttgcactaaataaaatgctcaactaaaattgctaaaaccaaaattagttcgctcacaaaaatacttatcaaaattttcttaagtagtttgatcaaaaccctagttgaatcttttttaaagaaaattttgtacccaagttaacatcaggggccgctattatcttgcattaatgcttgtccatgccagcaaagatgagttaacttgatcagacattctaccaaccttttctctctttctcatacaaccatccgttaacgttttgctgctgcaccgacaccgacactttctctctcctctcacgctcactaacctcctccttttctttaagaaaaaattttaaaagaaaagcacagcgccgccaccaccacgctaatcagcagcagctggtagcaacgcgggggttgcgctgctctgcttcccaagcaacgcaccaaagccaacgcggcgcggtactattataccaccacaccacccaccgatcccacagctcataccagcgcaggagcagcgcagcgcagcgcagagcggcgccgcgcgcagcacctccacgcccccagctgcctgcacatgtgagcggccgcggagggcgagagctaggtacatttcgttgtgccgccgctgcggggtccgtgcgcgaccgagatccggtggggcggtggacagag

SEQ ID NO: 5336 - DNA, 550 bp, Zea mays
ggaagattgtcccaaaattagctgtgtttaaacacagccaattttgatagccacttgactagtatgcagtctgaggaagtttcatgttgacccagtagatcagtttttgcaaatgcttttagtttgtcttatgccacccataaacagccttcgccagctagtatgccatgatcgtgtaatttgttcctcatcaaatacttgaaatgcatcaaaccttcagattgcactacttcgttctttccaaaccgtgttctgatcctgtcactgtggaaagtttgattgcatattaactgtcactgcctatgaatgttttatgtatcatgtgtcgcctgtttatgtcttctataggcagtgcatatgcatgctacaaggttaactacaaacttggatgattgaaaatagtgatagggttatgtgccttctgtcactatcttctgagattgtagagtgctatgaaggcaaagccatcaccgcttttctctcaacaacattttgggatttttacttgttttttcttctgatctactagccagttcaagatccacaaaag

SEQ ID NO: 5337 - DNA, 511 bp, Zea mays
ggtgagccaatctttacctaactagagctcactaaatcagttaatcaactgctgttaggcactttaactatctgaatataatctcttgatgatgggtataggtactcatcaacattaattacttggtttaatcattttagatattaagacaacataaccaaggcatactcggactgccacagatgagttagctgttacccaagctaatggaaacgtcataagaggaaaaccaataggaaaagaccacctcaaatcagggaggtttcaaacattagaaattgaatagcaacgccccaaggaagatagatgaagcagcgaggaattcagtgcacacaggaaatgatgttgaatcaaaacaagatgatatggcaataaaaagtggtttgtcctaacgtgggcaataaaaaggaactacatcagatatcacattggacaatttaaatgaacaaaggaagtttataacttaccagatgttgtgcatggtgttaaatcagacacattcttctgtgat

SEQ ID NO: 5338 - DNA, 1500 bp, Zea mays
ttcgattaaatttatagtaagaaatactaacattcatgtctctaaataagtttaatacaattatataactaattcaatgatatttattctatattaataaatatcagtactttttaggtaactttgatcaaagcttaaagtattttttacggaagtaaacgctgccttcatatgaaacaacatagatgagaatgtatcagagacaaagatagaggtgggagaatctttttaaaaatattcagaagaggtgggaggtgggggttctcttaaaaatgacatttttttaaaaaatctctctctatccttatgtcttggttacacggttacaagattgcacctggtatgtttgcaagttcaagtttccggagaaaccagcttacaatacaaagctcaaaagaaaaccaccgctcacagacatagcgaaaagatactggcagtccaacatcctctcagcttccacgctcctccgatcgaaacctgctttgccccacaactacgccaaactctaaacaaactcgactgaacaaacctaaacaaaagcgaaactaagcagaactcagatcaacccttcagtgaccatgtcttcagttcgtcaccaaaaaatcctgcagccaatccctcgcgctcttgaattcttgatcgcttcgtccatgtatttgacatcgggtacaacatttctttccacagtggtttaaatcatttaacttctcgagatgtttcagcaaaaaaaaaaaaaacttcaacaaaagttgacaaatcctaacctgcaagtgttaaatgtcaagataacaccacgctcccaaagggtcaacaattctacggcctcagacatttccttgtgtccttgcccaaaaaaaaaattggtcagctatgcttaaacccggtcaaacggtacaacgctttcccggtcgctcagccgttctccaactactcgcggaactggaaaggtcaaggaaggctccttgcactcgcagtcccatcctcttcaaagaaaagcgagcccagaacatgcgcactgtgccactgccaagtggatcccacccgtaaactataaacatcccggccacactgcttgctgacacggtggcacaccgcccgctgctacgctcacgccaccgtgtacccccaggccgtgcgcgctcgcggaggcgcatttctgtcgcgagtgctcgaggacttgcctgctccgttttcttttcgcccacatccgccgttttgcctcgccgttctgccgcgccatcgcatcgtccgcgctccttctcatcgttcttcccccggtacggctcgacggcgggcgtgggcgctggagttgcggctccgaggccgaggcgccgggtggtgcgttgggtgcgctcggttcgggagatcccggactttgctgctcgcgcggtcagacagggagcgccggaggaggaggaggctgttcaagtgcaagctgtgctgaactaagggttctggcttcggactctgtgtacgcgccgcggcaggagggagctggag

SEQ ID NO: 5339 - DNA, 312 bp, Zea mays
ctgcaggtgcgggcaacacgtgacctctctcaaggttatcctatctttgtcagtccgtattgtattcgtttgtttcccccacttctttttgtccggttctattcaatgatgcttctgggccataggctggtgccactagatttttggagtcttcttgctaaatcagggataagaccgccttgttgtttttgtgcctcgctagatcgttccgtaagggcacccatcgtcatagatacgattcatagcttctgccactacttgtgcgcgaagagccaagaaatgcgtcaggggttgtgaagggaaggagtgccg

SEQ ID NO: 5340 - DNA, 684 bp, Zea mays
ggtacctcctagttcctcgccggcggtagcggcgtcgggcgaacagcggtgacttggcgagggcgcttggccggcgacaatcatccactaggtacgctgttctttctcttgccttcctgctgcgcgcaaacgagcgcccccaagttatatatgcattcggatctgacccaattacggtatatacatgtgtggtatccactaaattcgatttttgttaccgggtgtacatgtcttttactctgcccgcttctgactcttttccttctccatttcctgtaatctgatgtgctgaaaaaattattcacgggtattttatgttgatgatgctaaaatagcagatccatcatctatttgtgggagtatttgatttgcaaaactcaaacttttcaagttttgaccaacaattggtcacattattattcatgcttcgtgcacaagtgttgcatcaaaagattcatatccaacttgaccaacaattagtggaattattcatgcttcatgcacaaatgttgcaccaataggttcatatccaaagcgcttttaggatggtgtggattctgttgtaaagataacataattcaggaccacccaatcaaaatatgccttgtattcatgaatggagggagcaaacatttgtagcaccagtgagttatcccattaaaactatgagaacgatttttcagg

SEQ ID NO: 5341 - DNA, 396 bp, Zea mays
ctgcttgtattttgtctctatgaattgtagcttcagcaatccgaacaactgcagcagttacggctgccagccaaccgacgaccaggttatatatgcactagacattattgtgcaaatgttggaaactgtttcccccaccttatcaaataaaaggtttttgttatccgtatccacttgcgcattagtagtggtggagagatcgtgaggactcatggctatcgacgtcgaccacaacaggcggctagaggaatggtacaatagctccgcgaggccttggatctataaagccatgccatcctgcccaaggaatccacgggtgctccaaacaactgcactagacatctcaattaattagctaatgagcaagcggctgagctgcactcaagacaaactacc

SEQ ID NO: 5342 - DNA, 993 bp, Zea mays
cctctcaactaaaacaacttgcacaaatatttaaagattttctgagaactttaaatatagactcaaaacttacacaaatattttcaaggactttatatgggttcatgtttaaagtctttgtaaaattttgaaagtatttgtgtaagttatttttgctaagaggactactctttaaaaaatgaagattgttactaagtgttctaaaaaacaaatgtaaaaattatttatttagtatttagaagaaatgacacttaacttgctcaaaaaatgatcccaaatttcagtagtttagtaatattatttaattacatataggaaaagtgctagcttaagaattgaaatagacaaaaccgatgtcacaattgcaacgtcacgtcattaaaaccactcgttatagtgatccaacctttcagagggttatttgtctaattttataaacttgaagagttaagtaattgattttgaaggtgagaaagtaaaatagactatactttaaatggcgagggtgttatgtagtttctttttatttttcagattgtatatctcgttccgattacccaagaaaaaaataacgacacgtgaccgcgtgattctcgttgccggtatcaccattcgacgccaccttcctcctcgtcttctttcctccgctgtctcggccgaccccatccaccagtctaacgggtaaacgccagtccaaaatacatgtacccacgagattttatccatgacaggtgggtcccgtctcttgcataccccacatggcattgggcaggtcattgtagttaggcccaccgagcgctgccgcccgtctccctgcgcgagcccgcgtggctctttctctttgggtcgtggagagggacacgcctcttaccccacgactgaaaaaattctggaaatcgaaacccaccctcgagcgacgccaagcggccaagacggagaggagaacaattggggacggggaaagtccagggggaagccacggccaccggcgcg

SEQ ID NO: 5343 - DNA, 1204 bp, Zea mays
taaatattaaaccattataggaaaaacaaattacattattcatatatttcatatgaacttaaatgtcaaaacataatatttaggtacgtttataccttcgcctctgacaaaaaataattccagcgtaatgtgttaacgattacaggattgcgtgaacagtgccagggtactgttcacctatttataggcacagggtgcagcctgtgtaaaattacatttatgtcctttacaatcgactacaataatgacacaaaacatcatgggtctttaagtcaatccatctttaagtcggttcggcccttcgtcttgagatctgtcattatgccgaagctctataggtaatagcttcgacgcttgctcctgaaaggatcttccgaaggtgttctctttctaaggatcttcggctaagaagcatacccccaacagatcatttgttcctaatttagaactatagagaaataatagattaattatctgttgggggccttcggctttcgaaggtcctcaaaaacatgatttaacaatgtttttggagtataatacatgaacaggtatcttcggactcggatcagaaccatagtatgaaaaagcacaaagtacacgaaggttggcacagagccgaagctatgtgcaggagagcttcggcactatagcagaaaaggaaaccgacttaaaaaggaaaaggctattcagaccttgatgggttactatagagtcattagcaaatgtaaagggcatgggtgtaattttacatgggctgcgtcccgtgcctataaatagatgaacagtgctcccatactgttcacgctgatttggcatttgcttttgcgtcatgcttgtactcttacattctttcaagccgaaggtacatttgtaatttaatatcatttctattttttcataataataaaatagaaatgagttgataataatacataattgtttatgttacctctcatactttacatggttccttcttcattattgtatgttgtgctaatgaaggtatgtccttcataaccttcgtccgaaaatcattatatcccaagggaaataatgcttcgaaggacgaaggactttaacgtttaacaatttttgtgttgccttgttcttcattcatagcatttgagaacaagtccccaacattggcgcctacctccggtgaactcttttcgaccaccttcggcaagcattgaccttcgtc

SEQ ID NO: 5344 - DNA, 1185 bp, Zea mays
agatcgctactggactagcctaactggcattctgatctaaaagcaaccgtatttgtacatttctagccatgaagatcaccatctgattctgcgggttccagtgcaaatactccacgggacaacgaggttatagcttcagacttcggagtactgtactgctaatgtgagtgcgtataagtgacagacgagcggtgttacaagacgttgggtcgcagagacagtcatagagcacaacacaaccggctactcccctgatcgatgtaaagcttagcaaaaataacctaaccgtgacaatgaaaatatgatacagtaatgtttaacaacgagctccgcaagtgtcatttgggcggcgacctaccctgtgagcgcggaagttgtgactgaatttacttgggcgtcacacttccgcgcggggcccgaagttgtagaccatgcattctgctctgccccggttgaatactgtaaaatattgctccccttatcctaaactattcctcctaacgttcggttaggcaaggcagatctcattgacacagcctgatgccacaatctacagtcatgcttgaacacaacacaacacaacagcacagaatttacgtgtaacaccctgcctgtttcctgtatatgaaaacactactctcattcatgatcatcacctggtgtgaattttgtcatagtgcctgcttgctataatgtccaagtctcggagatgtctcaaaatcgtattttccatgtttttttttcgataacttcaaattccaaatgcgtgttgctcggcgcatgcatggagctcgatacctttgtccaacggaaagactaggcccaacacgtacaattagcctaacgccaccgtgaagcgttagcgttcacggatagcatatatctggaaaaagacgaggttttggttgcaaactttttccagaacagagcagaggaaccatgcatgctgcgagcgtcgtcatatatgtctagaaggatgtcgggggccgtattgtttacagcgcctcacagtgatcacgcgcgcacactccaccaccaccagaccgtccaagctttctaaatcctgggcacttaccgcgtgagaccaaggcgccgatggaaccactacggcgaccctccctcgcacactgtacgccataaagcgcgcgcctgcaccaccagctccgcggcgtccggtccggcgac

SEQ ID NO: 5345 - DNA, 692 bp, Zea mays
cttaaattcaaaagtaaacttaatttttagcattcaaaatttatattattcttttttacattgaacttattaaaatttataaaaagtaaacttcttcgatacatatgtttttttcaacatttttcattgtatgaaaaataatgcacaaaaaattaaataaaattttattcttgtatttcataatattttaaataacattgactaaaaattagtatcatattatatacatatctaatatttatattaaaatattaaatttatcgtataatttggatgttttagatcatccttaagaagagaaagatcctctatctattctgatcagttttgaatctagcagagaccaaaaagtgattaagacttttaaaaacatattttaaaagtttatgaatcggatcggtatatacaagaattgtattttacttaagggctagtttggaaaccttattttcctaaatgatttctatttttccattagaaaatgaactaatttcgtttggaaataaaaatctcatagaaaaatgggttcccaaattagtaaaaaaaagattgtccttaaatataggcgccgaaacgaagccgacctaaccgccagacccaagccaacaagcaagaccgaccgcttctgcttgtgacccgaaacctttcttcgaacgcaaaaagaaccccacccgacgtaccgcgagccggct

SEQ ID NO: 5346 - DNA, 687 bp, Zea mays
ggtaggcggaggaggcctagtatagtatgtatgtcaaaagtaattcacaagcgagtgcatgctaggaagaagaactgaagaagcacggtagtgcaactctctgcttactctggctgcgctgcgccttggctttgtgttttagattataatatgatgagccccaaacggcaacgccgagagccccgcccccgggaggccgggagagaagagaacacgcgcgtcaggagcgcacaccgcacggcgcacacacacacgcctcccgcggcaagcagcgcaggacaccgacgacgaagcgaggagaggggaggaggcggagccgagcgcccgagcccaaccccgcaaccacgacccacttccccgtcgcgattcgcattgcccttccctcgggttctacccccagcctcgcgccgccgccgccgccgccgcccttgccagagagatcaccccccattcccacaatcccgtccctccctccgtccctcgaggtaaacgcccgcccacccacccaatccgattctccctccagcaaccccgcgcctcggcgaccccatcgcttggcttcgctttggttgattaattgatttagcgctcggttctcgcaggagccgagccctccgcgcggccgtgggatggggcagtgaccggtgagtggcgtggggagccggtgggcggtggcgagggcatatc

SEQ ID NO: 5347 - DNA, 587 bp, Zea mays
ttttatggcacacgtccaccattcgcctcccgtcgaccggcatgatgtgcgacgcaaaacaacaaaatggcattccaacactagcatcgccttttctttatagggacaagatcctgcacctagtatatctcaaactaatctttactattccttaagagcataacgagggcgtccaccgtgcccccgcctgctcccgcaagtccgcaatacgtgcccccgcccccgtcagtgtccgcgagcgaccctctgcgctcgcgcgaatcccgcctgagatcgccgccgatccgaagcagcggcaccgtaaccctccccctcgcgagatccgcgaccgccccatcccggcgccacgggatccacgcctccgccctcgcccttccccacccccacccgctaatctcgcggtcgatccgcgcccggtcctgaccccgcctccgtcctcagcaccgccactccgtcccccatcttcggcgccgccgtctcccgctcccctggcacgcattcggggtccttgcgggcgacaagcacctccgtcccggaggcatctgccgctgcagcatagaccaccatgtcctcgctcggcagcaccg

SEQ ID NO: 5348 - DNA, 196 bp, Zea mays
ggaagcagtgctcgtcgactttctctgcgcaaacgctgacgttttcgcgtggagtccctcggacatgcccggcataccgagggatgtcgccgagcactcgctggatatctgagctggagcccgacccgtgaagcagcctctgcgccgattcgatgaagaaaaacacagagccataggcgagtagatccacaagcta

SEQ ID NO: 5349 - DNA, 1059 bp, Zea mays
ggctggctctggcgacttgctgttctcgggacttcgatggcggtgtactactataaatcaccggactgtccggtgagccgttcacaggcaaactcgtcgctctcgggagatgattaacggcatacggctaaaattcaccggactgtccggtggtgcatcggactgtccggtgagccaacggtcagccgcgcgatctgcgcgggacatgtggccgagccaacggctagaatggggcaccggactgttcggtgcgccaacggctctgaatatgcaacggtcggcttcgccaaataaggaaacaaatccgcaccggacagtgtccggtggtgcaccggactgtccggtgcgccaggcgacagaaggcaagatctgccttcctggaatgctctcaacggctcctagctgccttggggctataaaaggggcccctaggcgcatggaggagaacaccaagcatccttagagcattgttgatcactcacacttcattcttgcgcacttgttcgacattcttagcgatttgagctccgttctagtgagaacctcgtgatagtcttttgagctcaagtctgggtcttgtgtgtgcgtatttgctgtgatatttgtgtcttgtgtgagttgctcatccctcccttactccgtgcttctttgtgaacatctttgtaagggcgagagactccaagctgtggagattcctcgcaagcgggatatattaaagcaaagcaaaacaccgtggtattcaagtgggtctttggaccgcttgagaggggttgattgcaaccctcgtccgttgggacgccacaacgtggaagtaggcaagttttgtacttggccgaaccacgggataaaccactgagtctatctgtgttgatcttcttgtggttgttgtgtttcgcaagaactcctctctagccacttggcttaattgtgctaacccctaaccaagctttgtggaattaagttgcaagtttttacaggatcacctattcacccccccctctaggtgctctcaaggtatcagagcagttctcttcacgaagggactaatcgcttgaagag

SEQ ID NO: 5350 - DNA, 210 bp, Zea mays
cgtctctcccagcccagcagccagcagtcgtctccttctctacctccctcgcatatcctgctcctctgtaaccactgtactaaaactagcctgtacctgtactgtgctgacattatatacagccccttctctttgcttcttgctcgtgccaattggcagttgccattgccaatcaccacgtagagctgcattattgcttgcttcgaggcc

SEQ ID NO: 5351 - DNA, 124 bp, Zea mays
ggtaacacttctttcttttaggagtatactatcttcagttcctgtgtgattttacagctaaattggaatattttaacgtgatgactctcagacactctggattgtgtgtgcatacgttgttttt

SEQ ID NO: 5352 - DNA, 1500 bp, Zea mays
agtgacattgcaaagacagaccgatctaaagcaaaactctagctctagcatggytagaggtgactgattatatagtctaagtggcatgcaaggacgctctgttcgtgttcatagagtcccaacacgttacaaggaccaaacaacacaaaagaaggtgacacaacaccttgatagattatagacgctaaattattttgatgattcctattgattccaaaggaatttcaatgtcataccaaagccatcaggtagcctataaaactatctttccatgtataggtaggtaaaaaaacagagtccgtatatatccatcatttgttttactgtagtatagtcctggcttccaataaacactcgaactagacatggattgtgcctctaacttgacttggacatccttactagcctctgaaggtgatggacaaggtggggaacatcactgtacatgctccatatatatttgtggcattctccatatttcagtcatcctctctcctattcttgtacatgtttagtgtgccccttaggctgcagcgtttaacactactttctcctctaccccttgttgcacatgcgcgcacgccacattaagaggagcaatgtgtcagtccccttgcattgattttcgtgctcaccagtattgttagttgacagaaaaatagataaatgatgatggataaatatagaaaataatattttatggttgaagttgggtatagacggggagaatttagggagaaccaatgtggaagaaagaaaagtagggataaaatgttgataatgtgataaaaaagtgatatagtgggagaaatttagaagtaaccgctgaggatagccaattcaacagcatctcccggcccgcttaaacaatgacactgctctgctcctggtagagattaatctcccacgagcatgccgtgcgaaagcgatgtctggtgttgttgaacggaacttgaactcatggttccacataggaataatagaattgggtggcattatgttatctgcatatattaagcacatttcagctttctcgaaaagtatcattttcgaaccatgagaacatatgaacattcccatacctcgagataaaatacgaacttactattttcaatgaaaggtataatataattatgaactataatatgaagtcaacatagtgagattctcgacttgtttgtttatgtctcatggctatacggcgtgttcattaaaaaagacacagtatctgaatgcaatcaagcacggagattcagaatcaattacaccaaattatatcattcgttatcacacgcgcataagctctcgcctttagtagaatccgcatgcaaacgtttctacattggcaaaccacaacccggctgcgacaacgacgacgacgccgctaaaaacggcataaataactccggcaggcatggtctcagtcatagctgcaaccgcgggccgtaaagcagcgtagaacaaagccaaacgcgcgcgcgcacacacacggctgtgtca

SEQ ID NO: 5353 - DNA, 943 bp, Zea mays
tgtggagggtaatttaggttgctttatgtttggacttcattccaaaaaatattaaggaactttccggcatttggatgaaaggtcctaagaataagatcactaatatgttcttgtttgggtgcggtgatgttttatgggctatttggagaaccagaaatgattggtgctttggtgataaatctttgtttgatcactctaacgtcatattttttgctgcttctagctagattcctaggctattcgacagaaagagaagtaaaaaagatggtggtacaaggaagcaagctcatcataagaatgacaagtgaagatctacaacgagcttatggttggagacttagagatcgtcgcattactggatagtgggttccaaagcttttggctatatttgcttgtcttgcagttccctgtatgtcggtggttatgttcttctgcatgttgtgtcttgcctcctgtctggagtgcaattgtcgtaataagaaaaacttgtggtttctatcggggcatgtggttcgctgcggtaggtcacttctctatcgagttagctcgatattgtagggggtacttgacgcggtgtctagttacctgttagttagtctggttgcttatggttgtgaactaatgaactcgatgtttctatttcttaataaaataggggctctgtcccgactaaaaaaataggtgtaataaacagtagttcagttcacccatacagtaggacagtaggtgcgtatccatatccatgagatggttggctgccgatacgaacagagatgttggcggtattataacgagaaattacaagcacagcagacagcctccactctcctgcctttccggtttcccatataaactttccacccgcaaccgcaggccgcgctgccccagcaatcccgcgcacagaaacaccaaagccccaaacctcaccctctcccgaatcccg

SEQ ID NO: 5354 - DNA, 558 bp, Zea mays
ggtagtttgatactctgattagttgtgctgagacagtggtagcgattggattagagctgatcgattcatgatcttgcttctaaagtactgtttcccaattgccgttcctgcgtcggcttgtgtcgcttcggcggctgccactgttcgccttccctatcttttcgctctctggttcggtttttttttcccggaaatttgtgaatctagttttttttttttggttttcaggaagtggattactatctccaatcccatgcagataggcttcattgcaagatctccgattagttaaggtgatcttttttgaatcgccagatacacagagaagtagggtttataattataataagcagaaggcaaaatggcaattggacagggcaacgcgaagaagggggtctcttgccagttgccaccagcttgagcttctcaaactgcaggagcagcacaaggatcatcgggaggaagagagtcgccgtctcgccgactccgggctcccggaccccgcactcgccatcacgcaccctgcgcaagcagcgaagcgtccgcttccacttccac

SEQ ID NO: 5355 - DNA, 1006 bp, Zea mays
ggtactaagaaaggtgctgaactcatatattctatgtatagtgtgttctttattttctattcagcacatgcacgagaaatacacatcccaagctgatttatcgccggcacgaagtcgatgggagtgtacatgtgattgctgctgacttgaagtcgctgacacacgtcgatcaatcacatatgatgcacacgtttattttatcatataaccaaaaaggacaacacaacgttagcgttgtcgtcgtcgctacactgtcaaaatgcgacgactgcaacctcaccttgcagcttcaacgtgagggtgtgtgcacgcagtcaccactgcctcacagtcgttgtcactcctgctctataactcgagcaccaccgtcgcttcgtagccatgggcgcgtgaagtcagtagcagttactcagccgcgcggatgggcatacagatgctaccgctcggtgcgcgggtatacgaaccgtctgcctggtggcatacgaaccgtctgcctctgccgttcaaaacaaaaaagcaaagagaagttacacgcgcatgtaatctgaagcgcctgcatgcaggtctgcgcccgaagcgcctgcatgcgtgtatgtccattgtccacgcataaagcaagtatggcagctcatcttctcacgtaataaaataaagatgcccattaaaaaatgaaacatgaagagacatgggcaaacaagtgggcaacgactcctctctaaaaaaaaatgggacagcatgctggcgcacactcatgaccattagcgggattttttttaaaaaaatatatatgcacatatgtaaaagcttatttaggcattataataactctagaaatttatttctgaaataatataaagttaaatactggaaatttaccttcttgtgcatttaaatttgtatagtgcgtcatttattttaagcatttgttgttgtttttacaattatttatttaattctctcaaatgattacaagaagtaatctaactataaaatttatcacatgtag

SEQ ID NO: 5356 - DNA, 245 bp, Zea mays
agtatgttacgcgtggtttgcccttggcaacttttataagagattagtacgagtagatgtactagtgatgccctaactcttgggttgatcccatctgttcatatctcacgtgtttcagttcttccctgaggcgaatgaggtttcttttgcaagacagtcagcctttgaaggatgttcgctgaagctagattatcttacgaaaccatccttgttcgaagattttggtttcacaacgaaagtgaaaa

SEQ ID NO: 5357 - DNA, 109 bp, Zea mays
tagcagagaaatggacgccgcaaattccacccacgttttgcatggtctatatatgtatgtatagtggcatctgctgtgtagctgaaagctgaaggcagaagcagagata

SEQ ID NO: 5358 - DNA, 54 bp, Zea mays
ggttgatgtcctcgtggtgccacgccgacctcgccgccaccaagcgcgccaccc

SEQ ID NO: 5359 - DNA, 611 bp, Zea mays
cttacagtaaaaaaaaaaaagctttgaacaggctaatatatttatggttctagttgtaggtaacgtttccgttgatggcaacttcgtcaatctcgaaaatttaaggtttcatctttcgaatatgatttgtgtacgtgtctatatgagaggagtgtgcctacattacgactgacctaaattactgaccatataattcaaaggcagaaccgttttctattgagacttcggaactccaatacaccatactgttttttttaattgacatcaaataacttcaaacctgaaagtgtcaaatggctcgaaatcgacacacacacacacacactccatcgatcacgggcagaaacggctccatccagtttgtccttcaaaatcaaaatggtctcggatcacaaaccgggaaagccccccgacctacttcccctccgctgcccacctatttcacctctagtctctaggctctggagacctcgcgcaccatcccaccagcagcaagcgcccactaattccgcaccacaacgcgcactctccggcaccaccgccgtcctcgcgacgtcacatagtacgcattacgcactcgcgcgcgcgcgtgcgcgtacatttacgcagcg

SEQ ID NO: 5360 - DNA, 1500 bp, Zea mays
atcgtgtcactccgctacatcgattgcgttagtcatcgcgcatcgggatcaggtaaccccaatgttacatcaatttgactcgcgtttttagttcgaacgttgttcttttagttgaattaagccatttgatcaaatctatagtcgaagttatgtggaagcttccctgcgaggtttaatgattcttttgtttttatgcaacaatacatatatattttagaaaatttctatataaagtatgtttcttttcctatatgtagtgaactaaatggagytcgaaaggagaatctgtcttggtctctatagtgagagggttttttttatgatggagacgagtcgtggagagctactgatattactttactaaattggttaaaaacttataaatggacaagcaccatgactacatatgaattaagagctatatccaagagtagtaccggttcttggctataaccagtactatagatggagggatctttagtaccgattatagccaatgtaagaaccgataataaaaggttaattaggctttgatactagttataaccaagaacagatattaaaggtccctctatattacccgttgttgcaaaacggactaaagatcgtgacctttatgccaagtatcggttgggaatctggtaatagccggttcccaaccgatgaagatgtctttgtgtagtagtgtattcttaagataaatagggtagatggaaaaactaacgctgtctgcgacaatattcgtagacccacttgttactagtgatccttaattgtcaatcccatccattcgctcatagtccctccgtttatttttatttgtcgttggatagtgtaaaattgcactattcagcgacaaataaaaagaaacggagggagtatacaacatcagaccagcagaccatactccccagttatctgtcctcggaggtgtagctcaccccatggccggtcaccgcctcgccctacgtcgacactgcatcgccccattcattaccaaacctcctcacctccatacacacctcatgctggcacatcagtttcacttgtcgcggagtgctgtggtgcatgcagtacgtggtggtaggtagggtttaattgaaacagtcagttgagatgctaccaacgctgctggtaggacgccgtcgtgccgcccgcagcggcgcagtatgagccgatcaccctaactaccactactcgtacggatggcacgtgtacacttgtgtctcagcattcacgctcagattgattgagagagaggtggtagtggactagtggtactcgtactcagctcaccagcagcagccagctgcggcatgggcgtactcagctatcccgccgtcgtcgcccgcacgtccgtccgtccgtcgctatgggttattatatatagagagagatgggcaagcgccacaaaccgatcgagcctcgacgagcgagtcgaggactcatcctagctagctaagctgtccgacagcgcagcagaccgatacgagtacgacg

SEQ ID NO: 5361 - DNA, 1146 bp, Zea mays
cttgcatgcctgcagatttgcggctgcatgatgaactgctgatagaaataatacaaccgtggaaggcaggtcgtgggatctgaaaaagggcagaccgggatatccctgaaatcgaacaaaaatcagaggaaaaggccaccggaggaagttattttattgttgagaaggggaaaggaaaggagctgccactttcatctttatctgaagaagatggagaagacaaagacagcgagccgggtggtcaaaagccagaccaaacgagacaatcagtgaactagcgtggaaaaaagaatcgcaggagcagaaaagaaaccaatttttttttgttttctcttacagaagagaacaaacaaaggcttgagagcggtgtacagctagcgcctgcgtcttgacgatacgcgttagcaagtagcaagactcaagactcaagagggatcccttagcaaaaccggtctcgcaaagggacacaattccctaggaaccgcacaaaagcttcctgcaatccggcggctttggcgttgaacctccccccttgatcagtagtagaatcggctgctaaagatttctatttttatttttttctcggttcggaaggtgccgtgcggcgagcgaaataaatcgctgcggcgagaatcctgtggagatgagttgcgttaggtggcaggaccactcataaattctgcctgttcattcagatctgctccgtgctgtgcttcttctgctgctgccttgcagcgaccagcgagaagaaatccattcgctaggccggcccacccacccacgatagcggttgtggtcactcatgcgtcgtcgccggagtccaatctcgccgctcggagtttcttgacttttctggtcggagtttccatttcctcctggaggagattatttctttctcctctttcaccccgagaatctcgtctcgggtcgcgctggtttgattcctcctcgcctgagtccaccgctttcgcttccagtggagaagcttgtccgtgaagcagcgctcgtctcctgcttaaaatttcttccttctgccttggtttctttgctcgcgcccgccgatttgcttgctgcccagtccacactcctccgttcgtgtctcgcggctttccgcactcgttttcccggtctcggatttcgttacca

SEQ ID NO: 5362 - DNA, 1500 bp, Zea mays
cgcttacatgtaaagaaacacctacatagcaacctatttaatgtaaatgaaactcatataaaactcttactaagattaaccttagggctcttttgtattgaaggattatttcctgaatctttcttttttttctgtgtttttgaactaatttctgtaaaatttctatgctatttctgtaaaattcctgtgtttaaaaaagcccttagatctgtcccagaaaatccggagccaaagctgttgcatctgctcttcattcctcttaacccaaacatgcccttagggctttgcgtcatcattggaataaccaagtacagtgtatttgtatcatcctcgttgaagttctgtagtttgcagccgaagagcgacgaatgtcgcagggtcgccactggctggtaccgcatggtcaggttcatgtttatcttgctagcactcaccctgccacccctggtctgaagacatcccccattatccccgtgtaaagaaactggaaggtgaggtcgaaaggttcttcagttcattgatctttgccatctttctggacacaggtgcgtgatcgcgtataactcttttaacgcacgtggtctggaaggtgtgcagcgatgacctttacagcttctttcggtagagttttgtgccttatagtcaatgatcacaggtagatcaccaaagacttcatgtgttgacacgtcgcgtcgtccaacctttctgcttagctgatcgttcgaatttcgagcacgtgaggtgatagcgggcttgggttgcaggtgcgcgttgcaagattctccctgaactaggatgatttgaacctgagatttttaccgttttaatcaacacgcgcgcgccgtgtattgggggcttgttgcttggtgatgacatgattatccacgtttctctacttaattgttacgcgttgctaattaatgtatagttgacaaactggttgaataataatttgttgaagactctttagctgtaaaatcagttcgtctattagctcttctgtggatgcattagagctgattggagtttaaaaaaattagctagataataatcagccttgatatcgagcacgcctttattaataacaaaaaataaatcgtgtgtcgctagcgtggtacaatttttgtggataccaaatccttgggaagtcaggaaggcacgtaggaggaccgtgtacgaacgggaaagaggtactacatgtacgggtcttatttaccaaaactgtatcatggggaacagtcggacggacagtgcccccaaaatcattcgtagcatgcttcattaatcacggtacggcgcggcagcagcagacggtgaaggtcagcacgccacggtgcgtctccaacgaggcatcgcgtcgcatctccactcgtcctccagctgctggggttgccgtcaccgtcaggcgaggtcgtcgcctcgtgaggaacaggaactcgatattgcttgtgcttcccggtggcctccgcggtccggtgtcccatcccgttctccaacctg

SEQ ID NO: 5363 - DNA, 151 bp, Zea mays
gactagactagacccatattccgcccaactcctacagataattctcttttcaggtccattttgaacctggaaaagaaatttaagagaggctaaataaccggaatacgattgtactgagcttctttcagctaattattgaaagaagattata

SEQ ID NO: 5364 - DNA, 103 bp, Zea mays
ggtacctgcgcagcgtcctcgtctcttcccggccgatcgctcaacattaatcaggcgtgctagatagcacaagtctggatttaattttgatgctgatatatat

SEQ ID NO: 5365 - DNA, 106 bp, Zea mays
catgtccaagctcaagatgtatgacaaggctgactctgtgaattgcccgttggagcttgagaaatctcaggcgaatccgtgagaatgagcggaatcacatttacct

SEQ ID NO: 5366 - DNA, 163 bp, Zea mays
gaagtgtttgttttttgtttgtcctttccatgcttcatttcattttcccgctgtaacggtcctcgtctgctatgaccgaacccgagaaaaaaagtattgttctgtggctgtgctgatcatgccatatttatgtgcaccttgagcatcccagtatcccactgta

SEQ ID NO: 5367 - DNA, 222 bp, Zea mays
catattctttatgtgtaacacatgttcatgttttctattacatattgagatgatgaaggcatgtccttcataaccttcgtctgaaaatcattatatccaaagggagataatgctttgaaggacgaaggtctttaaccattaacatttgtgttgtcttgttcttaactcgtagcatttgagaacaagtgatcaacaagtacccacctctgttaagagacacac

SEQ ID NO: 5368 - DNA, 445 bp, Zea mays
tcttgaagaagcgatttcccatcctcaaagtgggcacctttttatcccatagagactcaggttttgattccatcagcagcagttgcatttcataacatgattagaggtttaaatggtgaagatggatggttggatcagcacccaactaacatcaattctagtcaatttgttgaattaccagagggagatagcaattatcggtatactagtcggtccaatgttggaaatgctcttagagatcaaattgctatgcagatgtggaatgattataataatcattagtattattttgatgtaatagtcattggctattctatactatgtagtcatggctagatcttcgtggaatatgaactatgagaagattcttgttgacatcttgcacgagcacaatcatgtgaagtaccggggctagaatggttgggcgccagaaggttggcgttct

SEQ ID NO: 5369 - DNA, 1500 bp, Zea mays
tctgacaggggattaattggcttggctgcgttcgcgcgcatgggctagtaccgtggtaacagggtactgtcgtccgtctgattaacggtgactttggtgcttctctgcccaatggaagcctgtcacctgggtgtccgcgttcattacttaattaagcccttgtgtcgtgcagcggtcagtatagtacataccatggctgacaaatcatacttacgcatctagcaggcttccatggagaaagctagctcacctgcttgctctaaattttactgtgacttaatttttaccagattatacatatggtttttgttgttagcctatgcatgcctttgcaccaccgcgtagcgcatgcagcagagggcatctcttgacttgagcgactagtaattagtaagtaacagacatacatacagcatgcatgcatgtaattaaacttgtctgtctgaacatacatgcatcagcgataccactatatattataacacggcgtacacatgcgtcgtcgtcgtcgttgtgcggtctactatataatctcccttcccctctagctataccctactgtatgtatatacatcagggtttacaatttcatcaaattttctgaaatgccactatttttcagtggagatcccaatatatatatatatatatatatatatatcactctaaacttttcagttaaattgcattggtcctgaataacctctagtgttaccaatgcaaagccctaaaacacttcaaatttatatctaatttcctcactctcatgtttgaggccattatattagcacactaaattggtcctccatgcataccccctctagctagtgttaccaaaaccctaaaaaagcttcgaatttatttagttttctcactattatcacgtcgttagccagcctaagcagctgctcgcccaccgtcagcacacatccttgctcgatctactcctttcatatatatactctgttattcaatgggtgctatataaatttgtgatgctcgatggattggacagttttcgtagtgtaatgaggctaatttctttcaaaaaaatcaaactgaattttttaaatttgatataatatttccgaaattcacaaaaattcgtatgtatattgacgaggacccaatttttttcatatataccgaaaaccctgatatacactactccttccattgtctgtagctactactatattcagcagctgctgctgcgttgtgcgtgctgtgtgtgcccggccgccggccatgtcgctgcttataaatatcgctcgtctcacactccgcagtcgtcgccattattgcttcgctgtgcctgtgctagctcgatcctcctcgctctcttcactggagtgtcaagatatatacatcgacctcaagatatatacatatatatatatatatagcagtgttacttagtgttactactataccatcatatcgatagacgacgatcgatacatatagcagctagctagctggccggggttatctagctac

SEQ ID NO: 5370 - DNA, 323 bp, Zea mays
gaattcacatgcctacagttgttcggcacacacaatgctgtccggcgtctccctctccctccatcctgattcctgacccaccctccctccttcccttctctatataaccaccactagtccaacccccaaaccaccaacacaacaacatctcctccgttctcctagctccagcaacaaacaggacacaacaccttctcctcctcattcttctaccatagctagctagctagcttcacatcagcagctacatactcaccgatagatacagacctcagagcatcacactacagagtacagacctagctcagagcacacatccagcc

SEQ ID NO: 5371 - DNA, 1206 bp, Zea mays
attgccatccctattcactccaccacacacaccccccgagcccgctgccgtccgtccgatccaccccctccgcccgcatcccgccgtccgcgcgtcgacggtccggatgcgcgcgcatcgcccgcactgcgcgtttcctcgctcgacaccaacgcagcgctttgcccgccaaaatggcaggcccttgtaatttgtccccggaccgaagggcggttccgctccgccgcccccaccctattttatactactcgtatataaataaaacgaaggcatgggtgcgatgaagcctagcggcagggtgtttaagaacaaagactccgaaccaaaacccgacgcgacatttttttttttgttggaagggggtgggggctttgttggtgctgtcgttagaagagatcaaacgggtccgtggaaaaaagaaagaggtttcattcgcgtgcgtgcgtgcctgcgccgagcgcccgagctaatctagtagttagcacgcgacgggagcatctaattcacccccacagcgagccgagcgagcgagaattcgaattggagttggacttgcggctgctgcgtccggtggggctggaattctcaccgcctccccgtgcggggtgagaggcggtgggtcgtggttgcggtyggcgcgcgaggagggtcgacggcctcgcgccattgggtacgaaaccggccgagactgtgagcggtgggcggccgctgcctggagacagctcaaggcaggtgagttggcccggattccgcgggcgtgtttgttcgtacttcgtggtgggggatttggacggcttcgttgcggttgcgccgttgcggtggttgcttcggtgggtgggggcgggcggctggctggctgggggaggggtcttccctgtcgcctcgccgttcactcgctcagcgacctcgatcggatcctcctcgggactcgggagtggggaaatgcaaggctccagcgggagcccggcgtgccggggcacggctcccgaggcgggcggtttccttggtgcccgtgcagggttcgtgggctggggggagcttccccactgacaagttcgtgtcgctctgctgtttgattgcttttgtgttcgatttgttgcagggccgctgatcctggtttgagcgcctcgggttcctcttggatttggttggcgtttttatgggcgggtagatcggtccggtgatttctcagctgctatcggtgcg

SEQ ID NO: 5372 - DNA, 917 bp, Zea mays
acatggatggcagcaaccaaatggttgagcttttggccactcgttcactcgacacctattctacgcgttcttttgtggcaggcagaccaaagctgctttcgcgccatgatatgtttataactgaagaagagagtgagagataaaattgacataaaggtagcttttgctgcaaggcttgaccattgcacccggggaagggccagggccagggctccaggggtagaagagatgcgtggatgctccttgaaccttcagacagagctcagagcttcagaccactgcacggctgttgcattgcaccctgtgctctgtgtggcacgatgtcgccgtggtccaagccggctttgaaaaaaactgcaattcggtttggtttaccgaactgcatcctactctgaaccgtctcagtaaatgactttgcagtacattccttccaggggggccatgccacggtgatgcatgtgtgatgcagaactgtacacgagtctgaccatagatagatactgtgtctgtgtgtagctatgaggcgggcatagcatagatactgtatctacaaggtagtgcacaacccccaccaaaaaaatggcgaattagtaggccaaccatgtttgaccctgtggtttagctacagaaaccttgttacagcagtaagagaaatggacgaaacggtcagtcaaaaggtccaagtcagtgacctggtcattttggttgtgctgctgtctctgtgtgactgttgacaaatacctctacttatttattattgctcagatctaacgtctttacttgtatgatgctatctgaatgtctctttgcagttgaagttgaagttgcacatagcgcatacgacatcatgttctgaaatctcgaagcacgtactactgctactgtctggcagaggagttcgagtgttcgacacagag

SEQ ID NO: 5373 - DNA, 1270 bp, Zea mays
aatagctcggtacccctggtttaggcgtgagcagaaggattgtcccctcatataaggaccggtttttcatccttcactacctgtactcatgacaagtacaaccactcgagactgtatgggcaatcactcaatctgaacttgtactgtctgaacccagggttatgaaggctagggagcaccagaaggataaggagggggaatgttttgtccagtttggacatggcggtggcctgactccttccggtataaccgttaaggtggggacgtgcaaggaaagaaagagattcggattcggatctcatcggccatgagatcgcagagccggactagtgggtaaagtgtacacctctgcgcagagtttgaaaacctattcgaatagtatgtgtccacaggaatggacgagtctggtatggtatggcaattaatgttttgttttccaaaaaaagagatgcttttgagaaaagtggtttttaaaaaaggttcggcggttgagccgtgagctatggtggacgggaagtccagtagctgtttttgaaaatgaaaaccagtgggaaactactgagatacctggatggtttagtccaggggattttgttataatactgaaaaacttcctgctccttttggagaggatgcgctttgcaaaaatacaaaatgtttttttcaaaacaactctgcataaaatattgctgtttctgcaaaatatcctgagctccacatattccatgcattatatctgatttccccattccgcgggtgaaggtgggctgctgagtacgtttgtactcacccttgcttatttgttgtttttcagaaaaaggagatcgggtaagagttacgactgttcccaaccttgcctgtggctgttggaccgctgaattccttcactgcgtatatcgggctgcttcagccccactctgatgatatgtcccgagttgtggaccaactcttaaagttgttcgccacctttataggtttgtcgtttaagcagatctgtaatcatctgatgtgtaaatgtgtttactagcctcctgggactagtaattgtatcacatttgagtcccagaggattgggacgcttcattgatcaacggacttacctcctttgttgaggtcggtgtgtccgtcggttcccatcggagtctttgcgggcttggcgtccttcatcccaaaccgctttagcaagtcttgcgtatactttgtttgggagatgaaagtgccgtccttgagttgcttcacttggaacccaaggaagtagttcaactcgccc

SEQ ID NO: 5374 - DNA, 834 bp, Zea mays
tgcatgtggtaactgacatttttatgcaagcaattaaacaagtgagcttacatgtaccttttatatttttcatgtggctctaacaatcaaagagctgcttgctgcatcactggagatggagacaaccaaacaatattcagttacatggctaaaaataacctcgagatgtgatgcaggctatgtgacatgagataaaagctaaactagaaacacaaaaatgctacttagatcatctaaccaacttgaaaaatagccaaactgacccttttggaatttgatttacgatatatatgcgtatgaaagtatatccggtgtgctaggatgttgtaccaggacggatgtgtgtccctattttgatgatgcctccgtatccacttaaccagagggacatgatcagcaaaatctaccaaatcacgtgtagacagtctgtgtctcaccaaaatctacaaaccacacgtagacagcgtccgctcaaaatttttttttacggaaagctgtatggcgtcagaaattttttaacggaaaagctgtatcgcgtcaccgccgccagtacgcccgccaccggcgctcgttcttgtcttcgtccatgcactgtacactacacatcaccgactgtaccgcacccgcacatgcgggaagccgcctcatcctcttcgtcgccgtgatccatccatccacatcactgatcagacccgtgccgtgcagttccaccacacttgggggaggcagagccccaagcgcgcgtccgacctctggacctccgcaggcggaacctattgctccctgcaggttctctcgcgggcctagccgtgcttcttccccacccggaatctg

SEQ ID NO: 5375 - DNA, 1500 bp, Zea mays
gttcgctcatctcaccctgctgcagtacggtagaggtcgttctctctccctctgtttttatcatttgtgtagcacgttaagcttaggagattcgactgatacttggaattgtgcagttggtagatggtcggtaggagactaggagtgtttttacctcaccttcttatacttggatgtgctggtcccagattgggaccgggatccactgcaatatatcgcctgcttgtctttcttcttttagagcagaggaatcaacgatttaaattgttggactagtggaggtgccgagatggtttgtcaagctggcccagtggagcttgtcagctttttgcaaacggaattactctgagaagggaaggaccgaaaaagaacatgaatctgtaacggccaatagtacttagattcttctgtaattccagataaggaatattaggtgttttctggtggattagcagtgagaagaaagggggattaagagtgttggagactgaaccctaaccctaatcaggggttgggtgatgtattaaatagggagagtaactgggccaaggcccattacacaggggtataatggtcattacacagggaatagcacaaaccctagacgggtagtctaacagttccaattgtacttcgtggtgccaattggatgtctctaccatgtgaagttcatcattttagtgcaccaacgaactagtggtctatctttttagttggcagacggtaatgctggcgcgcgactggtgagtggtaactgttggctacttgattttgactaaatgcatggttataccaacagagtagcatgcttatgttggaggttagttttatgttcctataaactactgcttgcgttgccagtttgccagtctcatggagctagcttcaatgggcacctgcacaagcaagcgtattacttaagcagcatacatatccttgccatttgtgcagctgtttaagagcctatctcgaatgagcatttagcggagccttctgaattgtcaagcctgacgattgcccctgttccattgctttgtcgctgggctatttgatattttcgcactgcatgcgcttagacaacctacactacatgatctagctatccctgcagagatcagcactcgctcaggcatgcaatgcaatttttccattagccagcattagctaaaactaggcgcagacgtccttgacacgcatccagaagaccggtaataatgcatgataactacaaacttatatatatagctggtgcctagaactaattaattaagccgcgcgcgtcagtttgcgaccgccttctttggcttgggcgacgccgccggcttctcgtgcgcccctgcaggagcggcggcattgaggtccgggatcgttggcgcgtggttgcctgccgctgccgccgccgccgccgttctggcgacgcgctgcttgagctcggtgagcaaggccttgttctcctggttgagcagcagagccttgttgcgcagccgctcgttctccttc

SEQ ID NO: 5376 - DNA, 840 bp, Zea mays
tgattagccaccatttacgccgccctgccctgccctgccctgccccccctccttatacgaccaagcatcatagcatcccctctgtccctctggctcaagttcaaagggggtcatgaggagtggcagactagcgtccccgtcccccccaccttctcgtacgtgcggcgcgccatgccattgccgagcgggtcygcaaccgcccccgcgcgtcgccgccgaggcgagggagatcgatcgcggtcgcgcctataaataagccccaccacgcagcacgcacccaagaaaaaagcagagcagtggacttggccaagaaaaaagcagagcagtggacttggccatcgatcctcccagctgcctgcccccaccagcaatctccgctgccggccccccttctccttctgctagtcgagtgaccgaccgcggcttccaacggcggaggtgatcctctcggtctcgtcgctttttttccatggtgatgcatgcatgcgctcaattggttcctgcatgcatgcacaatcatggctccatccatgcgtgtacatgtacatgtagaacgcctagtgcttcccctccccctttttgttcgtttctgctttacacaatctgctgccccccaatgccttcgatatattttgaatatatatatgccttggcaagtggcaaccaacctttttatttatttatttatttatttattcaatagaagtttcagtatatatatctactgctgctctgctagcatgcaatgcaccctgttccattttgcatggccttaacgatttggtctgatgatactctggaacatgggcaggcaaaggcaaaggcaaagcgcgagcgagc

SEQ ID NO: 5377 - DNA, 822 bp, Zea mays
tgtacgataaaggagtacatgtagtgaaaatgacaagccggtccttatatgaggggacaatccttctgctctcgcctaaaccagctgagccaacaccttaggccctcccctaaaccagggagtccctgatcatcccactcccaaggtgatgagggtgagtacccttcatcgcataacctttcaaaaagagattttatttgaagaaacacattgcccttcttcccaatccatatttcgtgcccagaatgtatatgttaatgcgggccatctctcactcacaatgcaatattccccctgaattcccggcctaggcagtggtagagagaataggaaatttatgcatcaagggaaggatggacttgccttcgtcgaagctttcctggcaccgaagatctacttccgggagatcgggctccggcccttcttccggggctacgggttccggatcaacggtccccgcttcttctagtagaacaggcaataaaacaatacatcaatagtggtttacaaattatagtgtgtcattttctaacatcattattgcatgtgaccttagaaatcatttttgataatttttggtgcataaaatattgagaaatactaattagaggagaaaaggctgaaaaaggaaaaagaaaaagggattccagcactggtgggccggaggggaatttctggcctagccaggcgcagcgcgcgcgcgagggcgcgagcccagctgcggcccaatatagagctgagggcagaggctcaatcacatagtgctgctgcctgctgagtgtccccctttctcttttgttgttttttctaagcatgtaattt

SEQ ID NO: 5378 - DNA, 160 bp, Zea mays
gtcgctttgtttaggggtttcagaaaatgttagaaaagcattaacgtttcaggggtaaaagctctcgaacaaagaggtgtaccggcgccaccgccagtacacaccagctcgccggagatcacaagaagatacaagaccgtgctcctcgacgccgcccgac

SEQ ID NO: 5379 - DNA, 433 bp, Zea mays
atattagatttgtgatacaagtcggatgttttagaaacatccctaattggcacacgtgcccacgccatgagcagcgaataacggttgtgccacttatccccatgcggatcttctcttatctcttctcgcgactcacgaaggaggcgcgacgtgcgcgtgccgctgtgctgcactgctagtgttcctgcgcgccgtgctgtccggcccgcccgcgccgcgcaccgatgccgccaccgtcttcctcgcgctactccccgggccggctgctcgccgcgcgcccggcgtccgccaccacggcatgctcctcgtttccgatcctttcggccttttctggtcttggtcacctacgcaggcggaccgtgcgctgatatgttttgcacgtgcacatgcatcacaggtggggagatgggcgcgcttgtcgtgctcgctgtcc

SEQ ID NO: 5380 - DNA, 115 bp, Zea mays
ggtttcaaattggattcttttttagcgggatggatagtgatggattcgagtggttttgcgtttgtaccaggtgtcgaattggttcataaacgcgcgggttcgtctatggaagccg

SEQ ID NO: 5381 - DNA, 200 bp, Zea mays
ggtatgaattcgaattgattcgcccaatccgggtaaacacatgtagcatgtagtagatgatagttccgccccaaagctcgagttacatcgtatccagtctgtttatatttgaacaattacttcctgatactcattgacaagacaataattgctggtgtataattagggataagcagttgtgatcctgtcctcttggtcgg

SEQ ID NO: 5382 - DNA, 583 bp, Zea mays
tctagtggtggtgacccatcacatgtggcctgggctacccacgtccttcgtaatagtggcagcccacagcagaaacgctgaagcctatgaaggtgcacgcgacatgattgctggcccacttggcccacttggctaagcgtctagcccagacccacgtccttcgtaatagtggcagcccacagtagaaacgctgaagcctacgaaggtgcacgcgacatgattgctggcccacttggcatcgatttacagcccgtcagcccatggtctcctatacccgctcggctcggcgcctctgcctcggccgctccccgttcccgtcaccgcgccgccggccgccaggatcgcccgccccaccatcctggctcatcagtcctcgccgcgagcccgtgcctggaacgccgcttgcgctaccacgccgcggtcccacgcccgctcccgttccagcgacagggggttactgggacgagatcaaccgtaacctgactgactcactgacggccttgcactctcagcaaaaccgtggcacaagtgggcaccggggaatcagctaggatttaagcttgagccttcgctccaaacctcc

SEQ ID NO: 5383 - DNA, 442 bp, Zea mays
aaaaacaacttaaacagctcgagaagctgtgtcaaacgggtgcctaccaactgtctgactgtgtatatatacacacatttgacgtcaacgctctcgtatgatcaggcttctagaatcccatgtgcgctgcatgctctgcaataatccagcagcctacccgaatccttgtggacaaggccacataaaagctaagcttactggccagtctttctatgaattttatttttcttcagcacctgtactattctgtacctctccgaacgaattctctgaaattttgtcgcggtcaaaccacgtgatctcgtggtccaagatttccacgtcaccaagctccggtccaaccgcgcagccacatctatataataagtagttcttgatcgtgttcgtgcagtgagcacaaacataacagtcttacagtacgtagcagcagcctagcacgacg

SEQ ID NO: 5384 - DNA, 1107 bp, Zea mays
atttgaatgtcaataacgagtattaaatataatctaatttaaaataattacatagacgactaaatagcaagacaaatttttttaattctaattaatccatattaggaattgtttggtgtaacatcacatagatgaaacatggattaattagtcttaataattgccttgtcatttaattatcatctttataattagttttgtaatttgactatatttaatacttgtaactagtattaaaacatctcatgtgtaagaatttagtctggtgaaccaaacacccaatgctttgggtattgagagcaggtttacaatttcgctagtacggagtacggaccgaaatttcgttgttttatcaaagtttgacttttgtatttttttttgaatttgggaccaaaatatataatttttcgaaccgaaaattcaatcttaccgaaaacgagccttgaactgaataggagagtactgtcggacgtagcacgtgctgcctgtttccgccgcttttgatagcatcaaggtgagatctagatgtgtgaaatgataaaatggcacactatttattcatcgctatttgcgagtaattaatcaaatccagttgataaatcgtcagatctccgttctcttactctgcgctgcaactggacggtacgtacaactaatctaatttttcagcttctgcatggacgaggaggtcaggacttacggcttgttcgctgcggcttgctgcggctgcaatccggctgcggctgcggcttctacagtatttttctctctatggattgcagctgcagcagtccaaacagctgcaacagtgtcggcttgcagcctgccgaacacgcccttattccagattcttacggcaacgttaccaaaccctcgggtgaaagcagcaagcttcaactgcagatataccaagccgcctcccttcgtctccgatcacctccataccgagcagcatttcttctcttcccacggcaagtttcgcaaccggacacggacagacacactgcacagtataagtaatttggccctggtcacggtacaagacaaggaaagctctgcagctcttaacatcaagcagacccggccaggccagcaccagccgcagca

SEQ ID NO: 5385 - DNA, 1066 bp, Zea mays
ctcggtaccctgacataaagggcaccccataggcctgctggtgccattcattgatttctggtggcggaggatgaagaggcacatcaggcgagcggggaggaaatggcatacccatggaagaagcttgacgatggaggttgtcgtcagtctcccgctgacgcctagccagctcatgcacatcggaagatatgttcctgcacatggaaaagaatgctgcaataccatgggccagacgagcacccatcccgcgaccacgacctcgaccacgaccacgacaacgtggtgtgggagatccgcgaccaggagatggacgtgatgggccggcagcagtaggtccacgagagctagagggagctttcctcagacgccctgctggattgtttggatcaatccagaagggggtgtaggagagatgtcttgttcctttctcaaagcaaaactgagtcaccacttcaatcatcttcatgatgaagggggcgtgaagacatcccttgagagggaagcaggcagcatgaatgatttcttgccaaatcatatcaaatacattgatgctttcagaactatttggcttcataaatgagagcaagactttgctctctcccaggatattcatttggttacctccttttggaatgagagtcattctgcagagagaatttatgtatctgtagaacttatgcagattggttgactcccaatatttatcagtctcagagatatgaagatccctggcttcatccttggtgggaggacgaaagtcatgaatcttaatcttgtcgcctgaaatatcgccatcagaaaatccaaggatgtgagcaaacctccggtagctcaccttataccagctgccttcaatatagaaattgagataaggaaagttataaggactttcctcatcagccagcttgatccagagagtagaataaaattgtgcaatgacttcatcattccaatcatattggaatgtcattatgttcttcatcctcttcctctcacaggccctcaatgcctgtgtcatctctggatcaccaattgcttcacatccttccgagttaatatatcgctg

SEQ ID NO: 5386 - DNA, 1500 bp, Zea mays
aaaagattcagatttttttgctaccttcgttatcttgattacttatatcacgattgactttattgtcttttagatttatcgtatggttagtagtgctagaaatcagacagtgctggcctgagcccatcgtgctttaggccacaaaggcctaaaaacttttgggccatatcgtaccagcctagagagtaaaaacagtagctcagccccgccctaaaagcatgtcgtgtattcgttgggccgtgccggtctaagcccaacccatatatttaaaccacgtaaattccaaatattacaaccacataaagtctataggttactaaggttatgtttggaagagcttcaattcaagaatttcaactttgttcaaactttttccacccaaataggtccagctccacgagctttagctttaaaaaaattgaaactggagaccagtttcaataaattcatgaagctccttagagggtgcttcaaaatattgtttttatatctactcatgaagttgcacgaaaattatccaccatgccactggttacacaacatacaacatccgttctatctcgcgacaacctactaatcatcaaggataattaagaaaactcacacaaatcaattttactatagaagccggagtccatgtgcaagtcaaacgctcctgaaactcactttaacaatttgatagagttgttttatggtgaagctttaaagtgaagytctcccaaacaaagccctagattaaagatattaaacaatacgagcatcatttgaccacataaagttcaaatatcacaaccacataaactccataggtactaaattaaacaaactaaataatataagctgcattggactatattgagacccagcctaagcctgcctacgggccattttagtctaacatatattatttcgtgttggaccgtgcattattctcttgtttttagatcataatcgttgttactggtccaaaatgcacgacctatgttccagcactaatcgttagcgcacgcgaaggttcgtggtaaaataaattgacagcagcccaatctcccgtgacctcagttaagccatggggtggacccgcgaggccgcgagacgaatattctccggactcgcctcgcacaagagcaagatgcgaaccgagccccctctggcgcgtgggacacgacgtgcagcgctaacggctggcatgcggccaccacgcgccatgaacccgtcgtcccacacgccgctccatcgcctcgcatccgccgccgcagtcgtcgcttcgctaccgtccagtggggccgagtggccgacccatccaccggaccacggtagaccggttgcacgcccccaatcgacccaccttcttctacaagccactctccctccccgtcgcatctcagtatctcactcccagtcgcctccgcacatacaaatacgcgacgggaacggccagggccgaaccctaaaaccatcgccctgcccccgcctccgcctccgcctccgctgcatccc

SEQ ID NO: 5387 - DNA, 196 bp, Zea mays
acacatcacatgaccacaaagccactgcgggtcaaccagggcactacagttgctggcaggcaggggcgaggcaacaatagtgtagatgaaggcgttgctgttgactgactggatggtgcctatgtgcagtcttgtcgctgcctgtgctgttagaatattgtattaggctccaatagatgtggggccaagctgtcat

SEQ ID NO: 5388 - DNA, 364 bp, Zea mays
acaggttcgatgatctggaagtgcccggcaaggcggcaaagaaaaaaaatgtgaatgtatttagcttggatctgttacaaataattgcaaactgctagctcggtctgtacattttacagttgctattcgtgtactgtgatgttctcgtaagtttggggagatgataaaccaatatttgtatgatatatgtgtcgtgttccataaggtaaggttttgacggtgtgctatcatcacctgaggtgactttagcatcaccaggctacttcaactcggttaccccattcccatggctccatgcctggtatgatggtcccgtccaattgccagatcctcgtctatccagcgaaagcatttctttgtggga

SEQ ID NO: 5389 - DNA, 783 bp, Zea mays
tttgaactaatactaagcttatataaattccgttagatactcggtttgacatctcttttttatatacatttcgataagatcgtaaaaatctcacctcgcgcgcaaagcgcgcgttagacacaagttgcttctcacttggaaggaattatttgagttagaagaggagctccgtgctctgcttccttcccggccaatttttattttttatttcacagtcccattctgatcctgtggacagtgggttaataatagtaataaaaatgataatccacctcctctgcttcccaggcccagcagcaggagctcccccgtctccgtcctcctccgcctctgtcagggtcccggtcggacttcctcacgaccgccgcgccaaatcccgtctcgttcctccgttccgctgcgcatcctcaggtacgcccgcctctctccctcttctcttcgaatcaactgtaccagtaggggaggagacatgttcccgcccttttcctccttcaccctagatcccgttagtctaggtagcattgcgatctgcagatgtccttccgttcccgcggttccctttctcgcccttttcccgcccggggacctcatccttccctcagcaatgggatccacgtcttctcaccctcctycacagatttaccagtgatgatacgattcgtcgtcgtctcatcggccccttgggatctagtagcacatccctttctctgctctccggttattgaccttccgtatcactcttctctgcctcacactcctctcatgcccaatccacgcgcagga

SEQ ID NO: 5390 - DNA, 73 bp, Zea mays
cctttggcctgcccgataccgaggctgactggctgcgtctggatcaagccctgctcgcctataaggacgccac

SEQ ID NO: 5391 - DNA, 931 bp, Zea mays
agatgggctgtgcgcctgtgcggactgaaaaagggaatgggccgaaatgagggtcacggccgaggtaagcctttcccctttttgttttgaattttatttcaattcctttattcaagtttggatttaagaccagtttttgggtttccccgttcacattttaaatgcacaagtaataaaatttccggcttgtatgcaaagtctagttttatttatatatatttatcaatttgttttttatataaatgcctcaaatatgcaatacactcaatattcacttttaagaaaatattatttggtatatatagtcaaattgaaagttaacaaaaatgaatattcataactcggaatttttaggagaaagtaatatataatctttgccatgagttatccaaataattttatagagtgctttatagtttagaaaggaaataataaatagattcaaggtctttcttttattctttgttccaaccttttgttttaagttttgtaccttagttttgaatgtcaaattatttactatttttattcttttaatttagagaaatatagtttataagggaatgaaataattattattattcattttatctcaatttttattggagaagacttaattagaatttgtaaaatcttaaaatagaattttgggtgttatatatagttcttttaatggtagatctctaatattgcactcttttaatgatatactgccaattttcccaaccagaaaacatgctgaacgttctggaaatcccttaccccttctctctccaaaaccctccctcgctcttaatgcagtccggtgtataaaaccgcgcaacctcatctctaaaacccgctcttgtcttcagaagtttcagatcctcgcatcgtccgcaccttatcctctagactttacagtacctgctctcagctcctccctatctca

SEQ ID NO: 5392 - DNA, 826 bp, Zea mays
cgaatttggtgataccgtaatctaagatcaatcttaggaaatccagttaatactaggagatttaaaatcttgtttccatcccaacccactgagggctcgttcggttaggatggattgagaaaagggtttaatcctgtccagtattttcctaaccaaacaagccctacaagattgttcgattagaagtggattgagatagattagaggagattaaatctcttgctattcaaaattgaatagaagagaatttaatccccccttaatctacttcaatctttatacaaccgaacgaagtccaagggggcatttgattctacctaagggcttggattaaatctctaactagtaaaaaatgaatagaaagagatttaatctctctcagtgccctccaatccgtatgcaatcgaatatggcctaactaaacgtagaatacatgtattaaatatagtctaattatcaaacatattatataggtaaagactacgagacgagacaaatttatttaaacttaattaaacctataattagtacatataaatgatatttaaatatttgttgtgacacataactaaattttagtcagtgtaactaaacagcccctaaaaggaacatataaaaatggtaattaccaatgcagttcaatacttcgcgtgacaaagatagatgccacaaccaccattccctccacaccacacaatactttcttcttcggtagacaacaccatttaccaaccaatccttccctgccaactgcagtagtttgttgaataactcgatcgagatagacctatcgctatcggtgtagcattcaagtagggaggtggcc

SEQ ID NO: 5393 - DNA, 945 bp, Zea mays
atatttgtttcccttctaaattatataagctagattaaggtgaaagtgtagaggtaaaatatgacttttgaaacataaataagctggaataagttagtattggatagcttatttcagcttatttgtaaccccaaaatgataatttattcttctatctttgtatcataatccaacttatataatcttggagggaagtaaacataccctaattggcggacgtgggttcaaacccgagcccttcgaataagattaatgtttatccataagctctcagtaattcttcatccaagcttttcatgttggtaaaggtactaatcctctgcatctaagacttgcacagctctaaacctgttcaaacgttaagtcagattaggttgtcccatactttcccgttgttgggtcagattttttcaggcagattttttgtctttaggttgagttttatttaggtcaacaatcatagcctgtatccgtgaattgtccgaccgtctcctccgggctcgtcttgctcctgagcccgcacatgcccgcctcggcaccaatcaaacaggccgaaaccgagcccggcccactgaagcccataatcactcgcctccctccatctttgacccagtcctccgtgacgacgtcgtgttttcttccttccccagtcgcatcccacgcgcccgctcctcgtcgccgtcctcttcctccatctcacccgtccctcagcctcgttaatttttcgcccccatctttgaacgcagcggctcaacctccatcgttctctccctcctcctccccccgatcccgtccctataaattgcgcccccgccgycacagcggaccgcaagcacgcaatcacacagctcgctgctgctgccgtctccccgtgtcctgtcgttctcccgtcgccgggggcggaagagttcggcgggcggttggggattgctcgggagccccgtg

SEQ ID NO: 5394 - DNA, 1500 bp, Zea mays
ctagtagagaaagccaagttttagaattaacccacgttattaacccaagcgtactcctttccaaacggaaagagtaccacttatcattaccagagtcaataccaaagaccatcaatctcattgccaccagtaatccgaacatctctgatcaagtaccactaatcactggagctctcttggtcgctcataaccgcgagcacgactgatatatcagttttcaaacactctgcaaaggttgagcactttacccacaagccgtgatttcctttatacccggagatcatgactctccattgatcactaccaaggtgacccggtagggcatcactatgtagcctttacaaagattccccggggctgtagccgcccgttaggtttcctaaatgtactacactcctccccaaggggcgaaccaaacttggcagagcgagccgcatacaccgagccccattgacagcacaacggctaagcaaactacaccccaattcctctaattattcagctaagggcatcccattccaccctcatggttgcactgttttctcgggcggtcatccaatgaacaggtccttacggagaggcactcgagaaaccgctcgagcccccttgaatgccacaagtatagcatcataataaaggaggaaaacagtgtatcatcgataaatcccatcatgttcattgattagagttgaacaatagcataaagctaaacaataataatccaacctaaataggtaaacaaggacatggataacaaaagctagtcaatccttaggtataactgtgaaatgcgggaggtgaattaaagaatgtataggacagagataggtcaagggacacttgcctccaccaaccgactgctgctcaagggctttctcctgcgagttcttcgggctcctcaaccaaatcgttctctatgcgagcacaaacatacatacatccatccattcgaattaggaaataaacagtccaccatacaagagaacagatagattgaatatgcatagggtatgacatacgatattgtattcgccatggctagaaagagaagaaagaaggtctcgcagtggttaaagttgtacttgaagcgtattacaaatagatgcatactaatcattacgtgatctagttccacctagttacactaacaggtattaagcacatgcactaatagagttataactatttccaattgatcaacattaatgtggcggaactgcccgaattattccaacttaagtgcctaagtcccgccttagaggctagaccacacttaaatgggaataactcgtcaatccctcggatctagtccgacgaggccactgacaggatcaagtaccacaatctcactcgatggtgagtcacagagcaaatacaataaaacataaaaccatacattaaggagtattaaattattacatcatcatcggagtttttgcaaaagtagtcatcattgttcgaagtgcagcggaatgaaactaacgataaataaacagagag

SEQ ID NO: 5395 - DNA, 903 bp, Zea mays
gtttgttagtttgtttatattatatataaaataaaaatataaatcgtcgctaactccactctgccgagcgccgggtctcgcagacggaccacggtccacgggttgtaaaaccaaccaggctaccagccgagggcgagtgcgtcgctttcctcctccaggcctccaccctcgctctcgctcgctcgtcgtcaccaccacaccagcgaggcgcggcgcggcgggcttcgctcgtcgaggtttgcgaccttctcctgctccttccctggttctgcatctgcatgcgcgcacgttgctctccctcccctgccgatttggtgccgagctctatctagcctcgtgctcatggacggggtccgggcgcgaggcagccgattgcttggtggcctagggtttcccgtcctcgatatttttcagtggttgtaagagccgcggcgggggtggcggcggcggcgatggctcctgggccatccgccagcggcgtcgtcgcgtgtaggtttttaggtgtttgtttgggttggctaggcttgtcatgttgcctagttttagcactgatctgggccattcaagcgccacatgttcccgtgctcgaatgcccaattttagcttacccgccccgccggtcgccgaaatgccgcctttcatgcgcctcatcattgcgggaatctgccgagccgagctgctactacttgtgtcattgttgttattcaggctgcaagtctagggtggcttgctagtcttttatggcatggagtatgattagagccaccggcgcgtatcagcctgtgtgtacggaacggaacgctcgtgctggtcaccgcgagaaattgctctgtgctgctcagcagctcaggcagtggctgatttcagttagtggttgcttcgttgcagagaggcgcgccgtcc

SEQ ID NO: 5396 - DNA, 1500 bp, Zea mays
gcatctgaaagtcctgagtgatttgtgaggatagtgacaacgagatattacttacgttatcgcgacttcagaccttgcaggcatggtgagtgacggtggcatgacgggtgtcgatgtttaaactctgagacgtgaacaaacacacccgtgacagtcctgaaggttagatttacggtacgacttagatttgcctagtgattcctgaaatataaaatgcaaatacttttcctgaaatataaaatgcaaatacttcgatccctttggaatgtagaaatttcatgactagaaatttatacggggaaaattcccgtatgcgaagagggccttcattaggagcccaagggtttgtttgtttcgatttttttctaacgagcttttctgaggatatagttgttggaaaaatcttgctgtgagaagaatctgagtatcgtaaagataacgtgtggtggaagatgaagtttattgagtttagaatttaggacttgatgaattccttgtatcacaatgacttaaccgattatgtgacaacattgattttggatgatttttaccaaaacaattatcataaaagcatgctaaaaagatggtccacaacatagattgtaatgggtaaatacccaccgggtattactatcccatacacgtacccacgacgaaaaaatagccccgtcgggttacccgtaccaacaaagattaaacatctaaattatacaaatgtaaagtatatctatctaaatatcattacaaaatttctagcatcattcaatcatctattcaacaacaccatagataattggataaagtagcaacactaggatagtaccacataacatattacatgttccattacatggttatcaaataattattaagccttatatgacataatcacctaaaatgttgttaaatagtcaaagagatggatggctgaagcccaagttcatgtttttagactgagtttataccgggtattttatacccattggttaacggacataagtgagggcagaacgtttacccaattactcattgagtgaaggtttttgcacaataaaatacttatgaatagaacatttagactcatatacatattttaatagagtaaatacttatcagttatcggatcacggatacccatttctagtccccatcagaaaaaagctgaaacaagactcggcttccacctgtcaatcaaaaaaaaaaaactccacattggacagcatccaggccccactgtccaggcacccggatcctgcgctctccttaccctctccacttccgtttccggatcccgtttccagctccgatccaacccagcatctgtaccgcgccgcgcgagcacgtccggcgccggtgcggcaggcgaaatccgagagcactcctcccccgstacgccgcaccgcccatggccgcagctagccgcagatagagagaggcgcaggcgggggcgtgcagatccagatccggtgggcggcgaggacgagatcgccccctaccacc

SEQ ID NO: 5397 - DNA, 142 bp, Zea mays
cgtcagcgtcctccccacgttcaccgcttcttaagcccagccgcagccgcagccggcgtcggcgcccggcttcgactgcctcagcgaggtctacggcgccgccgcgttcggcgggcccaatgctggtgactacggcggcgag

SEQ ID NO: 5398 - DNA, 685 bp, Zea mays
ctcggtgacctcccatcagaaatctgtctcgaagtgactgtcttcgattcagttaaaccgaagaaagattggggttgcttgatttctagggactaagacctgtttgatttgtggtaattgcaccacactttatttaatgttagtcgttcgaattaaaaaacaaaatttaaacggaaaagttagacaaaatgtgacaagttagtcagcgaaccaaatagaccttaaatttttgacactacatttttattatattttaatccctaaattattaaatacaaattcgtatttaacaagtatgttgtaaaattatatttcacgagtgacattgacttggcgtcataaattttgtgcacttctggtcaaacttaaaacagttttaacttagaacaagtttagaaattatttcgatttttaaatcgacggagtatattttttggatgggaagatttaaatcttgaaggaaactttggccgtgtacatgaatgggtacatctacrggcagcagactcgaaccagacaattacgaactcactgccgtgcaccggcccacctacctcgtagtgatctgcaggctataagtagacggcacaggggcacactttgatagcacacaccagtaccactgcacaaaagcacactctgttcggcttgccttgtcctttttccttgccatatggctaccaag

SEQ ID NO: 5399 - DNA, 1388 bp, Zea mays
cgttaccgacggtaaaacgccaaataaatacaatattatttggaaacggtcagaaaataccaacaccgtttctgttttctatttccgatcgtttttaccgattttgttagataaccgtttttggtttctgtgtagccctaaatttctttgaacttttaaaaatgattaccgatacatatgtgcgctagtattaggtcaactaaattggtcgcatagtctagtttgaattcaaaatttttcacgggctcgccagacagggacgtgtctagggagttgcccagccagccgaaaaaagatacaaaaaaggacacctttgtttcttgttttttctgtcttttttctcggtttgacttgtgacccaaccgtctagtatcggtacaatattactcgtacgtaggctcgtagcctagcactgtcgccatcagctgggaccagacacgtcagcatgtggaggcctgggcccgccggcaatatgggcctacggacggagactccggagacgctgtcagccgggaccgttgaccattgactgttacccggctccagctgcaaggcctaccaccgggccgggcccggaaagcgaaagctcatgctacggagcccgctttccggtagaggacaccgtgacgaagggagcagagaagccggagcgagagagctgcggctgacagacgggcccgtagtaccctgccccgctctaatccacctgtacgtgtacagctacgggccataatcgcgcgtcgcgcccgcctcccccattaattcccgtccactccctcggccgcacgtgccctgaggcaacctcacctggctgaccgatgggtccaagtcgtgccgaaagatgctgctcctcgggccccgctgcgccacctggcagtgagggcgagccggacattaaaatccccgcacccacttgacctcttcctcctctctcgcctgctccacccccgccaccacaccgctttgccgctccgatctccgcacgctccggcgagaggggcccactggacagccagctcagtaccctcctacggcgacgctgtcgcacgcgccaccattaggtgtcacccgtccttgcgccgccgcacgcatcccaacgcagccggaccccacggcagccgccgccgctgcggcgaaggcccagcccaggccacgcgcgtcatcctcgcgccgaacgacgcaaggtggagcggcggtccactccccgcgcgcgcttcgcctccgctgcactgaaaccgtgccctgctggtgcgagtgtccggatgctaccaaatcctagggccgggcatcgactgactgactgagtgagtaagggagggagggagggaggagccagggcctcgccgcccgctgaacgagggagtgatgcggcgcggaagctcggccgc

SEQ ID NO: 5400 - DNA, 652 bp, Zea mays
ggtcagcctgcttgctgcctctggcggtctgccatcgctcaccccttgcattcttcttgttcagaccaggtcagggattgtttgattgacagtatagctgcgattttagttttttttttcggacggatagtgtatgcctgaatcttgggtgctcacacgtcaaagtgcgtgatcctgcttggttgttaggtcgtcgtggaatttttcattgccagtggccagtgccacactttgttgcatctaactttggcacaattcctgtgaaagcttcaaagaactacaggcaggtaagtgtctgttcatgtctgcatgactcatgaggaagtcgctgcgacgaagaacaagtcttgtcgatactgtgaaagcccgctttgtcttggaatcagccaacgatcacgacagtgatatggatccagctcgtagtatattcagaaagttgacaacttcacccgatctttttttttttgaaaaaaaaataagtctacgctttggctttcggggataaaaataggttcttggacgccaattttaccagataatatatgccatacttatgtcaaatgtggactagttcgtgcgtgcatgctgatcacgtcaacacgcatggtgccagtgcgctcactcactagtcagtgcttgatttgcggttgca

SEQ ID NO: 5401 - DNA, 1500 bp, Zea mays
ttgcattgtactctgatatgctgctttgagtctctagaaggtattgggttgagttttgggaacaaagtcacatactcgcaagtcaagaatttttagtagctcccattcacatttccctctggttgcctcacgagtccttcaatctagaggatggtgtgagtgctaatkagaaagaaagatcatatggttctattatgatggaaagattgaccagttcaccgaacagtcaaattgatcatgtgcttcaggtgacaaaacttcgctccactttgaccttatatttttggcttgctgttcctatttgctttatcgtttacagggcggcgtttggatgccttcattaaaatcatagaaaggatgtctattaaactattctatgagagagatctagttgaggaagaaactcccgtggtgttttcggatcatgcggcaattaaggaattctgcagaaaggtgagagcttacacaagaaaaatggacgatgatgcgaactgccaagcctcgtgatggtatgtgtgcatttctcatttcctttttagccttcgaacacactttgaaattctgctgatcgatgaaccagaacaagtggaagaccctggttcgcgctgcaaatatatccccgcagcagcgatgtaacaccccaaaaaaaccttaaatttgggatctaggggaaaacatcatccaaaaaattaaaatgaaagtgattgaataaagaaaatgctcacatgaattaaaaatactttatatttagaaatcttttctaaatatttaaactaaagtattcttattagagattatgttctctcaacataaataagtaataacgattggattttaagttggattaaacatttaaaaggctattttctcaaaataaaactcttgtttgcgaattgcatatttagaagtatttcctaaatatgacaataaataaataattcctataaatataacttgcataccatgccgaagtttgtttgtgcatttatgtgtaaattcaaaaccgaattttaaattgaaaacagaaataaaagaaaataaaagaaaaatacctgttctgggccgaaaccactctttctcggcccgtttcccttagaatcctgtccgcgcgtcccagtcgaatcagcgtggcccaacctccttttacctccccacgctagcccaactcagactttcgccgacaagtgggtccctagcgtcggcctcacctccaccgcttgcgcccttggaccccgtattggctaccacaccgactggtggggccgctttgtcggcacttcccgtgctcacgtctagttggcagcgctgctatgtgggccaggtttgtcaggtgtttcgtttaccacggcgcaagctcgtgtaaccgccggccatggatcccaataaccaactctgcaatgcctaggtgtttctcctccgccccgaactagatctcctcagttataagtatcacggtctcccctcccctttctcccatcgagttcatccctcgtccgcagc

SEQ ID NO: 5402 - DNA, 137 bp, Zea mays
cctaaatagaaaacaacacaagtcaccatcgaatagaaacgaaatatttttaatccgcttttcggttggtggtgcctggcatctaccgtgcggagggggaagagggagaggccaggagaggaaagcctgcagccacc

SEQ ID NO: 5403 - DNA, 1500 bp, Zea mays
ctcgtcctcccatcggcccatccatccatccatccacgtccgcccatcggcccttccttgatttggctttttagttaattacctcatcacaccactgatgaacagcgagcaccaccgccgccggctaatggatccgccgttgctgcgattaagcataatcttctacgtactgacgtcatcgacaaccggagtaattcgctgcagcaacacaccatgcaatcagacttgaatccattcctccacagcgagtaactgcgatttgcctgacgacgaagcaactgcgcgtgcgttgcgatagtggcgatatcaaatcagtttttttttctcagcgttgttgcgcagacatgcatgctccatggttcttgtcaatggggtcgtctctgcaactctgcgtccacccccccgccaccccttccaagttccaaccggcctttgttgctgcctccttagctgacttgctcctcctgcaacagagccaccagatttttttatcgcctttttttcccagagaaagagcagaacatactccgtatgcaacactgatgtggcaaaatagtgcaggcagcactgaatgagaggaggcccccggcccattgctcatcctcgctcatccaccatcatcatgagctcatatgcgtgctgccccccgtccgagatccctttgcttgttttcggtgacaagctagctgacagctcccatacatctcacgaggagtagtttacggcatgtgtttaggggcagcttcactaatcttgttgtttagatagtgaagctgtccaagaaagggacttgcttgcacgcatgacaggagagcgaaacatcactaaacaaactgcacacacagagcaatgatgatcatggcacacatgtacactgcatcgcacacaaagtgcgtgcactgtttgagatgcaagctctcggctcctctcctggttcgcagtaccagttgcagttgcagtttgtgtccgtccagtccatgcatgcacgtgggcccccgcgcgtgcatggggtggcgaggtagaagaagattaaactggactcctgcaggccctgtctgctctgcgcggggcactgcatgccattgcttagcaagcgagcgagtggtgacactgacagtgtgtcattagctagcctgccagggttggaggaggagaggggggcgcgtgcaaaatttttaatccctcctccccccctagtgtctactactactctactagcgacggaacggaaactcggaaaggcaccccatgcgcgttggatggaggagccctggagagtggagatggtgtttataaatccgctcctcctgccaccccaaggtttcagaaacccaccaccgcaacacctgcgctccggcctgctctctctttcaaacagcttcgtgtgtcgttgcgccgcgcatagttccagcgccagctcggcactgaagaatctggtgaccggccgggatcgagagccaagctcgagcaggaacggagagcgcgcggatatatatagct

SEQ ID NO: 5404 - DNA, 1437 bp, Zea mays
tttccccattgaaaacgaacaccaccattgacactgataaatgtagtayagcatttgacaacatactttcctagaaagtaaccagcagagactggacgctacgtactaccacaccattggagcagccaatttaatcgtgtatagaactccgtatcgaaatttgtctgtgaatggaccttcatttgcatctaggtctagtacaatggatttcgaacaggacagcgccgatctggcaatacacacacgcacgacgtagcacagctgttcttcgttccacgcgttaattgaaggcaaagcgactgtagttgctgttggtggccaagttgtttaatgctatagtagcagccagtcactcctagggcaaattttaggacttttgcattgcattgccgccatgtagaggttgactgcacaccgagaatatcgagcattcattaggctccttgacttgttgctgtgaactccggccatctgtcacagtacgtatatgaccagatcggcaccatttgtctcggcctgacaatctcgcgcgccattggccatgcaaagctgtcctgccgttcggagagactagagagccagttggcaaattgacatttgcgataggtggggcggctttgactatgacatgatgacagatccagatggtcctccgctagtccccccgagcccgaggacagcacactagctcacacgaactgacagcgcggaggaggacacgtaccgggatgacaccgccacccatttgctggcaagccggggtgcgccggcggttcaggttgaatccttcctaatggtcgtgctagcaaaccccgcaagctcagtgcgggtccaaaacccattaattatcccacaaagccgccgttagacgtagaatcgacgccgcgcgccacggccggcggcggctacctggctcttaccaccatcattcgcttgtccgttccgtcgcccccgccaccctctcagagatggaggcggttaagtgcctgtcgactattgcagaacgtcgtcaggctcgctagttcgaccgagcatcctagatacataatccaaattccgctcggcgattataggagggtgatagtactgagtacagggcgaaaaacgttgaaaaggtcagcgaggcccccacatgtctcccccggtcgcgttcgcattcaacaccctctgcgctgcgtttcatggaagtttccagcagccacgcccacgcgcatggacgcggctgatcttataaaggtggcgcgcgtcccaacctcgggagccatcatttcaccagaagctgcaaattgcaagctctcctccctagctagcctctccagcagcccaaccacagcctgcagctgcagctcgcgttggcacagcgccgcctgaacgcgtgctaatttaagctctgtcgtagctcaacgcggccgccgggctttcgccgacgacgtcaaa

SEQ ID NO: 5405 - DNA, 186 bp, Zea mays
ctggcggaaggacagctgtcggggctgtccagtccttgatgacgtcctcttgcttccgtaagggggctgggagctgccgtcgtcatagagcgtgtggggcgccatcattacttgtttggcggggcgagccagatgggacgccggtcttgtcccccgtagcctgagtcagcttggggcagggtaatg

SEQ ID NO: 5406 - DNA, 1197 bp, Zea mays
cctcatgactgaaaataaattaattaaggttcggaatttgcaaacatttggattgaaggaaaactatactacggcattttttttgttatcgtagacctcgatgggtaataagataactaaagtgatactggtataatgctcgtgcgctgcgatgacacaatcatatttgataattatatatttaatataaaaaagaatttatggtccatatataagatattaaaccgaaaataacaaatattatactctatcttagccaagaggccgagaaagttatgagttggaaaaaaatctgaccgcgctttttatagcttgcttggttgcccatacccattcagctagtgaggtgatacatactacgtggaagcggtgtgttgcgtttggcttcttgtcgtgtttggcttaactggtttattatagtctatctatggtgtaacagcttattaratccatggttagacgaaaagcggagagggtgtcagacctacgtaagcacgtgacgcacgattaaccttggaattcacaacacgatattatatgtcattgacaagaatcatagcaagactaccgcagctttgcagaacttgtattttaatttggatttttaagctgtgctttacctctccgtcacactgacatccggcgcccggccagcctaggaacatccggcgtcctacgtccacaaggaagatgcatggacggacgttgaagacgtctcgaactcttcgcagcgccgctgccgggagccgcacgaagctgcatagcctgacattttttttaccggcatgcaaagaagcaaattaaatagagagagctaggacatgctcacatgcagaaacgaacaatttattagcgacgaaacaatcgaagacatgcatgcatcgttcgatgcattattattggtgcggtcgtccggtcgatgatgacctatcagcatatgctgttgatttccatcagcaagaaaaatggcagcacctccggcccgtccaaagagcacctcgtcctcgtagctcaacatctagcagattgccatatgcatcatctgctctgctagctatatatatagacatggagtggaatcaagaagccattggcaatgcaagctccagtcatcagctagcgatcgagcgtcccggccccatcgtctgctgataataaagcacaagcagcttccaagggatcggactatcggaggca

SEQ ID NO: 5407 - DNA, 316 bp, Zea mays
tgtatgcacaagtatgctttgcttttttttctgttttctattttaaccatatgtacatacatgctgatgcgtcgttggtgctattgcaatcacagagttggaggaaactcatttgtcaatatgcctgcctccccgccatcaactctgaagccacctctggaggaacctcaaggacccgttagcgctccaactagccctgatacccctattgatcaagacgacaggaagatacagacaggtcctcttatagggatagctgttggctcaatagctgctgcctcatgtgttcttttcgtcttggtgttctgcctccaca

SEQ ID NO: 5408 - DNA, 118 bp, Zea mays
ccacctccaccagctccacccagggataagcaccgggagtttatgagtcacaaaccaccaaccttgaaccttctctaactctgcggacccactacaagcagatgagtggttaaagtct

SEQ ID NO: 5409 - DNA, 1500 bp, Zea mays
ttcctgtgcgaggtcgtagatcgtcggccctgtgccgcggaccatccacgcctccgcagatagcaccaacaggcgacccgttccagtatttggtgcccagattggcgccaacaccatcaatacatataaatatagacaacatattcatttggccttaacctataccaatttctactaattctataagggctgatttggtgaccagggatcacgggaggatcaatcccttccaatcctcccgtgacctccttgtcaccaaattaaccctaatgttttgtgtatatggactgcggctgcagcagtctgaacaactgactttaatacgaagcgaacaacctaagaaaataaagccagaggagagtgaatgattttggaagctaaatataattttgtatcaggaacatctccaacaggagccctaaatagagtttattttaaaatattggactctaacacatcaaaatcctaccccaaataggggtcctatttgacaaaaaaataatcaaatcattattagtgtgtttggtttgaggaatgaaatgatccatcttcttctcactcctcactttttaatttggtttgtggaattgaatgggttgatccatcatcacctcattcctcataagctaataattagtatatacatgaggagtgagttgattccaccaaaattgatggaatgaacttatgatacatcacctcatgaaacatagagtgactccacaaaccaaacacatcatatatgtctcattctctcaaatcctaaatataggatctcatatgttggaacactgttctcattttacacatcattcctaacctttttctgtataatatgatctattttataataaactcaaattttgcagcattggaaccacgtgcttggaaaaatgaattttgctgccttccaatttccccgcctttggagcgacgaaatgagctccaatcaaatttcgaactgaaaccaaaaccttcaaaaaaaaaacgaaacgctgcaacactccacagttccacaccgagcgctatttccaagtcgagctcccgggtttggagtcctagtaaatcgggacccacgtatcagcgaaatcgttcaaattgaggccaggtcacattcgctcggacacgaccccgaaaatttcaaaccagtgtagccaactcttcgatcccgcccgcgcagccacccattcactgacgttgtggccccacatgtctcagaatacggataccagggcgcgtcatttttccagctgtttgccctgtttatttcctttcatccatctccgtatggaccgtatccctgtctctctctcttctccccctcccccccaatctccgaggcgagctcgagctcccaaaccctaggcctcactggggagtcacctccgccactccagcgatgtctctcgccgcagcggcttgacggtgcctgcccccaaatctacctctccgttagagagcgcggcgtggttgctgcgtgaggcgcaccggggtctgcaa

SEQ ID NO: 5410 - DNA, 224 bp, Zea mays
tttgcagaccccggtgcgcctcacgcagcaaccacgccgcgctctctaacggagaggtagatttgggggcaggcaccgtcaagccgctgcggcgagagacatcgctggagtggcggaggtgactccccagtgaggcctagggtttgggagctcgagctcgcctcggagattgggggggagggggagaagagagagagacagggatacggtccatacggagatgg

SEQ ID NO: 5411 - DNA, 1500 bp, Zea mays
gggatgtcatgcwctgctaattcactcgggatgtatataatttgtgtgatataacatttgtctgtaattaaaaattctaaattaactttttagaaataatttgtgtgatgttgataatgttttgcacacggattttgcatattatagtgatgtttgtcgtttcgtattaatgtttcatacaaatcttttacttccgtcgcaacgtacgagcacatatttataacaatataacacagatatgtacataagttatcatgttattatacggttccgttgcaacgcacgggcactcacctagtaagttttataagcattcaactactactctccatttcacactgtataaactaatttcatcattacttttatttacactttgcggcacactttcataaaggatcattttcattttgaaaattgataaattccaatttcttggcacatttattattttatatcaattaaatgtattactatgtatgtatttataggaattgtaaaagaatatataaatatggtaaaaaaattatgactataaacttaataaaacgaattgatacttattataaggttatgtgccaaatcaaacaagtatctaaatgtgaatctgaattcgatctatccttttgtattcgtattctataatatttatatcgtataatattcacatttgtatatgaattaaattaaatatggtaaatagtgagatggtctttatgcgtatccgatggttgtgatgtcggatcgcgcttgcggcttgccgcagtcgatccgaatcgcaacgcccgaatataccactcctccctgcttgcctcccgctgatatgatatccgtccattccaatccccctcttccgctccgcctccctctagctcctctccctctcgcagccatcctcgtccccccaagaatccggacgtcgtttgtcccctccttttctggtaagcacttgctgccttgctcggatgggttgctgcttctgttcggcggattctttgttgcgagcttctatattcaaatctctacatccagcttgctgcggattcgcttgcagttagagaccgacgtgtttgaggttttagctgtcccggatataataaactcggtgttttcttcatttgttcggaaactttagttattttctcttaaatatgcttgttagaagagcgattggggaagaggtctcacttattgctgggagcataagctttcattaaaaaaggtataatagttaattgggataatgtgtctttgaatctgtatatcaaaaaagggacaagttcacaaggctaagacaagtccacaggaactaatacaagttacagtatgttgtcaaatgtcaattgaaggaagtagtgttttcctatctaacttgctctgtatgttcatcttttacctatttggtatctagttttccgccctcctttactgaccctaatttatgtctactactctgtagggcgtttacatctttaagctcaaagagaaaggattatgaaa

SEQ ID NO: 5412 - DNA, 114 bp, Zea mays
ggtttggtcaaaggattgggtaaaattgctatatctcctgaccactctatttccaatgtttttcttgtagattctttagattacaatttgctttctgtttcttaattatgcaaa

SEQ ID NO: 5413 - DNA, 248 bp, Zea mays
tgagcttgcagctagctggagcctggacctggaggaagaggtctgagctagtaattggagtggggtattggtggtggtggcctgggtctggtgagtggggacgaaccgacggacagcagtgcagacaagtcacgacgagctaaaagctggtgacctctctctctgcttgcttgcttgcttgtatattgccaagaaccctccagaagcagaggcagtcaggaggagactggcgtgtgcagtaattattc

SEQ ID NO: 5414 - DNA, 1500 bp, Zea mays
cataaacaaggtcagcaccacctaaaccctaaggactagtttggaaacttattttttttaagggatatctattttctaaagaaaaaataaattaatttcttttgaaaaaataaaaatctcttaaaaaataaggttttcaaactagtcctaagacttatctcgtaagagataaataatacgctataaatatcggcctcgagccagcaggcaagcatctccctcacggtggcatcatgtttctggataagacttaccttatcaaagataaacacgctataaccgcgaccccctcccgagccagcaagcagacacctccatcaccacgcctgagatgaaacaagttatgttgtcctctctccatataactggtgatttccttgattcactagagttgaagtttacggatggtaatttaacccgtaaaactgaaaacagaggaatactgacgggtgtaggtacggtacatgcaaagattttgatccacgggtgcaatccacaccctatctgaatttttatgggtgtaagtttctatttcaacccgtgggtgacccgcacccaacctaaaattcggtttattttttattttacgcgaaaaagactaatatataatagtaattattttgaataagtaactagactaatgattcttgtaatgttttgttcctgctcaacgtgacaaggcttaaaaatcgttactataactcaataattaattgtacttaatttttatagctgaattattatttaaaaatgcacattaaaaaaactcgtggcacgaaacccaacaagtttaagtgcgggtttgaagccgtgatagaggcaggaggagagatcgttgaacgtgccctaagtattttttatgattttaaaagtttgtattctataaagtattttttatcgtaattttgaaattttatgctagaaaataaagtagaaacatttttagcaacaaaatcagagtcagagctatactaaactggcatttataacgttcgcgtcgcttaaatttctagtctgtgtaaaaatacaatagctttagggctgatttggtgaccagggatcacgggggattggaggggatatgggaaattagttcatttccctctcaatcctcttcaatccctccgtgatccccttaccaccaaatcagcacttaaagaatcacaatactcacttgacctctctagaaacttcaccgaggaaaagcacaagctggagtgcggcaaatacgccaactccggctgcaggtgtcacgacccacgacagtgtcacgctcaaacagctcatttcgccgctaaagaaatggccctcgcgttccaacccgatgaggcgataggcacggggagagctgcgcgggtgtatatataccacctccatggcacatctcttcctcaccaccgcatcccacaccgggcacaccccccgagctcagcttagctccactccagctccaatcacagtcgtgaccagagcgcgagagctagctagagggccgtgaaa

SEQ ID NO: 5415 - DNA, 869 bp, Zea mays
ggtaatcccttgcctcccctcccctcccctccccttcccctcgcataaccttccgttgccccgattgctcgtcacgatctcgcgcttcgcggcatttaccgccgcgcggatctgggctggctgtcccgtttcacgtgttaattttctagcgactgtggcgggcgttggaattgcgctgctctcctgcggtggatctagggtggtagtggagagctgccggagtgtgagggcttgtgtcgccgccgtcgacggggccacaccgaaacaagctgctttccctccgtaggagtcgcgtttcgactagagtacttctcagcatactctaatgtagtggttctggactgtagggacttccactttgctccgactggggtattgttggttgaatccgattcttcagttgccccatcggttacttctggatttatctgctgcgtggtttgcttagcttctacacttgtacccatgacgcgtttttttaataagttgccagacatttgtgattgtctctcactctcttaactgtgccggtcactgtaatctatgtcgtcctggcctaagccttgtggaattttgtgtagggaggtatcccacactatagtggatttgattatcatttgtcagattgtagctctgaatatcacccagattatatttattgtgtaattttattacttgacccttgttccatggacttggttgactatactttgtgccatctatttcctatggaaaatgctccaagcaatcaccggcgataccctttcaactattttattctccacctgttagaatgtactgaattctgttcattttgttcttaagtgcctttttctgctaataatccatgcaggttacacggtgtgaaa

SEQ ID NO: 5416 - DNA, 318 bp, Zea mays
cagaagctattttttaattaactaatttttatttatcaacaaaaaactattaaccatcttagcaatgacatctgattataaaatacagtagataataaagtaaggacacatgacaaaggggctatgtctttttccaggaacaccgcatcttggcccataaccaacacaccatcaccaaataaaaggacgctagcccactaatctataggcccagcatggaaaatccacgaataaagatgccaagcccgccacggggactagcggataagcccccgcgccggtgcctacacagtacacactgaccacgtcagtttcgcc

SEQ ID NO: 5417 - DNA, 1500 bp, Zea mays
cgcctgggtagcagtaaaaaaactcgttttttttactatccacgactagattcaaaacccaagtgcctaatccaaccatcatttttgcagtaggctgatcgtagcatgcatgcacgtgatcaaaagttccgtgagacgaccggatgccaaggtagattacccttccagcgaggtaaaaaagctgcgtacggctagtaccggctggtaagtaaaaaacaaagcagtacgtcctgccaaacagcggtaaacaaagcatcgaggcggggtggagttaaatcgcaggcccaatcagacaggactggcaggacgtgacactgcctgtgggccccgcgctacggtcgagctcctcgcaagaaccgatggggacagacggagtcacagagctcagacccggttacgatactgtttggagtgaggtgtctggagcacacacaacacaaaagcagccgcaaaacgcaaggagcagcaagcaagacagtgagaccacagcacacacgcagtcaccgcagcgggatatatataaagataaaagaggtgtgtggagcgggagaaggccggactgaaggaggaagacgagcagggagagggaggtagggcaaaaggaagagaatccgagaataaattcagagagggagggagggagggccatgatgatggcaggcgtggcgtcgtaggtggttaaagcgaagggcgcccctcgtcgtccggtaaaagctctcgaaagaagctgccccccgcccccccttttgcgccctttttctttctttccgttgcccttttcccgttccctgccccttcttctccgtctttctccggtcggctttggagaaagaggtgatgtgaggttcccatcactcacgcctggctgggtacctagatgctcccgggccgtctttattacggctgtcgccgggctgggctgcggtcggcggcggaagggagtcttctggcggagatatgagaggattgttttagtgaggtacgtgtgggtgttcggccttgatggtttttctttcccaacagtgtttctggactcgttagttaccgagttttttttcccctggatatataggggggtgatttatgttttgtgatggcatagcaacctgctataaggtcatggctgatttggtgtggttgttcgtgtttgatttgaggaaaggtctagttcagaatttgcctagtatttgtctgctacttgcaaaattcttcatgcaaaagatgactctgaactctgaagttctactcaaatcgggaaaccatatggttacctgggaattacgaacaccgtattctaggggtcgcgctcagtcagtgctcagagtcataagataatttagcgttcttattttcttagttgattttgtgagctatacgtcctcatgattgctaatggcaactccagttcataaatttaactctcttgcattgcatcaactgctcaggtctatgagctggtaccagaactgctcataatattcaggggaaaaaaaaggcaac

SEQ ID NO: 5418 - DNA, 151 bp, Zea mays
atagaatcacggggatgaaagtgggccaattactgaactcgagtgcttgggcggcagtagtctctttctaatatgatataatgccagcacctcccgtcaaaaggataatgacgaatattggtggcaactatacagactggtgtcgctggag

SEQ ID NO: 5419 - DNA, 594 bp, Zea mays
cccaacaggaaattccccgttgccatctctatactgaaatgtcttgtaacgaactgtgtcataaactaaccatcaccaattcaccatcatcctgtatggcctactcaggattgaggacaaagaatgccaaaattgtgaattaaaattagcaaagtgagatacagttaggccagcgtttacgacacttgcaaagatattcaccttcctatattgctaacccatgtgagcatattcaacaagtatgatttgagtttctggtcatatggtacaaatgttgcctgaagaaaactcgctcccagacaagaaatctacaaaactcacttgcagagtggatcagctcagagtacccttgcatcaaacaaaattccatgcaagttctgatttatccccagtacaaaattgttggacctggcacctgggagtagaatatttctgaaatttacagattcctgtacaactcacagtaacgcaccaaaatctccacaagagcatcggccgtccttgaacttgtgaagccgtttactatcccggacaacaatctctctgttcgcaagcaatgagaaaaacttaatagagctgtggcagtccctgcac

SEQ ID NO: 5420 - DNA, 612 bp, Zea mays
atgtacacaatctattcatcaaaccaataattaagctaacagaaatatgaatcggcttaccatactaaatctgacaagctatctgcgaatacggcaaggattctggttcagcccttgcgtcgagtacttggtgaacatcacgctgctagcttcgtcttcacccgactcttgggttttcttgatgacgcacggaatgacgacgagatcgagtctgcagcgagctggtgaggtgtggtcgagcaggttagcgcgagctcttacgaggacacgaatccagtgaggactccgacgacggcgaggtcacgagctctagcgacacagcgacacagggtcaagcggtgaatgcgttcggtgtgcatacgtgagccgaaccgaaggcggggaacctatgaagcgaagttcatcgacaagcaccatggaggaatcagcgacgttgttgcacacatgacgcgacgacgaacgacgacaacccacgacggtgccacgcatatgacatcaacacactgagtagcggttgtgctttcgtggcgaggagactggagtcagggctagacgtcggcgtcatggtgagctaatcgaaggtgaaatgcccggccatcagcgagctatgcg

SEQ ID NO: 5421 - DNA, 1500 bp, Zea mays
gtagggatgaaaacgggtcgggtaccgcatacggatagtgtaaatacccgttttttcggatacagattcgggtatttttatattcgggatggatacgggtaatacccggatactgtagcttcggatttgggtcggatacggaacgagaactacccggtaaatacccagatattcgggtcggatacgagtatcagttttttctttttttgcataataatatagttataaaatcataacttttacatatgaaatcggatgaagataaagtttatatgaaaattgtagagctcgaagagatctataactttgtagtacatcattttttgtttaaacatatatttagaccaaaatcattaaaatcatgtccaaatttatatcaaaataatatactttaacatttttatgtgggagcttaaggttatctccacgtagaaacttaaggttatctttgtctagactatttattcgtattggtaacttatttgcaattttcggtcgaccctacgttatttgatggatttaattgtattttgatgattttctacgacaagaaattaataatatataaatactctaaaaatcatgaaattttacggaggcacaacctatgttcatatataactataaaaaaatatttggatcataagatctataaaatgtccgcgtttctttcatttcacgttcacttatttgtatgggttacatgtgaaatcactatagatatccaagtttcaacataatcagtactttactttatcattttcatatgaggacttgagttatcttcgtataaaatgtttatttgttttttataacttatttgcaatttttaagtgaaactagaatattttatgaatttttaatattgcggtattggttctacaatgtccttgtaattagtaactttgaactacatgatgtcaaatttatcagtttcctttcctacatttgatctatcatatgcatgattatgtattgcttaatttatgtatttgttgggtggttggacaattaatatcaccgggacgaactacccgacaactatccggtacctacccgagtattatccattatccgtttcttacccgtccgaattattacccggtctcgtcctgtatccgtcccgaatcttaactacccgtatccggtctcgtatccgagagaaatacattagggtaggatacgggatgaccctgtatccggctgtatccgtcccgttttcatccctgcgcaaaagagagcgtcgcaaaaatctcccgcacgggtgtactagcattttaacgccgcagctcatcgtctctctctccccgcccgccgcctatattcctttgaccgaccgccgctgcgcccactcctgttcgttcgttaagccctctgaccggccgaaaccccggcggcctcctggaggttccggggttgagttcggtctgagctgctgctgccggcggaggcattcccttgtcgtttcttggagtgtcctggtggtggtgaccggtggat

SEQ ID NO: 5422 - DNA, 166 bp, Zea mays
agtcaacggcgccggcgccccaacagggggcacgtcgggcatcgacctcgcgtctgagacgaagacgagcgccgtctccacgcaacacgccaaccccaagcaaacggacgatgccagcacgctcgcgaaggacttgctgggtgtcatcctcgtacctgggacgact

SEQ ID NO: 5423 - DNA, 76 bp, Zea mays
ggtttgtttcaattcttgttgcggggatgagatgtgaccccaactggcactcgtcatctgcaggatacagtgttcg

SEQ ID NO: 5424 - DNA, 751 bp, Zea mays
gagaagaggtgagaataacagattatttatcagaatttctctgtttcatcgtttgtttatatgcattgattctatccattattgagagacataactataaaataaaccaagtgttagtctttcttacatatgttgtttagaaacatatgtttccatttggatttgcctcaacctaaggacggtttggttaatagggttcaattataggcgatggttactatcgaaagatcatataatacccaagtaatcgaagtagaaactttggagaatcatgcaaaaatgggagtggtggcctcctaaagccacatatgctttgctaatttgttgctggtctcatttgtcaagattcagggagaagcagatatctgtgctacattttgatggtytcataacttactatatgacagtgggtgtttctctgttgacatacctttctgttttccatactttgtcaacccattaccaaaagtgttcatgaagagtgtaaaaaatcagtggactgtggacattagtttcggtaaacaggttttgctgcaaggaacaagccacctgttgagggacgtacacaatttgttcgattgaatgaacgagatcaatgcaagcatcactttacttttcatcatatataagcatcrcatcagattaaattagcaatacaacatttggtcatttgctaagccacaagcatcttctaattacattgactaatctttacatgatacccttttggttgtatggcacaattgctagg

SEQ ID NO: 5425 - DNA, 649 bp, Zea mays
actctataatttttatctacttaaatattcgtcacacaacgtttaaaaatacggtttgcgcgcaagacgtgcacaatacactagtaccaaccaatctatatcgaccgcctgcgctgctwcaatcacctgtcggtgcattggacccagcctttagtgaaggtgggccttcatagaggagcccacatgtcatccagcagcccaacacaaggcacgccgccggagttgggtcaggcgcacgcgctaaccacgcacgctcggcgatcgaaagtacgcgggcgcccacccactgacatccctaccccgctcacgcctgccgcgctcaatgacatgtgggtgtcggtgcagcaggggccctgcctgtcgttgcggctgggcctgggcgtatggccaaaatgaacggaaccctttgttttccggcgacagaccccacggcaccgcacctgctcggcacgtcccgctatataaccgcttgaagttcttccgccgccacgtgctcgctgccgtcgccgcgccgcattcgcatcaccgcatcgcgccgccgaggctgcttactagacggacgaggagtggactggagtaacttgcagcaaccctatcccggcaggccccatcgcgaaaccctagacttcgccgccggcggtcgccggag

SEQ ID NO: 5426 - DNA, 1500 bp, Zea mays
ggtgagtctcaccttctatgcrggaaggccaacaacatggaagaggaggagaccaaccaagtccaagacctaagaatgggaaatgggggtggggtggcaatggaatgagcagctaaggtgtcgtaatggagaggagtaaaaatagggacaacatcttctattgatgggtggaagggtttgtttccctaggtacctaaagagtcaattatcataatcgtagcggatacttattaaattgtctctctaaatagcatattttttcccaaattcattgatttttttgaagacaaatatttttaaacatcttgtataaatacaattgtttgccttctaggatcaattttatagcactgtcactaaccatctgattgtgaattctttactatgtgtacaaaatttcgtctacatgtctagtatgcagtgttattaattagctgctagtagagttttttgcgtataataatagtaaaagagttctgcctctttatactaaggcagagtaaattgtttggatatacacacagtgaaaacactagaggcctaatggtatgtttggaagcaccacagtatttaagaaactagtttctatccctagtttctagaaactagtttatggaaaaaaaatgggtgtgcttatttggaatccagttagtttctagtttttcgatacacaaagacaagtctacccttactctattttaaagtaattgattcttttttagttttctttgctaccaattttttctaccaattttaaatatagattgaactcatattttttaattctattatttccaatgataattaaacattcgaatcgggcaaagcggacatcaagaggatcacatgcataggcctgagaacgtgtcaagtgccataatttctaccaaactagctaaagacactataatttatcaggcaaataaaatctgattttagtaagagaagaccaacttctttgttattttaggaactggaaattcagtttatagaaaccgaagcatattgtgacctgtttggaagcgctctagtttctataaaccagttccttaaaaaccagttactttcaaacatacccttagtagcctaacagataagaccatgaaaacaagaagaacattgagttttagaagacaggcctatttgtctgtacatatatcaacctataatatctcgtttaaccaggtcagcacgcagagcacatgctatcttttaggtacgcactatatattatatgaagctaacattatggacgcattgtggtttagcaaaaacgccgcaaggcgaccacgttccctccctattctctcccatctcattatcggcggcaacctcaatcattaacagttaaactactggccaaacccggcaatatatacccctgcaggcccatctcctaagcacaccatcaaagtgcctgttcctgagccagcagcatctgtctcttgcttcatcagctaggcgcccggccgcgcggaccaggcttcagaaaacaaaaaa

SEQ ID NO: 5427 - DNA, 439 bp, Zea mays
ggtccttggagcgctacgtgggtcttcttgtcgtattgggcttcgaatgatttctcatagcccatctttagtgtaacgactcaaatcgtgagtatgattgttggtcatacataacactatttgtactttagagtttactgtttataaagtagaattttaaaatagagatggaataagagttaagataagctctggagacggctaaccgcctaacccacccgaatctcacagcatcaaggcgggcctcttgcctgagatcacagtgacaatcgaatcgggccgttcgtttgtttgggcagccttccgttgcacggacgcgatttgtccccaaaccactaccaggagaaggctctgttctgtaacccaatcagtcatcaccgccgcccgacggactgtgtccccactccccagtgagccgccgtgacctcccagccgcccc

SEQ ID NO: 5428 - DNA, 1500 bp, Zea mays
cctacaccatctytatgctccctacccagtccctgcttaccctcactcgcgaccctgttcctcttacccatatgtgttcttctagccctacatgctcccttcgctgattagagatctgtaacagccttacaggcatatactttactaaactacccagatctgagatcatttttccatacatagtttattttgaatctaggatcagttcatgtctcagaaatgtccactttttgagtcaggtctgttgttacttctctggtgatggaccggaattcagatcaaaactgaaagattggaggagcatataccagtttgagtgtaaatagaggtttgcctgcttatcaattctctcctttgtcgtgtgctcgtttagaactgtgtctgtatagttaattttttaatgttgactgaaccttggactattcgagttgagatgtccgactgtgacatatgtaccaaaattttattgtaattactcattttgtcacttcctgcatttctttggccataactgatagtaaaacttctatctttgttcagtcttgccagcctgcactgccaattcattgcctggtcttactgtgcaacattgttttaccatactggttactgcatacactaaaatcagttattcaagttattggcatgactgattttttgtggggatggatctgtttattctgtaccctggtttcttgattgtctatataataggatccttttgaattttcagcaaagctcgaaagattaaagcttttcagcctatagattgaattatacttatatagtttgtgtttctttgtattatttcagaaataggtataactgtgaaaactatgtagaattaggttacatgacagaaaccttttaacataccgtttacagatattggtgtactgatttgtttttcgagaccacctttaatcttgattatttatatttctgtccatcatccaggatcttccttatgtttgatgattagctcattgagcaacatacagcaacagatagctacaaatcgtggcatgtgagttccttagtacgggtctgattggttgcctacatgaccccttatccaggaccctgcactgcaatttgcctttgtttggtaacctgcagacgctcatatgcaggctagcaatctagcactgtcctcaaagcaagtccagcctgcatcccgtaattaggccaaatcctgcatccagctatgcatcctccctccatgatcctctctgcagcccaagactcagtctgatgaccacttacacaagaaaccaatcacacaaaacacttacaatttcctattgagccgaaccaaacaacagctaattgcatagccttatgcaggttaaggatattttgcataacccctaataggctaatacaatgcgatactaatgcgaggaaccaatcagaccctatgaatttacttcctttttcacgttttggtttatttgaattctgaacaactgttgcatggtgtcacatgtgctgtaacag

SEQ ID NO: 5429 - DNA, 626 bp, Zea mays
ctccatccggtcggtcaacccctctcgcaccaaccggaccgctccctctctctctccatgacttctctctctctctccatgactgtgttggccacctcgcaatgctccgtcagccccggatagcccccctctctatggtcacgcctacacggatcaagaagaaaggaaaaagagacagacctgaagcatatctcacgcctaaactaagcaatttgaatcaaactgcatttgtgtgtatctagatctactgcataaaccaaacgattgtataatagatcttagattcagtagtggaattgctatatggtgaattacccttggtcaaaaatattggctagaaatcggtctcgctacatttgttggttttcatcaatttgtgaacgccttctgatgggtcagcaggtcagccctcaacttcaacttcacaagctcaagtcttccccagtccattccatctcgatcccccacgagctccaataaactaattacagatttcaagctcgcttcaaattcttaaatccaaccccattttcacctgagcacacgcattgctcgagaactcgcgtagcaagaaaccatcaacaagggaagggagcttaggcaaagaatccaagaaggcaagaacc

SEQ ID NO: 5430 - DNA, 836 bp, Zea mays
gtcagcacatatgaaattcttcttacatacctacttacacatgctcatgattgtgctgtgcagcttgcgacgcaacttggattctctcctctcctctcctctcgttgcaacaaggcagtccagtgaatgagacggatggccccagctgtgcctgtagctgatgcatgatggagctgagcctgtgggtgggaatctcttctctgctggtggccactcgcctagctccaaaaacacacacacacacactctctctctctctctctctctctctctctctctctctatctagggggaagtttcacatcactagctccatcgcaattggtatgggtggtgcttctgcacaaaagaaaaaagatgtgcctgtctcactccccaaccaacttgtgaattgtcatgcatcgatcctagctagagcatctccgagagcaaaaacccttgttacagttttccaactcacattctactatatattaggatgtgttgggcacacatggaagtaaggcaaaatgatgcatcgacatgtgatacgtgagcacgtatttcaaaacccgataggttggttggagtgggcttcttaaaattattactccgaagcgtgcaattgagattgtagtattataatacccacgtatttgtaaatttgttatcgtcgttgctttaaacacccatctatatatagctcactcactgctgctgttactggcatttctcccctcatcccgttcctgaaaacggatctgaggccgtcgtcttccactgggtcgcgctcctgttcgctccgtcgtcagaaatgcaggcagcgccagcaggtcttgcttcacgctacctcgcgg

SEQ ID NO: 5431 - DNA, 1500 bp, Zea mays
gggtctcaagcccatctcaatcgacgcactatctatcacactacgtgtaaggaaacatataaaattaagttgggtcttcgttacagtttccaagtctctgactgtacttgtaagtaaacatataaaaccaatattatgttgcactgcagacaccatgaaatggttatatcacagttaatatcttccattgcagacaccattgaaacaggaacaaatttctcttcatctgggttatattagactacatcctgcactgcatacacaaccaaattaagctcatatgcagacaaggataaaatttactcaccagattggaatgaattccacctcaagcaccgtgcctagctcaatctgggaaagatgaatgctccctatagatccggtctacatctaagattcctcagcctttattagacggggacgcgacgacctgagcacgattgaatcaaggcgagggaagaaggcgacgacgggggctgtacacgacggcgaggtcgcaagggcacgagaaccccaatcgggagagtgtgggagcgggagggcgcgagatgtacacgacggtgaggatgcaaaggtaaaggcgcagaaaccagagcgagagcgcgcaggcatgggaacagagggggagggcgtgggtgggaggagggtgggatagcgcgtcggcctggggatggcgagtcctgactcccgaggactagccaaacattgctagcgaccgggacgcgatgccgagcaagatgcaatggcgagctagaagacgagccggttggaagccgttgcatgggtttttctttttctttttacccagcctgttggaaaacgagcaagaagatgcaatgtctgtttatccagcctgatggatgctctaatggaggaggaatcgctatttaaaatttaaataacaatgagattgttccctatatatcctctttaattcccttgctattcaattacggttaacaagggaattttaacgcttcaattatctttgttccacttattctagaaagtcctaatcgggcctgagctctgtcaatagcgagcaatggtgagtgatttccaatcacacaatacacgatgctatttcgtttctattctgtcgaccgtcggctctgcctttctattctgcagagccctcctggccgctttctacactgacaaaaatctctatataagcacagtgtccggcatcttggccccttccccacccttcgccctttcaaggaggccggcctcgcctcacactcccgcccgcctccggcgattcatccacccaataaagtatccaaccctaacgatccggatcgccttaccccgcgtcatccacgcgaattgattcgattatcctcggattttccccgtttttttgtgggtttcctatcttcttcgatcggagtgctagggtttgggcgcgctcggtgggcggcgtactccagggtcatcgttagttggacgggctagggtgctttctcaccgggggaagggaagcgaatccaaacg

SEQ ID NO: 5432 - DNA, 1500 bp, Zea mays
cctagtttgatttctagtgtgtcacataaacttatttattgtctacagaactctagtccgtacaaagtactagtttcatggtgtgtagatttatttctctcccatccggttgtcgtctacatggtctatacatcttccactccgactattatggagccgcgctatttgtgggtctcacgctgctgtcaactgatgcgccctcataaaaacatacagactacccacggaaagaagaatgcagtttcaaaaacatggcacaccctaaattaccttttaaagtagatatatattgtggccacgaagctgtcgttttgatcatttaatgcccgtgtcatcatccgttagttaaccgctgcgtgtcagtgctgggaattgggtcgggtcgagctaatccaagcctatcatactttgggataaacagacctaagccgtctgagaaagtctaaatttttttttaagtcgtgttagctcaaatagtagaaacagtgacccaatttgaccctaaaacacatcccgagtgattggttacgcggcccagcggcgcctggctctggagagcctgggcagcgagaaacggaatgttcgagcgtatccgcgcatgcaactagggaatatgttttggtctacgttgcatctgtgggtgcagcctccatctcgctatatgcagttaaccaaacagtgactgcttcttattcaacgcatgcgttcggtctagatggatgtgtgcagcttaccaatcacaaggatcatgtctttgttggaccgtgtccatagctcgatctatatatttgaatcacacaaaatttaaatattacaaccacataatatacatggcttaytaaactaaagatattaaacaatgtgagttctatttgacaacataaagtttaaatattataaccatataaagttataacttaccaaattaaagaaattaaacaatataagtttaattgagccgtgccgacccaaactcgacctatgcatacaagccgtgctaggcccgacgggccgaaatctaaggtacggcttagacctgctttcggaccgtactaatttgatccatattatttcgcgtcagcacgtgctttaggctcttgtgtttgagtcgctcgtggctcttgtgtttgagtcgctggtggtgacaaaaaaaaaaacctggcccatattacgtacgtggtgtcaggcgtcactacaagatcgaggaaaccatgcattaacgaggtgcgtaatcaggagtcacgtcggtacagcttgggcgacgagcgaggcggtgccccggcctgggcctgccccgccttaaatcgcacgcgcgcacatacacacatgacacccaaccgcgagctcccatcgacgttgacgcgtggtacacaccaccatgtacacgcactgtgcaacggtcgtatataagtatgtcaccgatgcgtcgagcggccacacagcccggtacgtacgtgcaagagacgagcgtagtaacaactgtgagcagctagcacatgc

SEQ ID NO: 5433 - DNA, 173 bp, Zea mays
cgtacgcgcgccccgcagccggcaccaccaccaccaccacggcggcggattcttcctctctacctttcctctttggtctcgactctcgaggccaccgcgtgtcaccctccgtgcgctgaccccgcctgtcgatccgccgcgcagatcccacggtgcggttcctgagggagcgg

SEQ ID NO: 5434 - DNA, 118 bp, Zea mays
ggtatgcaatatacttgttttctgtcagctgaaccaatgttgacccttcaattttttatgggctaattattctgaatctgctaataattctgactatgcagcctactacaggggtgca

SEQ ID NO: 5435 - DNA, 1500 bp, Zea mays
acttcaaaaaccatgataaacgtttctacttaaggaaaatattattatggctttatgccaatttttttggcttgtgaaattatatgttactgtaaaaatgcttccgatttaatagaaaaatggtcgacctcaataaaacatataaaaaattatgtttttactactctctctatcctaaattaaaatttatattatttttcaccggattcatacattagttatatatatgtctaggttcgtaatcatccatataaatatgaacatagaaatatagagctcaaactacttttatttaaggggctgagggagtatattttaatttcgttattatctaaaatcaatgttgtactgacttccaagaagaactataaaaatttaaaaataaaaaaataaaaaataaatttccgaagaaatgaaacaaaccggcctgtagagcccgtgcgggtgcgcccaacaaccccttccgctgccttcccacttccgtccgcagtccgctgcattgctcgcgtgtgttctgtctgtcactctcgcccagtcgccctcctcttgctctccgacgactggtgggccgccgctgccgccgccgccgccgccgccctacgccaggtgctgaggctttcatcggtctcttcgccggtgtctttgccggcgtcgagcacccgccaggtactgccacggtcctaccccttctcttcccttcatgctgtgcgaggccgagcattgaaaccctaacctctttagctatttgacaagactcctaccttcgaagcttttgcaaaaattattgggtgtacatgtgtacacccatgcccctttacttgttccgcccccgtaaagactaagctgaaaccatggaaacaaattcaggaatttcgagttatatctaatagcattgatggaattaacatcaagtcgatcacaaggaagctaatttctagtttccccatgcacaagcaacccaacccgtctttgagtaatttctaatctgtatcaaacattgaggctacatatccggtagatcccttttgttgtgtctggaagcagatttgaactggcatggatgtagaccgttaagggtggtaccaagcaaaatgaacttattaatacattcttgtgtgcataaacttaccatttcttactagaaggaatagtcaaattatatccaattaaacctaattcaaaacaattcaatgtaatggagccaacttgttgattattaagtcaccaaattatataggtggagataaactttggggagttttaactgatggcctgtttggtacatgccaatgctctgtatatggtaacacaccaagcatttgctagttgctactaggattagccaaatcattatcatattgcttgggatctgtgaattggttaattaacactgaactgcatgctcgagtgtcatttagtgctctttgctcttatgttgtaccttttcttgcaggctatccatgatttttgcctacaaaaggtgattgaaaaggggggagg

SEQ ID NO: 5436 - DNA, 693 bp, Zea mays
ggtatgctgcagaagttttatatctttctctctcgggctcaactaatattttacttttttttgttgtctgctatctcgtttgtattctgtcggttctcactaaaactgcatgccttttctttgtacaattgactaccataaacaaagcaggaaacccattttttgtttttgtattagggatattagatctttgcttcctatatttatttgttcacttttgcaaggtctatatctataatcacatacttttagtttcatagtgaaatgattgtgccattttcatacaatctataaaaactgtttttttatatacaggcgaaagggcctctagctgaattggttaggtgggctgagtagcactcctcaggtcctgggttcgactccccgtggaagcgaatttcaggctgtggttaaaaaaaatcctcttgtctgtcccacgtcaaagcataggtctaaggcttggcctcggtcgtggtcgttctcacatgggcttcgatgccgctgtgtatgggtggggcaggggttcgggggttttctcgacctgtgtgaaaaggtcttcttcttaatacaatactcgggggctgtcttaccccccgcagtttttttggatatccaaggtgcttgatagttagggctagttaaactaaattgtgtttcccctattgtttcaaactgaaacctttttttttcaag

SEQ ID NO: 5437 - DNA, 207 bp, Zea mays
agcctccaccccccctactatccgcatccttcatcccagtagttggtgacaaacctgatccatttccttatgtttccagttcgattggtttgattccttgtcgccgtgaaaatcactaatcaactgaaccatgtgaactatacctgcagatgagtcctcaaatgctgttattggaaacatcttaagttagagtaagttgctgaaact

SEQ ID NO: 5438 - DNA, 570 bp, Zea mays
ctcactattttctggaaaggagctgggatgagagagagaatatcttctgcccagttgcttcccccactcgttttcaaaggtgagagaagtatttaaagattgcgatgatattttaaagcagagctctggttttcagatctcgaccgcatagttgccgcgtgtgagctgtgaacgggcgagtgaatattccgccgcaggccatcaggattaggacaggtaatttggagttgcttacggagccagtcactcacagctcctggtcctggcggtaagaagtgaacctgcccggcgccccccgccggacggggtccgtcgcctacaagccgcctccccacggctctccgctcccggcccgtcacaccggccgccaatcctatataaagccgctccaggccctccgctcctccagtccaaagccccttgccttctatccctttcacacacgcctctccttccctctctctctctctatcttcctgcctgaggcagcagccatttccgcttccgatcgtggaggcttggtgtggaaggaggaaaggaggccagctgctggttttcggtgcggcggar

SEQ ID NO: 5439 - DNA, 1500 bp, Zea mays
gttgagggttagtaggttcacaagcaaaagagtttcgtcctcactatcactcgaatcactcgaaccaaactcatcttccgtatgactctgagacataccgaactatggataacttgattsactcagtagtatgggcgaacaatatgggagaggttgattgaatatatatagggggagcaaagggggggggaagatcgcttccattaaaagccatccgtggcttcgtatgaaagccaacggtgtcttgcatcgtaagatagtcgtggcttacaccgtacgactggatggtttgtcgtccaaagtaagtgtgctttagaaaagttcgtgcacatatcaatggaacatttccacatacggctaaggttaattaattttaccatggtaccaatgtaatcttaataaatgaaatgatgtaagaaggattacaattaaataatataatatttgattttgtacatagtatgtctaaattaagaggaataattgaaaaaaaatttgttcaacaagtatcatctggtaatcaatacgtgttcaaacaaaacaataaaaataaaaaaaaacaagttggttatgttagttatagggaaatgtatatttaatgagtagagtgatatgtagggtaaaatttagggggaacggttgcgggacgagtaaatataggggagggaatcttgctgacgtggctgcatagtaagatttagggggaaaaatttagagggaacggctgcggacagcctcagcctctggaacttcatcagctttcccgcgctcagtcaattcctcttccacgtctctgcgctctagcatcttcagtctcctgacacaaagtagcatcgttgggggtacgggatggaccggatgacgctgctcgcctcgctcgctctgtgaaggcgtctgtgcattccaaaattctcagtttgtgttgcgaaaattcctaattgagactagtttttcaagctaaaattctgaaagcaagataaaattaaacttcacaaaaatctgcatgccaaactcaaggtgcggggtgggctcatattggattttgtaatcttcaagtgtccgtccatcctcaagatgcttgcctgcaaagactatcctctgatggccaggaacctggttcctgaaccttttcgttgatctagtcgatttattgtcgctgagaactccatttggactatgatgcttctgccagtttgggtctttcacatagatgtccatctgaaggtagcaacaaaacatgataggatagaggcagaatggtaccattcaattcgcagcaacggttttagaaacaaaatgagtacatacagacaggaggtggtcgtcaaggaattgtctcctttgaaataacccgcctgtctcggcgtggcgcccaaacgcaacggtcctgccaacgagcacctgctctgctctcgccggctctctaacccttccgaatcccctcctcgcaacagcccggcaatcacctgccccacgaccaccaccataaatcaccagacg

SEQ ID NO: 5440 - DNA, 153 bp, Zea mays
gttttagccggctgcttctgagtagtaatgtgatgcgacggcgagtgtaatcatattcttcgcgctgttgactagagtcccaatgggtgttgtgttgtgtgaaacggcgtccgccgcttgacgtgtcttcaaacgggttggagtgcttattga

SEQ ID NO: 5441 - DNA, 250 bp, Zea mays
ggtgaatgcaatactggcaaagctctcgccttcttggcgagactttgtgacttcacgtcgccacatgaagaagcaaataactctcactgagttgtctgctgctataaatgtggaagagcgtgtaagggccagtaacaagccatcctagcaacttcaagctcacgttgttgagaagggcggagatagaaaattccagaagaagaagaagaactctccacagaagaatctgaaccaacgtaagtccaaaaag

SEQ ID NO: 5442 - DNA, 278 bp, Zea mays
ggtgtcgccacgctcgcggacgccgtcttcgcgcgccccccggatcccgccgccccgcgaccgattcccctggaacacgtccgtccgcctccacgcccccgcatcgcgctgctctactttgcgtggatgcgctattgcgacgtgcggccgggcgcctacaacgttcctcactgtcctcaaggcctgtggccgcgccggactcctggttcacgccgaggccgtgaggagagagggctgggcgcggacctcttcacggtgaacacgctcatcaacttcta

SEQ ID NO: 5443 - DNA, 1500 bp, Zea mays
cgaaatagcgcgcgccgtggttccgtgtgcgtggagcgcgtctaggtttagtcccaccccggaggcaatggacgagcggagccagaggaacgctataaaagaagaccctggtggctagtgcaattcatacctttctcggccttttggctaagatcaagtgtagtatctgttcttatcagtttaatatctgatatgtgaactatgtgttcacttcgatattaaatttattttttgtgggggagggtccattgccggtggcttgcccttgggggctctcatgcgtcgtccagctattgcactctgctggccggacctggcgcaccccaaccaaaacaaagtaagcttgttcgtactctcttggtttgcctattgtgacttttggattatggtaagcaaaaccttttttgcgtttcgtcttatggctgaagctgcgagtcttcgggaaaacccggcctggaaccgttgaagacgacacacaacaacgatccggttttctatcgttccgttccgtccgtttccatcacaaccaacagaggagacagccaggaaagttgcagttccatcacaaaccaacaagaggacatacttaatcacagcagtgtctatcacaaatttcttgctgcccacaagtccgtgtagttgcatcaggactagatcatgttaatgaccctttatgaatgttccctgcacatgtagatttaccgttaatctagtgtaattcaaagcttcgggatacgaaacagaccgtgagatcaactccaaccaccctgccatgcagagcgcgcacggctgagccgaaatcaatctgcatgtcgcagccgtcactaccagtgcagtgtccagaaaatgggatacagaaaccgttggaccacacatgcagccgagggcgagggcgacggtgtcctcgtgccataatcgcgcgttggcgtcgttaatcacacgttgtcaagggcttgtgggcgttgttgatggatgagggatgatccataaaatagagacggttggatgtgattgagagaggaggtaaataaagtgttccgtaccgttggttttaatggtgagggatcactgacgtggatttagtgatatttaaaatgatggattatataagagtagagatagagcttaagatgttttacatacatctacccgaagaaacataatatctcgaagaaaaacaatgataaagaaaacggggaaatgaaaaaaatgtagtaaaaactcctcctttagaacatatgaattttataaggatggtataaaaaaattcgcaagatttagttcaaaaaataatagaattcaggaaatattcctttgattcgagaggagtcctaaaactctacataaaactcgatcaagactacaaaatggacgaacacgaaacctaccctaccaccacacgtccacgcagcccaactcttcgcataatcacatcgcgccggcgggccattggcattcycaccactccaccatcgggggtcgactggggccccatcgccg

SEQ ID NO: 5444 - DNA, 1500 bp, Zea mays
tgtgcgctcgtgagccgtggctaggaaaaggctggattagtaaactgctggactgtggcctgtttgtttgtttgggttgcaaataatgcaccacgatccaggcccatcagcaacgcagcgatttaaagctcgttgtaaaagactaaaggcaggggcccgatcaggaacgggtctcaggtatgttggattaataggtcttttaaattcaattaaatcctagaaaaatatcaaaaaacctatgtatgggtatgactaataaatgatggaacaaatagtcctatattgctagttcaagtagagtgaaactagtttaaatatggaagctacactcattcgtcaagtcatggatgaggggagagaatgtggagaaccaaacgtgtgtgcgctcgcttgccttgactgggttgggcgaaggacgcgatcgattcatggataacgtaacacgtagatcggatcgctggtgcttatcggtccgtggtcatgaccatatatctcaaaacaagttaggttttcgcctctgcttatagccgcgtcgtcatcgtggacytcttcatcctgactgccgaggtgcatttgcgatcgggagagaggccgaataaggtttttgggaagcgtcctcacgcgaccgctctcgatcttgtcgtcgaccctgctgcttccacgcagtcgccgtctaccagtatgtctgatcagtacacatcatctgatttgacctcatacttcagtttatatattattgtaggatctgttgcatttatataattatgtgttaggttatttgttatgaaacagacacatagactatttattgttgatcatcatttatattcgaagtttaatatgaaaatgcctaatttctcaacatattaatggtcgatttttaaatgaggacgatcgataaggtttagaattagctagttttaagtaccaatagagttaacatgaatcacaaagaagtgaacaacatcctgattgcctaagacttacttcgattaataagatcacagaatttagccgggctgatggttagaaatccggtttttcatttcagactaatttctagtttgctttattaaagccagaaagctaaggaaaacgtgcacatatttgtacgtgttctccgctagtactattctttaccgttcctcttcctcgtgcagggccaaataaagagcaggtaaatggaaaacaggcagataggaacgtagaagagaacacgatccttttttacagcctagaagagaagaattgcatcactacgacgctattccatccctcttgcatcaatcgaccccccttcaattcgatccatcgatctgatgttctgcagtttcaagctaaggagcctcctcttcctttggcgagctctaacgctggcgttggtctcctttatctcccaattcctctggtgaaccatcgctgcgacggcttggatttggttctgggttcgcagtctgcctcttgtgatgcatcaccatcgccggtggagggccgacgacg

SEQ ID NO: 5445 - DNA, 559 bp, Zea mays
gcagtgatctttcctttcactaatcagtgtttttaaatgtgaaattaatcagtttcatgtttaataaataaataaataaataatgtattatgatactataaatattgtatagaaaactgaatagagaaaatggttgaagatgaagtgaaatgagaaaagaagggatattaaaatatgaataaaagtgtgaatatggatattttaaaaagggaactgttagagttagccttagatatccccaataatctctcactttattttaaactacactctaccgtatacacgttttggtaacacaacccaaacaaagcaaaaagatttgatgcgcggtttgtgtcacggtgtgtcggtgtgcctcttcgtgggccccacatccaaaaaaattagagtcccgttcattttgagccctcaaggcctcaagtccacattggagccccgttcgttttgggcccccatgcccaacggaacgggcaacgggtcctgtttcctccctgccgagaagaagaaacacaagcgcggtgctatccacccatcagctctcgtatccgcagcgcccgga

SEQ ID NO: 5446 - DNA, 1011 bp, Zea mays
gcttcgatcatcagtcgatggatttctttgatgtgtaaggcttttaatgtatgtaaaaattctgaacttttaaaaagatgctaacaagaacataaaatgggaattagtagttttaaatttcaatatatcttatcctaacatgtttactccgtagcaacgcacgggcgttcacctagtatatatataagataataaaaggccgccgcatctcccattctccctgcaccgtttcgtcgtctcatttcagcagctactagaagtagtagctggctcgctcctgctgccggtttcttgccgtcttcttcttcaccgacgacggtcgcgcgttcctacaccaggtggtccggtgagcctctcctctcctcgccttgtgctgcgttttttgctgtcgccgcccgtatcacagcgtttagttctgtttcttgtgttcgggatttgatgcgcgtcgtacggggatctctcgggtagggtaggttatgccatgatggggtcgtggatctctgctcacaacccctgcgtagcatttacttggagcatatacggccggatgcgcgtccattgtaaaacgaaaagtgcctgaaacgaggggcacgcaaatttgggccggccaaagctttgaatggacctggattttctgctatttatccccatttccggggccttttatttgcatctagtttttttcttcttctttttgttgcgaaaacgaaatatgcatgcggtccaagtaatgtggagttgtccttttcaaatcccaactagaatgtgctagagagtagggaaggcctcatcattgtgaggtgccacaaatgtaaattaccagctcctcttctttttctctcttcactttctagattccagatgcttattctccctttttttttcttctgaattgttttaccagggtggaacggattcgtatccaggagacgtttgaggtcgtccttcagcgcttatcatatacatacatcaagcagatcaacaagggcttaattcacaagacaagagagg

SEQ ID NO: 5447 - DNA, 293 bp, Zea mays
cgggtcaaacatagtggggtttgtaccgttttccatctctactcccaccaccgcgtcaaccagtctctccggctctcctcgtccggagtatgttcgagtggagagagtagttgacttgcgagttagacaggtagactactcggggtcggggcagccaaggccaggtgggtcccccgaactcactcacggtcacggcaaccgccgccgcgacgccatcaacggcatcatcccatttccacttggatcccaacttcccaagccacctctgcttctcctccgtctcgtcgtcggcc

SEQ ID NO: 5448 - DNA, 1500 bp, Zea mays
gcaggtcctgaagaaattgccatgtccacaaaatgaaaatgcaataactctttagctcttatcttgtagggaatacattatacgctttaatgttagttttaggtttgaaacgctaccggcaggcaacatgcatcatacatggttaaccttagtcggggtttgtgattgtaatatatcttctcttcttcacattttgggaaatcattggaaagagggtgagtgttgaaatatgaagtgtacaaatataaagtgaactgccaccttccccatcagcttattggtttgaattaatcatgtatgtaacttaatagtaataataaatgattgttaaccagatatttctttgattccttagaagaactgagcacttagggccaggggagctcagccaaatgatattttacagagaagttatggtagagtatgatcctatgtaatgaactgagcggttgggagctgagaaaactaggggcatatttggatgtgcagtaagctttgcttgcctggcctcgctgctagtcaaggctaaccttgcccattgtggcaagccaattcggctctctcgctccagcaagaaaaactagcttgtacaagtatggaggcaacacgacaaggtaaccaaacatgtttctatatcctgtttctggctggtcaaggcgaggcaaggctcacatatggaaccaaaagtgctctcacttgtcctaattcttttcctacatagtttatcatagagaaccatttctccctgagaatcacttcctacatataatcaggagtagaagccttagcagccatgttaccggaagggaatgggaacatggactgatactttataatgtttttatactgtgggaatgtaattgttcctggtaatgtgaatgttcttgcaacgatgttcccgaaatggggaacgtggccatgttccacgtttccggctgctaaggcaggagccctagtaaactggcctcaagttttacatcatttgaaccacgaacttaagaactttcaagtttgttgtctccatttctattattctatattgtcttactgttagttatcatgaaaccttccataactgaaaaataaccagtttgactttggttaagatatttggcaggaagcctagtgtgagttaaagtatgatttgactgcttagctgaatgctactggagtctggatctcttaggctgtcattagagctgtggtataacatgcacttgaatggcagcattagcttccaacaaaaccacacaaagcattttttgtttccccctttgaattgtgggattgaagggcagcctctccgcatttgtagggggaaggcttgccttgatttatcccttacctagaccccaccattgtaggagcctccgacactaggtctgccttttcattgtttcaactgactccattgtgtatctatttgttaaactgttaatgttaatgtgaatacaattactctagtggaagataccctacattagacttaagaatgttaga

SEQ ID NO: 5449 - DNA, 166 bp, Zea mays
ggtcatattaccaattttgtcatgtctctctgctgttacctgtgctataacattgtcgatgtgtttccagactggaaagtgggagtggaaattcgagaacaagccggtaaacatatactatgaggaacatgagcaggaggttgctgagaatatgaagaacattctc

SEQ ID NO: 5450 - DNA, 1093 bp, Zea mays
tttgattctaagtttgggaagtcaaaaactttttccttttttcttttctccgaagctcttctttctgacgaagcggacgttgagaagcaccttcgttcgattttgggacttaagcttcggctatgatggaaaatttcggcagcaaaacagtgcaaatagcaatgaatgctgtggtaacttcacaactacttgtcagtttatatagtgctgcaggtaggaaggcgaagcggtggaactgttacaccaggcgcgcagtaacttgtacccgctgcgcagtggaccgcaaggatcaaacagtaactctgcaaggtgggaccgacacgcgctcggaagtcggatcgtttctccgcaacgagctcagggaaggtgttttttggaccttcggcttcccgaagctgaagaggcttttttcacgggtcaagctcgttacgaagaacgatctagcaccgcgaaaggggctactgttggggtcgtgcttcggtgcgccgaaggtctcacacgaagaagcagcttcggctgaagtcgtctccaagagatggccgaaggtcccttttcatggagcttcggcgttttaaaccgacatagagatagaatgacctttttatacatataggtctgagtcaatgctgtaaactttcgcaaggggcataattgtaatttgtcacaggctgcgacctgtgcctataaatagatgaacagtacctctgtactgttcacgtgaacctgtcatttgctttcgcatcacgcttgtacttttgccttccgcaggaccgaaggtacatttgtaattcaaagtcatttatattcattaatacaagtagagataattctatgacaatatttaaatgtttatttcatattctatgatttatgtgaatgcttcattcttcgttgttatgcttacgaaggtatgtccttcgtaaccttcgtccgagatgctttatatcccgaagggatatatcgttatggaggacgaaggaccttaacacttaacattttttgtgttgccttgttcttaattcttagcatttgagaacaagtccccaacattggcgcccacctccggtcaactcacttccacctttctgagctg

SEQ ID NO: 5451 - DNA, 913 bp, Zea mays
tacgctctgtagtgcactagtgtggcaggtgattgcagtttgcaggggcctctcaattggtgaacttcaccaggtgccaaattgaaggcaaatggctttcagattttgtaagaaaaagagtaaggtggcgtttgtttggtattataatctaaccagattatataatccaacaaattttaaactaacgtttagttcaaaatttggtgaattatataatctgggtagattataatcccacacaaataccctctaagtatatattttgggaccttaatccaggcttcggcaaccctaattggctgaccccagtaaaacaaacaggcaaacaaacatgcagccgtgcaggagagcctgcagggcattggcatcactacagcaggttcattaactcagctggtcttataaccaatggggaagagaggagcatgaccactgtttggcccatccccaactgccaacaactactactccagacaataataacagtaagcataatgttactttgtgtgatgacaaaatagttccaaatttacatactattcagatatacaggagtaaaaacaattgtgtttcaaacgagggattatttccgtctctcaaattcaaatataagcagttgtctttgcaagccgtagtccagagaaaaggatttcaagatttacccaattgacgctgcatgtactatcaatctcttcaaatgggttgttccctacaggcctccaccatttcagatttcacccaccaggccaccaccaccctctctcggctcggctactgttcgccaattccttgcttccttcgctcacagcgtttcagattcccaagaaggcaagaatcccctcccttcccatttcccagcagcagcagctttggagccaaaggggcaggcagcctttgaccctccaccgtcgcc

SEQ ID NO: 5452 - DNA, 190 bp, Zea mays
gtggtggtcgacgtctaaccttttaactagataggaacgagggatgtgttcctctgtacttttctgggaagcaaaaataccatgctaataatacaagcagacagctaacttgattatgtaacatcaggccctgctttggcgagggtgatctgctggggtatctttcttgcccttgcttcaaacaggaagc

SEQ ID NO: 5453 - DNA, 253 bp, Zea mays
atcgattcgatgagcctacgactaccgatccagcgcggcatcatggcatgcggtcgcggttatttactagcgatttagtgtatagcactgctgtaaataaaacacctactagtactacatctgcgtgaggtcgacgatcggccgtgtggtgcgtggcaattggcatgcatgcgtcgagctgcctacgttccattatttgctcgtgtgatttgttactgtagacgagtgtgggggtgtgtaattagcattgttg

SEQ ID NO: 5454 - DNA, 145 bp, Zea mays
agccgtgagccgcacccgcgattgggaaccgcacgaagaggctaagtaagccagagcactgactcgtatccgtatgtaactggcagggagtggattcctgcggcatcatgggcaaaattttgcacggcagcccaaaggaagcccc

SEQ ID NO: 5455 - DNA, 112 bp, Zea mays
ggagttagaaactgctcagctggctgctaaagttgccgaggaaactgctattactctcaaagctcagcgtgataaagccctggacaaggctattcgggcaggacgaatcttg

SEQ ID NO: 5456 - DNA, 957 bp, Zea mays
cctagacacaatagattctaacacttatttctagtattcttgctagctacatcatcctatcgctctgctagtactgctgcctgtactagtacccaatgacatcccaaccataagataaacgctgctgcagcctgcaatgccctgctgttggcgtactccaacctcactttacagcaatccagcgtcttgaatggaatttagaacaacacgtcaattttaatgatctgagcaacaagtagagcaaccaatccatctgcaggtctaggagaggaacttgcactggaccttggacctcacctggagtagatcttggagctgagatgcaaatgacggaggtcacgtgtcgacggcgaggggcaccccgtcagtagcgtatcgagggcgaggccacggcggagatgagacgaggaaggccgtggtggcggtggcggtgaggcgagcgcggcggaggcgaggacgacgtcgacggaggcggtggtggggcgactgggcgaggatgacttccaaatgctccgtgcgtggtcgtgtctgaatttcataggaaaaggccggcagttgaattccacgcgacgtttcccaggaaaaaggccgggacatccacggggggtctgagcttccagagggtgaccgtctgatgctctgatgggccggcctaattcggatctgcccagacggccgtttctaatggggccgcagtcacagcaaagggccgagtctttttacgcctccgcccctcgctccaagtttgttattcaaaatcgatcccgaccttccgctcccgcaagaaaggaggagaaaaggaacagcggaagcgaagcacaagcagtcagaggcggccgccgcagcccgccgcagtagcgacacgcaacccccccttcccctatcacgccacccggctccacggaggagcgagaccgcgcgccgcagatccttggtcgccgctagggttccggcgag

SEQ ID NO: 5457 - DNA, 1169 bp, Zea mays
tataactaataaaactattatgcagtctgttccaaagaactttttgttagattaaaacatgtcagaaggcccagcatagtgtgtaaaactttcttcaagggtgcttgcctaaagcgttccctaaagttttagacacaccctaaagctactgtcgttgcctctaaaaggcactctaaattaaagagtcagatcctcatgcatctaaatatatggggttctctcttttcctctaaattttttatgctctaaaatacgaattaaatacagaattaatatgtacataccattttagactataataaatacatatgtaaaaaaatctaattttaaatatattaggaatatggtgtattatgtatagggggtggatttagaggggagagtggtgaaaaaaaatgagatttaggggatgaaaaatcatcgtggatattctcaaggagtgacgcgtcgagctctcttgatgaatcctcgtattggcccgagccacgcaggtcctttaaaatctgaacagaatgcaggcacaatcgagcatctcaggagacacgtctcgaaagcactgagcagcattacttacaaccaatttgttgcaaaaattcgcaaatgtcaagcagaagaaagtggcacagagaagacattatggagtcgaaggggaggaccgcaggagcgagagggaccgccgctggcctcctcgaagaagagcgtccaccggagggccttattgatatattcggagatccaagtagcagcggcgccggacgaggtgcggccgccggcgaggacaaggacgtcgacgaaaccccgcaccagacggcgctcctcctccatggccaccaccggcgggtgtgcccaccccattttccgagcctgcttctcacaatcctgacttctgcagggactacccggaaaacaatcctgcacttatcactttgcactcagaaccctatatttatgcatttccttttctatcactcttttgtttggttcgcacctcgcacagacgcacgcaagcctgaggtcctgaaatgaaaatttgcaactataacaaggtggtactcgaatagcagccacaaaaccctaacctcgcgaccgtataaacgagccaacccgcccacctcccgcgccgccgccactcagcgccgcgcttgcgtttccttctcttcgcttccaag

SEQ ID NO: 5458 - DNA, 1036 bp, Zea mays
gtggagagttgcaccaaacaactcctaattcattgggttcctcttgcccttgttttgacacagcacattttaataatcatgcactacccatagttagtggtgtgttgtctcaccactgtctattattgccatagccaccactaatccgcttgtctcacgagctttttaaatctagtgaacattaggcagcgtttggttcaggagcaaggtcataaaatgaagcggctatattctagctctaggtatgtttggttgtatagggatttgaaaaggatttagggacatataatcctttgatagtcaaattaattagtaagggattatatagtgtttgattggaggaagccagtgactattaaaccttttcacttacggaataaaggaaccgttctactttttttttccaaacacggaacaaagtcatttcattcttaaaaactgaaatcgactcgttcagtctaactggactcataactataaaaccaacaccgctattctcatcagctaggctattcaaggtgttgcttggaatcatctttagggcccgttcgtttgtccagaattagaccaggattcattccaacttatcaaaacttatataaattagagaaacaatccggtcaggaaccgttccaggccttcaatccgtgaaaaacgaacaggccctgatcgatcgttcgacggaacttctgcacccccttccttttcgcagtccgggcgtcgtctccatcgatcgcatctttactaactattaagagcctattgtagaccgcccccgcctcctacgcccgcccgcaagcccgcaaatcacgccgcgaaccgccgcagactgaccccgactccctacgcccgcccccaatccagccgcaatccaccctgcgaatgcggcgaccgtcgcgttccggccggccgcccgtccgcccgccgctatggcactatccactaaccagacacagcgtccagccaagcttttgccgccgcccacttctctcccacctcccctccactcttttgcttgtcgcggggttagaatccc

SEQ ID NO: 5459 - DNA, 51 bp, Zea mays
aaaatggttgtaaatgctgaacagatctgtgacccgctggcgcctgggcac

SEQ ID NO: 5460 - DNA, 420 bp, Zea mays
gttgaggctgaaccgaatggtgtagtccaccacacgcacactttcacacttggagccagcccaagtgctcgacgtcacagagggtgagcaatacagtctgacgactgtcgtggtctcgtggacggatggggcggtcttttccttttggcgccccctgctttattccaaagcgcaaaagcatccaagctcccaccccaaaagaaagtcgattcccgtcgaaatcaaatcaaaaccatattcgcccatccatcacccaccgcacgaacgcaccaacgacctcgctgggctcgcacccccccccttccgcgcgaaggaaccccgggcgacgatcaaacctcacagcccaccacgcgccactgggccactggagagagagagagagagcgagcgagctagcgataggagcagacgccgccaccg

SEQ ID NO: 5461 - DNA, 699 bp, Zea mays
ttctttcacccttattctgtttcgggcaatccgtcttcatatcaccaatcaccttaccatcaacaacgccttcaaccgcactagcaataggagtcccagccaaaacagcttcaagtccatgcgatccatcaagcgtactgtactatactatatatactatactatactatttattagtctctgggaatgtgttcataggccaggccaggatctgagattccatgtgtcctacttctctgccttggaggatatgtggtcgatgaatgaataaaaggcaggtgtctcgattggcaatagcatttcgagttgtgtttttttcagacttgaatattgatctggcgcacagagttctagtgatagtcccaaactctgaaatgagaatgcaagcaaggaagctccaatggcaatggtgactacttaggcgccgctatgtgagaagcggtatcaaagaataggagggaatcaaataagcacagccttctcttggtaagaaatagatcatcttatctttgatgagatagctcatctcattaaatcaagaatgcggcgatgttcccagttattactagagcgcgcttaggcggctctgtattaaggtggtagtaggtacgagtccgtcgagcccatggaagatataggttgatttttgtgaaaaatggatttatccatgtgtctctgtatgataaagtgaagtgaagt

SEQ ID NO: 5462 - DNA, 1500 bp, Zea mays
agttaaatacatattgaagtggcacatagatggcatgcaaagtgaaaaatactataaatgttgataaaaaacatatagaagactaaattgatctctagtttcaacttttttaaaagctagagattgtacaactagatctatttgggtggaagaagctcgaacgaagctgaaattgttgaaatgaaaccctcctaaacaggttcttaactaaactgttcgaaagtctgtagctaatcttaaccgttaactattaagagggcctagttccgctttcacggtctacttccgctttcatgaatccgaccagctagcccccacatgccaccaaaggtttctaattcggcctacaatctacaaacatatctggaaaagaataatagatccgagacgattttggaccggagccggtgggtgcatcaatgtgttcaaactggaaatcgttcaaggctagcgccacatgccgcatctgagggcgctgcctctgccctgacgcaaatcttcccaacgaagcggattgtcgacatgccggcatcttctctttccttgcacgtcactagcatacatccaagtttgctcaacagatgctagcaacatttgaacctgccgctctagcacctgatcggctatgttgaatcgtggatggtccatgtgctcgccacctaggtgaagggccggaacactccgagaaagtagacagcgaaggcgcaggcgcgcagcgcagtaggctttccgatgtcttctccacggctgccggccgatttggctagagcggtgcgccaaacgcgcgccggatccagccggaggaccggccaccgccaaacacacgagcctaatacggcctccgtcacggctcacgactcgcacaaacatggacgctgcggcctgcgggtgcggcgtgcgggaggggtgcagttgagccctcgagacgagcctttatcgggaggaggttaacggctcggttatctcggggggagatataactatcgcgccacctgccttgcttttcaagcgttccggcccaaccctatcaaaccgagagttaaaaaacgcgcgttttattccggtcgtgccacgcccacgccgcagcgtcctcccgagctaaacgccacatgcgagtgatgataataaggaaggaattgaaggaagcgcccaaaccaccacagcacccacgaggccacgaccgcagtatcgccgccgccgtttcgtttccttatcgatcgtgcggcgcgccggcgggatatagtagctcgaggcgagagagagagagagagagagcagcgctagccttccgttcccattcgcgcgcggccgccacgattccgccgttcccgcagaacggtgctcggaaggggcgcaccgccagcagcctctgatcatccttcgcggggaaggaacggccgggggtctcgagcccctgccggccatttcgccccgcctcgcgggattcccgccaagccgttggtgtagcgcgtggaaggcggcgatctcgggcagggccgg

SEQ ID NO: 5463 - DNA, 181 bp, Zea mays
ctccctcgcccgtcccatccagctccagtacgctcctcctcctccttcctcctgcgcctcgtcctcgtcctcgtcgtcgtagtcgtcctcagctcgtacgtcttcttcctcgcccctcggaggcaacaaccaccacacgggagaaccgctggcgaggagcggaattgggatccttgcatgc

SEQ ID NO: 5464 - DNA, 983 bp, Zea mays
ggtaagctataatctgcacagcacagccgtctcgatcgaaccaggcgctatatagctgcaaccgtgcacatcgggggctatgcgtacgagatctctcacctgccggcttggatcttggtggtcttgttctccaactctcccctggcctgcgccttggtcctggagctcttgctttcttataggagtatgtatgtgggtgtgagcacgatgatctatctgcctcgccgcggcaggctttcttgttcttggataccgccatggcgaaccttttattctttgcgtagatctaggcgagtatcgtcacctcctctctgtgtgcgtgccgtctcttctccattggctttgagctggggggactccggggcctttaattcccccttgtctcctccttttaatccttgaaaggagcacacggccgcctttatcttcctttgtgttcctgcctttctttctatcttatcccccctttccaagctctcatctcctttatccctccttttctttctcgtatggagaggagctttaccctccctctcccacaccttgcatcaaaagagcagccatgtcttgggtgatggagtgagtagaagtgctacgccacagatgcaaccctacaagagcacaagcaaagttgagtttatgtggtgcgctgcgatgtttctctctcatcttttccttgttttttttcaccttcttatttgccttttcccattctctttaatctcgcctttgtatccatgtgcttggttctttgttgcactgcactgcagttgttgcaccataagaatccaaagtcctccacgctcataccccctctgatatgtgcttgctatatccatctcttcaatctcccatacatactacatgttcttgcttcgtagtagttgtcagttaccttaacaatcatcattcaggtttgcagtggtatcatctaacgatgagcaatatgtgtccatcaccaggggctagggctagggaagccc

SEQ ID NO: 5465 - DNA, 333 bp, Zea mays
tgttaattttttcgcctctagcacgatgactattggagtgatctaacacacctcttttttgtgcatgttgaccgtgtgaggaacacattggaggaattaaaaaggagctcatgaatctgaccatactggccatagttaggcaagcaatcgaccctatggcgaagttactagaaagcacatatgttggacgcttattagataagtttttagacatgagacgatatctggcttcttctgactctacctctttttctctcgcatgtgaagaaactttgctacgtagctgctgattatgaaattgaactgagctgcccgcacgctcaggcgagcggt

SEQ ID NO: 5466 - DNA, 283 bp, Zea mays
ggttcttcctttgattggtgataaagaaaaactctgatcaaattcttcgcatattcgcacggcagattccgtcagtccaactccatctcctcgttttcttcagcgcccgtacgcaaatgccgtatcttacaaatattgccgcgaggcattctgaaatcgatcgagactttttttttggacagtttttaataattgtgtgaaatacaaatgtttggcacgtttttcggttatacaggagccatgtaaatgtttatttgtgtaattgaaggttagggagtcggcc

SEQ ID NO: 5467 - DNA, 1289 bp, Zea mays
tgcatgcctgcaggtctactatatcaatcgagaacccccagttcgggccagcgcgacaccggcttgttgttgacaccccctgcgccggcgttctccgccgacgagcggcggtatgcgacccagcaccacattctacggacgcgggtcaaggaatccatacacatacctcgatatcatcggccccccaccgatgcttgttgtgaatccgtcgcccaaccattcgccgcaacctcaccggagtcgggattcattgacgacgggtacatggtggagctgccggcaggtgatgctactcccgtgcgacggagttaagcgcgcgaacgagatgtggtggcgcgcccgtcttggaaaggacacgaaatttggttttgggaggaggagatggcggcgtacatttccgcagcacgacaccctgcattcgccagcgaagttgttgaaagaacatacgaggaattattggaggattgtttttttaacttttccctaaaatagtattgaaagaggtttattatattgggtactattgaaggtgctcttataaagggttattacagatatagatattgtactacttttgtcgtccgccccctgctgttttttttttttggaatcctgctgctagcgagcatgaagcccatcgtgtggctctaattcaacggccgggttactcgctacaggctctcaacgggccatcccgcaccggaacggcggaaccccaagccggcaagcccgcagcagcgacaggggggacagcagttgtatctggtgtacgtgcgtggtccaccgatcgagcgagaacaagaacaagcgggtagtaggatcgctacaggcaggggcgccgggcgtggaaaaccgtgcgtgcgcagtaggcaaggaacatgtgagatctccgccatttccacttcaatttactttgcaactagcactgcctagggctgccacgggtgtttttttgaaagagttcagagtctgtctgaatattcaagaacgacgacttggtcctctccacatgcacacgatgtgcactatccatatgcacacgatatgatctgcactctctgcatccgcatgcataggatcgtaaacaagcgtgagccaagtctcacccgtatattgtaactctcctgcctgccactgcccgagcggcctatataaaccaccgatccgccacggccgtgccagcacaccagcccactcgcgccaccacctcacctcgcctccgcgcgcggtcgatcactccaccaccacacacatcttccgtcttgcacgaccagctgcacggtgtagcc

SEQ ID NO: 5468 - DNA, 182 bp, Zea mays
ggtcagcatcgccaaccgcagctccacctcccgatcccagccccaatctaggaggaggaggaggaggagaaggccactttcaggattctgacgaagccctccctccctcggccgcatcgcatgctaccacgactgaccaccaccagcagcagcagcagcagcagcaggaggaggagggcagg

SEQ ID NO: 5469 - DNA, 79 bp, Zea mays
ttgacgcgcgcgggtgtggatgaacagaggctagcacagcaagaaccgagctagcgggaaggcagagacaaggaagacg

SEQ ID NO: 5470 - DNA, 1357 bp, Zea mays
cgtggtttccttcaaagttttggagcaagaagcactaccattgattgacatgatgcgtttggaaggagccacgttgtaacttgtatgtcatctctaacatctatgaagatgtcttttcattgtacactttttatttatatgctaatgttgttgggggtttagtatcgctttgactcgggtcttggccaatttctgggtctgccaccggaaaggaggtactctaatttttttaatacgattttaaaaactctatgaagtttttttctgtatagttgaggtgtttggatagaaaatttctactctaggttagagctggagccatgccaaacatgaaacaccccttatctctagtcaattttctgagagagatcaatcctttgttacaacaaaaaaagttatttattctttgatttaactaaataagattgtgtaaagtctaattaaatctaacaagattaggttaacttttacatgttgtttgtttgttagtacaatataccaacatgtttgctagtagcaagtatagcaatgaaaggagagaagagacaggccaggaagccaaaagccctcctctttggctgacgcggagcagatctttcgctctgctgggcttctcttgtcttccgggcactcctgcgcgatcaaatccgattcaacggccgagaaaaaaaccctcgaagaggaaaaaggaaaaaaagaaaacagggagagcccaagcctgagacgaacacgaagaagcaaggagcgaagcagacacgagcgagcccatcccaagttcccaacccacacgaagctgcagcagcaggcagccgcctcgccacgcgcccgagcaacgccgccgagagagccgcccgcccgcccgcccgccggtgagcagcgagggcaattcgtcttcggctggtccccgtcccgctcccgcccgccaaccccaattgctcccctctcggaggtcagctcaattcctgctgtttctcggattcgattcggttgcaccgggcgcgtcgtctccctcgccggagatccagcaggtacgagctcgcctggggccgaggatcatgcccccattgctctagggtttgggtgggtaatccaattggctcgccaggcccgcggcctctatgcttgattcgggcctgccgcgccgctccctgggatctcgcggcggttggtgcggcgccagcggtgatgagatcccctccatggccggcgagctgggaattggggtacgggctcgctctctgcaggaagcggcgcaagccctaatggtttgatcctagctgggtgcggcgtgctatccccaattcattggtttctctactccgggtctgatattggggtttgctgcggtggtaactgc

SEQ ID NO: 5471 - DNA, 547 bp, Zea mays
atggtaataggatagatgcctcgtcatccgcatcgatatgatgtagcaatcaatcatgtgcgagccgagcacgcaacgaaggaatcccatgtggcatgcatggcttggctagccagctcaagtagtaccggcgaccagttgcagaacaaaaccagatgagacctcccccgatccccatcctgttcctaccataccaggatcagctaagctggtggacaagacttgaaagagacgagagagagagcatcaggcatcatcatgagctgcagctcgccgccgccgcgtggagcatcatcacgacgccgcccggccgacgatagccccggcgctggacctgctggacgagcactggttcttcggcaacaccctcgtcaccaatagcagcgccaagaagaagaagaagccgccgccgcayctgcccaggtcgccgtccacagccacagccacagccacaggggagaaggcctcgggttcggcggggccgccggccaggctaggaggccggcagctactccggacgccgtcgctcccgtcgtctcgcgtcggg

SEQ ID NO: 5472 - DNA, 529 bp, Zea mays
tttccaaaccagcgccgcgccgcgctcctttttcgtttcctcgaaagggtcagccagccaagacagacaaacagaggaacgtgaggaagatgcggcatgtcacgtgacatgacacgagcgccgagattgggatggatggcgtcacgggctcaacaaatccattcaattccccccgtctaccctgccctggataggtggaatggggaaacccgacgactgatgcagtgtgtttagactctgtgctcgtgtcacacgcactctcgccaccgtgtctgtgccagtagtagtagtcgtagctccagctcagctattgtccctgctaatcacctcccgtaactgtcagcacccgtccaaatctactactcctacaatagtcctattatacaaaactcatcagctcatgcccaggagagcgcacgctcttaagcagcgggcggcagtggcacggagcacactccccagtccccagtcccccgctgggagcggcagtccagcacgaggcagaagcgcgctgcgaggggcagacgcc

SEQ ID NO: 5473 - DNA, 559 bp, Zea mays
agtatataagcccatgtattattcacctaaaagtagcggggcataaatgaacttgcacttggacttgccctcctctccctgcggaactgcaggaaaagaagaaaaaaagtccacgcctcggcctcgctcccgcgaacgcgttgtgtacgtacagtacgtacatccaacaaaactctgctgctgataggagtatatgcccgcggacgagggccccgccatcaaaccgaccgggggctcgctgccacgcacgcaccaccgccatacgtgactttgtgtggtcgaagcggccgcggcggcaccctcgtccattcgttcccgttgcgtgtcgctttgaccccgagcggtttatgtgttggtgcgtgccgcggcggcagtggcacccagctgggctggcgggtggcggccggccacggcgctgaccttgtcgctactggtctgtgctgctgtggcggtccgtccaagtttctcgtaaaggctttggcactggtctcgagctgtgtggtctagcagggccagcgacaagaacaagttcatggtttaacaactgcataggaacaag

SEQ ID NO: 5474 - DNA, 972 bp, Zea mays
catctcctgcgagcccatatgaacagaaaaaagaactaagcagtcaatgtagtgggcttcaatttctgtcgtgtggacctgccacggggtgaacgtgagggattgtaaagatgtgtctttgcatctcgggtcgtcgggtgcacagaaaatttttccgtatttttcatggttgccgtacgcccctcggtgtaaaatctctgatctgggaccaccgcgcatcgctggacgcgtgcacatcatccggtgtaaacaatggtctcatgatcaattaaacaattgctttgggatactataatcctaatcacttggacacctaagctgcttgcatgatccgttccgttccatggaataagaaattgggatgtgatgacaaaaattaaaattaaaggtggcggcaatgctatcttttctttcgagctgccttccttggattggaggcaggaaaaaaaaagagatcaattgaaaccaggaggaacacgaagtcagcgcgacgaggatggtgggatttggatacagttcaatgaatcatccgcttcatcaacctgccacggagctgggccatatgcatgcttgaagatgagaggggaacagaaaggcaacgatcgaggagggggaagagaaaagatctctggactagagaaacgtgtggccatggtcactctcaaggacgtgactccctcccgcgtgggccaaagagaagcacccaactgtcagtctgtcaccattagggccactctgaaaaacaatcccggctcctcctcctgctgctctgctgctaatcagacgccacgccaccacttatatgatgggctccatcgccaagaaactgagccatccggtcccaaaagtagaaaagggcaagcgacgagcacagcacagcacagcacaagcacgccttccgttttgggaaggcgaggagaggggaaccccggcccagggagagttgtggggaggggatcggcggcggaggag

SEQ ID NO: 5475 - DNA, 1314 bp, Zea mays
catgaagacggacgtcgacgacgttgcagaaatggatagctagaggtacgtgtactccattaccatgacgagcgcatgtgcatgtgtacgtgatcgctccgccgtcgttagttatgccggccggccggccctctggtacatcttccaatccagcagcttcacggccgaaaagtggaacctgctgccgtactacccatacggctatacagctggggggccaactaacccaataaagggcttgttcgtttcagcggtaaaccatatggattggatgatattaagtcggtttaaatttataacaagttaaaatacatcataatccattctaatacactttaatctacatggaattaaaataaccgaacaaggcctaaatgtgtgcttaaatgatcattttgaaggttcagagatggaattgatcgttctttaccatgtctctagtagagtgtgtaaaataagagacacggaactgtagatgacactgtttgtttttgtggtaatatgtcatggaggttgacctcgctctacggcccaaattaaacggagacgttgtacgtgatgcgtgtgtacttagcttggggccggccttcatttgggtcggcggggcggcgttaatcgacagatctctcttccagcacacgaaaagtgaagaaatttaaagtagctagcatcagtctagattgcatcgacacgttgaatactgtagcatcattacgtcgttgcttccggacatcaatcatgttcatatcgggatatatatactactacgtatattataatatattgtataaaacatggttcagttccaagtacatatgccgaaccgaaattatcaccgccctcgtcctgcacgtgcgctatcggtcgtactcgtacaactgcagtcggccgcggagacggagaatgttcgttgtgcgaaatacaaatatcccttcacgagcacgaaaggtttggccgctgggacagacacaacacaaagcacatcgctgcgcctgcgcggggcagagacaagacaggcccatgatgctacatttggtagatctgggccagcccatgtgaaaacctccacgcgattattgcatcttatccagacagccccgcactcctctcttcagtctctctccccttcgcggctcccaccgcgtgccgccgccctacaccaggtgccccccacgtctgcatcgggcccgtctccggcgacgaacgcccagcaggtaacgccccccctactccctccttaccccttcccgccgtgcgaaaccgagcgcataaaccctaactcaagcgctctttgtgcccgcaagggggaggagg

SEQ ID NO: 5476 - DNA, 1500 bp, Zea mays
gcacggatgggatgagccaagattgacaggagatttgtgatctgatctgatttctgttctggtttttgaagttgttttttgtttgatrtgatctgtgacaaaactggaggtgggggacacacagacatcatcagaatgaaaaaaacgaaagcgaaggatgaaccccctcccctcgtgttccttagttttctttgctttcatttgtctttttctaactggtttttataatttgtatttggagatcaatagtttcacatgctctcggggaatggtctgtgctggatttatcaggataaaagcatgatcatgtagaaatcactaattatattcccagatttgatggtcttgttagtattatcttgttacacgatggaaggtatctttccgtataatttcaagagcaatttagcaactgaatctaagcagatcttttgaagtggttgctcatatttgtgtaccctgaagtatcatcacattatactcttgaaattgaaacacaggcacatcaggcttcatagagagaagtttcgctgtctaagcttgactgctagcaccatagttttttgttctctttgcctgatcctgtgtttgtttcgtttttatggtcggacacttcccttctgcatttttgttcccatgactaaaatttatccataggctgatgtttcattttagaaagctttcacggttaaatactctaatcatgttatatacttgtgtggatgtccctgaagcagcattttttccccagatgttaaccttagaaatcttgctcgtttgcaggcaaatagatgaatacacgyatctcatcgcaagcataaaagcacagatcaagttggtacgtacaatgcatattataatwgtctaggtgttccattatgtcgtaaattatataatctactactacctyccaagttataaagacgttttggttgtttcagatacattgcttttacttcgtatttagacagtgtatattcaagtgcataacgaaacaaactgtaaatctagaaarggtcaattttgaatgtaggaagtaaattatagttgctccattctttcatacgtcgttatctgcttaaattcagatattactgtgccctactgcttagctattggcattttcacacgcaggtatgtgaaggtatccgcgaagtgctgcagctgcctgcggagaaagagttatcgcccaggaatacgtggtagaatttggttctatgttttggacatctgtgtactgtagagtatagtcaacttgcagaagaggatatggaaggatcgtcaacaatggatcaagttgtaaagaacacacaagagaacatgtcctggctttctatttggtggcaacaatttgttgatgcttcaatggtaatttggttcatcgttggtctctttatgtgtactgaatagcaagtcatttattgttgcatttggcaaggacagtaatttttttccctgctggcttcctgctctgcgagaagaagcaagtgacacaggtgc

SEQ ID NO: 5477 - DNA, 806 bp, Zea mays
ggtccgcttgctacctgccatctcctctctctctctctctgcaattctgcattatttgtgcttagatttctcatgccacgccaaagtttgttttgttttcccttttctgaggattcatcggggttcttaatcacagttagcagaccagcaatttggtggaacccctacagatttacagagtaatttgcacctccgatttttctcaccctccatttttttttgcaacctcttgtccaaaagatggccaaactccgtggacttggaatcattatttttttggtgggtgccaatatcttactaaaatagttacttctggcttggatcgagacctaaattctaactcagaagattgttagcttgcactgaagccaatagataggatagcttgagctccatgacaatctcaaacgcataaaatagttgcctggatggcttcaatgggaatattggtccaaccaactggccaaggacagccactcatgtcagtctcaatgggaatcgtagagactgggccatgtgagtattagtcaagatagatggcatcataagtcaacctgtgatcagcgccacgcctgttagtctgatcacaccaataattagatacaaggacacggagacagtttcctgatcgttataattattagatgcaagtatatgaaaaagaattccacgcaaatctcaagtgctgacctgtgttccttaataagtgtagtgcttatatttacgttaaaggaacaaatagcagttcactagatacacttatttgttttttttaaggaatgtaacagttcatgagttccttttaa

SEQ ID NO: 5478 - DNA, 1300 bp, Zea mays
  unsure (1)..(1300): unsure at all n locations
tgccagcgcacctagtcgctaactcaccagttattttagcgtcataggacatggtaccgagatgtgttacctcagcgccgagtaaagagtaaaaaatgatattaagtcatttaggggtctaaatgtaaaattgttttaaaaagaccaaattttaaaaaaattggttatatctaccgttatattatgatctaaccaattaaaagactcgtttttacgcttgtatataaactttgattgtacagagtcgccgccctgaattacgtgtagatgtagtgtacactgttaaatattctgacgtgaaaacggccggccagtaaggctactaaaggcaacgacggttatgcaaacagtctttttttgcaagcgttcaagcaaaccatctggttcattagatcgtaatctaaccgtaggtcacatttaacacttaaaccttttcaccaccagctcaataatctttataaaaaactcctctaacaaatcatggttatatctgtggttggatcgtaatctaatggaacagatagtttgcttgcatgtttgcataggactgcttgcatagcagtngntgccccctatatatatgtaccgaacacattgaatgtaaatacttgtgtgttttcatccattatttaccgacgctttcacagtgtatgctactcgttctatgcattttaagtgatgtatgactttctccgttctcgaatatttgtcgtccactagtttatttttatactaaaacacaacaaataaaaaaaggatggagtactatttttaaggctagtttggaaacttcattttcttaagggattttatattttgctaaggaataatgaactaatttctctagggaaataaaaatatctcggaaaaataagtttccaaactagccttaattaaggaatgtttagctgctgtctgctaccggccggtcgtagcacgtttgaccgtttggtacacctacaaaagagttgaagatgtcaggatcagaacacagctggttgcgaattagggcacccacatgtaggcctggatatgtgggcatgcatatgacacgagtgcgattatgcgcactgacataacatgattttcccttgagccttggtttgcatatatagctgaactcatctccatcattgtgttttttttttttcgagaaacactcactgacggcagtaatagccagtagggcgctggaataaatactccagccgttgctgcggccattagccacgagacgaattgaagccgcaaaaggttcgacgtgctcctatcgttgcggaggcgcgccgcggggatacga

SEQ ID NO: 5479 - DNA, 684 bp, Zea mays
cctcattctaaggctttctccaacaagaaacgttaaagcgttcggtacgctatatttagcgtgtaccttcgtctccaacaagcacatgtatagcgttcgctaaaatttagcggagcctcagcgtccgccaaatctagcatctcctgtccgtccgctattctgtcagctctcgtacgggaagccgtatgctactatcatagcgccaataaaaaacaaacaatgccaggaacgtctccgctgaccagtaaaaaagaactaaaaatggaactaaaagatcttctatggacatatgtgagaacgaccatttcatatattcaacatcttttagctgtacataaatattttactatgtattctacaataatttgtaatttgttgaaaaatatgattgcaataaattatgttaatatggttgccaaaatatatacgatgagatatagaacaaacattgtagtttatggattatgttaacactgtagatatagagattcgaatttaggtgacgttgctgaagatgaagaagatatagagaacataatcttttagagaatgctgtaaaggacagagaatatttctttagagaacggaatttagggtacgttgctggagacagcctaatacagacactcttttcctctttctccattccccatcgcaaaactggaggacctagcttcgccgcag

SEQ ID NO: 5480 - DNA, 1500 bp, Zea mays
atagatgattaaatggatcgtgctaaacggatcggtacatttttttgaaacatccaacaatttacatatttacaatatctattggctattggatacacacaaacaagagcccaactgtagccgatcgtagccagtggacgttcgcctctagtacgaggccgcgtgagtttgattccccctctccaatgtatattttagctgtttttttatctaacagaaacatgtgagtctgatgtatcatgttggatcggaccacctgttggagcgtctatactgagtgagaatgcaaaaggatggcacaaaaccacatcggcgggtacatggccgggagtgaggaaggagccgcyagagccattttttggcactagcttcttccaagtggtttcgacttctaagtactcttcgttgggagttgttttttggcaccatatagaaggctcttgcacgaagtcaaaaccggtttgggagccctcctaaacaaactttgagagtaatttcatatatgctccaagcattcactcgtgagrctagttttaaaacttgtttggatctcatgcgctaaactttagctctgctaaaatttaacacatgcatatggatagtgtcaaaatttatcacgtgatatccctaattaatataggatgggagaaagagagagtgtggggtgaggatggtaggagatgttttttcttaccttggctcgctttaacacatcttgatggagctaaaccattaataactaccacttcacttttagcactctcgtttggatcttttcggtgctaaagtttataatcttctatagaataaaacgcgtcatcagccgttacgatatcccgtctgttattgctaatacaatagataaaaacagtagaacatatatatacacatataagatagaartctaagattatgatatatagagctttcacggrcttagaatttaataagagtataaatgattaagattagrattcttcgtttccatacaacactctcaccaccaatacttgaatctttcgctaaagctgacaggaccagcaaaaacaaaactagttaacggccaaaactccggcaacacggtagatagaagattcctgaggaggggcggtttcggcattttgaaagccagccgccttcctataattagcgcgragggtcccaaattcgttctcttcacrcacacgcagtagcagactggacgcaacctaatttaattcgcgagggaaaacaggtttccccatttcccagctttctcctcgccctccccaccaaattcctcctgcttgatcacgccgatttcagctgtttgcaacacttcctcttgttcgatttttattaactcgtcgactccacctcaccgaggtcaaatctttggcatcggattctgttctgtgctgccttttggtttcggcgccgaattcagttccgattccgaacagttagcagctttaagcggctttcagttcgagcgcgtcggaggcatccctgattccggcg

SEQ ID NO: 5481 - DNA, 163 bp, Zea mays
tcactaggttagccatttcttgccccagtgttctccgattcatggttgtggaactagtccgagaatagctggagctgctcgttttcccttccaagaagacgaaggcggggggcgaggcgatcgtttgagcggtacctgttgcgcgcctgaggcggtgcaatca

SEQ ID NO: 5482 - DNA, 1222 bp, Zea mays
ggtagagatattctaaaaatgtttccttagctttggtatcatgttaattgaattgctaaaagactatcgatcgaccctacgagttaaaacctattctttatatagatcactgattttatctcctatttcaaagggggagagctcctgaaatcaagatgttgctaaaggaaaacataatattattctatcatattttatctcctatttcaaacaatattttccactgccatatacatacaggcccgtgccagaggacgtgcgggtgcgggctgtgcaccggaacagggcccctaaatatttagggcctccaaatgtgtaaatttacagtacatttatataatagtctatttttgtactatataaaaacacaagttgttttggttccaccttgtcttcacattaaaattgaaaaaatgttaatataatgtcggatcactttgccaattagtatgaatgcaatagagataatagttagctgttaaaattagctaaagacattcaaacaatatagctaatagctcggctattaacctcttttagtaaattaactaatggttagctagctatttgttagctagcaattttcagtcaattaattattagctttaatgcattcaaacatctctaattctttattaatatgtctgtacgtatgcttttattccatgacgtgaggaatgagtttagccataacccgcatacctgcaattttacgatgttttgttcaccgatatctaacgtcctcgactagtaaagaggtcttattttaaaatctgtacagggcctcggattttgtcggcacggccctgtatacataaaatctgttagacatttagacacagccttagagacttaactatgttcaagaagacgttgtttcatgaaaaagaataatgttgtaccatctagacataatgttaacaatagcaaacattctcttgtcaaactaagttatggttcatcttgcgtgtaactaacttctgtttctacattgtagatcagacgtacggccagtgatctcggccagcgatgcttgatcgtacggccagaattaccacaccacgctgcggtgaggactgaggacttccccgcgcgccactgctccgcccgcgtccgcgtctatacaaaggctgtcgcgctcggcactcttgctgtcgcgctctgtgcacagacgaccttcttcccatcccttccctctgctagtctgcttcgttcctcggcc

SEQ ID NO: 5483 - DNA, 800 bp, Zea mays
tccaaaggagctctaaagaaggggactaaaaatgtcggaaattgccgcccaacccctttcactcgtctgcctccagttctattcgaagcttgttttctcgggggctcttgtttccttgattgatagagactagggagcggagccggggggttagtgttttagccgtttgatttttaattgacagcgcagggtaaccattgacttacgtacatatcttgtaacattttttaaaagttttatcttgtcgcattttcatttccccggattccatccatggaaacttgtaccatttttccccctcggaaaacaaataccccagcccatggattgtgggcctgtggggggatccttggctttacagcacaaacctcgatagcctatccagccagcatcgttggattggagcacgcaaacaaaaccaaaagggagagcgacagcgtcaggaaataatacccaggggaaaaaacagagagagaaagaaaagaaaagaaaagaaaaggccattcaatcttatcaacacaaagttgatttaataaaaaaaggcaggaatcggtacagaagctgctgaattttctgttccattccatcaagcaataatgaagcgggggagcatggcccgccccagccttgcagcactattgtgctttgttgtcacttacctactcttcactccctccataaatagcaccactgcaccctctccttcgcgcactcatccattccatcatcccctttgcaagtatagtctctctgctaagcgaagcgaagcttcaagctagtctcggcggctctagaagacg

SEQ ID NO: 5484 - DNA, 741 bp, Zea mays
tgcagtctatatgatccaccgagattaacacttgttatctatgaatgttaaaatcgcgtctcacttcgttgccctagtttgagctgatgctcgttgcacatcgtttcgttacatggctggctggctcacaatggtaactgaaaacccatcttaatttctgttgtttgtttagatgggtatttagattcagttatatgagctaaattgtaaaaagatttagccactttaccaattaccatctgatttgtctactcacccattgttgatctggttctctttgcagtatatctggagtcaaagcgaggccgcgttttctgcataatatctggttatgggagaccccagcattatggacgagccgaggcagtatacgatccgccgcccagaagttttcttttttattttttagatcctactagttgtgaagtcagctcaatgattgcctggggctgtgggctgtggccatgccgctgcaaataaactatctccaaatcgccgtccaaagtacgaccactggcagagtgccagtagtactagtttcttatggttttctctctgtacgtgccagtagtactagtttcttaatcacgggtgtagtgcctataaacgcgtgcccatttcggctcaaaattctcatcagcctctattggattcgtcttccctttccctcgatctccagtgtggtcgtgcagtgttctctttcttgcctgagatacgaagatcagcccctgagccgatccc

SEQ ID NO: 5485 - DNA, 194 bp, Zea mays
ggtcgcatttgtaattttgtatgatcaggccttcatttctgcagcatatgagtccgatggacctagatgctggagcacttggaataacttgtgtagctgctagcagctttaccaacattcaactatttcttaagaagtaacaattatgctttctggcgcaggttcaaggtgcctggcgtgctaggagcgataat

SEQ ID NO: 5486 - DNA, 372 bp, Zea mays
ggttatggctcaccgccctggactgagcgtgatcaggaggcacgggcctagcagcagatgcgacgcggcgctcttggctcactgacgcgtaggtcctcccatccgtagcctcagcctgcggctgggcgcggtccacctcggcccgtgcgccgagagcccgcagccggaacggaacggactggatgccgtccagttcgctcctcgcaatgggagcggagcggagcggacccaaaaactcgaaaagtcgaaatccaaacccgctgatcagcttatccccttcgcaggagccaggacggacgaactgcgagtacacgagagaggacagaggagaggagacacaggcgacacgcgccatttgggagagggaaagga

SEQ ID NO: 5487 - DNA, 614 bp, Zea mays
aagaacgagaatcgaatgcctcgcactgtcgaggcaggctttaccaacttatcatacagcgcccccgaaaaaacccacgccctcccaaagaccgcaaccgcaaaaggctggcacagcacgctcccggctcctcctggatgcccgcctgccgcgcacgcgccgccgtggcactgacatgaaggacccacgtgccggctcgcagcgcagacggcagaattcttgtgcattctgtggccgactgacatctgggccagcgcgtcggtttcttgggctccggcgccgcgggagtgccggccaccaaccccacccggcgctctccacgacgccaaatccgcgcgggaaacgcctccgcgcccgcgcgccaaacccaatccaaacccaaacattttcttctccagcgagcacccaaaaaaaataaatagatcctccagctccagctccgcttcattactcctcgcctcttccgcgcccaaacactaccgcctccctcccacccctagtccccctacccccccatccaatcctctgctcgccttgtctcgacccggcagcggcggcggcttgggcgcgcacacacaccaggtgttcgattggagtcytcgccgaagcggaag

SEQ ID NO: 5488 - DNA, 430 bp, Zea mays
tcggaggaactagcacagaaagattgacagaaagattggcggcgctgtggaatggaaagaggagttaggttttcacccggctccgtggttaaagcagggacaaaattgacttttatcatagctcatggaaggttacagagggcgggagattaaccgtcccaatttgatgttgatgtgtgcttcataataccaaagtagcgaggtgtagcggagtagtagaccggcgaagtcgctcgacgacaatgttacaaagtcaattaactccaactagacgaggtcagccacgcgcaacggcgcaagccgaatccaccaacgccaaacgaccgcaccagccagtccacttcgccagtgatctgtctcagctcgtcgcgtctccggcgccgacagacacgggcgagtgggcaacgcggctccgagatcggcgggcagg

SEQ ID NO: 5489 - DNA, 561 bp, Zea mays
aattattatcgatataatataaaattgtatatatgtatataaaaacactttcttcgttctaaaatagtagttattttatctattggtttatatctatatcaaaatgaatgagaatgaatctatacatatattaactattgtataaatctaatattttctaaaacaaattttattttagaataaaagtattatacttgtacacgaggtccaattttttatgttcccctgcagccatcgaaatctcaggtctgccgtctggccctcgaacggcgagacggtgggtggccgcatacgcatacatttcttccgcattgactctgtggggccaccgacggccacagagagaaacgttgagacagggagagagagagagcgagcgagctccagcctccacgcctccactacaccagccaggcagcagcccccaacgactggctcgccgctcgcgagaacccgagtctatttctgcacgcgcttccaggttttagctgcagcggcatcagggcagggggagagcaaaagcaatagttctgttctactggaggaagagcagggagcaag

SEQ ID NO: 5490 - DNA, 1486 bp, Zea mays
agacggaaggccggatgttgtcgctcaacgctcactagtcaacataaaataagttggtcaaacaaacatatctctaccactctagataggtacaattaccctttacgtatagaataaccgacagatccaggtataaagacagatccaggtataagtatgactttgtagccgcgcacaggtagtttttagtcaaaccgagccgaatgtagggtagcaaaacccaatgagtattcgcccatgcgcagtggaaaaaaaattcgccgcacgccggctacgagtatccggcagcgctccggtgaattacaacgactggaggtgaggcaaccgttgcggtgccgtgcattaagggcgtgtttgtgacctgtgtctggccagctcggcccgttcagctggtccaggctgaggctagcatgtcccggctaccgcaactcactatgtttgcgcacttgtaccatatgagactggctcagacgagttaatgtttgtcacccagtatgcagccaggctagaagactaaaactacctaaacgtgaaattcttacgccacgaccaatcagactccagaaaacagactttcatcttatttctgtggagtcagtttaagaggctaaacttactcgaggacagccaggtttccgaacagacccgcaaacacggagctacagccgaggacagccaggtttccgaacagacccgcaaacacggagctacagcccgagagccaggctgctcggccatggcggcaaacacactctaaactaccctgccccggtgcccccgctccacgacgccgcggcaccgcacccgcacgtagtccggacggcgagcacttgagctgagtcggccgcgcttcggctttctcgcccgagttactcggtgccgcgtcttccctctttcggcggcgtgatctgcgtctcggcgctaagatagctgtcgtctcccggctcccgcacttgcacaagaccttgagctgatcggccggccttctgcgcgacggtgtatctccgcttctctttttgataatttcccgcaagtcccctcacttcggatttgactgaaggagttggttttcctcctctcgcgctgaagtaggttcagtcaaaagtcagaccggcctgtgagcggaattttcctggcttggatccgaaagcctgtgcattggctacgacaactggtggaaagcggttggtcatcaaatcgccgctgctaaagtttctgctccctgaactcagttggatcatagagttttggttcagtgtaccatcctgaattctgccgtgaattgttggatgtgttgtttgatcccaattgcattaaaaaaaaacttctattttgggctgggggctacaactacaagagagcaacaacaagaaggctcgatcagctcgttctttttgttgaccatctctgtctggcgagtgcttgaggaagaaaacgacttgctcagctcgccttttcgttgttgatccgatcaaagactagggaa

SEQ ID NO: 5491 - DNA, 1500 bp, Zea mays
tcttaccaagtcttctcgacttctatggttctaccccttttctgtgtttgtaataacacaacacatgataattattgccgggcatgtacaagagctcgtagatcagtttcctacatataagagatagttaagagattgtatgatacaattatatatgagtctctagatcattaatgtagttcagagacaatatatatagaaagttgtgaatagacgaactcttcccgaagaacttgtttatttattttttacttaacctctaaagaccccctcaattaattaatgaggttgtacatactctaagatatatgctccattttttgacacatcgaaactcttctttcaatattttttcctaaaaatgaaaaaatgtttgaggatatcatgccgtttagcatagatgatacattaattcggatgtcatcttaagaaatactacctccaggcataattagagtagtagaacctccataacagttatggtgcggtatagcgggagtgtcgtcccagttcacggttggcagagcgaagtagacgaagtggttgaggacgagacggtgacgctggcaacaaggttgtgttgaacgaaggcgaagagataggtgtggcgatacatcggcgagagagccacgacacataggaagaaggtcctcaacaacgtcactgtagttcgacgataatgcttgaagtcggcgaagaactcgaacagtcgaagaagaccatgcgtgagagacgcacactgataagagtcgacagcgtgtagatgcaacgacgaggatgacgacgggtgatgatgctattgccctaggaggtgatgcagctgcagccctcttgattggcgaagcatcacgcgatggacgacatacctctcgggagggtggttctcccgcgatcagttgatcagggcgtcgacgtgtgaggctgagacgatggtggcgtggtcgttggtggagcctcccgatcagatgtagaaagaaagggattgcggataatgtgkgggatgatttgcattgagcctatagggtgaagatattgaagtaaatgacttagagagcaagtagtctatcctaggagggttatctgtaatcaatcgtagattaattgtattctagaattttctgatataggttatccagagattacaattaatcttagactaaccacatccgaagttgcttaatactccctccgtttctttttattagtcgctagatagtacaaaattgcactatccagcgactaataaaaagaaacggagggagtaattaatttacgccggattggccattagtcatttttcattggggttttctgatatgtttttgatccgaatccattgccacgtgtatccaggatccacgcgtgtacggtgctgtaaattttgttccgaaaacatcctcytctgctgtgcgcctgtgcctctcaccccctgctagagctagacgcctagacccactctcagatccaccccaactcgcggagaccgagcccagtccagcg

SEQ ID NO: 5492 - DNA, 775 bp, Zea mays
aatttcgtgttataaacaaatttaatactgcgagggggctactgttggggggccttcgtcttccaaaggtccttcaaaaaacatgattaataatgtttccccaagtgtaatatatgtacaggaaccttcagactcggaataaaagctgtacacaatgtgaaaagcatggtcgggacgaaggttaaaatagctctgaagctacacgcaagaaagcttcagctcagtggcagaaaaaggaaccgacttaaaggggaaaaggctatctagtcctcgttggattgtccttaagtcaatagtaaacataaagggcatgtatgtaattttacacaagctgcgcattgtgcctataaatagatgaacagtgccccatactgttcaggttgacttgtattcgctcgtgcgtcacacttggacttttaccttctgtcaagccgaaggtacaaatgtaattcaatattgttcttgttcatccatgatgatataataaagatatattaatgatgtcatatgattattcgtgttatctcttatatttcatatgcttcttctttcattaacatataatgtgatgatgagggttcgtccttcaggaccttcatctaaagatcattatatcctaagggagataatgcttcaaaggacgaaggtcattaacctttaacattctgtgttgccttgttcttaactcatagcatttgagaacaagtccccaacattggcgcccacctccggtgtactcacttccacaatcttcggcaaagtatcaaccttcgtc

SEQ ID NO: 5493 - DNA, 1500 bp, Zea mays
aggggaaaaaatccaatgtttgttaggagagaagcaggctgctgcaggcgctttgctagtgtcacttaggtgctaaccagtttattaattaattttctctactagtctgatgattggcgccaatgcaagttattaaactctgtacatatactttttactaagggcatgtacagtggtgtttaatgtgggggctcttaaggtgttttagggggttatttacaaaaaaatcttagagccgtctctccgtgaagagacgcctctggctcgtaaaccaagtaacaacagacgcctcacttcccactgtacgaatttgtcgtctgttctatcgatctgatgctatacaaatacatttaattctgtatttattaatagactacgtttatagacactccattgtacaatatagtctcttagttgtctcctgtgcttggagaaccgttttggtgtctctccactgtacatgccctaaagaaaaatggcagacgagaattcctcggggttctcaccggaggacctgggcaataattagccactttaccgagggtggaagccgcttcggctcgaagccgccggctgagctggcagccccgagtgacgcgtcgcgaccaatggcagcacgccgcgtcagcgcaccctcttttttgacaaattccttgtgctggtcgctttgacttttacgccggtgcacaagcaccacagcacgtccttggtggtgaatcaatcaaacgctccgatttttccaccgtcgtttgttcgtattattttactactactactactgcagtacagtagtctatatatattattcaaatttttaccgtatcgtgcatgtactgtgcttccatctggtcgcatatgcttgcttcggaataaagaaatagtgtggaaaaaaaatggacgcgtcacatgcgctgctcacatggtgggtgggccccgcgcccggcgcgcatcatcatgcaccgcatccgagtacacatggagcccgcgctgccgtcacttgaattcagttgaaattgggggatatataaaatctccccctccgaccctcctgtcccgctcctcttctatttgttcgtttacagccccccagctcatcaaagatcacattttgagcactgctatataaacaaagttggcaggagtcgtagattagcaggccgcccgtctatttttttgttcatgttttgaaagtgaaggaggatttgggtgggcaacgtctacctctgccaaaaataatcggcgtccatatgcaggcgtcgtatctttggaataagtgaatagcaggtgcaaaataatcgacgttgccttcatttcattccatttgcgtgattaatgcatgcgtatccagcctgatttgcgtttcccgcattaatatcttattccgcgtcgggggttccccccttcaatttttactatttaaattatacagatacatatccagccggcgcagccaggaggcgactgaccgaattgtattgtttgttcgatcgaagcaggcag

SEQ ID NO: 5494 - DNA, 294 bp, Zea mays
gatctgcccggtttcctgcagcgaaacctggatcagtttacaggtcagatcaaaaccgccgccgggtttggccggggcgatacattcggttcgctcgggtgctgcggcctgagccgccgcgagggaaaaagccagcagggttgtggcaaaggcggtgcgcattgtttttttcatctgtcgctccattgtttcttccagagtgtgattgccaccgaacattcggggttgctgaattgttaaaacagcaacctttcatttacctttcagccatcggcaaaactaacaggatgtgat

SEQ ID NO: 5495 - DNA, 527 bp, Zea mays
ggtaagtgtcaacctattgtcttcacttcagaataacaaagtcaatagtcttttgtttgtttgttgaaactcatgtctgtcccatcagttttcaattttgtccttgaaggagaaccattggggtcattttcagtacattgaaaaatatcgttccactattttttttgtcttttctgaacctgataattcaggaggcgactagaaaccagcactacttgccattacaactttatttaagtgggaaaactgtgatgtaaaagaagacatcaagtacaggatgaagcatctatgtaaatggttgaataattgtccaaaaacatgaatatttcataaaattagactttcttgccttttacattagtcatggtgagactattattggctcctgtaccatgggtttgaaaatgacatggttagtatatagttcggattttgtatgactaactggaaatgtatcatggcttaagtgtcgcactgtcaccatagtagaatgtaccgtgcctgctattggtttcttgtcatttttc

SEQ ID NO: 5496 - DNA, 1500 bp, Zea mays
cagaagcgcaagactccaaagccgtcgccttcctatccatcccttcctcgccgcgggggtcgcctgaggtatgctacctaccaaaaccctcacggatccctggcatttcgatcgcctcactctgtaccccggacgagttgcagttggatctcagatcggtggtgcggttccacttctaatttgtttcccccctttccgcttctgttagcttccgattgatcgttgagtcagatcttacatcctatatatgagcccatctgggcgtcacaagtagtgggactcgatttgcttcgttccatcggattaagcactttgagagcgctagatacgtgtcatgttagttcctttgtttagtcttgttgcttgttctgggatgaatggtcgtgtgtatatctttgtgctactcgtggtggactggtagtgtctcctgttgctacgtagactgttgtggaagtgtcagctatattattttttcggttttctgttgtttttagctttgatgaaccggatcaccattaaaccttcagcttcaccctgaccaagaatacctgatgaaagaatgatatttcaaaggccgtaccgtactggtatcgctatttgtgccaagaaaaagcgtgactgaatcatgcggtttaacttctagaagttcagatgtcatagaatcatgatttcttcctgttgagattagctatttggagcacgtttgatcagctaagtttaggtatccatatcatgttatggtttgtcaggggatgtgtaggatgactactagcaaggtggccagtagaaatcacttctaccttcatgattaaaattttgaagttctgtttcgagaatctaagttgtgtgtattatgtgttcccaattgtgtggtgtgattctcctagactcaattcttcatgtgtgaaaggtcatacagtttttggttatcttgaatgagtgtacatgcctggtctctattacgtggagaaccagaaacagtcacttgcaacatagtgagtgtcatatttcctcttgattcacttttgatatcttgacgatgtcacaaatgaaggcatagctcatgtattttgctcaaaatgttccatcttccacttacgatgagattatgtagatgctatatatctaggggttaacatctactcccttcattccaaattataacacattccaactttcttggagagtcaaggcatatcaagcttgattaaaattatagagtattacaaagatttgtgacattaaataggtatactatgaaaatatacttcatgaataatctaatgatacttatttggtcacataaatgttattttttattataaaaatttggtcaaacttgagatgctttgactctccaataaagttggaatgacttataatttgaggaggtactaaaatgtactgacatatcttactgctcgcttttagtttgtgctacttttacccatactgaaatggccctgttacttgtggacttgtttgcagatcacataaaca

SEQ ID NO: 5497 - DNA, 157 bp, Zea mays
gcttgcatgcctgcagtcctctgcgcttctacgcatccgcccatcaattagctgacgacaaggaatcccaccccactcccgagagcagcgaggaaggcgtgtgctttctctagtctgtgcagtgcaagcgccggtgcccgccgccgccggcgcggcc

SEQ ID NO: 5498 - DNA, 505 bp, Zea mays
agagaaatgtcaagttttgacgatagcaatgtagaaactataggtatatcaacacatatatactagaaggtggatagagtcctcatattagtttccgtcctaatgtccatgtcgacgttgtcgtcacgcggccatcatcaaagacacgcggcgcatcctttttgttgtgaaatacttccgttttttatagtttagttaaaaataaattaacaaacgataaatgttaaaaacggaggtagtatattgttattggtaagattttttcggcgatagtcgtacgtagatattactgctcgatcaatcactatccgtagcttagcagccagagctcaaccaatcatgcggtccgtagcgtagcagccagcaaaattaaaaaaaaaatcctcagacgttttattatttattactcgtgccgtggagcttgtccggcgtccgcctctacaagaacgagaccacgtcgcatagtaatgcgcacgtgccacagagctcagctcagtagctcacc

SEQ ID NO: 5499 - DNA, 311 bp, Zea mays
ggtaataaacaccaccaagttctccagtatggagtatattcgctggctgaagtcagctttgtaaactatccttcaggaaatttgatggacccagtgtatgaaactcattttgtcccactcttgcaggagatcaggcctaaccttgagaatgcccagattttccagccccctaacgcagccgacaatgtctccaagtacctgtcctcccacactctttgcctgtaccagtatgctgtcgttctgcttgcttattctaaaagcgttattctgtccatctctgtaggctggagactgatccatctgctgaagct

SEQ ID NO: 5500 - DNA, 376 bp, Zea mays
gcttgacctcgcagtccagggaggcggggggcacgcagtcacgcacgaacgtatcaagggacgaaacgaaacgaaactactagcctccctctcccagtttctccccctccctatctctctgtccctgcttgcattgctcgtgttgacgcgcctgcaagtacgagacagcgagcgggaggaagaagaaacaaaaaggccggcccccgatgctagctcgccgcaagagcactaccaccacgccaatccattgaggcggcttcgttagcgtagcggcggccggcggtggaagctaagtgtaaagcggccgcctgctcggggggataaaagctacaacgggcagcggcaggaggaggcgtcgtctcgaggactgcgcgca

SEQ ID NO: 5501 - DNA, 854 bp, Zea mays
ctttgcctagtgtcaaaaaacacccaataaaaaactctttaccgagtgttaaaaaaagcacactgccagaaagtttttgtcttgtgtcaaaaaaagcactcaataaataagttctttacctagtgtccaaacaagcactcgataaaaaagatctttgccaagtgtaaacaaacaaatggcaaataagttttggcgagtgtttttttgacactcggaaaatatctcctttaccaagtggcttatatcggcaaagaattgcaaaaacaagtccagattgtaaactatatattcctacacaaaaagaagattaaaggcttatatcgaaaacaataatttagaagcaggacatgaaaatcggcatgactggttccaaaaacaggtctggaaagttttcatggactaagtttaatgtggctggcgggtgtagcagggaaacctgttcttccttcgctcgtgctttgaattttgttgcatccattttttttaatattatctcgtttcagaattttattgtttcagttgaatttgcatgttgtatttattcgcaaagtttggcctagccagcagtacccccacggccagcagggcccttataaataaccgttccggttgcctagaaacttaccaagacatcgcaaactcaaaagatggagcacaacacaacaccctagaacagtagtgtgatatgtagctcaataggttggttggttgtgtatcacaagagcaggggtagagacacagagagctaaaagaacattattggacgcgagggagcagagtagaactgtagaagggagtggtgtacgtgcgctagactgccagtggcagctgctgcaagctagctaaggtgaagg

SEQ ID NO: 5502 - DNA, 431 bp, Zea mays
gattctgtatcctatttattcgcaattaaaaaaaacgactaaaaaactgttaccgaataaaataccatttccaaccattttcatccgcttgtgtactcgtctctattgcttcggtcccgatcacatcatgttcctgctgtcctgcacgtgcacggcacttggagaccacggctcaccgcaacgctactccgccccggaagcatcgtgctgggggtagcgtggtacggccagccaacccgggcccccgggcccaggacgcgcccgtataaaacccaccccaacggaaaagccccattgttcagcaacaacaacaacacaaatcatcggttccgttccgtcgcagaaatagaaaaaaggctttcttgtcccacagggcagggagaccgagagagcagtctagtgattagttgatcaccagacgtccagacacc

SEQ ID NO: 5503 - DNA, 636 bp, Zea mays
gattctgtatcctatttattcgcaattaaaaaaaacgactaaaaaactgttaccgaataaaataccatttccaaccattttcatccgcttgtgtactcgtctctattgcttcggtcccgatcacatcatgttcctgctgtcctgcacgtgcacggcacttggagaccacggctcaccgcaacgctactccgccccggaagcatcgtgctgggggtagcgtggtacggccagccaacccgggcccccgggcccaggacgcgcccgtataaaacccaccccaacggaaaagccccattgttcagcaacaacaacaacacaaatcatcggttccgttccgtcgcagaaatagaaaaaaggctttcttgtcccacagggcagggagaccgagagagcagtctagtgattagttgatcaccagacgtccagacaccatgagctcccgcatggctggagcagcgcttctgcgccacctaggcccgcgcctgttcgcggccgggcctgcggtgtccgggctcaccgcgaggggcggcatgcccgcggccgcgaggcttctccccgcgcggatggccagcaccgccgcggaggctgccagagaggacgccggtgcaaataaacggcacggcggcaccgagaagc

SEQ ID NO: 5504 - DNA, 258 bp, Zea mays
gctgatcttagattagaaaatgaaaatttgattgctaagactaaagattttgatgtttgcaataccactatttccgaccttagaagtaaaaatgaaatattgcatgctaaggttgtagaactaaaatcttgcaaaccatctacatctaccattaagcatgtcactatttgcactagatgtaaagatgttgatattaatgctattcatgatcacatgtaacacccggttttaaggaacaaagccgggtgcatctcatac

SEQ ID NO: 5505 - DNA, 127 bp, Zea mays
ggtaaggctttgtgtttttatcattgtctacttactatatgttcaactaaatttgcaccttatttatggcatctttctcatgcagtcgctgtgaaaaagttactacttctggtgtgtctgagattgt

SEQ ID NO: 5506 - DNA, 567 bp, Zea mays
tgcttgggtcttggcttattgcataagttccttgaaaacttaaaccaaagcaagcattttgttttgcaatttatcatcttcctcgaaatgactaatgtgtagaattatattttcttaaactgagtctatatgaaatggcttcataaagctacacctatgattgatcaccggagcaattaaattgcaagaaggtgaaaattgtataagaatatgggttgaaatttcagtgccataaatccaaaaacaacaccgaatgcacaatgtatccgaaactctcgaccacaaaataaattcctattaggaatgcaggagcttttataggaaataatttcatacaatataacaaactaaatcagttttccaaatgaattcttaagttttgaagtttttttttggtattttggtcaattagtagtttagtacctcgtgtgcaacctgacaagctgccacacaccgtgagatgtgactcctgctggctatcttgtttttcctcaggttcggaaacattgctgacgttcacctgtaccacagtagttcagtcgagtagctgtcggactcggaacacac

SEQ ID NO: 5507 - DNA, 1500 bp, Zea mays
tcaatgcaggttatagatacttctcgcacataccatgtttgttcgtcgatatagaattttaaatataatatatgtctatatatatgataaacataattttgtcattttgaccatgttctaatatgataatatgtagactaacataacttatatactttatatttaaccacaaaacctcaaaagaacctaaagctctagggccatactaaagtcgcatcaattggtcataaagaatatcctaaatttagctaaatttaggagtatgccctcctcaattgaatagtaagtgatgacccatgcaatttacttgtcattaaaccaacctttaggtctagtttgggtactctattaataaaarggattaragtggattcagatgtattgtgggagtttttgatctattagggatttatacactcttcgatccttcaaaaccacttcaatactagagtacccaaactagcccttaaggtgttgttttccccttaatttttttatactctaaactatgaattaaaaagaaaaccaatatcaatatgtacacaccatttcagactataacaaatatatgtgaaaaatatattttaaaaggtattagaaatatagtgcattgtgtagagggatgaatttagagggaagctgcgggagctttaggaggactgaatttgagaggatgatataaaatttagagaccgacatagagaaatcgttgcggatagtagttcctaactatctgtcgcgtctttttcaaaaagaaaaaaaaactcccaacgacagcgagaagtgaaccacgcgctcggaccagccagacggccagaccaatctggccgaaccgtaccatgggtgctgtgtggatctgttcatgacataaacccccctacacccactaacctctgcaccattgttatgccgtggacatagggacaaaaccggaattctgcgagtccgagggggactcgactcgactcgacacgagggttttcctctccgtcttctctctcttgcccctccccgcgattctattctacgccgctataatcagtcgtgcggcgtcgtcggcgaccttgccgcctgcggcgcggaccacgcggttattatacagctaaccggggctttgagctacagccttctcttgtggggaggcatccccgtcctctacttcgtcgctgccctctgctgcgcctggactggcgtggagtggagatccatccacccgcacttgccacgatctcttccttctcgtgtcggtaaccgcccctcgaggttgcttggacggattgcactagggactggctttctcgcaacctaatctaaatcttcttctctcaccattcagagttggttgcggatttgcttactttggtgcgccgcccggcaatccaaacaatcctgcttgggttcgattcgcttcgccttcgtcttcagcgctcaagatcagtttagccgaggtgccgggcgcggtttggctgtccggaggcttttagagttactggaaccccg

SEQ ID NO: 5508 - DNA, 977 bp, Zea mays
tagctatcatcatcattaccgagcaggcttaggtcctaaatacactagagataatagttaactgaccaaaaaattactagtaaaattagataactaactagctaactattagctaattttagttaggttgaaacaacttataactaataaatagttgagggtgtataatagttagttggactattagttagatgtgttttgatatctctaattaaaagtagctaatagctaaactattagttaagttgtttgaatatctctgggtaatcttagcagctaactattagctctaatatattgcactttaatatctctgaataattttagtagctaactattagttataatagtgcattggactttaatattctcggtgtccgcgtcgtcagacgccatcaacgagatgagtcaggcaccatcgagacgaagtatatagagagaagtatgaatcatccaaagccagcgaataaattttgttgrtttggacgagtagcgatagtacgtgttcgcgaaacaacacaccaaaccaaaccatgacatgctgccgcggacaggaaaggcaccagtgccatggccacgtttcttatcttggtgcgccctggcgctggcgctgccgaccctcagcagatccatttattatatattcaacgaaacattcagcaataccatgatcatacggacagctacgaggatgtattatacacacaaaaaaagtttcattcaattctcggagaagaattctcatatcatttcccgtcaaatttcagaaggttcctctcatgtcagagaaaggaaaaccacacaccggccaaaccacgactgcaggaggcgggtagtagcaagagaaaggaaacgctctcccagccccaaagaaaaaggcagcacaccaactcaccaagaaagtgtggaactgctcctgcctgcagcctcctgctcatcgaccctttcgccccacaagctcgattcctcgctcggcc

SEQ ID NO: 5509 - DNA, 805 bp, Zea mays
gcgatccgaacaccacaacaagaagaagcaccatggatggaagccggcgcggtcgggggaccagggcgcggctgccatggattggtcacggcagccatggctggaagttttgtggacgagattcgcgacggatttggtagaccgacgagattcgcggccagcgcgtggagaaaagcagaactgtgcaccaattttcagtgtggacgcctacgttaggtacataaatagtagtagagatttatgacactggtttctatatactaagtaatgatgtgtgaaatttgatcgtgacactatataaaatatctctaaaattatacttaaattcggttgtgacacaactctaaaccgtgtggaccctccatccttcccctgcacaagtcccgcaatatcttagattttcgtaagattaccaaaaatccaggttcgctgaaaaaatcttgagaaaaaaagctgttgcaaacatgagacgatgcaatattcgattttgcagagtgtgactttttattgaagcgtcgatcgtacgttttccgattcatcgttggtcgttgcgataaaggcggcgtacgaacgcggaacgcgggagaggcggcgcggccatgagttggagccggaccggctcctctgaaaccggccgcatatctaggctcgcatgtgttgccgttggagatcgcggtcgcgacgagttcgggtcgggtacggacacatcgttattgattgcattacggggttgcaaggatcgctatatatataggttgcatttgggcgtgaggagaagaagatcgtggtctcgtggatatcagca

SEQ ID NO: 5510 - DNA, 1500 bp, Zea mays
tccggttaccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaaggtaactgtgccgccgccgccgcatccccctagcgttctagccgtggaatgatttctctccttttccttttttcgtgcttgctttcttggggatctctccccctccagattattctctacattggcgactggggggcggtgattttgttagacatgtttcttcctcggtatcgaccgcagcccttgtcctgcgccgactaaatgttaggcttctgtttaccgtgcgttggccacggcttggaaccacccttggtatctccatggtggccgcgtcgatgtgaacgaacaaatctggcgtgcgttgtttgtcctgtcgaatcccgttgaagtttccaggtgttcaagccaaacacgcattataatgtatttttttcttgcggcttattattggtgactggtcaccgttgggaaatttcgacctgcgcagaatacatggatggtaagataacgtttaattgtctttggtgggcagattggatgattgtgacgtgtttgattatcactagtcgctggataaaagcatactacgggtctgtgtatggaattgtcgcccaaatgaatcattagcagcatgccagcatgttgtggttttcgtcggctgtgctgcggccaacttgcagcattggatttattggctttcgctggcatctagatgtagccctccccagatgatttattaaccccccacgttctcttgcgtctccacttgtctttacaaatcgactatatgtactgcgcctctattcccgtaagaccaagaaagacctgaacctgatacaccttgcctctccccactaagcttgtttaccacgcttgtaggtatttgttcttcttttcatcttgctagttcatactgcaactggctgtgctagtttgttattgttcttttggtgtctatctattttgtgcaattcattataagaaaagtgtgatttctttgggctgtaccatgatgatgtcgagaattcagtaggtttaaggacatggctatctttatctatcagaaattgttgctgagttcatgtcacatactgacatgtgtctttgagcatgattgtttgtgatactgtacccttgtgttctatgttgcaattggtccaaccttcattacggacaagttagccaatccatgctatctacttatctagcatacatttatctttactcgtttattaattttattccatttatgcgacctatttttaataatacatccagtgatattaattggagagatcacatcaactgtgagcctaagtcaagattctgcaaatatgtggagattctatcatttgttctttagcatatgacctgacaaattttttattcctttgtagataagac

SEQ ID NO: 5511 - DNA, 119 bp, Zea mays
aatgttcataagcagtgctcagcggcagcactgaagcaggccagctggttcagctgtaatactacaaatttgagcaagttgcagagcagaactgaggttggttaactaggaacgcagcc

SEQ ID NO: 5512 - DNA, 401 bp, Zea mays
acttgaaagcacattagtcatagcatataaaagagatatgatcaaaggtatatagaagagcaatgtgtgcaatctagcaaaagaaattgcgcgaatcaagaatattgagctcatgcctaagtttgttaaaggattgttcatcaagaggcttggtaaagatatcggctaattgatctttagtattaatgtatgaaatcttgatatctcccttttgttggtgatccctaagaaaatgatatcgaatggctatgtgcttagtgcggctatgctcgacgggattgtcggccatcttgattgcactctcattatcacatagcaaaaggactttggttaatttgtaaccatagtcccgcagggtttgcctcatccaaagcaattgcgcgcaacaatggcctgcggca

SEQ ID NO: 5513 - DNA, 583 bp, Zea mays
gattagtttttcataagtccaaacataatttttttattgaaaaggagctaaaataaaaaaacgcgatggacaggataggatcgaaacgtgtaatctcgatgctataattcttaggctgatttacaggatttaaagatagattagtttttcagaagtccaaacataattattttatgaaaagagctaaacgcgaaggataggatgcaattgttctactagttctcatcatgctcctacggcccgacccacgtcaccggccgctaactctcttcccattctgaggcccggtccacactccatcctcaaacggccgccgccaaagtgggcgtggcccaacgagagcgcggattaaccgctgcccgctgcgtaaatcgcaagcagagaacacacggtgacacggaggcagtccgcttgaaagctaagctaaactgctctagcacgcatataaacccttgacaaatcaagagtggagaaaaaaaaacacgaacccactagccctctctgcttcctctccgtttctcctccactcaccagtcaccactcctgattgctgtcgagtctcgatctgccagcgcgcggcgcg

SEQ ID NO: 5514 - DNA, 175 bp, Zea mays
agcgaaagcgtgacaagtgcgtgcgtgtgagtgtgactttgtgttgctgttgcgtacaggcgagaggagaagtaacagggattcttcggtaaattcaaatgcataaacagtattatttcattcattggttttttttttttgcatgtagttacgtgactaatgactgggtgaatgg

SEQ ID NO: 5515 - DNA, 894 bp, Zea mays
acgaatcgtcactggtgacgtcacgaaactcccgcggggttccgcgccgccgagctgtccaccaacggcagcattctcccgccgggtcgtacatcagatatttcccgccagacaagtgcacctgctctcttcccagatcccgtccccgtcgaagtcgaaccatggcgaagctgctgctgctccgtggcttttgttctctccttcccctacggccctaccctcccgagcaacgaccattgcgaccccttctcttcgtccttgtcccctctccgaaagcgaccacaccgcatgacctccctccctgcgccgctgcgcgcgtaggtactacgacctcgtcccgagtgcctttgccaactgccatcacgtcgagaaacaaaaagagcttctcgcggcaaagatcacgagtcggcgccgtgccgtgcctgtgcggggtcaccgagtcatcggtcacgtacacccgatggccgatgcggtgacaaggtaaccgacgagatgacgggacacctgcccagtccagcgcaaagcttcgcgccttcgcggggagtcgccgagcagacaagtagcagcacacggtagacggtacaggcacagggggcggggcgagcctctggctctccgctctcgttcttccgtccttcgtcgacgtcgtgcgttgcgcctccctttcaggctgtccctttcagcatttacggcgctcacgtttctcgctccagtccagtctccaccttcttatcccccaagcaaagccggtcggggcaaacggaagcgaaacagggcccgtctcttccaccactccgcagaggcgcagactaccgtctcatcctactactctagcccagtctcacgatccagcactcagtcactagcgcttgtcgtcgccagtacaacaacggc

SEQ ID NO: 5516 - DNA, 921 bp, Zea mays
aggacgtggccggcggtgctgcagaggagccgagagggagagggagagggagaggaaatgcaggttgcaggtagacctaagtgtgctcctcgggtcggcggtggtgcagagaagccgtgagccgttacccacacgctcgctcgcgcttctgctggttcgcctcccgtcctatcccgacagccctcgaagacggtgttgccgccgtggcttccccagtcggccactcccaattccccaacgccgacggcccgggctccggcttccttcccagttccctccccgaccagcgatgcgggttgtatgggccgggctgcctctgtagagtaaatgagtaattgtgtttctgtcgtcatcatcccgttcctctaataaacaggccgaaactttctattctcaatgctggatgcaaagcgagcaggccgagccggcggcccgcgaacgtgtcgtttcactccacggtctcgggccctcggccagacccagactttttacagacaccacgcgcccaaaaacacgagtgagtactacactactacagacgccctaccgcatcgacgcatgcatggtgcatgtcatgcacgaacgggtctagaatagacagaagaggggggtggaggcagcagccagatcggcggtggctgggcgaacggacgcgcgggcaagacggccagacgggtgttgcatttgccgttgtgggcaaaccaccgcgccacggacagcgcgcggaccgctccttccaatgggcgacaggccccatataagccgcggcgtcccggctccctgtccccactcgatcgtcgtgcacgcccccgccaccggccggatcgacagcaccgatcaccctgaccgtctgcgcgcggcggctctcacaccgaacacacgcagggcgcgcataggcgagggcgagggcccccgcgaggg

SEQ ID NO: 5517 - DNA, 557 bp, Zea mays
ctcttagagcaatatcgatcccatcgctggtcgtacatcatgcaagcggaggggggcagcaaattttcgggctgatgtcgtagcaattgttttttttgccggtgtgtgtcccaaggaagcaaggaatcaatcaacccattggtaataatcttcttcttttttccctgccggaccaaggtcgtacactaattagaatttttatttggttccattagtctctagaccacaaaacaagcgttgcacccatgacacagggtatcgttcttttctctgccttgcaactacaagattggcatcatttgcagctagcagtggcaaatcccttcagcataaagcaacgccagaggaaccgctttattcttctgattcatggaccaagcaaaggtaacctcttgtcagttgtctcccactgcagtaccctctccaatctataaatttcttcacaatatcttctgcacctctcacacaagacatccttacattttcttgctgatcacagctagtagggagcgagagttaccttgaaatcaaggcagtacgtacgagtacgatcgaca

SEQ ID NO: 5518 - DNA, 1386 bp, Zea mays
ggtggctgataaataaattatacctttgatacatgcgatgttccttttgcatgggctttacgactgcagatttgaacaacatgcatcccattctggtttttgcaggtgtgcagaggcacggcagtcatgctggtctcaccgactgatgggactgatgagatcgccaaccctttcctcgcggacggagcataacttgcacccctcggaacaatatgtccctgtgggaaaagaaccggtttctcgtgtatctgttgtatcgtgtgcagctgtgcggcttattagtggtgtttaaatgcactagatctaatagttagtgactaaaattagttggagacatccaaacatcctagctatgagttcaattattagctatttttagtaaattagttaataattagctatctatttgttagctagctaaatccactagtatttttttagccaactaactattaactatagtacatttaaacaccccttagaatttagggacaaaatcagatctcacgttagggttgtttgatagatatatttagcccgtaagtttaaggggctgtttgaattcaaagttttttaatactatggtattttgggtgtttggtttctaaggactaatttttagtcgctctattttattttattttagtctctaaattgctaaatacaaaactaaaattttattttagttttgtatttggtaatttagaaactaaaaattagtcagtagaaactaaacacctattaagtagattttcaattccttctaaatgaaaggatacaaacaacatcttacgttttttctcaacttcactaaaacataacaatttttggaactagcacttatttagtctagcatttttttgttaccaaactcacaaaagacacgcatatgctaatgtttattgcaagaccaaaaacaacagttagcaccatacgccattgtagaattgaccaagcagaacttatcagttctttgcagcataagctgtacgaacacatactttacacgttttggtcacaaactttcgctcgaaacaaaataatgaaagaaagcctataatcaaaatgatcagcttctgcatagagttaaaatgatcagcttctattaatgactcaaaataacctgattggagtttggagatgctcttacgttcgatgaagttgttggtcataggccgggccaacaaatcacacggcccacaggcctatttccgcccgtttctcttctagggttaggtcaagacctccccgacctcgagcctcccagtattaatagaggccatgcggccgccgccgtccgcatcaccatcaccacctatcgtcggagaaccacagaatccaccgcatcgcagagacgagtagaggttagatttaggctgaggtaag

SEQ ID NO: 5519 - DNA, 184 bp, Zea mays
ttgatgtagggtaagccttttcctttcaagctctagatgttatgctctctactaacatattgctagtcaccaccgcgttttcggtgtgattatactgtgattttgtttgacagatcaaactagtagtttcgttgtagaatgtgtagtatgtaaatgtgcctctcctcacctttgtttcttgaga

SEQ ID NO: 5520 - DNA, 428 bp, Zea mays
ctgccatcaccttcaccgcgagccacgcaagcatcccgccagctagctccgacggtggcgaggtagagagaggtgggagaggaggtggcggcggctagggttggcgccgcctgagtcgcccgagctgggcgacgcgggggcctatcttatccttctttttctatatctcattttggtcttctgaaacaccacgatgaatgtgatgtatagtcgtgtgcatgtatcacagaaaaatgctctgtctccctctgaagtctgaactctacaactccaaatccccatggggccattcctacctacatacaacacaaactcgtcacgccgtcttcaagctcaggcagcggtacatccacgggccctgcgccacctcgtccatcctcctagtaacctcgccgtgaaacctggccaccggcgtcgccacgacgtcg

SEQ ID NO: 5521 - DNA, 562 bp, Zea mays
ttgtcatagacaccaaaaaatatacctatatgctactcagtggcacacaagggatgagtataaaatctgatggcataccaggaattttctccattatcttaggcctacgcactacatggaagcatctttggcacagtgagtaagatacacgaggtgattggccggaggagcttggatttgtccggcatgcccgaagaccccacacatgagctgagatagaagcaagctctcatcacaagggacctgtccaggttggagaatctcctctctctctcctcagctcccccctgcctcgctagcgatataacaacccatgtcagcctgcttgccagctcccaccagagatcagagcctcttggctaagctagagtgggagggagggagggagagctcgccgtttccgacacatcggcagcgccggagatcytgaaaagaggtgagcatagggctcctctgttcttgcctaggttttccttgaaacaattgtcggaaaatcgtccaatctgcagtgccagcagagtacctgatcctcgaactttctcgtggaacagaaagtttgcag

SEQ ID NO: 5522 - DNA, 157 bp, Zea mays
tggtcctggaaaccttgtagcaatcacaggcgtatgcaaatgttgaactatttccctgcatttgagccggaatcrtacgatgatgcatcttgtgaacatgcggcactaataaatcgagacgaagaataatgtgttttccatcagtgattatgagcag

SEQ ID NO: 5523 - DNA, 708 bp, Zea mays
agctctaaattggtttactctaacatcactggaaaattatccgtatgtacatagtgtgaccaaaaagatttagctcacactatacaggtacccaacatatttagctcacagtctaaatgtaccaaaaagactacagttaaatttaagcggactagcaagaataatctggtacttcatttttccggttctcatattcaccccaaatatgacttggttttttaatgtacacagtgtgaccaagcatactacatttcataactttttagtgaaatttagcttacactatagaggtaccaaaaaggctacgtgtatggtcattatagtgaatcagtgtttgtgtaataaatatgtttaaagtgaatagcatcgactgctataattttacttttcaatatgggctcttaccagttgcttacatatgtgtgtatgcaccaaaacaactagatatttgacaagaggttcaagtgtggccatcagtgagatcgctagcgctaatcattcccagacggttaaatctgcaccatctaaaaactgttcagttcgctaatcagtgtttctgaaaactgttcagttcggttcttttcagatagtggttgactggtaaatcagttgcagaaaaaagctgaagattacagaaatagtttgcaacaagaagcacaagcaaaagctcaagcattacactttgaagatgaattagctagaaaaaga

SEQ ID NO: 5524 - DNA, 306 bp, Zea mays
gagtatagtgattctgttaggagttgttacacttatatattcattttttgtataaggggagctacaatgtacagttcatactatatcattgatctcctaagggcaaaactatctggtccagtttttttaagaccacaactattagattttggaagagagtaaaaataaaagaatgagggtattgaagtaaaagaaaacaaatagtacataccattcatctttttatccatttttttgtttccatgtgtaaactgttgatgctaccatcttagatcttccaactgcagtcttgtttttcaggacaaa

SEQ ID NO: 5525 - DNA, 1395 bp, Zea mays
atttatacaataacacaactgtgcaaatagatttgaaaacaaatatttgctagtataaattttgactacgttggttgctgtgattggccgcgcggacacacaaatcgatcagaattctttttgtagtgataacattttagttttatgcggtgcataggacccacaaaaaaatcaaattaactaccacatcatatccaccttctctcatctttatatatatatatatatatatatatatatatatatatatatggttggcaagagctaattaaatatgtgcaaagccagccagactgcctgtggttgcattggatgatatgccacccgctgtagcacgaatgcatgcatgatggagcttctctaaccagcagagtttctggccgggggctgagcaggtatggagctaggatagtagtaacgtgcagtgctccagtgcttttcgaaagctgtacgtgtcatcgatctgttggcgcgcgcacacacacgtacgtacgtagaaatgcatgacaagctagccaacagtcttggcaactccattggccaccacgaggttctcggttgttgtgcctaggcagtacatagagttctcactactctgacaatcaaccttacaaatattttagaaaatcaggaaaaagtaggcaatgtgctcaaaccttgaatcaacaattaatgtattttagtttgaatgcacccgcttttaacttggatctgctgctgttgtttcggccaggataaggaccgacaaaagtgattaattccctgttgccgggcccacacactaatccccataggtatttattcttgtgggtatttgaagaggctaatgagagttatttaatccccatcggctggctgacttcttggccggacgatggaaattaacttaagtcggcttcgccactaaaaaatagcactgacggttgataacggaatctgtctataaaaaaatgcaccccactgtgcaggttttggtgtaaagcaatccccgtgcatcgtcgtcatcaacacactcgggaaaactatatatagaatccatatatgagaggggaaagaacccgtgcagaaatctttttaatttactgaatctttctgggaaactttttctttactaaatcgttttgggggaacattttcctttactaaactactaggaggctgacatgaagggcccttcttccctgatccattcttcttgccccgcgccggcccctggggtggtcgatctcgtcgtgggcacatggctggctcgatcgggcagggcagggcgggcctatatatgggatgctgtcgctgttggctagcgaagacgtgcacaaaggtaagtgtgtaaggttaggagccagtgtaccatcacatcagatcagatcgatagctcgccggagcttatagggg

SEQ ID NO: 5526 - DNA, 236 bp, Zea mays
catcaatagtgctgatcgtgatgatgataagtcaccggggatgccgtagcaggcacactgtaagatattccatgaaaaactttccattaggatgaacctgattgcattttaatcttgcagtaaaagaaactccacgaagctctcatgtgttttctaattttaatgcggcttctgtgtagttattcatttattattatttgtaaccgctcaggggttatgtcgctccagaaaaactt

SEQ ID NO: 5527 - DNA, 1500 bp, Zea mays
caaattaaagattcaacccgacgcgaggccactgtagagtgtagagtcgagcaggctcggcgcgttccgcaagcaaattcatgccaactgccaactcgaatccagccgccccgagacctcagacctggaacacgaaaaagcccaacaaagcaaggcacccacgcgcgctgcgcgcgcagacagatacagagcgagcacggcacgccatgtcggaatccccgcgcgtagccggtgcactgggcggacccagtcctggagcaccatgcctaccaacgggccaaccagaccagacgctagtgctggcgccagctggtgcacgagcgccgagcccactgttgctggcgcgagcaaaccctaggcgcgggcgccgaccgtctcctctctctctcctactataaccacctctccacccactagaaccccccctctcgtcgagagagtcgtccccccgcgtgctctccgcctgcggcctctgtatcccgaacaaattaattggaactagacgatggaagtgaggcaaaatttaatcggaccgagataattagagccaataatgagtattcataattaatctgtttctgtgttcagactatgaattaaatttatcgggtttcgaatcaaatcaaattaagcatcgtctataatatcgaagctgatcttgtttggttcagttcgtgtgtttctcttctcgatccaaatcttcaaatacaaatatgggtaagaatccatttgacttcatagtattcaccaaatcaaatcttgtctaaatattttcgttgatcttaggttggtgcgaaccatttctatatcttttaaacctaatttctgtaactttatttgtgtacgcatatttgtttagagaagagagaaagaaaatatgagtttttctttatcctctacgtgtcctctccctctattcttattctgacgtgtggaggcatcgtgtccttcttatcctctcaccggtgcccacgaattcatctccagaaggtgccggccgtgcactgtctgctacctccacgtccgagcttgtcctccatcttgcccaagcgccatcggttctctatacggcttcaaccccactgtcggtctccagttcgccatgccgcccctccccatagcgctcggtcctcacctcgccggccctggctgctggtcgccgtcggccgtgagctctccaacgcaggccgactctctattcctctttctgcccaagctctccactcgacgcctgggtagccatggcgtctcccccaaccatggcgctctctgctcctccaagccggcgagccctcctctctggttcatcgcagggaactccctccatggctggcgcccctgtgctcgcgcccttgatccccatgcccgagctcttctccatcgtctttagctcgccatggtacaacgccactgtcaaatccggtctccagctcaccagcaacttcccccttccttgcccttgcacacctctggtgcagcccctccctggtgctcgacgaa

SEQ ID NO: 5528 - DNA, 127 bp, Zea mays
ggtgaggtcctgttctcgccctgtcgttttagcgctcgatgtcgattactaatgtgtgaatttgtgtgttgatgagagagttaaccggtaaagaagcgaggtccgtgagacgtttgccaagtgttcg

SEQ ID NO: 5529 - DNA, 1500 bp, Zea mays
taacgggctagctcggtatggttggacccatcccgtgccgaactcgttcagataattgagcctgtcgagcagcccggcttggcctagatagttattcgggcctaactgtgttgtgcttaaacgggctgtactttaacgggtttgggccatgatgtgccgggtcgggcgacccgtttggatatctctactacaaacaaccaaatagcgcttggtgctccagacacgtgaacgttatgaaagttgtcttttataagggttagtttggtaaccctaattttctaagggatttttattttcccaagggaaattagttcattttctcatggaaaaatagaaatcccttgaaaaattagggttcttaaactagcccttaatttgtctataaacttctctaaaaaaagagaactgattgtgaaacgactcacgcggccgacccctggagcgcgccacccgtcggctgcgcaggtgcggatccccaatccaacgcccgcgagcgcgcggtgccgagcctcggctcccgccctggcgctctcaacccctgccctgaattctgaacgcgagcgcgcgcagcgctggggcgctccgcgctcccggtctcggactctaggctcgctccagtttccgcctggctccaccaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggttcgcactccaaagtccaaaccctgcttcccctccctaccgtcccgcaccgcaccgcctcactcgcgctttcctttctggctgccgagtccgcagtccacgcgcgtgaggagcgaggatcctgctaggtttcccttgttttggcacgcttggaaggctataacgtttgatttgtccccgatagccgccggatttgtcggtgctcgcgcccccctcccttcccctggttagattgtagtcgcggcgtctctgcgcaagagttatggatccgtgtcttctcccgctctaaattttagcctttaggcataagggtactcatttcgttacggtgctatgaccttgatttaacaacatggacttcgcattttgatctgtgagcgagattgggagaattacgtcatatagaaccttggattttctatttgttcgtttgtggcatgcattgtctgcttcaaaagggcttggatttgccccaaaatttcaattagcacgctgcgcatgtacttgtttccctcctgtattggacggatccagctgtttttctatgggcaaaacctagctatttgtttagcctacagccctatactatccatcttggaatttcacttctgccgttacttcaactgctctcattgttagcttattaggtcttgtctgtggattgaccaggcatttgaggccaggattttttggtgctctcattgttagctgactggtgagggtctggatctagca

SEQ ID NO: 5530 - DNA, 1500 bp, Zea mays
gtcctaaaatagagtcctacaatttaaaacaaggactcaatttaaatagttcaaaggcctaacaatatctagtactccaacaaaagacactataatcactattacggttgaactaccaccttattcccatttccctccgtattgcgagagctacttgatcagtacttgtggacctctcccttaatgtatataccactttacttattcagtagtgatttactaattctaatggagaagacgttatacatcgtatgatagacaattttgtagtgtagtcaagtagtccaatgaatgctaactattgactgctatttcaagtttgttggttgtgacgaaataagggcccctctggcatggcattttggacggctctagctcgggctcatcgtgaagccctaccaaacggtcataaacggcttctcgtccagaaccatcctccttcatttctctaatacattattcgaaataagcacaagagaagctgttttgtcaaacgaattgcaaaacaactccgactcctataaagaagctaaagagccagagaagctagagccgaaactgttctagaggatccggggccttgccacgggaggcctaagatgtcatttttctaccagccctgttttttgtcattcggtgctgtcaattagctcaaagtgatgtgaatgtatggtctctgaagaaaatggaacacacaagtaacagagctcggtrgcgagggagtcccttgagtggcggcgacgatgaatctcttgggctacgatgatgaatcccttggcggtggtggcgggtgacgctaggccggagttgaaggttcacggtagacggatacgaagtttcacgaaaataacttagcatgaaaaatagagataaggctcaaatagtcaggtattatttttaggacctgagtcactaaatcctaaattagtttgattaattttaataaaataagatctttgttggagttattttttatctctaaatcttatatttcgagttagaagctcgtttaagagcctttttggatatgttctaagatggtaagatgatataagatcatctttagcagcctgtgtaaaaggttgtgtaaagtactattttgtactgtaaattacactatttgagagtgaagtttaaaatagaaaatgagatatgcagtgagataagaaatgttggatagtctaagctacatcaaataggctcgtcttcaactttcacaaaacggacggtacgagtatcagcgaagacatcttgcaactatccgatcacaagaagctcacaaaatcacaacacacatctcttcacaacacgatactcctaaaaaaaaacgaaataaaatcgacgacgacgtctaatctatttaaggctgaaatccaccttgcctgcgtggccctcctccccatcgcgtctgtccgctacccctccccgaccagatcgctacgagacgccgcgcgatccgacccaggccgacgccgacgacccctctcgccgccggcggcc

SEQ ID NO: 5531 - DNA, 1496 bp, Zea mays
gcatgtaatatatcatttttacttctaaggtcggaaatggaagcattgcaaacatcaaaatctttagccttagcaattaatttctcattttcaatcctaaggctagcaagagaaatgttcaattcttctattttagcaagcaacttgaaagggaattaggcttacacctatttcctaaatgattttgctggttgaattgcccaacacaaataatttgactaactagtttgctctagagtataagttatacaggtaccaaaggttcacacttagccaataaaaagaccaagtattgggttcaacaaaagagcaaagggataatcgaagtgtgccctcgtatagcgcaccggactgtccggtgtgccaccggacagtgtccgatgcaccaccggacagtgtccggtgcaccaggggacttcacactaaactcttcaccttcgggaaaatccagaggcgctctgctataattcaccggactgtccggtgtacaccagacagtgtccggtgccccaaggaagagcgactctggaactcgccagcttcgggaatttgctccgctataattcaccggactgtccggtgagccagcagagcaaaggctacttcgcgccaacggtcacctgcagaagcattaaatgcgcgccagagcgcgcagaagtcaggcacgcgcgtagtggcgcaccgaacactctacagtacatgtctggtgtgccaccggacatccaggcgggcccagaagacagagctccaatggtcagaacccaacggcctggtgacatggctggcgcaccggacactatccggtgtgcaccggactgtccggtgcaccatgcgacagacagccccaccaaacgactagtttggtggttggggctataaatacccccaaccatcccacattcaagtcatccaagttttcccacttcaactacttacaagagctctagcattcaattctagacacacccaagtgatcaaatcctttccaaactccacacaacgccctagtgattagtgagagagatttgcttgtgttctttcgagctcttgcgcttggattgctttcttctttctttgattcttcattgcgatcaaactcacttgtaattgaggcaagagacaccaatcttgtggtggtccttgtgggaactttgtgttccaagtgattgagaagaaaagctcactcggtccgagggaccgtttgagagagggaaagggttgaaagagacccggtctttgtgaccacctcaacggggagtaggtttgcgagaaccgaacctcggtaaaacaaatccgcgtgtcacactctttatttgcttgcgatttgttttgcaccctctctcgcggactcgattatatttctaacgctaacccggcttgtagttgtgattattttttgagaatttcagtttcgccctattcaccccccctcctctaggcgactttcaattggtatcagagcccggtacttcattagagcctaaccgctcgaagtg

SEQ ID NO: 5532 - DNA, 1500 bp, Zea mays
tattttcagatttcaccatatttataaaatataaatatggtatcaaaatctatgacatcaaattaatatatttagatgtattattataaaatatatattcatacatatttattttttgatgttatagatattgtacttttttctataaatttgattaaatataaaaaactgagttaagatctaaaactcacatcaaagaggaatggtttgaaaaaacttttaaggttcttgctaaaatcaggtgactaaaatttagttttttcacaaaattattttatatattttagattaaaatttgtagaattagtttgttgcaacttttatgtatgtaatctataatttttagtcttaaaaataaatacatagttagataaaatctaatttgagttgatacaaataaaataacaatatctcactatttttatgatccaaaaacaaaagattaattgatataatacaaagacaaataaaacatcatacataattatttatttgtactaatgatgtaagaatattatataagattatcttaaaagttactagaaaatgttaatttaaagaggcacaatgatttagaggtgtttaggatgacttcagattctagctccaatgtaaagttattgtttataatatgactttaaatagttttaaaaaatatttttaatctaaataataaacaaaataacttatctaaatgtgttctaaagacttcgaactctaatttgacgattttctaaagcaactaataatctactttacctattctaccaaaatttctaaaggttttgccaaacatgactttattatttgttttaaaactcgtgatatattgttaaatataacgaccctttttctcctctgcacgtgcggagaaggcagcgacgaaatggcgtccccgcggaggcgcggacccatccgagccgcgtgcgcgtgataaactgataaagccggtaacaatttttccgtgctgccccaccgcagcgtctcgactggtcccctccttcctcttctcttcctcttcctctcacatcccggacaaatccaatccgaaatcatctccccctcgcctcgcctagaagaggaaggaagaacagagataagcgacaacgcgtccctcctcgccttcctcccgcctcgagctcttcccggagcaaccggagccacagacgtcaggacagcctagcgcgttccacgccggtgagttgcctcgtcctcccctcgtcttcctcctcttctcacgcttggcgagatcccgattgacccggatccatgcgagtatagctggcatgcatttggctcttcggttaatggtagggtgggggcgggcacgcgtgggttggttgatcgaccgatctcgctgtcgccaccaatcgaattcagtgttgggccctgggtcgttgctcgactcatccgatggtcgggttgctttgttgattaccaccaggttgcgattggatgctcatacgtgcctcgcttctttttcctctttcgattccaggt

SEQ ID NO: 5533 - DNA, 1321 bp, Zea mays
cccctgaagatcttggatagttccaatgttacttgggataacaccagttattttatttatggacaaattgagtgcagttagaccttttatgttactcagggtttgaggtatgcttccatcgattgagttattatccaatataaggtattgcagcacagtgcattccccaatactctcaggtatctcgccagacaatcggttcccagacagaactagctggttcaggttccccaaactactcatctcagaaggaagatgtcccgatagcgaattgtatgataagtttaaatagataagggatgacagtttgaaaatctcattggaaattgaaccatcgagggagttctttgataaatcaagtgtcaacagattcgacatgttgcctatgcttgctggaattggcccccccaagttgcaatgatgtgcatcaaagacatttaaccctttgagatttccaatagataaaggaatgatgcctgacaagtcagtgctgaacaaatccatctcagtcaagtttcccagcctgccaatgctctctggaataacccctgatatgaaagtacttgacataccgaggacttgtaggttgagcagattgccgatggccgatggtatgcttcctgagatcccagatccatcaaagcggagcgtctgtaggctagatagattcgctattgaacttggcagctgcccagtcaaaccggcgttgaggccgatttcaaattccacgagctgggtgcagtttgacagggacgtgatgaattcccagccctccttgtcgtccgcctgcagcaggttcccgtacagtaataggctttgcagagctaccaatcttccaactgcaccagacacatatccaccgagcctattttctgagaggtcaagcatctgcagtgtggtgaggttgaagagtgaaacagggatggacccggtgaactggttagcataaaactcaagcatctgcatgctgtgaaacctgatgcctatggcatcaggaattctgccatggagcatgttatcactgagctggaacctttccaacgaggttaggttgtacaaggaatgtgggggttcgccagagaggtggttgtcattgaggtcgaggtgctggagggcctggatggcgccgatgccaggcgggatggtgccgtggagctggttgaacccaagtgacaggatgctaagcgacgacaggttggctaatgacgccgggatggtgccggtgaggctgttgttccaaacactgagcaccacgagattcatcagtttctcacccaactcgtagggcacgctcccggtgagctggttgaagcggaggcgc

SEQ ID NO: 5534 - DNA, 204 bp, Zea mays
ggtaggtgcatttcacctaagcttcatgattgttaagatcctagaatgctgcaatcacaatcttcaaagttgagctatgaacttacaatttgaggaagtgtggacagaagcgtaaatgatcatgcaatactgtgtttgcaattgacatccactgctgcacggcaggctttcaatgttctacgaagaaacggtgtcaatgtccag

SEQ ID NO: 5535 - DNA, 859 bp, Zea mays
cacttattattgaaatggactctcaattttacactataagatttaaggatcagatcagattaggattgggtcctatttctatatatttttgaactaaaatttattttggctatatcattttttgaagaagcatttgaatcacgatctattatcaccccagccctagatcatggcccgagtggtgagggcacaaatccacctgtggtcttatatgtgagtgtttatatgactaaagtgattttgtttattattgaaatggatctaagggatttaagaatcgttggagaagtgtaaatagaatagatcttcaaaaggagctctaaaaaaaacaggagcggtcgttaaaacagactcagggcctgtttggaaatacaattttaaaatactgtagttttgagataccatagtttatatttatacatgacataaatactacggtatttctttaccgcagtaaaactgtagtattgctcaaaaccgagatctgtttgattctattgaaaaaacaaaatatatgtagatagaagagaagaaaactgatgtctgagtaaagtttcgaaaactccaaaaataccatggttttgggtaaatcatgatatttaaaactgagttttgactatataaaccttttaagttctaatactatagtatcatcaaatacctagtattgtttcaaaactgcaaaagtactatagttataaacggggcctcaagtacagttgataggctaaaaatgacttttttgttgtctgatctaatgggaatgtacggaatctcgtctcccatctcgcacttgagttgagactactgttgtgactattgtgtgcgtgagagagaaacagaagaggaaaaggaatcc

SEQ ID NO: 5536 - DNA, 1500 bp, Zea mays
cccactgtttaactatttagggactaaataagactaaaatggaggaactaatctttagtcccttaaacaaaacgggcattacttccatgctatttcttttagttatattatatcctttgtaagtagcatgcatgcccttttccaaatcttgattttaataaatttagatactagtattttaggcttagcggcttaaccatttatctttctagaaactgatttgagaataattatgtaacatgaactttcccaaattaagaaattgatctttgacctccatatataaggcctgcctagaaaacgagaaatcctagcttttttttcttgcattggctaagagtttggttacataaatacttattccagagaacatctttccataaaccattctcactacatagtttgaaaagccattgtaagagacatttgttttgcaaatctggattttgaatgctcaaaccaccttgttttttaagttacacaaaatatttcacttggttagtctatttttcttaaactggccattgttttccaaaaaaaaaaatgatctaaagtatccaaaatttttaagatgtccttagcttgcatgggatcttatattcgttgttttgtcagtttgtctgccactctgggctgcatgcatctctgtaaaacgtaacgatgaggattcatgtctgttgctttgcattgtactgtattagtattgactgaactgtttacttttgttctagtgtttggatccatccttgttttttaaaactgatttattgattttgtttataaaaattggcttttaaagaaattagcagaagttgtttggattccacctagtttcttagaaactggttttagctaagggagactagcttcttggtttttaagaaactgagaaacaagtttttagaaactaactaaaaaactgactgttcggagacctttcagcttttgaaaaccagttcctaaggaactaggtggatccaaacagagcctaaaactagtaaactatatatatgttggttgtcgttatctgaaaccggtttgattgttattagaaattaactactgtccaataacaataagttggagtttctaatcactttatatttgtttaatttgttgtgagactcatgcatgcatatctgatgaatcattctcattctcatgagagaaagatatgtaagtttccaaaagttttagtctgacagaacttgtgcactcgatctggggtccggacctgatgattcttgcgatccttattgccacatacctaccaaacggaaacgtgggcgagccctatccactggctgtactgagacaacctcatctcacgaaacaatgcaacaaaagtttggagcgctgtatataaattcgcttattagtaccatatgattgctgttgcaaattacgttccctctagtctctactctagccccctctctctctcacacacacacacacccctatcacttggactgtgctagtataggtagccgccgtgta

SEQ ID NO: 5537 - DNA, 1500 bp, Zea mays
caaacccagaccctctttgaggttctagagtgctgattataggtgttggccttctcccgagcgcagtgggcttactgggcaggcccaaccactaggttaggacagatcaccattagcatgctagctaatggtagtgcgggatggtccgccttgacctagcaatagtgtgtactccaatattgaggtaccgacagtacccaaaccatttcctatcttatttttagaggaaatttcgctcctttatatgttgtgtctttcttttaaatatagagaactttcctttgttctctatatacatatagaatctttcctctcttctcattctattttaatattttaaataacgaaataagtctaactaaaatatttataagccatttaagtgtataataaatatgtacgtaaaaaaatctagagcaaatatgtagatgactgagatataaaggaaggaatttttttagaaagccttgtaaagagggatataaatgataccgttggagatagtctaaaccaccatagtgaatactctatcaaacttagtcaattttgaatgggacatatcatatgcaatcatccatttagtgcgagtgagcaatcaaacaatttataacatccaatctagatccaactatttcatatggaatgagttaaatataaataggagctaggtttaaaggggaaggaattaaatatcaaataatactaacagttggattttaattgaatacactagatcgctttattgtgcacgatattttctcattttgaactgacctaaaagatggcgcgaacaacttatctatatctcgtatttcaaactctatatataaatagtgcaatctatataatgcaaaacagtggtttgcacaatcatatatatgatctgctggctatagccttaggccatcttcaacagactttcgatcatgtgtgaatgcaatagagctaatagttagctcgataaaaagttgttagtaaattagctaactaacagatagttggctacctattagttgatttgctaaaagtagctattagctgaaatattagctagactgcttgtatgtctgcagctgatttgagtagctaactattatctctagtgcattaaaacataacctttctatccacctttcattccacgtctattttaaactctactatatgaacagtacactatataaaacaatattttacagacaacttaaattattagagacaggtttaaattatctccaataaatcttctatctcatttttctataacatcttatatttaaaacttcgttctacaaacaactgcagtttcacatcacatattgtattttataaagacgtcccccatcctgcatctgcaaaggccgcccactaccctctccggctctccgctaacaaaatctagaaccctctgaaccctccacattcctccagatcgaataataacctagctctgcacaccgcccagccaccagtggcagcaggagcaggggtcggaacaag

SEQ ID NO: 5538 - DNA, 683 bp, Zea mays
tatcaatccaagcattccaaacatctcattcgatacaagagcaaaagacttcactccaagatacatcaaatagattgaatcctcttcaagcctccaaatccactcaattccattagggacttgagagggggtgtttttgtgttctttgttgctcttattgcttggcttgacctttttcttttcacattcttattctcaagtgctttgtaagcaaggcaagagacaccaagtgtgtggtggtccttgcggggtcttagtgacacgtgagattaaggaagaaggctcactcggtctaagtgaccgtttgagagagggaaagggttggaatagacccggtcttagtgacctcctcaacggggactaggttctttggaaccgaacattggtaaaacaaatcatcgtgttcactcgccttgattcttgtttgatttgttttcccctctctaacgtttccttgctagtgtgaatttgagttggctcccatacgttatccgcaatccttgagcaactcctagcaagagagatattcttttggacttgaatttaattctaacgctaacccctgaccttagtgtgtgtttaagtttataaaatttaggtttcgcctattcacccccccactaggcgactttcaattggtatcagagccggtgcttcattaagagcctaaccaactcaaagta

SEQ ID NO: 5539 - DNA, 938 bp, Zea mays
accgatttctgcgcactggtaaacgaatacagaggcgacaaaacgttgaaaaatctgaccttgtttcgtttggtttggaaaaaaaaaggtgaagaaactgcaagaaacaaaatgcgcgtgccagaaggagaagaggaaggcggagcgcagcaagacgagcaggcggtggttcatggttggatgctgaagaagtggaagttggcagtaacacgcatggcgatgaactaactgatcttggtcgatcgtgtacaagccatatatatatatatattttttgtattgtttttgtactctgctttgatctacttccgtccaccattagttgtaaagtattgtcatggtccatgaatgcagcatttttctcgtctatcaaatgaagaagaacttcctaatgacttgtttccgtggagcattcaggttctccagcggcgctcagtgggactctgggaggatctgctgcccttgctcttgcagtcttgcagcagcgtcttccacttctcacccacgtgaccacgtctggtgctaacacatttgggttgggtccccccaaggaaagggaagcaaagcaaagcaaagcgacgccgacgcgtctccaagaataggcagcatgcacctggcgggttgtggagcgcacgcctcggcgctgggctctggccaccatcccaaacatagcgggcggctgcttaaacttggcaagccggtagccaccacataacccgccatttcaccgcttccctcctccctctcctccgattgggcccaccaaccagggagagggtgagagggccccgccaccgtcaacaaaacaacccacccaaccccagtcacaacgaggcctgccgccctccggtgcgggccggtggtcggtggtgacgagcagacacgctagactagctcgctagctagctacctaggtagaagcaagcgctggaccagcc

SEQ ID NO: 5540 - DNA, 1500 bp, Zea mays
tatgatgtgattaaatgattaaaactaggtctattaaatgattaaatgataccccttcgatgtggacggtgggttgatttgttataaacccaagggctctttagcaaaattgacacatcgaaggggtatccttatctctgggtcgatggatttcgcttagacggtccagattacaacctcgcctatatctaaatcggcatgccgcggactcctcatgatctaggatccatggtcccaaggacggccacgccagcactagtatcccgcccttggatcggatcttgacggcgcaaaactacttgcgcaaagagtcatagagattctaatccacactattgatttcaatccaacagaccatagtgttcttctccccatcgaccaacagagcggtggtacgcgcacggtcaacggcggcgcgccaccggagaatcgccatcacccacccaagggttgaatcccccatggagactggtgctacacggagagggcaccgagtaccaatgggaaaggggctagatgttgcgctgccccgtgaaggccatcgccatcttcccatccaagcatgacggcgcaccagggcatgtatggcagggacgcgcacgagcttaggcggttgggggtgtgggcatggcgagcgctgagtgccatggtagaggaggtgaggggcccgagctgaggagaataatggcgttgggcagaggagttggagcagggctaccccgcgtaggagctcccgcggcgactctcgcttcctttctctaaccctctgttcggtgatgcagctcgccaatggcccaggggatgccgcggccacggatttatacccaggggcgaggacgagctcggtcagaccgcgcgacaggtgcgggagatcctccgcggattccacggcggtttggtgaagcacccgcgccgaattagcgtaatccagcggagttctgtttcattcgcccgcgaggaagatggtcctggcgttttgggcccaccagccatagatccaaaaaaacaggcaagaataggctgtgtcgtgtgaagtgggtagcgggaaacagaaatgacttggaccgatgggggtgagaatcggagatgggccaaccgccggaaggcccgggatgaaacaacacgaggtggcaccatcacgccgcgcacggaggatcgggatctcggtctcgcggaggacacaagtcacggaacccgcactgcgtacaccacaccgcacactgcgactggcaactgggccccgtaccttccttcacttctccgtgtcaaccaggaaaagaccgcgcggcgcgacccacgagggtggtcatccccatttctcctcgaacccccaggtcccccacacaacgcagatacggacactctcctactccgccctccccctgcgccccgcgcagcgcacgcccagcccagtccagccggaggagaccagatcaaagcgccaccgccacgccgtactctagctaatcccgccgccgcgccggggtcgcgaggaggagg

SEQ ID NO: 5541 - DNA, 1335 bp, Zea mays
agcccgtggccaggcggagaggggatggaagatggtgggcgaaagaggtcgctgctcgccagccatgggcgcactcggagcagagaggcgcgggcgcggtcggagcagagaggtgcgggcacggtcggagtagagcacgggcgcgcgcgacgacggcgtgcctggccgggtcggggcacgccgggtcctcctgggcgcggcttggccggttccctggtgggcacgtcgagaggtagggcgtcgagcctaggcgccgctgtggctcggcgtccttggacggggtcgacggcggtgggcgtgaccggcgacggcatgcctggccgacagcgccgggtcctcctggcgcctgggcgcggcttggtcggttccttggcgggcgcgcgggaggcagggcgcgagcctgggcgcggtggcggctcggcgtccttggtggcttggcggctgtggagcagagactgagcaggggagaggccacgaccggcagggaagcaaaccctagccggcggcggctgaggggtgagggaggagcgaaaccctaatctgataccatgttagaggaataacccttggattaattggaccaaccctagagggtagctatatagtatttgtatatgggccacatgggcctagccacatgggcctaatccatatattctaacacgaattaccccaaaattggtgtctgagatgttcctttcaatgcaatgctgttccttaaaaaaacgtttcgatgctaaacaaaagcataggaaatataaaaagtttttgctggtataccataccagcatcatgcgtccgtgctattcctctgcaggccttggtcttgtgcgtacatgcctatggatgatcacaggcacgccacatttcattcttaatcactacttaattgacatctaatgccctctgctcaacttgcgcacgctacgcaccgtataaaaacaagtgtcagtgcgagccagcccatgcatgcgcagcgatcttggccatttgcggagccaagccaacccaagccgagcgagcagaaaatatgcgataccgtatgagggaaaacactagttattatacgaggtagctagcaataatacagatcggactcttcgcaaccggcttcacatgcacatcatatgatggccgcgccgggttcacatgaacgctcccgtgcctagttgcaccgatttcttaatcccgagcatggactataaaatcccctggtaacaccgtgatcaaagcatcgcaaacaagctagctaatcacttgtcaagaacaagagctctctacttgcattggctagcgtgatccgcgaggtagctggctgcttgttgtgatcgagca

SEQ ID NO: 5542 - DNA, 202 bp, Zea mays
gtctgtaggagcctccggctcgtcgcgaaatataagcgtgtcgacagagccagagaggcaaagggaagcagccgagcgtatgacggaatgctgtaaaaaaaaaaaaaaacagagagagggctctgactctttgagagctgcacttgtgttgtgaccgctgtattgcgttggttacttggttctttagttcaatactaacaaa

SEQ ID NO: 5543 - DNA, 322 bp, Zea mays
gtccgcccaccactggctggccacagctccccgtgtcgcgcacggcccccgctccctcctcgccaacctcgtgctgacagcccattggcctcggcctgcagccagcggctatcggctagcggccagcttcctttttatcaacaactactacccgccgtgacctcgcgagtcgcgacccggacgcgactagtacactgcctgccaaacagctgagcagagtagagtagagcagagggcgaagtgcagcgcagtgtgccccgtctcggaacagcgcggaccaccagagcgtgcgcgtccgtgccccacccctccctctctatcc

SEQ ID NO: 5544 - DNA, 1500 bp, Zea mays
ttgctatcgtagcaacaaggcaactacgagataaagatgttcactctgtagcaggatattcaggatattcatctagtagtaggtgtagtactgtgaagattacaggagtaataattggcaagtaatgatgaacgagtaggtgctccacaagcaaaagaaccccaaagttccgtgtgaggtgtgactcgagctccctagatttcgattagaaaactcgatcagattcttttctttcctctcctccggaatagtttattccgctttgctttgggtccacgatctcttcttcgtctcctcctcgaggcagaggaagacgtccggcttcttgtatccgccttgttagccccacacaccgacaacctggactgcgcgtccacgaactcactcgccgaacagacatcattccccttaccccgacgtttgaaatcctctccagccgatgcatcctccccatcaatcttctccggttcgttgcattgcgtctggattggcctgcccctgctagattcaggtaactgctgcagctgcggttcttgacccgtttacttcggtttgcccgtggccgcccttgtcttatccttctctctgcatttgagccttctttttcacagtatayttgattggtttgggctctgtacccagtcaactccctccccccttgtcctggcttttgatactgcattttggttgtcctaacttgtttctgctaatttaatcggcattcattgtaattcccgtaccgagtcctcttgggtttgcttggcagttttgctttgctagcactagcagtactctgcatctcttttgttgttaatgtgggtaaagtttttgctttttcttcaaccaaatgctcccttttttctctttccaatgaacattgattggttccttgatggctcaggttctctttacgggagctgctcttgcagaccggctgatttaatgcaagacgctgtctgtttttctctttccattgcccttgatttaatgcaagacgctgtctgttttctttgcctctggtattgggctggtacttcacatgttctggatgctgcattggttagtctcagtccagtccggtcaaagtcgtctcttctctcagatctcgtgctgtccctagcattttccctagtttaactaggttcgagttatctccctttgcttcatcgactcatgcgtccgtattatttgggttttacgctaccttgttctttttgctgaaaattttgtattttaacgaagtttttctattcactgcatccccactaggatcatctgcttctgctgctgctattattattagcattaggtctcgacgcacacgatcttaatcattaactgtttttcttttctcctttacctagtaagataatcactgccttgctgaatgcagggacttcgcatccattgtgtctgatttcttctattcagagtgaattgcagaagtagactggtttcttcttcatccagtaagytcagtctgtaccctgcactgcaaca

SEQ ID NO: 5545 - DNA, 900 bp, Zea mays
ccatgtaaagtaaagacttgttataaaattgcaccacaacaagatactcccctaaggaaagactcagaagaaaaaagaaaagttagcattgtaccataatgtcatgatgcaacctaactgataggagcataaaaaatccacgaaattctagtaaaaagaaagcctctggaaaacgcgaagtttgtacttaacattggattaaatccaaacatcacgtatgaattctgagtcacttttggataaaaaggaaaggcaatcaaacaataacaaacgaattttaaactgatacgaatgtgccgagcatacttgtctatcctactgatacgaatctgtttcatgccgattaataaaacagttaggagtggagaaactagagcttacttgccgcactgctggcagtagcgcttctggacaccatcgagcatgacagtagcagcgtgcgcgcagcgcagacacacacggtgccggcgatggtaccctttcagctcccgtatgtccgcctcacagccaggcacttggcacttcatctccgccaccgccgcgcggacagttcctccggcagtacctgcagcttccgctttgccacggcgaccagcagtcttagtcttcttccgcgcgccagcaaggaactccgtcgccacgtcctccacctcggcagcggcgaccatctcgtccacctcggggcacgcgcatgggactatccccgcgagatagttcgggcacaccagccgcgggtcccgcttcctgacgcggcgcccgatcccctgaacccgaagagggggcggcggaagcactggccccggttccggctccggctccggctcctcctccaccgactgcggaagcgggggcgaggcggggagcagtgccgtggcggcctcggtggggtcggatgctgct

SEQ ID NO: 5546 - DNA, 1500 bp, Zea mays
aagctcttcattttgatctttaatgagattttataaatataagttcttgggatcatttgggatgtatagaaacattctaggacctcttaggatcatttccaccaatggtatagaccggtccacctagagcatgaatttctaatcctttgtgtcattttgagaaaaaaagagttgattcaaattcatatttttatctgactttgaaatttgaatatttttagctcaatttttgtggaaatctgggacaaccttatgaaggtgtgtgcataattttagctcaatcggacttagtttgcatatattttgcattttagaaccttgattcgggttgttgaaaactggccaagcactaccccttgaagagcagtagtgtcgggcgatgcctagaagtgccatggtgtagcaacaccacttgtggagtaatattgtcgagccaatctgggtgggacactttttttagggtcgcttcagacttcttgaagttcgttatgtgatctgtttgtttcattggactcatgtatgcattagtatttttttcgaaatatatttttggtttgagcattttctttatcccaattgaagataaagagctcgatttcctgatttgagatagttttatccgcaaactcattgatgactgttttaagagtttcactatgtttttcggtcatcgtcgaraatatccatctactagttgatgcttaaatacctcttttatgccttttgragttttgaacggttaraggtagcattggaaaataagccaacattacttgagaccctctgtacggtcgcctgattcgatcttcatatataatcagaagagttaaattttgatgaaatatataataaattttatcatcatttgtgtctctaataaaatttactacaaaattataacttattattaatctaataacacttattttatatcatagatactgacattctttgtataattttaagttcaaatattgtaaaaaggaacatcccattttggattgtctaatctttaaatattgtaaacaagcaatctccattttcgattacaaatatcgtaacgagactttgtactacatacaataaaacaagaaattatccataaaatattgtcatcgcatgatttatatttaatgacacgtattggttgattgcacaaaacatatatttgcacgtaggagtacctcccatatatatacacacgttacacacgtcacgtaaaacgggtcccacaatcgcacacgtctcgcttcgcgataaacctgtgccgaccaccgaccaccacgtcacaggctcacagtcacaacccgcctgccacgtgcttaactgacatctgggacccaccgtacccaccacaacaattttccatcccaaccgcgatctcgttcttgtctttctcactcaccgtgcgcggcggcagctttgcttcttccaccactgaccagcgggtcccgcctcgccggtggagttttcagggagcttcttctgcccgccggcrcg

SEQ ID NO: 5547 - DNA, 217 bp, Zea mays
ttagcccttagtggctgttggcgccggcaagatgatgatgcatttgttttaaggtggaggttgctattatgatgctacaaggaatttgtctcaaggtggagtttgttgagtttgtgatccaaattctgaagaaggcgtccaagttggcgagcgaagcggaggcccgtcgccgggaggcttgggccggaggagatatttatctcaattgtaaaatctc

SEQ ID NO: 5548 - DNA, 1500 bp, Zea mays
agtggaactttgtaaaggcctcgtagtgttaccctgcccgcttccttggtagaggtgtatgggaagttgcgatgccttggcagatcggtaacatgacttgtgggtaaagatgtgcaacctctgcagagtataaaactggtatatcagcaatgctcatggtcatgagcggcttgaacactcacatgattaatttatggaattaaattcaatttctcatttgcatcgcattgtggtttattattaatttgatctattattactctagtttggtatttacttacatttagtaactgctaataaaatttgaccaacttattaaaagttatgatcatctttaaccattatctgttgatcagccttacacttcacatgaactcccacctttggtgaattcatgcacattattccccacaacttgttgagctatgatcttttgtgagctcactgttgcgatatataaaccccccacaggtgaagagcaggtggtccaagaggagccgccctataatgaagaggacgagttgatctaggtggagtatcccagtcagctttgtggcgccaaggaataatacttagttcgctttattattatcatttatttttataagacttccgctatgtaataatgacatttatgatatttgtgacatttatctctatacacttcgtcattatatgtaatgttattctttagcgcacatatgagacgcacccgactttatcctttaaatccgggtgtgacagaagtggtatgagaggaaatgttgactgtaggatgaaacctagatagacctagacaaaacccttactacttaccttactctaattctttcttatcttttctattctaagacaaggaggatttcacactttggaatccaacatccatgaccctctaaagagataggagacccaagacaaaattaaaattattttctctacttaaagtaattggatgtttgttcttgtggtaaatgcttaattagcttatttgattgattgaatcaatatagcagggtattctagcatgtaccaccataaggtaattagtatgagtaggtgacacactaatctacttagttattataacccccaaaagattctgcctcataattacccgtctattctacaattctatcttaccatatatttctaacccagatggtcaataccaggaagggaggatgaattgatctacctgccaatccacacaaccggagggtacttagacaacaacaagaagaagatatgaatcctccaaattctccaccagccggaactgatccagtggttgcagcctagatgcagatgatgaaacaaatgcctaatactatggcagatatgcatgcgtagatgcagcaggaacgccaagagatgcgccaggaaaggcaagatatttgggaggagatgcatcaggagaggatggggcgatagcagcaagccccattaccaccaccgccaccaccacttgcaccctgggacaagcaccgggagggtttt

SEQ ID NO: 5549 - DNA, 726 bp, Zea mays
gctgtaaccaaactatctatccttttgtttcgccgttgttagtatgggaggtttgttcctcttcttgtggcagatagttgctggtcttgtaataatttagccctatcctcctaacgaggtcaaagacggatataattatccattatctaaaaaatcaaaactgaactggaaatgactcgagagaagcagatgcaggagccgtcttgctgtccaatttttttcctcgaacaaacgctcgtgcttgtgcatgtgcaccatcaatcttctcaccaagagaaaaatatctggaaagattccttaagtaaggtggtcatttcactgtcctaaatcagaaatgtgagcttgataaagtccctttgaaatgcaggaatttcagagaaattttataaaatcagttgttttcgcataaaaacgtaggaatacgatttcagggaattttttcccgtttactatgttttttcttgtaaataaattaatttctataagattcatgtatgcttcctcagttcctctgaaattcccgagggcctgaatcttattgtaatgaagtacgtgtcaggcgtccttagaaatgaagtacgttttccttatgagaaagcgtatcaacgaggggagtgccttgcccctcgtcagcggattagatagggggcaggcagcagaggttcccggctccttcgcggcgctgcttatctcccgctcccggctcccctcctcccccgcgccgcg

SEQ ID NO: 5550 - DNA, 52 bp, Zea mays
atgtctgaccatgagcctgatgactccaccgaagttttgagagtccccaaca

SEQ ID NO: 5551 - DNA, 205 bp, Zea mays
tttgtagcagcgattcgtttcagcatttttttgtttttcaaataccatttcgagagtgtaaataacttcaacagaattcaaaattgatgtacttaggtaggcctgagccctgtttatcttcgatgtatatggtttgcatgtcaccaaccgttgtgagcgatgattgattatttatcgtcttgttttatctgtctgtactccttta

SEQ ID NO: 5552 - DNA, 1500 bp, Zea mays
gtacattaattaatacagtcctataataataattaattcacgcctcctccttccccaccggcaggcggcaccgcaccgcagtactcctggatctaaaaataaatatacttctgatgtactgctacggtgtatataggtcatatttagtttttttaatcacactcttaaactttagagacgaatggcatctacaactctatttaatatacgatcctgtgagtacccaaatgaccaaatcccagatccatttaccgttactgtgtcgaatccaagaaaaaataaaactatcgtagcaatttgatttccaggagcttccctttggttttttttttccttcctatctgtatctaccggcatcaaaagttaggttgcttttggcacggagaaaaaaaaagagttgccagcttttaacagggcacaataatttgagaggatagctgctccctgcattgaactactcgtagttcgtactaccgtgctagtagttctgtctggcggaaaaaagaaaaaaggaacaaaaggcgtgacgagtgccaatcgaatgcagagtgctgaaagacgagacccaacacatgagtgaaggcagctgaccaacatcgctccatcagttcgctccattctgttctgttggagacagaaacacaactactagcactgttcgactctacattgactagggtacagactttatctttttatatagacgaacggatacaatcgattcaatcaaatttatcttatttctactgtacttttcattttttaagagtatgattaatctatccttaatattagttttcctcgatctatttcttgatcgttgttcgactctacgttgaccagaagcgttttgagtagcctgccgaccccgatacgaccctctggaactctcttctcgacggggtccctcacgggaggcgagatttagatttttcgcggagaagaagaccctccgcgccatcatggaccatccggctccagcgcggatcgtccgaargcacgcaaaggagaagtcgttcctacgccgaggtcgtacaccgtcccatcccgtgccaccgcgttccgtagagagcactgcgagacgattcacttgtttggtgccagatcagcgtcaataaattattattttatatttaacctcttcctcctaaaacctgatacctattttatatttaactcctatataaaactgttggatttgaattagaagctctacatagtttgagattgcacgtttcccgcgactaattgcgcctacgtttgctccctccaaattaaaaaaaaatctattccgcaagggaatcaaatcgactcggcccattccattgagcccagtagccacggacagagaggcccaggcctgcccactccgactaatatcctggggccgcgcggctatgggcggagtgaaggaagcagggaagcatcagcagcgccgccgccatcactgctacgctgccggcgctagagccctaaaccctagctagggctaggccatcc

SEQ ID NO: 5553 - DNA, 1253 bp, Zea mays
caccagaacactatcttataatcgtatctaataaattgatatggtgtaatccatgccattgaatctgctaatacaattgtgttttcaattgcaagcctagtgcaccacgtgacaattatgcacccttacattgtatctaaagctaagtggcaactatgtgtgatcattcaaaagtaaaaaaaaaacctttcacataatgtaggtaaaatatggagaaatttgaaacgggaacgtactggccagagccttaactatgtgactaatgtgagtggagacctattactcgatttgggtttgcctaaccttgaatgggtgtttggagagccatctactttatgatcttcatttgctgttgtatggtgaatctaccatgaagttcaagtgattattttatggaggctgacgacatgtgctcattgtctttcaatagaaaatggaggcagcgataatgtgggcatgttgaagaacatcccttgccaccacgttgtatcagctgaaaggtgaaaacaacctgtcggatgttgtctgccaagaataaagttgtgaaccaccggagaacagtaaaaacgacttgagaatagtaagtaaacagagtattcagtttgtgagcagttatccttcacgctagctctgaaaacagtgtctcctgagttacaacgaagtagcaatagaacttagtgcatcctccctttgaaactcccgtaccaatccttgtcagccgaaattaaccagggccgttcctgacttttgaggggcccgggacaagattataaatagaggctccaacaccataaaaactattttttactattatatatatcaactaattatatttgatgtaccatagaaagacttaaacagtaaaaaatagaagtaagattattacctcaaatatattatagagatcaacttaaaaatgttttctaacatttctagatacaaaatcatcaatgatggcttcaatattaacatcatctaataatttcttctcgatacataaagttgctagctcgtttaagctttcttgagacattgtagaccttaaataattcttcaataacttaaactttgagaagctcatttcagctgatgccacagttattggtatagtaaataatatccgataaacaacaaatatattgtgataacaatccattctcctaacaaactcaaaaatatattggtatagtaaataatatccgtttctatcctatattcctattagactttgtgtacggtggggcccctgggag

SEQ ID NO: 5554 - DNA, 67 bp, Zea mays
ttgtaaattacttttgcaaaccttttgttttattttaactgtaaatatttgaagaatatatatatta

SEQ ID NO: 5555 - DNA, 1500 bp, Zea mays
aaatatgttcttgatttcaaaactgaaccaaacgaactccgattgatatgaaattttacacacacatgagcaaatacctttgcaagatctccccaaattttgagctcaatccgacttgtgaatcaccagcagatttaaaaatacagcaaaaattggtgttttgttggggttttctagaaacgagttcaaactaagtttttctcaaatcgcgaccaaaatctgcaacaaataggtgtatgcagtggtccgaagagtgcaactcaccaccaatcaacccccaaaccaaatcctctcaaaggaatcaaagtttttcaccaacaacacaagatcgggaaaaggagaaaccaagactatagaacttcagaaatttcagcaagggtacaaactgagattggaagccaaagagccctgtgggccggaccgacgacccttcctctgattaaacttgaaaatcaagaacacagtcgaagtacaaaatcactgcggaaccctcagctcaactggtgtctacctagagagaaaactaggagctgtagaatgagtggtcaaaacaaatggcagacaagagatgttgaactaaccagccctcccctctatttatagtgggttattctcacttcctaaactaaccctatttacatagagtctttccactccaccgggggcaaaatggaccaacttctaggttttttatctgacggtcacgtccttcacacggagttactttgccttgacgcaccctccgcgatcacgccgtgtgccgccaccggttccatccggaaccgccgccgccgagttttgaggcccaaactcagcaaaaccagtcatccctagcgctgggtggttttgagacccaaatcaccaaacctgtcgtgagcaccgcaactcgtgcacgtccttcagacgcgtgtcccgctagtcctcgaccacgccggcaacacggtccactccaccacgtcctcgcacaagtgtgtgtcacatgtgtcagccaccgcgattggtcatctggctgctctgatccgtcagtcaagacccagcacttgcccttcaccgctcccgatccatcagcacgggcccacatcaccttcacatcagccatcgaccaccgttcctatgctccacacctgcacatcacaagtcgaccgacatagttgcacaaacatagtctcacactctggtcagttcactgattaccccagagtattacccgttgacaatcactcgtcatcaacacgaaccacaaaggacaaatcaaaacggtgttcgcagccttccttcaggcttcgttcgctttatttatatttttagatgcgatctgatgatgccgccttgatttgccaaatgtgaacctgcaatctgaacttgaccactcgtggttcggctgtcacaatattaaagagtataaagttgagaggtactcatatattcatataaatacgcatacactacagcaccagccaccaggttgaccagaagaagcagagctcgtggcgcacgctc

SEQ ID NO: 5556 - DNA, 643 bp, Zea mays
cgtgargaggggscgggcactgcctactaccgtgtgggtgcgggggctgttargagatgggcccctggatggtggggctagggcggggtggcgcgagcatagctgggscaagccaaggccggcaaggtccggtgctgtggccagctgggcctagccatggctggctagggctggcctgagggtggccaaggttggctgtgaggctttcttccttttatcttgtcttctcttcttcctattacttgaattcaaattcgatcaaagattcatagatcaaaagatgcacatcaagcaaaagatataatataagctccaaagtatgatgcaacattttataacttccatgaggttttatacttgaaccttatacacattcctgaaataaccgtcttttctcaaacaaggataaaataaattaggagagaaaaaaaagagtaacatctgaattttcataggtatttagaaaataaattttatgcccataaattcaggtgactctttgccggtcacaagtcacagacagtacaactcaaccgactcagcccatgccttgcgcctgatgatggcgcttgcagccagcgcatcactgcttgacgtctcctcccaacgatgactctcatggagatcactcatcatctccgtg

SEQ ID NO: 5557 - DNA, 1500 bp, Zea mays
ctgttaagttaattaagttcttcttttggaactggggacaagagttttaccaataagataaaaaactaagtagaaggagctgcaggggtatgctcttaattagcttcaaaagtggctttcataacactaaggcgattgtatcattccatgttgataattaagggaaattcaatttgtatacatatgaacatacgaattgaatatgaaaaacttgacctctcagtgaacacgaattacgaattttctcatataataaccccttttcttgaaaatagtgtatataaattaaagtaaagttcaataatactacccatgcacatgcatgtatatacactgctacagttgcctttggtttctgtatagtggacgctgttcaccactagtttcagttaattaaaatcaagggattcaagagagcgcaactggaggatataatgcaggaattttgttgtacacccaaagaaatatcatacacagaagtacattacagagcaaccaaaacaaaatctagagaacttccagaagtacatatttaaatcgaattacatatctagctagcaaactgatcggtccatgtacctggccctcaaacagcagaaaacatcctttccaaaggaacaagaaatttgaagaacagaaaaaggatgggagcttcaaaagagaaaattcggaactagatttgaagaaattgaatcgaagaaagcagacgacatgctaggcagatctcgtgaagaaaaagccgatttactgcctctttaattttcggttaactgagagaaggggccggggcgacccccaagcctaaaccaatttggaagagcgcaggtagaaaacaaatcgtgggaaagaaaacaggccaatataactgcgtggcgatgagggtgcatgggtacggaggcgcgcggcagtcaattcatcactgcgcataaatctcgaaagcagatttagggaggcagagaaaaagggaaagtagcagctagctaggtaccagtaccactaccaccagccagccaggcagagagttcatcgatcctgatcttagcttaccgcgagaactgtgttgcagaagttgcagtgcacatagcacacatggtccgccggcgcgatttgggccgacgacattccttctgaccgatcggtcgtcgtctccgccccctgccgcgcgccgccgcctccggccgcacgaacaacagcagtgctctcgatcgatctcagctcccggcaaccagcagcaagaagaaggagaagaagagcgaggaggaaaaccgtaccaacagctacagctcagttctcagctagaaaggcagcaacaagctaggtttgcacatccatcctactgatatatatgtggagagagagagcgctagagtgagaactgagagacggtggaaggagagattgagctatcccactttcctcttttcttttcgcgtagagagagagagagagagagagagagagagagagtgcagcagtgcctttatttgctgtggtggcctt

SEQ ID NO: 5558 - DNA, 311 bp, Zea mays
ccctgcaagcttcagggcaggtactggcggcagccgatcccgtgtttgtccatgtccatccaatccaactcatgcacttcatcactcctagaggagtgcagaagctcgggaattgtacttccactactaaaaaatgtgattgatcactcgtttatcggcaaagatgtttctttgggagtgaataccgagaggctgagatcaccactgacggccgctgcagccacacggtttgcgtataaataagtagtcagtcgctcatcttgttccttgtgaacatcgcagtgctgtagcctccttcgtcttgagcgagc

SEQ ID NO: 5559 - DNA, 1500 bp, Zea mays
tcgaggaattctaaactagactagcggtgaacccccagtcggctgtctgtgaaggcgttatcttattgcatttcgttcagcactttgatttatgtttaagttaatgactatgtggatattttgggcatcatgatgtaataaagttatacttatttctgctattatttgagcattgtgtgatgatgtccaattatgtaatcgttgtgtacgtgaatttctgatcctggcacgtacatggttcgcattcggtttgccttctaaaaccgggtgtgacagcgtatgatggagagtctaaagcaacctactcttggcctgctcacagtggcggccctgagggtggggtggaggggccaccgtcctaggcccctaatgatatagagccacgaacctagttatacattcagtaattagactattagacacaatagcttaatagtaaaatatcgaataattagcagccacgaagcgttcacaagcctgtcgtatttaaacatgttaaaagaacttttaagataatactataatatgtatctttttatttatttgttgcttggtatgaatatttttagatgtgtcttgagtttatatattggtactatttttatataacaatagtttgatggacctctattttaaatttgtcctgggcccctaaaacctctggtccgccgctgcctggtcaacgtgtcgccctactcgaccgacaattacgcaaataataatttcgaaacaattaaatattggaagagcatctaatatggatgaaataattgtaaatccaacattaaaaagacaaattgatgagtatgataaaaaaaatgttcaagatgaagtgagatgagtgtacattcaaattcaattttttattgtacggtcactaatttctatatgcaatattgcatctgctttacagccttgtctagttattttaagattttgtttggtcccacgtgatttttttttgtcctgcttatgcaactgatcaaagctatatatactacctgccatatcgtttcatgctggagaagaacatcgtgatcgtgaatcacgcacaacatgttgtgattgggacgactccaaaatgagatgatggtcgacctacccccaaaacaccagcggagacgaagatgcctccacacagcgcgtcaagattcctccacctagacacaaggcaggccacatttttagacgaaaatgacaggtccgctcagctcgagtgtgcacagcgctgcaggtgcgtgttgtatacgtggacgcatgctttgcctcgagatttggttcctcgatcgtaatcgcacgaggatgacaaggaaattgtacacgttaatcaattaaactaacaacaactacaataaataaagaatacgaccacagcagcactcgtcaaccgcgtggtctctttaaataacccgcgcgcggctactgcagcttccattccatcacagccaactaaagagaaggagagcgtgtgttcgtttcgaggacgcacacacagacgcc

SEQ ID NO: 5560 - DNA, 875 bp, Zea mays
ggagcattaattgttgacacagtcagaaccaaccgagataattgttaacatagatgattcacgttgagtaacatgtagtgagtacgaccctcagtttacttgatggccaacttgcctttagtcaactgcccattgttcatacagtcatacagtttcatcgggatgagattcaatcctgttgttttctccatcttgatttgtcttaattttgtaggcacggtttcttgctagttgttgggggccttctcccgttgaatgaagctcctcaaagtagaaattgacaactacttctaagtatatttcaggtgttccggagcgataacgattaacgaagctcacttttgtttaggaccttcgcttcaacggctctcatgcttcggctccatgatgaaggtgagagccaacaagacaacaagaaaggattggaaagccaggaaacttgatctgcactgcaaaagaaatgatgatgatactcctttaagatttcgtagtttgactgtatagcaattgagagtatgtttgtaattttacaccgagatgtaatgtgagtcgccactataaatagttgtagtgttagggcatgtacagtgacgtttaatatggaggctcttaaggtgtttaaggggtgtatttgcaaaaaaatcttagagccgtctctccgtgaagagacgcctctggctcgtaaaccaagtagtaacagacgcctcacttcctactgtacgaatttgtcgtctgttctattgatctgctgctgtacaaatgcatttaattctgtatttattagtagactacatttatagacactccattgtataatagagtctcttagttgtctcttgtgcttggagaaccgttttggtgtctctccactgtac

SEQ ID NO: 5561 - DNA, 421 bp, Zea mays
tctctgcactcagtcgcgaccgccgcaacttcgtttcagtttgggggaggggacctggagcgggtgtggcggaagccgagaaatttgctattttgtcactctcaattttggctgcctgttattatgccatccttcttactggctgaaatgggctttcgtctctgtgtgccgctggcagaagcccttcttacggcccatcgtagctgccaattctcgcgtccggaccggaccccggaacgcgcggccgttcactcaagctctcgaataaaatttcccggttttccggtccggatcccaaatccagaaatcctacgactcgctcgtcctctcgtctcctccgatccgttccgttcgcgagccaccgatcccgccaacgggagcgaacgagaacgatcgcgtcgtcgtcgtcgcagccgccgcc

SEQ ID NO: 5562 - DNA, 1020 bp, Zea mays
cacaaatgaggtattgattgacaaatatgtataaaaatgttccataccacaactttaaatgcatagagattatagggaattaagggttatataaggcggactccaataaataccccactccttcaacaccccctgcaagggtgtacgtccggctccaggcggcgtcgaacgacgccccctcacgagggtgaggttgccttcgcccgtcgtggaaagaggatcccctttcattattcaatatatttaattgtgatttttttgagtttaattatctatagcaatatgtattatgatactataaatattatattattttttaaactctaaaaagtgatgtaaaaatgtcaaatagcttaaaaccgtgtccaacagtttgttcatatgatcacctaaaacactgatttaaaatatagatgtactgttcatatagttgagtttaaatatgagtatgaagatatgtaagctgttttagatagtataaagagtagagagttgaataggggaatagttggagaggaagtaaaatagaggaataggaaaatagttggagagaaagtgaaatataggaagtgtatttgagggaaagatatttaaatataattacagaataccaggatttgagaggtatcggagaaggtctaattgcttgctgccccacaattccctccgatctactctgtgcggactcggcctcgctttttcgcaggtcggggaaggcaaagcagagcacgcacactcatgctgctacctctcgtcctcgcgtcctcctgtcgtgtcggatccgagcaaaccactgcgcaccttcccttcacttcccccacagcgcgcgaggcgcaacttccggctatgtgcttgcccacgcctgaagtcgccgtcacgtccttacgcgtcaacggcacggccccacgcgggtgagagaggagagccccccacgcacccgcgtgaatatatactcgcgcggccacggcagggttggtgggagagcgaattcgagctggtcgaatccggcagccgagcgag

SEQ ID NO: 5563 - DNA, 1089 bp, Zea mays
caacccaagtcctagggttgcatcaacgacgtcttctataatctaatggatggacgaataaagtatgccatttcccaatgcctgtcacgagaaggtctccgaccctcccagaaatttcaactccaactcttaattattcaatatggccgcgcctactatacmactctgcccgtcaaagatacagatgattataaaactgtttggttcagtcttagaatctagctgtgaggattatgtgggcaggaaaataaagggatatttaggatctagaaagtgataaattcttttctatcgtaatactcgccgattgtatacttcttggacgatttttgtagaaacaatctgaaatagctagacatttagcactcagttgtagtttgtgacggccaaaatttggatttaagctgggtctatgctcctcttcgtttatgttcatggatgagctcctccagcttccaactttctatggtactactgaacggttttgacctagggtccctgccgcacagggagtggggacctgggggccgcactcaacgttcaaaacgcaggagtccgtcacaattcacaagtgccgaagtgcgtactggcgtgggcactgggcaagtgggcagtcagcacgcccctgttctcacttcacaggtcacagtggcgcgtgtggaaagcgcaggtcactcggcgcggggaaacacaggaaaaggctgctgcaattggcgctgccaccgaggcctctctctttctcggtttctctctctctcacgtggtatctcctcggccctctcgcctgtcctcgcacaccagcggtccaggagtccagccctccgcccgcccccctcccctccacctcccctcccaggctcccaccccaaattcccccctcccacccgtcggttctgtagccctctacatttctgggttttgggtcgtctccacgggctgggtttggggtcggtcggcggcggcggcggagctaggagtggaggcctgagatatactccaagcgggagtctgggcgctctctgcggtcggagaggcgcgggtgagatctacgagggccgctgcgtcgttctcgcagggccggcggaagac

SEQ ID NO: 5564 - DNA, 578 bp, Zea mays
gagcctttatcaattttagttcaaagatgaataaaaatagagccgatccaatctgatttttaaattttatagtgtaaaatttagagcctattgccacccctaaatgtatgcatatctttagctttagagcatccacatattttgtccttcacacaatgaacatctatagctcatttatcaacaaaagtatatgctggacaccagcatatgacttctaagaggctcacaatgcaagagggcctagtcatggtggtctaggaacataatcttgtcatacgtttaactgaacacagttttaaaaagaacaagtaaaaactaatgatgctaaaataagtttaaacaaactgaccaattgtaaatccagattttattcttttcatgtcacaagctctttactgttaatggtcaagtactgataatgtgataccttacacataaacgacgcctttcaacaggtacaaagacatttgcaactccgcattgaagcacaagggaagtacctacaatctgtgctagaaaaggcacaggagacactttcaaagcagaatgcagggtcagtcggtgtagaaaccgcgaag

SEQ ID NO: 5565 - DNA, 1219 bp, Zea mays
actgctcagtcgcagccgacagccctagttaggttagttaggggtatgtttggtttgacattttgggtgtggtttttgctcctcaaaagtgaaactaaagggctcaattcaaccaatagttttttttaaaaaagccagtttaatttcattgtaaaattgaaagcaacttcaaaatctaattttatcgtcattcagatgaaaaaaaatcttacaaacatatctgatagaacttttagtagcttccataaaacaatttatagctttttacagctcatacacacaacaacttttgttacaactcagagtttactacaaccttttttatggtcacggcctaactaaagagactctagacgaccttactatagcgtgagacttgccaggtatccggcaaatatacacgtagtattttggttataaaaatgttcattttcttatgaattatatttttcgcaatgataactatattttacatagagaaaagaataactctacaaatttaaccaccaattattcaaataatatacaattttaagatataaaacttgtttcaatttatttttaattagcaaacaacatttacaaagggatctatttttttttttttttgcaaacaacattcaaacggctatagtcaggaatctttaaatttatttttagtaaaccacaatatattttaaaagaaatttatcgtgaagatagtagttttatatatttgaaacacatttaactgcggaggtttattactatcttgttgtataaccctgtccatccatgcatggtcatggagcagcagcgtatctacgtgcatacgcatacggctacggcggcatacgtctgtcatgcaactgctggcctcggcagctcggaggccctcttctccggtgagatgtgacgcgagaaaaaggggtcgccaccagccagggccaggcagccatccaatcttcacacaggggcagagggcggtcgcgcacacctttcccttcccccctctcgttcccctctccttcccattaatatctagccgcaccttccctctctcacctcctcatcctcctccaactgtgagcgtacgttccacggccgccgccattagtgttgagagagggagagaagctacagggaccggacgcctccttccttgctgaccggcgagctttattttcaggcccctcgctcgctagggttccatcatcccgcccgctgttccttttcgtcc

SEQ ID NO: 5566 - DNA, 99 bp, Zea mays
attcaagacataaaggacaatttgatgctgttcaccacaatcagggtattgtaaacataactagctcatctaacagttggcttcctacattccagcaca

SEQ ID NO: 5567 - DNA, 248 bp, Zea mays
attggagcggttgctaggattaggcaccagttagcctatgcatcacacaggttctttgatgagaatggatttctctatgtacatacaccaataatattatcgagtgactgtgaaggtgctggtcagatgtttcaagtgacaactattatttagccagtctgagatagctgagaagtaattgagagagaacccagatcgttctgattttgaaattgaggcagctaaagttcttgtcaaggaaaaaggtg

SEQ ID NO: 5568 - DNA, 359 bp, Zea mays
gstatgttggytacatatatatgaattatgatacacggtgatctacctatttatgtgtagttgtcactgctgtggtatcacatatccacagtttgcctgctgttcatgtcctttattattccattaagctaatagtattgttcggttccaagcatatactatctatgtgccatggatagtcaaactaatggcaaatgtattttgtcgttctgttttttagatggatgcaaccactccgaaatactccaaggcacgttatgatgagattgtgaaggaagtctcatcctacctcaagaaaagttggatacaaccctgataagattgcctttgttcccatttctggttttgagggygacaac

SEQ ID NO: 5569 - DNA, 1186 bp, Zea mays
atcaatgtaacggtacttatgatgtaatcaactccactaattaatgtgtaatgaccttttcttcgttatgggtttcattttatcgtttcttcgaacagaatctgcaatatgacaatctgattatccaaacacgtaaattctcacaaacagcttttctgcacagctggcgaaccaaacacctaaattttaaccaccagtttttcccaacagccagcttttccccacaaccagcttttcatataagctggtcagaaaaaaaccgaaccaaacacaccctgtctcgctccgtttatggccctgggccgccattcggaaatcggaagtcacattgggctggtccggccactccgacacccttatataaagtcccgaaccctagaggcaagcaccttcctccccaactcgccgtctgccttstgcgcctccatttcggcctctgtcccttgcaaggtagctaatcctctgtcgctcgatctttgtccttgaggtgctcgatgagataggcagtggttcaaagctgtgctctgttgcctccccgtgcctgaagtgattcggtcttctgtttgcgattaattgtagctactgcgtctccattctcttagtttttgtggttttgtttgcttccgtgtttggatgacctgattcttacggatagttgcttctggatttgataaattacatacgcaccgtgccaccgtagttggacgacttcttaattgcgcttgcggtcgtgttacgtggtcttaataaagtcagatcgaatttttgaggtgtagagctgctgtagtttctatttgaccgatacttgtctttgtagttcatgcgcagtaagagttgtaacctcataatatgaccaaattcctgatctgctttatagagttgttgtgcctaattttgaattcgtcttactggctcaaaatcatgtgcgcacgcttattagtttgccctttattttctatgcctgctttattttttatattacattgattgctctgtttaatatttgcttctttatttttacactgcttatgtgtatcaagcttttttcaagctcataactccggcgacaacgttagatctagtttctgatcccatccgataaattgtgtcgttactggtagtattaatttactagtgtttctaatcattgattcgtcttgttaacagttcaatctcacctccaacc

SEQ ID NO: 5570 - DNA, 84 bp, Zea mays
tgtcacacccggttttggaaggtaaaccgaatgcgaactatgtacgtgccaggatcagaactcacgtacacagcgattacataa

SEQ ID NO: 5571 - DNA, 130 bp, Zea mays
aattatagactacgagtgatggtgcatagttattctttgttcatttgctgatatgcaaactgcaaattttgtgtagttttttaccactttttgatgtacgatttttttttaccaaagcaaagttcagttc

SEQ ID NO: 5572 - DNA, 553 bp, Zea mays
ggttcgcgcttagtccttctcttcatagaatccgatatagatatattcttgtattgctgttttgacctccgtagaggccttttgccctatttgtattggtcctctttggatcctcttatttcttcttaatacaatgatgcgcagttctccgcgcgttcgagaaaaaaagttaccgctttccatgaccatgagtttgatatacttttgctttgtcatgatcataaagtttgcctgtcgatatctctgcatgacttactgttaatgaatctttaggagctgagttttgatgcttgcatgatttgtttcatattgtacttcctccaattttattacaatattttgtttccttagaatttttttgtgcaagttcatattccaggccaggatatgaagagctcaatggcatagacaattaggcatgtacatgagatgatttatttatcaagtttgtgcactataacgcattgttgacctgcacatatttgcttggttgcaggctccagacacatttgttgcagcagctgctcgaaacccagtatgtaacttatcattg

SEQ ID NO: 5573 - DNA, 66 bp, Zea mays
ggagtctaggccccatcttctaaagaagttaagcaagtttcaacaacatcttctgcagacaacaag

SEQ ID NO: 5574 - DNA, 233 bp, Zea mays
ccaggccttttttctttaaaagtgtccattcaatacttattttaagtttactttgcatttggatctaacttgttatatgttttctattgtgatatctatcaaaattagagttggagacttggagtaggactgatgatttttgtaatggattgttggatggagtctacatggctgaacctgaatggcctggacctgaatggacatcatggtcaattggtcatggctgaacctga

SEQ ID NO: 5575 - DNA, 100 bp, Zea mays
gcgccgcccccggcccccgctgcacgcaccgggcgggggcccatgcggccgcgcggctccgcgcccgcgccacaccgttggaaccgagcgggcgcgctag

SEQ ID NO: 5576 - DNA, 1500 bp, Zea mays
cattcttgcctcatttgagcttgcatttcattcattgtgtttgccatctgttgtagcatctacatctaagagacaaccactagatttgtcctagccggtggatgattcagaggattcatttctggttgtggttgtctaacaatcctcctattgtgggggttggcaggtagaccgattccgcctcccttcctggtattgaccatctaggttagaaatacatggtaagatagaagtgtagataagacgagtaattacgagacatgatcttttggggggttctattagctaagtagactagtgtgtcacctactaatactaatacattatcttatggtggtacatgctagattgccctgctatactaattcagtcaatcaaagaagcaatcaagcatttaccatcacaacaaacatccaatcacttcaggtagagaaaataattttaattttgtcttaggtctcctatctcttttgaaagggtcataaatataggattccgaggtgtgaaatcctccttgtcttagaataaaaaagataagagtagtcagagtagaatagcaaaaggtgagacaagatcaagaagtatagaaagaatctgagtaaggtaagtaggtaagggttttgtctagttctatctaggtttcgtcctacagtcaatacatctgataccacttctatcacacccggatttaagggataaagccgggtgcatctcatatgtgtgccaaagaagaacatcactattgggggcctttctctttccgaaggtcctaaaaaatgtgactaaccatatgtttttagtataattatgaatagttacaggaagctttggctttggaatggagaacttctctcatgatagaatgaagggaaataaagggtgggcgacgaagctaaaagccaaaggacttcagctagacatgttgacgaagctcaagtatgataacgactgaagaaggatcaagaccatacaatccttaataattcttgttaaaatatagatagttaccaggggacataacatacttttatccgggctgtgtcccgtgcctataaatagatgaacagtaacaccgtactgttcacactggattgtaatcgctctcgagccattctcgctctttcaccttccggcaagccgaatgtaccattgtaatatgaatattattaacgtttattcatgtttaatgaagatagataaatcataaaatatatgccggatattatctcgattcctctgtattccttcatcttcttatttatattcatattcatgtttatttcatatcataaaatgatgaaggtgtgtccttcatgacctttgttcgaagatcattatatccgagaggaaataatgtttcgaaggatgaaggcctttaaccataaacaactgtgttgccttgttcataattaatagcatttgagaacaagtgaacaacatttggcgcccacctccaatgaactcccttccacaacctttggaagagcatccattttcgac

SEQ ID NO: 5577 - DNA, 1500 bp, Zea mays
ggaacttctagatttttatataagttttcatgattttatgattttttttagattttaaattttttaaccgaaatcttcgaataatctcggcggtttttattctggcgcgtagcgagaacgggaaaagtagcgataaactgccaagaactcgtcgggatttgaaaccatgctcacaacgcactctaaagtcctagtgacttttggcgctagtgatcattgatcattaaagtgagttgattgaagatactttatttgctataaaatagacttctttggaacatgatgtgaattctacgcggttaggggtcatatcaattagcttatttgttttcgtgttaggttgtagtctattcgtcttacgatatacgtcttataggctgtatacggagagcgatggtttcatgtattctttacaaccagtgaactttgcttatgtagcaaagattgacggttgttggcaatgttttttttttttttgcgccaacaattcacacggtgttgctgcagcggcgtcaaggccgaatgggaatgggattcggatttgatcccttcgctagaggaagggcgcgtggaacgaacgcctctgcactgcaatctccgacaccaccagtgtagctgtagcatggtaggaaataatcaagcgcatgggaatcccgaggcggcgtttatctatcgcggaggccgagatccacgtgccgcgtgagaccgcagttaatatgtttctgtgaatctcgatgctgcatggaggccgtggcgtaactagtagccggatttctaccgtgccgtgccgtgcgggtgaaatcacgagccagcgtccaaaatgccaaatcactggctcggctaccgagccgctgtacattcgctgaaacctcatgctactattttcttttgtctgccgtcacggactcactgcgacgtgggacccaaagaccaggcggagatgacaaacgtgagcggcagccggcaggcagatgttgcagcactacagcggcgcgcgccgggtttttattattataataccgtatctaaaattaccgctttgtaatatactaatagatgaattgaagtttaaaacaaaaggtggaatatgagttgccaatgtgggataagggagccgcttgagatagcgttactaacgcatagccggaatgtactgcatgttcaccgtacttatggctcgcatcgtcactgttttgtgtttcttttcgctctgatccagctcatcgtctataaaaaacactcgtccctctcgttgccccgacccgacctccgcctctgcctgctcctcccgctttcctcccagctcccatccccgcaagcccaaacgcgacgcgacgcaacgccacgcgaacgtgacgggagcgagccacccgaatccaccagaccacgcgcagccgtcacgcccgggcgcttctccccccccgaccccgtcctcccgtttggcgtctctctctctccgtcgcgcgcgccacgcgaacggcacctaggcaagggggcgcg

SEQ ID NO: 5578 - DNA, 942 bp, Zea mays
tgtggttggagttggacatggtcatggttaggtccatgtgcacagtgtaaaacactgacaatgcaaaagatgataagaaatgcagaagcaaataaaagccaaaagcatagaaggccacaagctaaataaaataaacataggggtcaaataaggtactagacgtctagaccagtagacccttcctatgcaatgcaatcctgacgtgcttcagtaacccgcctatttttttattcccgactaaaaccattttctttccacaaaaagattacgtgcgaagaggggagctcggaaaaggaaaaaaaacgaatgaaaatggaggtagaagaaggttctgtgatgtgaggggaaattacgtgggacattagacataagccaaatccattgaattctctcgtcggttgcttgagccgagttcgtctgagtggcctgctgtgaggagcaagctctgcgtcttgctattcctgactatttttcttgccttttgtctctgtttccaagcgccatcctaatttctgaaggcctcttggagcaattctctgcttcatttctcgggcgggtataatcactaatttctctgatttatttgccaaaaccttgctttctccattgtttcctcttttttttattgtgattttacggcttcttcctctcgttttcttttccatttgtcctcgtttcatccccgccgttacaagctctctacgctgtaaacttcgctctgttcatcgtcagattattcagctttgagtagcgctgagtttatgcctttatgggttttgcagttcctagcttgcttcgccggttgtaagatttgctgtgaaatagaagaagtgaagaactgcagccttcagtccaagaagtctctgtagagagagacagagagagctgcagattcgtagcccgctcctgcttccgcacacttgttcagtgtggaactgtggt

SEQ ID NO: 5579 - DNA, 346 bp, Zea mays
tggtccccactcgcaccatctgcgtcacttccacgtggtccctatataccgggacggtcccacatacgacgactccggctcgaagtcataccgtagaagactccagaacgttccctgccatgtgggccgtacactggtccaggccccgcgagtcagtgatgtaccaggtgacgtggctctctccgagttccaaaccctcgccgcaagaaagaagctataaaggaaagctaatcccccttccttgagtcctccgcatctcgcattctcgccggtgctgctgcaattaacgccacccccggccaaccgcctgaaaactacctctgccgccggcgccgccatccccaac

SEQ ID NO: 5580 - DNA, 620 bp, Zea mays
tatttctattgtatatatatagactggtctgacacattaagacattctwggctatttgggtcgacctaacatagataactaattgtaggctatgccctgagccgattactgagtatgcgggctggcatagaacgactcataattagagatatgattttacaggctatatctttataagtcgtacgcttataagcttgtatcgtgccgtgccagacccaaacatacgattgacacagacacactagagaaggaaactggttgtagtcgttttagggaatgtttttccttcaaaattcgaggatctcaaataaaaaaaaagtcattccgactacgtgcctccctctattgtatggtaggagtatatactaatatacatagttgtgatctgccatgttggccggccggcggccaggtcttcggagttccggcgcgtggtgccgtgtcgtgccacagtttggaaaactgctattcgttgtcagttgttggcttgttgccctctcatgtcatatacgtactgatacagggcgtgccgactttccagggcgccaattcccctccaagatccgtcttctccggccgctccacccaattcgtcgtcctccccgcctccggatctgaac

SEQ ID NO: 5581 - DNA, 1500 bp, Zea mays
catcaaagcgttagttagctgaaactgttggattgttggccatcgtagcccattaggtcacaatccatgttcggtgaacctggcacttccttagtgcattagtgcatgtataacctaattaaatgagatgtctcttgagaggtctctagaaggttaagtaaaaaaaattaagacggactcttcacgaaaagtttgttctacatgactctatacatattgtattatgactgtttttatgatttagagactcaagattgtattatatagtctctttgatgttttttttacttaaaaaatcgagtcagagtctctagattgtacatgcccttaggagacctatcccttctcatctgtgattttgctggtagtatctccattgtgaggctctacatgcatggaccttgcaagagtaaggtcatctgcagcagtttacccaaagtttaccaaaaatactatgttgcattgttctgcattgtagaatgcactgttcgtagagtgaagtttgaatatgggcatggaaatagataagctgcgggagatagcctaaacctctaagtgatgtgcaatcacatttatgggagtgtcatcgacactactgttcgatcgacactgctacaattctgcattgcgtcgactgggccaattatatcaatcaaccatatatctgatctaggctatggtccccttttcaattgttatcaattatgcatatatccattatattcatagtaaacatattacatcacacgtatacctaaatgtgaccatggactctaaactttatactatataatttaagaatcatatcgggccatatttctatttacttttaaactaaaattaatttgggaccctaacaaaataaattgtaaataaacatttagatcttgataatcgattactatccctgcgtacacctacatattgtcattaattatgtaatattatttttctagattaaaatataactagaaaaagtctactgtataacagtaattaggctaattataatcctgcatataagtataaaatctaacaaagggcagcacacagagactgagactcaaacccgggagcggggacgagacgaagaaataaagccactttaatttggccaaaacgacgcacgcaaagcatgaaccgctgccaacgcaagcaggtgcatcgacgacgacggccgtgctttgttcctccgacaaccgataggatatggccggcatgtgcctgacgaggcaccacgtacgcatgcaatcgctgcacgctccaaaaagtgacgcgctccgtcgtctcttccggttccggccacccgcgcgcgcgttataagcacccttgccgcccgcgccctagctctacaagcctctctcacacacacacacatcgttgtccaaacaagatcggcgcggctcacgcggcctagctcgccggcctaacgaggccggatattccttaacctagctagctaacagctaactagatagatcgatccatcagctggcagcc

SEQ ID NO: 5582 - DNA, 188 bp, Zea mays
ggtttgtaacagactgctggggtgaatacacctactcaaaaaaaaaaaaagagagaaaatgggaaagagacaaagttctcgatgaattgaagtccatatgtcaaaaacaagagcaaggagctgttgtacaaggggcttgtggaaggagcatatcatatatttgtaggagataactttgcacttgactc

SEQ ID NO: 5583 - DNA, 59 bp, Zea mays
tgtacgtgccaaataaagctcgtcgtcagattcagatacgtacagtacagtagccgcca

SEQ ID NO: 5584 - DNA, 1428 bp, Zea mays
gcactctaggtggtagagctcgcttgaagggtggctaccaacggggagagtgggggagcaagagcgcgcgtgtcaggttcatcctgtactgactcatcagttcacgccttgccatgtctgatcgtgtcctagacgataataagtcgacaggttcaggctaggttagacagctgctcccagaagtgtttgtttgacagaagaaaaccttacgtgtcaattgtgacgaccgcgtgccagctgcttatgcaagtataaccctgataatcagacaagttttctgttgaagacgataccagaatcttaccgctattgctccaacccagtgccagtttggtagcacgccaaatgtgatgccgttgcgagaagaagagcaatctcgcagcgattggtccagagcaaacattcctctccctatacgcaaagcgatgcctggctccagccaggggtggctcactggcctttctcaagctgaagacgatgaggcccccctcggtttttggatggctccatgggatccatgcacagaagcagccccacggacattccggctgtcatccactcctttttttttaactttcccatttgtggcatcttatttctctttggcacttggcaggccagaacattcaaaagtgccgtgcgggtcatagcctaatcctgccccacatgccagtgtcactagttgcagatgacccgttttttctctgatatatctccagtctcatatatctcagtctatcttatatataagccggaatttttattagcaatctcaaaatcttctggcagcacaaaccgacgttaacagactttttctttgttgagaacctatctttacaatatacatcttttaaatttaaaacatttatcttttagatattagcactacactagttaatgctttaaaattgggttcggacaaaactagatgcactcgactcgcatctgtagttgtccaatgcgcgtgctgaagtcaaaccggaggcttcctgcaccgagtccatgtccactgttcccccgacatacagaccccgcacattggttttcccctcacaggcccgtagcctctgcccacgcagggtctcaggcctccctctcggctcttgcacacggacaggccccgtgcgcgtacaaataagccaagctgggcggccatccacacgggcgcgaacttgacacgcgccccctgccccgccgccgcagttctcacctctcacggccacgccggcacgtccgctcgcgcgcacactgttttttttttcttggtaagggccggcggccgggccgataatcgtaaaggaaggcgaggcaatacacccaccgagagagaagaactaagctttggacacggaagatcgcaagagcctcaaccacactattcaggtggcctaggactctacgagggacgttcgtcgtgcctcggatgag

SEQ ID NO: 5585 - DNA, 118 bp, Zea mays
ccgtcgattgttataacgtccaacaaaggccaagaaagctgacaattcatggaagtgatggcaatgatatgcattcttgcttaaaggccacgaagatttgcggcaagatgaacgagta

SEQ ID NO: 5586 - DNA, 1111 bp, Zea mays
  unsure (1)..(1111): unsure at all n locations
agcattcgagggcccaaaactgggccgccgtcccgccgcccgccgatgggccaggtcaccgatcccgcaccgtcaggtcgaggatgtccacgtggttccactctgtacgcaacgcaaggcgccgttcgcacttcgcacgcaaacccctcctctcctctgctgacccctcctctcctggtctggattccaccaagccgtgtccaccaaccggccaccacccccgctgccggctcgcacctctctgcgccgtgctcagatttgcccccctctgcctgcctgcttctactacctgctgacacggcggtgcgggtcgtgctcggtggacgccagggggctacccctacccgggatccaggatcgtgctgtctgctcgccctctcctgctccttcaatcccatcggagatccgtgctggcgtttcctcccgtaagcccgaccacggtcaacatccaatttctcgtccgattcatgcaaaaaccattatgggccccgcgtaccgtgcgttgtttagccatcttgaatttccatttttttccaggatcgatgaattagccttgtttaggtttggcggaacacgtaccgtgcgttgccaaattcgagcattttgctatcattatatttgtcatgaattttaggacccgttgatggattttatttttctttgggggagaatggagatggggattntgaagttaaattcatggtcctgcttgagaatttttggggttagagtcctacataggggtacaaatagtcgataaaatgaaatatatgtggtattgatattttttcgtatttcaatgttgccgaagccaatattcctagggccacatgccatgatactagtagcatatctgtgaacgcacattgtgtggtagtgatgttgacttcctcaaaatcttgtttgcaggatgtgttcattttcaagtattttatcgctttgccagaaatcttttttatgatgacttaaaatgtctgtagcatattaatcacaatttttagacttgtgctccgtcactacatatgccagacatatattgaagctcatgcagctcctattctcaaacccagtttcagcgcccaattgtttggtttgaagaaatcaagttcag

SEQ ID NO: 5587 - DNA, 89 bp, Zea mays
ctgcagagtgcagtgtgcagacacccgaggagccgagacagagaagcagtgaagggaacccgcgcgctttctcccgacgtgcaccggaa

SEQ ID NO: 5588 - DNA, 275 bp, Zea mays
ggtgagtgactcgtattgtttgctgacccttccatagtcatatcagccgcagtagtgtgttcatttttgcagagctgttttttcatatcagtggactattaaaaccagtaggggtggagggacacgtttagatctcttatgaatatgcttggttagggcatctggttattatactaaattaatttagtagacttgacagcctgactcctcattaacctgctcggcctgcttctgtgtgttcgtctgaacatgtgtatacattttttcttctacag

SEQ ID NO: 5589 - DNA, 1500 bp, Zea mays
cgagtctgtcaagcccagccggagccgccaccgccaccgcctcgggcatatctccaatcagactcgttctccagagtccagaccgatcttccgattctctaaccacaccgtgtaccttacgacttccttccgtctcgtaccgacccccgcaccgccaaaccctagtccacggcggcgaggcgaccttgcgacctccgttcctctgcgctccggctggtaagtaggctcgctccacctctccttcccctctccgactcgctatcttccacgcctgcagcgtgcgtcgattaggttcaccaaggcgctgggggcgtctcggggattcgacgctccgttggatattctagggtgcttcgctgcgcctagtctccgaggtgaaacccaggtccctgcctcgctggccgcgcgggtgcccgcccgcctcctcccacctcagcaccgcggcgcatctcctcctccggagccaccgatgcgccagccccttcttcatgggaccacggagtcaccaccggacgcttcaccatgcatgtagctcaccagggcctccctgcgcctgccttctcacctcgagcccggggctgtggtcaatttctcgccagatctattactagggagcgccggaatgtttgttttctatcagtagaattagtgatgtccgcctattgtttcgtgcgaagtgtagtactagtttacagctcttggttcttgcctaccagacttagtgcttggtattgtgctgtttcttgcttgttattgatatatacactttctctataatgtactcggttgctagtgattggttgtcggttaatcttatctgttcgttttttcaggatacgacaatagaattttgtatggtataatatatgataatatggtaaattggctgaattggttgtttgaaactgcaaggcttatctcagacaactctcttaattggagccattagaactagagatagcatgatgatctgattatttgtatgtgtgagacataacaatgagagacaaaactagtgtttatgtgtgacagtgagagaacttgataatctgattatagaacttccaatggtcacgtactgtctatgtactctagtaaaaactgaactacagatccgatataattatgcaagttactttctacatctagttatctactgttagtttgttatatttagtgtctgaagttgagaaaccataatagaaatgtacgaaatactcttaccaaatgttttccttgtattgtatttatccttgtagcaaaagggttaaaaacgttgagtctgaatgtgtatgcatatgttctaattctggctggtttgaggtgggatcctatattattattattattattatcatcatcatcatcatcatcatcatcgtcgttttattgaagatatgactgacctcattagttccttagtccttactgatcagaacaagtttattctttgcagagttgctgatttgggataatcctgttctctctgagtgaatcaac

SEQ ID NO: 5590 - DNA, 891 bp, Zea mays
ttgctttggaaaattgaggcattttcggactgatattttgtagactgataatttccatacacttatgctattactgttctaatttggaaaattatcaaactgataattttacagaaattgctgactcggaatttaggcactatactaataatttgtagactaataattttaaagagcagtaataaattgcatacacttatgatgctatattggtaaactgaattgttctactacatataattgtctattcaatttttttatcacttctatttatatgtattagcatatactcatgttttataggtaaaacaacactcttttaactgtttaaacttatcggtcaaagactcgcccgaggctcgagcaaattactagttgaatagagccgttgaatagaggctagaatgcttggcattggacacgatgacgcctagtatcaataaattattaatgagtgctgttgctccatcgctttttgctacagcgacccggcaggaaaagaaaaataaatgaaatgaaatgcaggtccgtcctggttttccagttcatatcctcgtctctctctggccgtctcctcacctcacggatcaacaggcggacatagcagccgtcctcgttctgcctcaggtccttgtctttcaaacttgtgagttcatgcgttttgatttggaaaatactgaagctgaatttatgcatgtacccaattatattttcttttccgcttgcatggttaaatcagctcttgacttgacactgctgtttcaggttgattccttgttacatctcccatctgcatgcagttccgcaatgtcataggatgcctacatcaacaccaagcaagcaagcagctagctagcgtggttagttatatcttcaaatcagtctacaggg

SEQ ID NO: 5591 - DNA, 1108 bp, Zea mays
gtctaagatttccaggtgactggtacgtattggtgatgtccctatttttttttattttgtatcaataattccttgacgcaatgtactgagttaactgaaataaaggttcatgtcttgactatgacttaatgacctaactgtaaatttctgaacatgactagtgactaacattatatgttatgtcaatcaggcatgatcttgaagaaccaaaccataaatgcagaaagtggaggcccccgcgtcgcccccgcttgggcggcgctaaccgtcgtctcctcctcttcctcccctctctacctcgccgccgtcggagctagccggcgggttgttcgcccggctcgtgaggaaggcggcggtggggcgtttcggcgtgtcgtggctcgcggcggcggtggcctgtgctcgcgcgcacgccaacggcggtggcattgctgtgctccaacgcgtggccgaccggtttggtaagcatggcggtggtggtgacgaacaacagggcgagagcggagctggcgtggctgcagtggcgggagcaggtgccccggagttagctgatggcttgctcgcggcggcggtgtggctcacgcgcctgctcttccgtcgagtagtggcatccccggcaatcgctcttgaggctggctcgcggcgccgctcgcgtgttcgctgcgtgcgcggcaacacacgcggggaggagtgggctatgtgggctttggtcggcggcggatctggcattgtcggcggatctaggccccatcggcctagatatggcccaccctcaactgatctacgccttggcgatggttgtcattgcggggtgcatgttggtgcgcaacggaggcggtgcgcccggcgacagctggtttcgatgtcgcgggtgccagggccagtggcggtagctcaagctggtttcagctctggcgagtgggcagtgtggcgcacaaggcaaggtgttccctggttccatgtgcccaaccggaagggatggcagccggcgcagctttgcggctgctgcggcagccggcacggtgcccctctggaggggtgtgtgcggaggcaagggcggtggcgacgacagaggctgcatgctttgacctagggtcctggactagcg

SEQ ID NO: 5592 - DNA, 552 bp, Zea mays
tgttaaaatacaaatgaactcttaatacatttatacttttataaaagcactttttatgataaattgatgcatataaatattaggttccaaaactaaataacaaaatagttatttgtagtcaaaattttataagtttgactcgaaccttatccaaaacgacaactaataggaaaccggagggagtacgtacagggctccaaagcaaaaccataccaccttatccatttacgtacacactcacacgtcgtcacaacttgcaatacacacacgacagcttgcagatatatagccttcacgatttgctatgaccggccggcatacagtcccatgttgtgaagcctaagcttcctctcgtcagaaaggagctttgcaaaccgtgcgagcatagcagcataggttagtagggcacggccatctctcggcgtcgtctcgacgcagtcgtcggtcttataatcgtcctcgcctactagtggcttatgcagaaggttctctgcaatcttaaccagccctcgcagattcttctccgtcgagaggtcagctgccacagccgct

SEQ ID NO: 5593 - DNA, 1171 bp, Zea mays
gatattttgatacttttagatacattttttactatgtatctagatatatatagcaaaattcataaatctaggaatgttaaaaagtagaatgaactattaaataacaaaaaaatgtattccatctctaactctttccagctgttccactctttgtcagtgtgccacagataatttcccaagttttaatctatcgctcactatcacatttgttaaacgttgtcttgcctagctcaacaacatatcataaggcttagagatgacaatatgtaccaaaacccgaatacccaaagagttttgatatgaaagcgggtataagataatttatttacccatgggccataggtatgttaagggcaagaacatctatccgtctaatagatgggtacaagtacgagtgatgaatactacacatactcatacacccatagataaaatatacccacaccataccactattatcttctaataagatcgtgttcatcaggttacttttgcattgcagactgtactgtttatatagtaaagtttgaatgtaggaatgaaaatagataaggtgctggagatagtttaaagccatcttagctacaagaaaattcttttctagctactatttatttaagtcatatggtttgttatattttaagttgatgtttgtttggaacttgagtgactggtatattagaagttaagattttttcttagtagtatgggttactctacggataaaatgtattcgatgagcacgagtatagaatgataatacccgacgggtatataacagggtatataacagttrccattcctaataagtctgcactgcagtcagacattccagtcgatttgcaaaaaacgccaatgcaattatacaaagtggtgaatgggcataggaagaaaaagatgccgcaaattttcttcacaagcagccgaacaaaatcaacttgatcatctaaatagacttatgatatgtgacagtgaaaagctttatgcaagcatcattgctgaagaaatgaccagctggacaacaaactgaaacatattaggacttgttcactgaaacatattaggacttgttcgattagttctcaattcatgtggattgagtgggattggatgagtttaaatctcaagcaagtcaaagttcttctaaattttttctaatctcatccaatcc

SEQ ID NO: 5594 - DNA, 953 bp, Zea mays
tccttttcaggcggaggaggaggtagtatcctttttttctttttcttttttttccctaaaacaactaactgagcagtggagcgccacccattgaagcgtttttggttcatttaaatgtaatagtgcaaaaatggagaaaaatactaatgctctgcacattgacatcactaaccgtgacagtttcgcctttctcaaatccgatgagcagtagcgcctgaaatccacatataagagcatgatatactgtaatttcagtgtttccacgtagtcacatgacaggcatgcaacgatttagaacaactgcgtctgcgaggcgcaactcaccggtgggccgtacatgggatcgtccgcgttcaacggcacaaacttggagtcctcttccatcagctcggccggagctcctgagacgcacgggtatcatcacacaagtgaaccgaaaccgagtactgccaaactagctgaagcgcgcagccttcgccaccacaccaagcatcttaccttcggggggcagcgatcggagcgggccgcgccactggcaccatcgactcctcagtggcggcaccgagatggaggagggatcgctcggcacccgcgcacgatgaggggaggtgaaagcactggagagtgcgatgagcgggcgcgcgagcaaaacggcggcagtgggtgttgcagccatcggcgagaagggggaagacgaagatattatcttcgcttctggatagtggtctctctttcgcggcaagcgccagcgcggcaacttggcgcgttgacgctgcacgcaatttcaaccgtccgaccagcatcctagggcttcctctcacgagcggttggccctgaccggcccactcgtctaccacagatttggagttcgaccacgacgacagaacccgccgtccgacccattcacccccgtggaccgtgccggtgccgcggcacgccgccgccgcaacgcc

SEQ ID NO: 5595 - DNA, 720 bp, Zea mays
cccctggtgtggtccggacttcaatcaagcgaaaagcagacaaaaaaagcgtgcggccgctaaaccgtgaaaatgccccggaaattcccggtatttaccgcctactactggctatggcctatgggtaggctgtaggcactggggtctgggtagcagcccgaacgcgcggcgcgaccgcgagcggccgagcagcaccagtgcacggtgcaccacgctcgcacccaaaggcgacagaggacggggacaaacacagcacaggcgcggcacgcgcgggtgccctgccaccactgaccgaggtccaccaggcccatcccgcgccgcgtgacgcgacccacgcagtagctgacgcttcggacccgctgctggtggggtccaagagtcagtgagtgcgaaagacagcgaaaaagggcagtgagggtgagggtgagggtgagaccgagcccctcgtcagtcgtcacgccgaccgagcgctggccgccaccactcctcgaggcgagcaccagcaggaggggcagggcaacgactcctggtagatccaccacccgcccgcttggtcgcccactccgcctgccttgctccgctccgctccgctttgcttctgctctctcggcttgcgggagtttgggccttggggggcgcaatgcggtgaggtggaggtagaggtgggtgaaaggaagcggagctgcggacaggagaggagaggagaggagaggagacgag

SEQ ID NO: 5596 - DNA, 422 bp, Zea mays
gagctaaatgtcgtgcttctaaatattttaagccatataaatttgctctaaggaacgagtgaaactgattaatttttaccatataatataatatatatgagtgtatgcatgttaagaattaaaaaagtacgataaaactaaataggaaagaaaactagatatcactcgaagaaaataaattctacgtacaaataaaggggtggctcgtgagatttgggaggctcggatttggtttctggtctcagttgcgttgtgggtgatccactcgttcttccctccacgcgccaaaaccccagccacggccatctcctcctccactcctcccgttcgtccacatccaaaagcttcccaggagaaaaaaagaacagttatttgcagcgggaaccctaacaaatcactcgctacaagcgagcgagggagag

SEQ ID NO: 5597 - DNA, 1500 bp, Zea mays
ggcgtcgatctggacgccaaacactgaaacgaaccacgtgctctctacggagccgcggacgatccgcggccctgggcgcagtgcacgcttccggacagtccgcgtcatctatataaagaggggacatctggacccgttacaaatcggtttctgagcctaattgattctacgcacgcgcgtaccgtccgcctacaggctcagacagtcccggctgcccattttgggactgaacaaaggggtttcaaaacaaaaaaatctaatactgatctaatatcaaataggaagccagttgaatattgaattgattcacagttggtgctgcaattgatcagagacccagagaattcaaacctgttcagctgctcttcttccgttgttcgctgttcggtgccccagcctccttggtgggacggtttctcggcaccgcactgccacggtgccaccgccgccgacctcagtggctacgagcgcgacgacgcccctggctgccccggccccggaccgcccagccactggccactgcccgcccgcaggtgcgcgacgcggcagccgtccaagccaagccaagccgaacggagagctgcctrcctgcctgtcctccaccgcctcgaacgagcctcagcagccagcaaacttccacggagctcgcctcgatagcgacggcgagacgagagtataactgtttaatgggccggatcgacactttgggctgactctaaatacgtagagaagacgggacatgtttgagtttgagagccattcactaatttcagcttccgtttttcagcttcaacaaattattgaaatgggtttgagaagtatttgacatgtacataaactcaagcttctataatacaattaatctgtataagtttttttattacacttcatgattagtggctctcaagaaccgaagcgctatggtgttaattttcatgtagcttcatgaaaagtataaaaacggtgtttgtccctcgaagagcttcgtgaatttcgtgaaagttgtctctaattttaagtttaagatttttaaagttaaaggtcgtgaagctagacctgtttagatagaagaagttagaataaacctaattttttttaagtgaagcctttccaaacagtccctagatacgtagagaaaactcccgtcggtttcgtgatgaggacaaaaaataattttatcaactttgcactcaagaaagcaacgctgaaatactgtaaaagaagaaaacgctgaaaccatcttcttgcacaggaagacaaatcagcagacagcagcactctttcgtgcagcggaggaaagaatcraggcccttcttgaccgtccgatgaaagatccaacgcccacgatccccgccgcccgcttcacatagccacgccgcctcccctgtccctttcattggccttccgcctccacttgtacacgcctccgccacccgacaaactactcaataaccctagctaaacccccacgccgccgcggcgacctcctccgccggcggg

SEQ ID NO: 5598 - DNA, 1162 bp, Zea mays
ttatttcagcccgttgaagtccataaaatttggttaggcaagcaggagcgttggatgcaaggaatgcatgcatgtagctgtactgcaagccggtgcagtaaaaacgctaagtcaggcgatccacgtccgcgcacattgggtaacgggaccgattccaaccatctgctcatttttgctcctttttctcctcgtattttcctatggtttgcatgggtcccaattaaaaattagattaattatatacatctcacttaacatttacaaaattaaatagctagttcaattgaatttagtggtattgaaaggatatgcatatacgataattgtttatttatgtgtcttttattgaacaaaactttcaactaactagttaacgggtacgagaacgtttcgccctcatcatacccgttaaccccgtgagtataaaatacccggtataaacttagcccccaaagcataaacttaggctttaaccattcatctcttttgactatttaacaaccttttagacgataatgtcgtaaaaagattaacaattatttgatgaccatgtaatgggatatgtaatgtgttatctatggtgttcttgaatagagccgtctgattggtatcctgtatgacagtggcgaagctagagtaaaatagaggagggtgcaaatagcttaagggtgcatggtaataaccgatacgtggtgcatatatggtaaaaatcttgtctgagtcactaattttgtaaaatttcgcgggtgcatatgcaccccctaccttctacctagttttgccgatgctgtatgagtcgatctagactgatgagtgcgtgtattgaccaagcaatatctcttgtttggttaactaaatatagcgagggtgagtctgccgcagtctccacgcaacgcatgtcaaaaatatattctccggctgcatgtatggtatggatacgccagaaaatcctgttctcgcgggccacactcgctgcatcccgccgccattcgcctgtctaaccacagccgatatataaaggaggtcacgtcgtcagggccaagtcacggtcttccattcgttaactcgttttcctcgttcccaatcatcttgccgcgcgccgcacgtagctagggtttcgtcctgtcgttgcacccgcattactagcattcaatccacacca

SEQ ID NO: 5599 - DNA, 1500 bp, Zea mays
ctttctatgcaagctccgctctggctttttttccttattttcaggaatagctctgaaaagagtattctatttggttggaaacacaacttcttatgcgaagtgggcttgacgaagataaaacatgggagagcgatcagtagaagctcattttctggctcgagggcttctgttgctttttttaagaaactcctccccaaagaactcatcaaagagcctctcttttttatagattttttatagagtgttagaggagccctgccaaagcggctctaactaagggtcagtttgtacatgcatataatttgcatgtgccaatgcatgtggacctaatataaattgccgtgtacgttatgagggtggacctacttcaccacttgataaagtcatgcactcgatcatgcagaagcgggccggccgggtcaattcatttaattgacttgcgatagagatagactaaccaccatcagtatcgcaataacagagaaaatttaggatgtggttggttggtagcgacaaatctctcacaagcctcgtagaatttactagaatcgtagagtaacaataatatcaaaaagatacaagaaatgtatatatatacaggcaaacgagcctttggccggcctgcccggctcggacccgatgaagtctgttctgttttaggctcgatccgctagacatggttaaaaaatcgggtcgagccgtctaagctcgcgggctcgtttccctgttcgagttcggcccgctgcgggtgtcgggccagtccgttaagtagaaaaaccgggtcaaacagtgcggtaagcacggtttaagtacaaaaaacgggtttaaaggtaaacgggtcggactagcccgttatgcttagtttcctgtccgagtttggcccgcttattcgtgctggactggcccgagcccatataaaagtgagccagaccaggctcatatcaggcaaaaaaaacttgctttggaccgagctttcgtgcttcgtgctttatgttcatctatatactatatatagatgtagctgaaacgtagctgtcatccaactctggcaacctttttcctacatacacacggcggaataaattgccttgagtgagtcctatagtcaaacagttcctccaggtaatctatccttgcttttgaagtgtcaatttctatggttcatgcatcatgtgaaggagaaagcgcgcaggtagttgctagcaaagctagctagggttggttagtcgttaactagatgacagcagctagcagtgaaaaggagctcactctcactgtctcacttagctctgttcctttcatccaaaacaaaaaccaagatggggggttgggaggaattgaagaggattaaaccctgcttgttaatgagatcccctcagcgccttccaatataataataccgccggacttccatttcgagagcaaccgaacgaacaaggctagaagctagctagccaagttattaggtactacatactagtggccggccggacacgatcg

SEQ ID NO: 5600 - DNA, 450 bp, Zea mays
cggtaccctctgtttctctcaaaacttacctacgtacagagacgacacacacggctgttatacggaaaccaaaaccttgtcgatccggccggctgctgctgcgacgcaagccaccaccatcaaaattcaaaagcccctgccgaacccgaaccggccggcgcaccagcaaaagccctcgacgtcgctcatccggtccggcccccctttccacctttccttaattgttaagtcccctctgccagtgctagtggggcttcagttccgcctttaaaatactcccccgacctcctcatcccattcgttccattccgtgatttccatcccatcccacaccaccaacagccttaacttctctctctctctctcttgccctcccggccctctccaagcgcaagtgaggcaaaagcaagccacagtagtgctccgcgcgccggccgggggcggcagcat

SEQ ID NO: 5601 - DNA, 1500 bp, Zea mays
atcaatttgaaggtaattcattacgaaatatcattgtttgacaatacataataccgaataataagttcattattacataacttcaaataaaacaccaagactactgagtacaacggggccatttgcctttgcgaaatgcatcagggttctcctccattgcttcctttgcacgacgtgcgcgctcaagcttcttctccttctcttccctgcattcagcaacacacctcatttcctgctcgtcttcacgttgttgctcggcagcaagctcctctcgtcttttctccatcctctctttgtcctctacatctgagagcacctagagggggggtgaataggtgatcctgtaaaaacttaaaacttaaagccacaaaacttgattaacagttagcacaatgaaatcaagtggctaaaggagaggtcttgtgaaacacaatagacacagtgagaacaagcacaagagacacgaggatttatcctgtggttcggccaagtataacacttgcctattccacgttgtggcgtcccaatggacgagagttgcacttaactcctctcaagtgatccaatgatcaacttgaataccacggtgttcttctttcttttactatatcccgtttgcgaggaatctccacaacttggagcctctcgcccttacaaatgatgatcacaaagaagcacggatataagggagggaaaagcaacacacacaagtctcaaaagcaacagctcaaacacgcacactagtcacaacttgagctctaagttcacacacggagttctcaactcaagaggagctcaaattgctatcacaaagaatcaaacgctatagaatgaagacttggtgcttagagatgatcaaagaatgcttggtgtcctcctccatgcgcctaggggtcccttttatagccccaaggcagctaggagccgttgagagcactccaggtaggcaattctttgccttctgtcgggtggcgcaccggacagtacggtgcatcaccggacactgtacggtgttgattgctttcctattctggcgtagccgaccgttgaagatttggagccgttggcgcaccggacactgtccggtgcccccatcagactgttggctcggccacacgtcacgcgcggattgcgtggccgaccgttggcgcagtcgaccgttggctcaccggacagtccgatgcaccaccggacagtccggtgaattatagccgtacgccgtcgacgaattcccgagagcagccttttcaccagagccagcctggcgcaccggacagtccggtgcacccagactgaacagcagttggctgtacacagccaactctttttccttttgtcttttctctgattctagcacttagacaaatatgttagtacacaaaaaccaatgtactaagtctagaatcatacctttgtgttgatttgcacttcttccaccatttggcatagtttcatacttaaaccatttgtgttggcacttgatcaccaaaatacttagaa

SEQ ID NO: 5602 - DNA, 554 bp, Zea mays
gctagcattcatgcaaaagcacaccaaaaagagatcaaatcctctcccaactccaatcaaagccctagtgcctagagagagtgatttgtagtgttcatttgagctcttgcgcttggatcgcttctttttctttggcattctttcttgcaatcaaacattcacttgtaattgaggcaagagacaccaattgtgtggtggtccttgcgggaagtttgattcccaagtgatttgagaagagaagctcactcggtccgagggaccgtttgagagagggaagggttgaaagagacccggcctttgtggcctcctcaacggggagtaggtttgaaagaaccgaacctcggtaaaacaaatccacgtgtctcacctctctattcgcttgcgatttgttttgcgccctctcttgcggactcgattatttttctaacactaacccggcttgtagttgtgattatttttgagaatttcagttttgccctattcaccccccctctaggcgactttcaattggtatcagagcccggtgcttcattagagcctaaccgctcgaagtg

SEQ ID NO: 5603 - DNA, 100 bp, Zea mays
ggtaactacaggagccaaaataaaaagtccagtacgctactgttgtgcactagtctgactgacgaaccggcgtttctctccgtgtccctctcgatatggc

SEQ ID NO: 5604 - DNA, 233 bp, Zea mays
agtctttcatcatcgccctagagggcccaacactcaccggttcaccagattgcctccgctgtccattgattcatggagaagtctcagggacaagttcctgctcaacttccaagggtaccgcccagacaccgacgccttggccgagctctcgctttgcaagcagctggaaaaggagaccctgcgggagtattaccgcaaattcttaacactcaagtcacagctgccctccgtcg

SEQ ID NO: 5605 - DNA, 865 bp, Zea mays
gttatacttgagctgaggccacgactttcagaagaaaagcttctcgtgtccattgctgtcaccaccaagatgcaagatttgcaggttaacgtgcttaaggatgatagagatttgctgacaacccatgagttgattttaacctatgaataatacatgaaatgtgatatgctttttgaatggatgaaaattggctaggcaatctctgtcatgaaataacgtattcttgatgctccacaaccagatgctcgctgactgtcgttcctcttcttcaaagttggcacagaggtgggtgtggttggtcaatttttttaggtggtcagaagatagcagttctgctattgctagcaattgcattcaaggctcaatgcagattgtgatcgactcttgttgtgcggcatttgcagaggtgtagatgaggggaaatgatttttggtcggagtagaagatgggaaatgattgatgattttcaaaagaagtctagaaaacctcaagctcgcaggtgttattctcacccaacaccagcagatatgttctgtccacatatattctacattttataaactaatttgtctttcagctaggtcctggtgcttcaatttggttattagatataaaaaaataatcttacatggagtcgattggtaaaacctttgtttgtttgcagaacaacactatatatcagttaattgcattwatgcacatgttgttatagctgatcctatatatccgcatctgatagttcatttctgctcagggacagtgacaaaaaaaaggggagaatgttgaaattccattacttgggagagagcacaaactatggtaatgttggcatgttgctccaactatgttctaaagattccatgac

SEQ ID NO: 5606 - DNA, 1168 bp, Zea mays
ttatatttattatttgagaagatatatgatagatttgagatttatctttcatgaatctttacaacaagctcaatactaaaaataataatataaatttgtatagtaaattctatattctattaattcacaatcaaagaaaaaaaagaccaaaaaactgatatcctatccgtttacacctctaggcacgacgtttgacataagcccttcaacaaatgaggaagccttacacactccatcgatccttgccttctgtttcaaattaccatggtacccctccctgtttagatgaagtatagatcaaataactaggtgtcgtagggcttccttctgaagttgcaaagaggataacattcgaagagccagttatcaacacaactcagtggctaaatccactttaaaggcataaatagaaaaagaaaaaggaggattagaagaggtaattagtgttactcatattaacttcagcaaaacccctttttagtcttcacaaaattcttagggaacactagtaccaatctttaaaaattgttgtagtggatcttgtcttcttgtgttgtaaaataatgaaagaagccagagtaagatattgccaggattttttgcaaattgctacacattagctgtcacagctcactactccaaagcagtggtatcaacagtggaagtacaaaggtcagcgaaggagaaaccaagttgcaagtcaaccacattcaactcaagctttaggaacttttagagtttaggtcaaattctttttttttgaggaaacaggaggggtaaaacccctactgattaggaatatattaagagaaaagggaaacgaagatcaaaacaatcacacaaaagcgtctagccattgctcaatagatgggaaatactttttctttgctcgatggataaccaggcaaactccttaaagatggctttgcagtgttgggtttgtggttgaagtcctctgaagatgaagtcattacttgcagtccatatactccaacacatgaggacggttatttccgtgtacaatggaactcccaattgccttttgaagctctcaagaacagccaaggagtcatcttgctgctgtgcaaagtcacacttgatgaaaatgtggtctactgtttcttctacacactgggtacataggatacagtcataggaggggagatcc

SEQ ID NO: 5607 - DNA, 1500 bp, Zea mays
gggcgatgtagggttagttgttgcacttattgcctattagactgcacacctaattttattgggtgaatattaccaataggtaattggattcggatgattgcttcccaaacccatacccacttacacgatgggtgaagattttatctcacatttatatcaatggggacaactcttgtcccatactctaaccctaattggggaatttcccacgggttcatgagtatcgggtccccattgacatctctaccctagatggtttgacacctcccaatagtgctatatcatactaggaaatttataagaaaactttatagacctaacccttcctatgttgaggcatggcacatcaatcctgtgtccgtcaatgttctatctttcatcttctgcaaaatataattatcttgcgtaacatcattcttcctccatcccaaaatataattctttctaaccttctttttccatccatattcgaattgaatgaatgataatgaatatagatatacatataaactatattcatagattaattaattaatatatgtttagtctaaaacaaattatattttacatcatatgaaaacgattaggtacacaaggttagagagacaccgagcaattcccaaggccattgcccattggagctcggcccgttcactaggtaggcacctgtgcatccttgactcttttataatagcatgaacttgacaaagtgctgtctatatgcatatttgcttatgtacggccatgtcctagatgcacatacttgtagcctccacctataccttgaagtcttgtttgtttcattcttagaccataatactttcttaaattagtttgcttggcctggtagaagttgagcgtgtgttgtgataaatttgcatatcatttgggttcgattaaataattgggaattaatgtgtaacttgtggatatgagtatgaatggctcactatctctaggggagggggcacaaaattaaatgcacatctattttgttgggtaggtagatagagacttagacaccgtttggtttggggtagtcacttttagtccctaaagaggcaaacatggtgactatagtggggtgactaaactttagttctctagccaccaaaggggtgactaaaagggactaaaatcggatttttacctcacttgtcctctcctctttctacgtgtagcagacatccactaattaatatgggtattgcagttactattcacaccaattaatgctctttagtcaggtttagtcactcaaactaaacgggttattttagtaactaaactttagtcaataaagtttagtcatgtgactaaagaaaccaaacaggacccgatcttagatatccaatccacaacagccgatgttgttgcaataaatttacatatctgtttgcagatgcatggtgttgatgaatacattctggactctacaaatagcaaggcgcattccctcttcacccatcaacaaagttcagttgagttcaatgctcagcc

SEQ ID NO: 5608 - DNA, 1376 bp, Zea mays
ataacttattttagagccccaatagttaatttatggtgaataatacctcaagtccccatgtgaaaatgatgaagtgaagtactgattacgttaaaacttggataattagagtggattcgtgtaactcatacaacaagtggaagtgaaatgatataaatgctgacatattatgcattttatggtccaaccatttttaggattatatatggacatatgttgcacctttatgaaatttcatgatttttaagactatttatgtattattaatttttttctttctaaaaatcatcataatacaattaaattcataaaatattctagtgtcgatcgaaaattacaaataagttatcaagactaataaacattctataagaataaaaccttaaattcccatatgaaaataataaagtgaaatattgattatgttaaaacctggatactcagagtgaattcatgtgtaatccacacaataagtggaagtgaaataaaataaacactcacatcttgtacattttatggtccaaacatttttaggattatatgtagatacatgttgtgcctccataaatttcatgattttctagggctatttgtgtattawtattttctttctgtagaaaatcatcaaaatacaattaaattcataaaatagtctagtgtcaaccaagaccaacaaataggttaccaagactaataaacacaagacgtcgatgactaatcgtatgtgcatagtaattctggatggcctctaagttaccattctaaaataatatagcctgaagctttatatgaaaataacaaagtgaagtattaattatgttgaaatttaaatacttagagtgattttacttgtaacacaataaatgaaagtgaaaaaaagaaactatgacatcttttgatttttttggactaaatattttttagtattatatatatgaacatacttcatgtctaaatttttgaggctatttatgtattattattattttttaaaaaattataaaaatgcacacgtctatcaaaaaagatatctgaatatcgaaaaratatatttaraagatattcggatatctgaaatccgatgaatattaattatgctatatacatatttgatattcaaattattgtatctagatcgaatctgaaatccggttatgttgtcgtgctacacatatataaaaaaattttccgaccagataattgttctcacacgatatgatactcgaataatattcatacggagttacggaccataccgtttacaccgagggttctctctttgtctgttcactgttctactgggacgaccccaaatccccaaatcgaaaggggccgtccggctcagggtttctcgacggctccttgccctctccgcc

SEQ ID NO: 5609 - DNA, 394 bp, Zea mays
tcttgccactaatgataacatggaatgataacaaaattgcatgtgtgacatagaatggattaggacatttgcgctggcaaataagttactgagcaaaattgcaatgacatatatagaattctccctatattatatatatcttatggtttatttgagctatatatatagctggcaagtacctgttgctaaatattaactaagttttctcaacccagaaaccatgagacgatttctatatttgccatatagaaactatattctgatggatagttttttaaacctgaactatattatattccacatcatctcttataggcaatgcatagtggctgcatatatatcaaattagactagctaccactcctcccaacgcaaggaaccaagactgtgtcga

SEQ ID NO: 5610 - DNA, 1500 bp, Zea mays
ctatttagctgtcttctttgttttggctgccaagctatatcatcgaggtatcaaacagagatattttctcttataccgttgtcatcaatagttgtagagttgaactggttgattgtggagacatactgtcagagacagagcagcgtgatagctgcccaccacagtaccagcgaaattggctggttctctctcctaccgtcattttggctggctcaaatgactgctctattggaggccagtttctcatgctacagtaccacgttggcaggtaaaatgactttggctgtccatttggctggtctgttggagtaagtctgaagtgggcgatggtggtgcgtcggaaaaaggaagaataagtgaataaaaaaatctgggtgtagaaagagttcaaaatacttgaataagaggtagacaataagttgagattaaaactcaaatgacacgtcgtcttgtttacactcttatgccgctagcgctaggtcagaccaattaacttattttcatcatataaaaaaggatcgactttgtttgatgtaccgctgtttcacatgtacagtttcttagaggagttcgcattcacattccgcgtgggtacgtaaagttgtatttgtttagttcgcttctttacccatccaaactccaatcatgcaagaaaacgggcgcagccaggcccacgcgggacgctccaagcgagcctactccgacatgcaaactcatggtatacaacgacacagttcacaagaaatagttttaggtagttttttgttatatcatgcaatttaaaaatatgatcacccaaccgattttatatttatgtttttaagatttttagaaacaaaactagaacattcatgctacataatatttgaaggtttttttatatactcttctctaataagacatgtttcagtgtaaccaagcaaacaaagtctatatctcttttgcatgagtcgatacaaataaccaaacaaaagcatctgcataaatttaccctggttccactaatactagctagactcataccatcctggctccgcttatacgatatccaaacacacggattatgtctcgtgcgagaaagtactggtggccactggatttggaaaactgggccacaaatgcaaaacggttgggccaaccgtgatagtcgaacaagggaattcactcactccacgaacaagagattgtcgaagattccagatcaatctagcaggtcaagtttgttggatgggaagtctgagtgaattctggttctggcccaatcgtgaaatctagtaacttctagcccaccctggggcacacaagacgagaaacatccggaagcccacaggccacaggcaggccctcccatcgctcgttataaattgagccgctcccgcgtcgacgctcctcatcagaagctagaagcctagagcagccaagaaaagcacatacccgagtcgccgaaacaacaacaatcccaatcccccctcgtcactcaaaactcgagctcgagcaaca

SEQ ID NO: 5611 - DNA, 149 bp, Zea mays
tgctgacgtcgccctgctttcgtaagagagctgggggccgccgtcgtcctgagcttgtggagcgccgtcattgcccatccggcggagctggccggatgggacaccggtcttgttctccgtgacccgagtcgattcggggtaggatgatg

SEQ ID NO: 5612 - DNA, 1500 bp, Zea mays
tgtatcaatgactaagtgttttaaatcatgtttcatacaagacagttgcactagagcaagataacatttcgtggtgggaacgccaaataaataaaaatagagggagtatcactttgggtttttctaatatatttgcaatagtgcataataaaactgtgtgtgcctcaaagtgaggcgctcaatttcagcatctaaggttaggcataaaaataagctgagtgattaggaatatcgtccacccccgtaggcgccccgcccaaagactggtggcaggcctcctacaggcagatgctaggtgcgtttttctcctccatttgcctctgcctgtctgtggtgatgattgttcgtttggattagtcatggttagtgtggtggtaatgctcaagttggggcactgtcaatagccggattgagtgtatttttttggttttatgtcacaatagctaacattacagttttaggtgtgattgaccactaagtctttatctctgctctgattactaagctggcaggatcgaaaagttcaatttttcatttggtagtctgaaactaaagctccttcaccttcagccctgtattttcactatgggaatggtcttccttagtccatatgaatattacctgtggcctacggatatgaacatgataactattttctagctttgtgattgatattgtcatgtgattcagcttcctagcagcaccggtaccaacctttctatttttcacagtacactggcttcgtttctttttgttgcaaataatttcttagaaaagtttgactcttcaaatcctaggttgttgagtagatacataacatcacagaagttgtacgtatagggtagcagtgatgctctttatgagaatctttacggaagagacatgaccccctggcacatcaaatccgaacttatttttgaactattatttataagataatctcatttgtcccagttttaccgagcaaaacttcaaacaagtacttaaaagggactttcctgtttatagatgccactttgataactgatgctgtctcaatattattgtggccttctggtgcttcaccattagttttatttccaaccatatgataggcattgaaaggacaccagctggcttagcctttcggtgactctaaacaccacggcactttcaggtgacacttccacattataaacattgttgtgagaaactaggagtgcacatcagtagccggcggtaggaatgtaaatttttaaattcgcaagtaactagtagtttgtaatgaagttttctttatacctatttgtggatttgaagatgtttgtaacacaagcttttgtgcttgtactgtaagttgacaatttacatttgagatattaaaaaaaatccacttattgaaacaccctagcttcaaatccttcagtcttgcacacagagctacatgtctgtccagtccaaggtggttgcgcttggtgcactgatcttcttccttatctcgtatggctcttgcactggagg

SEQ ID NO: 5613 - DNA, 1500 bp, Zea mays
cgataagaacaatgttggacacaacttaagtctgttttacaacaatgtctctcaaaactatagttttacaatattatactttgcaattatcatgacaataatgtagtttcggtagctccaaaaatacagtagttttgagaaacattgtttagatacaatattataaatcatgtattagacaaaagatagccatgccattaaaactttgaattggactgtagttttttcaatactccaaaaatattatggtacctagaatacgatgtctagaaaacatattttttaaaatgcaaccaaacatcatatgacataaataatatagtatttttttgaaaaccatggtattacctaaaaactacagaatacttcattctgaaataggtcctaacaagttgcagcagctaggtcgtacatcagcaaatagctacttcatcaatctcagaataaacatattttatagatgagttaaactaaaaatatagaagaacaacgtacacgcgttgaatcacaacgtagcgcgatatccattcaactttttggaagtttttactgagcacaaattcgaaaatgggaagcgccacgtaacacgagcgctgggccaatttctgccagtgccagttatcccggcccacatccaatcctggggaagacgcgaacccggctccgcggcacgagttgtccgcacgtacggcacgtcggggctggctcgtccgcccgcgagtgggaggccactgtttcctctgcctcaccgggtcgtgtggcggaggggcgtggggccatggttcgcagcgcggggcgacgagcgcgctcctcctctcgcgcagcgccagcgccaccccgcaccgtggctttatatacacccctcctcccaaccctaccgaatcatcactaccaccgctctctcttcctctcctccatctctcaacgcctgaagctcaccgcacctcccctcctcgccgcggatcccccactactccggtaaccgtctctccattcaccctgcctgctgtctcgctagaatcgcctgcctctgccagcgccgtgacgcgggggcgcggtatggctctcccagatccgcctggcattgctcgctcgggtcgtgccaggccgatctgatctcgcatttgctgcgcgctcctcctgctgcggatcccaccggatctcgctggaatcggagcgcgcgtctctttgaaatgccgcagatctgcgtgcttgcgcgcgtgatctaagtccgggcctttcgttaacgaaatggtccgatctgtggtttggtggaggcaatgccatggtttttccccgtgaattttttttgctgattttaggagcttttttctactgtcctatgttagtaggacaaaaaaaaagaaacatagattagcttcaataggcgccttttagaacagattctgtacagcaactcgtggaaacaaatctgcttccttaatgatgttgcttgttttaacaaatgcggcatcgggcgagcttttctgtaggtagaaa

SEQ ID NO: 5614 - DNA, 48 bp, Zea mays
tgcagccgttggtctcctgctttgttcgggtgctagctgccacgcgcg

SEQ ID NO: 5615 - DNA, 1086 bp, Zea mays
aaggtcgagtctgctcctttcgtcctccatcggtcctgatattgtatctatagtgttcagtttgcgttcattacattcgattcgttgcagcttgtattgtatgtagcctttttgacgtgtagcacgcttggtgttgagagcaatgtacacctgtactgttgggttggttgtgattatacacgcggttttttttggagctagcaatgtaaggtgcatgtgcatatctgagacgcgaacgtcgacgtgaaacgttctagtctccatagttggtaaatacagttactgcagaaactcgcatctatacgataataacagtgatagagagacctaagggattaattgaatggatttaaatctctatcaagtcaaaatttacttaattttttaatgccattcaatctatatggattgaatggaaataacggaaaggccctacgtagatccagccgtggattccagttggaacgtactgtagtagtagtagacagtaaaacagtcatactgaacggggtatcacggggcatataactttatcggtgtctgtgctgccggcgtatctgcgaggccgcgggcgtgagtgcgtgaccgcccacgcgcgcgaaccccgcttaccgccagcgcggcctggagcgtcacgggttctgggatgaaccagggacgggggccccggcccccgggtctgctggatgaagtaacgaccgttttatcctagtacttgacgtgcagtacatcacgcacccacatgaagcagaagcagaaccagatacggcttgctgctgcgcgccgcggcccaggacggccgtgtccccttctcggcggacattaattgcggcatcgtcctacgcagggaccgtacagtcacgtcggctaaccgcgcgacacgtcggtcgctctccagaggcttccagaccccagtcgggtcgggggccgtggcgtctgtgtgactgtctgtgtgtgtgggggtggggcggtgctgtgctatgaatacaaagcagtccgggcacgagcgggcggcactcctctccctccctcactcactaagccaaagctgacagcagcatacaagcaccagcagagctcttgccg

SEQ ID NO: 5616 - DNA, 902 bp, Zea mays
ccccccacccccgccccacaccaaacacacccacttactcctatacaaacacacaaaagcaaagctccttcctcactcctaaatccagctactagtgctccagtcaaatacatccgagacgcgtgtattttaaaacacgtgtattaataagaaacacactggactccaccacacctgtcagtcatacatacagacgctaaccaccccgacattaattctactgacattatagtagtatatacgtatgccacaagcctactaatgaccgaaccttatcgcttgggtatggtgagagaacatatacatagaatgatataagatggagcatgcagctagctagcaagcaagccttgggttgggtcacgtcgacgtcgtcgtcttcggcggctataaaactaggttagacgtcgagcgaccggccccttgcttctctcccccggcccgcccgcccgcccgctcgctcgccgctggatcagtttcgtggcgctttggagcagcgaagtggttgctgtgcttggtatttctagtgcgtagtatcgccatcagcgctcaataatactactcctcttcctctatgctgcacgccccggcccctttgttttgtagctcttgtcagcgaaccttccccctgaaaaccccacccacccttcctctccgatcctcctagtagcgcctcacttgcttcattccgatccattccaccacccatctccctcctcagctcccctctccgctctccctccctcgctcgcgctctccacgcggatcaccggaggctagctagcaagctcgaccggcgcggccgatctagctcgcgcttgttggccgcttcagcttagcagcggcggcacgtcgtcaacctgtgctgtgagaaagactagtagagagagatacgtgtaagg

SEQ ID NO: 5617 - DNA, 112 bp, Zea mays
gaggtcgtggtcactttttttcctttgtgtttgtgtaagggcggtggtgttgtactgtttggccatgggggattcttttctcccaggaccttgactttgctttcttaatgaa

SEQ ID NO: 5618 - DNA, 173 bp, Zea mays
tcggtacccctgctgcaacaaggaaataaaatgaaaatggttgatccatggtggggggcatgggaccaaaaaaaagaaaaagaaaaagaaaactcggtgtttacttcacttcggctccgcatccgatttattcttcgcccttttttctggcttcctgttgcttgccgccgcag

SEQ ID NO: 5619 - DNA, 495 bp, Zea mays
ctcttcaaactcgtgagcttagaacgagtgtgcagcagcaccgttcccatctagatacgcgatatgatgatacaccgaaatggtgcccctttgggatgtgacgcgaattgccaaatttgactgaatcctttccagccctggaattccaccccagtcattcaaccaatcaaccacacgagggcatccctccagactccagtgatccagtccgtggccgtggcgtgctggaccggcggctaggcgggcacgtcagccgccagctaagcgaccaactcttcaaaaccccggtctctccctcgagcagtcgagctcctccggtctctgccatgaacagcaaatgagcagagctcccaagccgttcaatctccagatcatttccctctcgtcctgctccaatccactcgccggccatctccacaggctcgcctcggctgctgcagctgggttttgctccctgagccgccggatttcgacaggggtcgggtcggccgtccg

SEQ ID NO: 5620 - DNA, 1500 bp, Zea mays
tctaattaggtacttttatatttttttatcaagtttattgtatttttatatgctgaattgagattaatactatcttagtctatgtttgtggtatattttgttttagcggtatatttagccgctcaatatattgggggctgtttaaagtaaacttaaagtattatagagtggcccgggacgttaattttatagagctccgccactgatcacagcagcacaagcaggcgcatyacttcgccttccatgcgtactagacggtgttggtcgcgctcgaggtttacttacggggctccgttagcgtygagcccccggatgtgcctctccttcgggacctgttcctaatcgagggcaaggtcagtattcagtacctgtagtctcaattgctgtacttctgttgtttaatcgtattagaagtcattactgctattggtgccaaaattaagctgtggtacatgaccaaagctagccttatctcagctaagcgcatacgtagcatctaacagaaactatttggtgttttaaggtgaatgcattctcatccactgctatgttgcaacaacaaaattatattgtgttctttgtttacattaattttgatcaaatatgttggatctgtgtactgccatttgactgctggggaaggggaaccggacggtcggaagatgacggcgaggaggtgtacttggacagagggagagggagggcgtccaggtctttagtatttttgcctttttcccatgtcatgaatagtgagaacagactattgcaactaagaaatgggagcaaaagagagaaaaccctcagattcaaagagttcgtttatgcagggttaaattttcaaaggcgtgtgaattagatgtcaaatgtagaggtgyacgtattgagggttaaatattaacatttctccctcactagtcactaggtatttattttcatctcatcatgtggatcatacaaccttctgaacaattttagtccaattatcaaatcaattagaaattttatcttcgccgtagttatttctgtgtgtgatattactgggcccattctgtgtctattagggtagatgtaaaatggtttgttttctgcaaggctgcatctcggctgagtaaaacaagtactgaggcagtagactggtatttgcacatcgcacatgcttgaaattggtgattgatagattgtaaaatatgaaccggtagttgatagacaatagtaaattgtgaaatgtgaatcagtagttggtagacagtagagactagagacaaaggtttccatatgccaaaaattggtgattgacagattgtgaaatgcgacatgtttagtgtcctagttctttggaccccggtggctgccacgacacccgacacccgccgcctgctccaccgtcgcggctgctcatgccctcgctgctgacctagcgcatgcaaacctcacatttcgaggcctaaaaccctcagcgtcagtggccggcacgtggcctctctagtgcccatcggtgcc

SEQ ID NO: 5621 - DNA, 257 bp, Zea mays
gaacagccctgaaaaaagcgaggaaaatttgaagaaatcttgctacacagttctcactgatggctatctttgctacacagttctaatgacagctgtgacgtgacttgagcagatcgagaggcgggtaccaaccgcatccctagtacagatcgagtgtaccgtagccactccacgtctccacgctccacggtcccactcgcaccccccgacgggtcggaacctcagctcagaggatcggaagaacggacgacggcgag

SEQ ID NO: 5622 - DNA, 1037 bp, Zea mays
tccctcctggctcggctcctgctgccagcttcacacgtgccgtacgcacgcacgcacgcaacagttcgatgtgtttatcgatctgctgcttgctctctctgcatttatgtacgtgcatatgtttaggaacagaagaagatccatggaaaccgtatccagccaatcctccattcccgccgccgatttgctcttgattttattcccttttttttgcgaagccaaaaacaacaacaacacacacacaccaacagagtctattcattcacagtaacagaaaaacagcacatgatatacaaaggattatcaaagatgacgcgataagtctgcaatcttccccaccttttcagttccatgccgtgtcgctgtcgatcgtctgtgtctctccgggctccggtcccaggatgagatagatcttctggtcatggtggccgcagccagcccacacccttttccccccctgaccactacacctgggggcacgcccagcgtgattcccctgttctcctcccggtttcgctcgcccccttgttcctcttccagctgctcatctgtcagccgttgcttgctcccgcgatcttcctctaccacacccacacacactccctagccctagcgaaagcatcaaacacgctgttcggcgctgtcgttgcaaggtttggggttcttgctcgaaacgcagccctacccggcgacctattaatccctccctccttcccctgtatcggtctgtttcctttctcctcctcctccaaaagcagctcctttctcgggggtccggccacttccaggagttcttgcctgcgaagcttgctccgttctttcgcctgcttgccctcactcctctatcgccttggcctgcttattgcccagacagtttctgcttgaccccacgattcttcactgatgattcacagaaagcttggcgagcacgtacataacttgccgatcggacagttgatggacggcacgagcccaaaccgtacaagtccacaataatttctccctccggctccggctccgcctagactcactcgtcc

SEQ ID NO: 5623 - DNA, 253 bp, Zea mays
ctgcagtctgcaggtgacggagccccctccgcgcccacaactgcagcaatctgtataaatacagcgtcgggccgtcggctatttcataccgccgaaccaaatccaacgtccgcagaaaccaaactcccgtcgaggaggaggcgtcgacttcccatagtttccactccacttcgatcctatcgtatcctccccaaacactccaccaagaaccttttccccctccaataatagtccaagttactcggaggaatcc

SEQ ID NO: 5624 - DNA, 1500 bp, Zea mays
gtcctgtagttggctgtgtgttgttggttcttctcgttcagatccctgtacagtgactggctgacagttttgaattggggctgccatgccactgccaccttctacggcggatgcgtgctttctcaccgatccttgaagcatgaatgcatacatttaactaatttgatctggcgattgcttgtttgatctggcatgcaacgttaactaatttgaccaagtaaaaggtccctcgctcctcctcaaagcaaagctactgccatagtgccatggcaagagcggtgggccactgctaaactactacttaaaatagttaccatttttatttttagaaaaaaatctctatagaagtaaaataatgattcaggtttttttgttgttgttggtcgtctaccccagcaataatgattcagaaatttgtttctataacaaacttatttagagctatgaataatcttttaaaaatctagtcagatttaagacatgttttatttatataacgataactaataaagaacggagagagtatgtccgttgcattcttcagcgagaaaacaataaagaaaaagtatatcatcaggctattcacctagcaaaaaaatagcaactttatgtcagtagtgctctctctgaatcaaactcgacttctagagcgtttccatgttaaactatttcaaatctaaactgcgttattacagaaaataattatacttctcgcaaaatatagcttaataatacagtatatttattttatgacagaatagtcttacaaattggaacacgaaccagcagatgggacgccgcatggtccaacatgcaggcacatccagaaattagaggaccaccagcatgacaacatgtcaacatcagtgcacacaccatggacagtactaataatgtataaattttctaatttaaacttatcaaaaaaatatttttattatagctaaagtacaactaatttaaattttatatataattagagcaagatagagagaatatatatgaaatttttattaactttttagttcgtatgcactaaagtttcatgtgcgctcgatatattctcacacggggcaaccgacacataatgaaccagtttcatgggccgctcttcttaccaaaccaatccagcaagaattcggcccaatagccctgtgttgtctgctgtttgctgtttttcgtttctcccgttcacctggcatccacgctcgattcggccgttttccgcatccacggagccaggcgaccgccgccgcttccctactcacccttggccggcgacgacgagcgcccactacggcaggtacgccccccatccccttccttctctgcgaaactgagcacttgaccccgaaccctaattcaagctactgtatttggctatctatatccggatctgatccaatcacaagcgcaagtgtctgcacgtatcgtccctgctaatttcgttctttatatcctttgttggatccgccgctgcctcctgcattccattccagg

SEQ ID NO: 5625 - DNA, 154 bp, Zea mays
aaattggaataactccgcgtccttttgtgatctgcgctgaaggatgcaaaacctttgcgcgaactagcgagtagcgagagtcgatgacagttgacaggacaaataaaattgtttgcagcattgcaaattgcaattgcaacgagcgccaagccag

SEQ ID NO: 5626 - DNA, 243 bp, Zea mays
gtatgacgtcattgtccactttgcatttgatcggcgtcaagccggatggtatggagaggtgggaccatccgtcatctgtggtagatatgaaactgtggaggtgcaatttgttcttccaagttccaaccacgtgcactgccactatgggtttgctttgggcagctgcaagatctgtcagttacaggatgcaaagagcttgtctactggccagagaaagtattccaaagcttgatttcattgcgg

SEQ ID NO: 5627 - DNA, 1500 bp, Zea mays
gagggcttttttcccgcccgggttcgacgtcaccattcaattcgtcgctcggaaagcgaatgcggcgtggcgtttggaagcgagaagggattaattactagagtattgttcgctccggtccggtccggtccggtccaaccgagactccgagcggcgtcggcggcgagggaccgattcgagaccgactgaccgggacrggcggcgggactggagtactggactgtttttttcctctctctctctccaccatcgactcggtcggctggcagaaaccgcaactccgaaagacgcatggtagcccacaagttgccgggccgcyagttgggcggcgcggtggtggtgggttggtgttggtggcggtgactcactgacggcgacgcgtcctgctcgtggaatccacgactcgcgctctctgcttgacagctgcgccgctcgcccgctccttgcggctgagaagccgagtgctcccagatttttcctttgccgcaccccccaaaccgccccccacccggcgcgtgcgtgcgtgcgtgccgtgccgtccaaccggatcaggccatcatggcgtcatccccttcgttggattggatcacgcttccccccgcgctctgttctgttctgttccttcctcaaatcttctcttctcgcgtgtttggataatggaattcgtagggaacaagctgtacaagctgtttgccacggtagtatcgtaggagcagcacatcgaagatgctacggcctcaagcccgtccggcccacgggatactggactggcccacctatacaagtatgcgtagtttgggcttccgtctgcagcattgtaaagtttgttctgcagcccatggcctggcctccgctaccacgagtagggttgatcaaacttgatcggccgctctatcatgagctgtgtctatcttgaatttgagcccgtcgcacttgccaggtcgggcgtgggccaacgtaaaaagagtgacgtttcttcaccaatcaccctgcgtttcttctcctgttcatcacccgtgcgtgcgctctctctctctttctcgtgcggcaactgcgaggcagccgacgcccgacggcagggtgcccaggccttcttcggtcccatcgcgaggccatagttgcatcattcgcctgagacgactgcccaccaccaggtatgcggcaccctttctcttccgtccccgctgtgcgaaaccgggcatccaaaccctaagttaagctatttcgcaatttatattcggatctgatctaattacaagtgtatacaagcctattaacttccttttttttggaaaaaaatgggcgtagtgtgaccacccgccgctattctgcggtgtttcttttttaactatttttttgtattatttttggtgttgtgtaatggtaatatatgattatatgtttatgtactggtgaattttgtgcggattagttttgaaattttgttttcaggactgatctcctcactaggtgcgtagaggtgaagagaagaacttgaca

SEQ ID NO: 5628 - DNA, 271 bp, Zea mays
tctgaaagaatgtatatagcagtagtgcctccgttctcgaatatttgtctctcgctagtttattttcgaactaagctaaccacgacaaataaaaaagaacggagaagcgctactgctatatatatagcaagagatatatgtactgatcgagaccttggagatcccatggctctatcttgtaaagatcgacatctttgatgacattgaggtcgatccttcttgaggccaccttcttcctgaggtagtagtccaccagctcttcgtctgtggg

SEQ ID NO: 5629 - DNA, 352 bp, Zea mays
cgtacgtctcctgcaccttcttccagtttctcccatttcagtttgtccactccctgtcattcctgccgcctcgacctccccgctctggaaggtcaaatccttcgcccctaagctttttattctggttggaattggttctggaatcgttgcctgctggctgctgctgctgcacattacccccgtattctgtgctccggccgtgggattgccctgctcgctttctttcaaaaaagaaaaggaaaaggagcaattgctctgctcgctttcagtttgtgtggttgacgtctctctctgagtctctgtgcttcagcaggttcagatttagcctgggtgcgtctgcaggttccggttc

SEQ ID NO: 5630 - DNA, 217 bp, Zea mays
gtgtcaccgcagaactatttctatgctgcgttgtaaattcttggaaggcgagtattccaatttgctcaaacaaattgtgcctgcgtttgtggtagatcaggccctataggttagtatatgtgttagagaactctgtcgtcctacaacgtcgtggagggtgctctgttggtggtactccttttgttggtaacgaaatttgaagaactagatttttctt

SEQ ID NO: 5631 - DNA, 1500 bp, Zea mays
taatattagtttgggtaagtacagcgtgtgttgggaaactgggtaggcagcagcagcaccgcagcaggcatacgtacatggtctcgaacccaacacgattgtttgtatgtgtgtgtgtttgtttttaatatataccctacgtggccgcatgaccgattgaccgagttccagttgcaacgtagtacgacatcagaaaagagggggggcgacaaagggcaagagcattgtggttgtttgcagctaggcaggtgctagatgtgttgttaggaaaaaaatatccttaggctaatcacagtgatgatttcatgtccctatttccaaaaataccacatcagctttgtggatgaatgaaacaccctcttttaataaagagtttcatatcactatttcatatgtcaacatacttcttaaatgctacatataaataaccaatagaatttactcaattatatgaagatgaaacaaaacactctcagtggaggtttcacacagtttccaagatcttggaaacgagttaacatggtttcatccccatgaaactccatgaaactcttccttcttaaatggtgtgacatgtcatcaaaatagctgatgtggcaggctaattaatacatgaaacaccccatgaaacctccattgtgaatagcctaaacaacagagttgcaggacgtacatgtagtcccaaacaagtgaaacgtaaaaacctcttggaggtaagtattttatcgatatagagctgcgtacagttagacagagaccgggcaacaagcagagggaagggcaggctaatcctcccaaaatgcaagctaataaatcgcaacctgttcatctttctggtgtacttatttcctttgacccctgcggcgaccctttccccctgcggcctagctgggcttttccaagcgctggcctgagcctgagcctgatcctgatccggtcggtctcgcccggcgcccgccaccacaccgcagtccggaggattagtttaagccacaggtttaaaactcgcaccacacgcgtagatcacatcgacgctagcccacatggaacaaaactaagggtactaatttaaaaaacccaataataattgcatcgtcagcacaggtcgcaaataccattctcgatcgccgttcgtgtgtgtgtcccagctttgatataactatgttctgtcactcacgaccaagacgacgacgacgacgactacgtacgacggacagggccttcgatcgcttcgctttgcccacggccccaactcccaagatgcttcgtctcccgagtcccgaccccggaactagccgtcgccgtcgctatcttctcagagccactcagcagtccagctccagcggccttcccaccaaaacctgcagcaccgcacgcacatgacatgcctagcctagctcctctgcctgcctatatattcgccttcctgcagcgatgcccccctcgtccaagcgcaagcgcaactcgctccccagcgctcctccttaattaatcccttgc

SEQ ID NO: 5632 - DNA, 466 bp, Zea mays
atagattggtgtagaaagtttttcaattttatgtctacaaattatgtaaaaacactttcgaatgtgaggcttgctgtatgtaaaaataattctattgcatatatgattgtactgtgtattatatttctttatgtagcgtgaaataatctttacgtatcatttattaggggtcttcttatctggcgaagttcctcgagacgaatagtactcacttgcaaatacgagattctctaagtctctacgcggtatatagaagtccgggccattaaagttcctacttcttcatcttccctctttttcctcccgcttccgaccgctcctcttcttctactccttccattcacactccacatgccgacgctggcggcggcggcggcggtggcggcggtggcggcggtggagtcgtagccgcctgaatcagcggtcttgtagtgacgccggaaccaggggcgcgagggggaaggag

SEQ ID NO: 5633 - DNA, 1047 bp, Zea mays
gcgcagcgcaggggacgacccgacccgacccacccgggccgccgcggaattcggccttggctctcgctcaagtgacccaataaaaaaatttatgtatttatttatttatgttattgggataagacaagatagacgacgagcaaagcttgctgagctaatagggtcagctccgtccttttgcgccggatggatcaccaacaaacgttgcagttgccagttgaaacgaactcggttccgccgctgacgtacgtatgtatatgtatacatctcagagagttcgctttgctgacatgaggaccacacgtctcctgtctactagtactcgtgagatgtactggtagctgtacgcttccactcagttcagtttcaatctgatgtacagctttcgagctccatccatgattccatgtacgctcgctgctgctccaacctccaaccacgtccgtgccagactttccactgccactagagtagtggtggactggtggtagaggagcgctcccatcccacgtccgctgtccgctctcggtgctggcgggagcaaacagcaaggacggtcaaagtcaacaccatggatcggagacacggcgcaggggaacggaatgatgagcgccaggccaggccaggcagcgagcgagtcgagatcgagacgagagtgcctgcctctgctgctctcccggctcccgcggaggacaagacaaccccgccagctgtgcgcattacggaccagtagtactgcttattatatcacgtggcccactcgagcgaccccactcactccaccggtccactcccgcccgtctcgtgtcagtgtcactgtcacccagatctcgctctcgcctcgcgcgcgtataaaacggcggcggcgtccactcctgcctctgcctctttgccaccgtccattcccccgttccatccatccatccatccacccaaaagccacacacatggacagcagcggaagctaggcctaggcgtcgtcgtcccgtccagctacgcacgcagctatagcctacagctcctccctcccgcaccatccccagcacc

SEQ ID NO: 5634 - DNA, 500 bp, Zea mays
tgtcgctctgtctcaagtacgtaataatcagtccaacatgtaattcaatttgatcttgcagcgattagagaagacgagagtgtgtaccgtcgccacaaacggtcattgcactagctgttctgtgtccgacagccataccatcgaacctgtggtgccggtaagggtaacttgtcagttgtcacatcaaggcggagaaagacgtaaacgcacacctgccctgctcagatgcaaagcagccgcgtttaacaatcaagggcgaagtggagccggagtacttataaaccaaccggcagtcctctgaaaagtcccttccctcctgcaccgtgcacgttcgtcctcgtccaccctccaaatcgtcctgaaacctcgcgacgcgaaaatgcccaaacgagacaaagcagcttccccgcgcgcttcgccaccccacacacctccgccggggacggacagcgaggccgaggaggcaaaccgtagaccaggcgggggcgtccgcggcggag

SEQ ID NO: 5635 - DNA, 745 bp, Zea mays
gcaccgtcacagttcttgttgggtgtttggcgctaaaaaaggcgtcaacaacaatcaaacatgtttgagattgtgatttatatggtgagacgctgggtgatgtggggatttgcgcgagcgggtggtgaactggtgatggtgatgctcgctcgtagtgcatgtgcatccatccgacttcccaacagcctacctctcgcgttccaggacaaaacgcagtcttggctcggcagccgaggcgagaggagcctttgcccacctttgctcactcgcttcgctttccatcctgttgcgcggccgcggcgcaggtgcggttggccatcacaggccaaggacccctcttcctcttccctttgacccaccaccgcccccctcttcccttcttcccccactgtcgccgctcctcgtcttccactctctccactttgctgcttcttctcccttattaatgctcgtgggctcctatgatccgccctccgccgcgggtttcttgatccatccccggcccaaggaagcggaccccggcgaacactcctgacagattcgcccgtccgccgctccctcgattcggtcctccccgtcagcggtaagacacagccggctcctcattcctcgtggcgtgccgtgtctttccttctattaatgttaagtatttatacagcgttgacgccttgacggtatgaagccctattcttggcaggcaggtgtttaggacctctgcagcatagcatctggtccgtccctggag

SEQ ID NO: 5636 - DNA, 499 bp, Zea mays
ctgaccaaaacacctgaagaagccggatggcaaaaagcgcatatcgactcggcgggcctctaccctttcagagccaccgacagccagaacagcgtgattggcatgcctgccagcaaggcgagcaaagccatcaaccagtcgcccaaagtgtttgacgagcacgttattgcggcgggtaaaccctttattgcagggttcgccatgggcggttcacaaatgtcctgctttcccgcgcctgtcacactcgtccccgagcccggcaaagactatgaaatggaactgcagatggtcaaaatcagcacattcaaggcaggttgcgtgattgccgttcgccaactctccgttcagggcaacaacacggttgaaacaccgctcaggccgcaggtgtgtgccaaaaccccttcgggttggtacaccgtcaccccgacacctttgccctgaactgcctgggcaggacatctccctgacctgggacccggcgtgtattcatggaggaaaa

SEQ ID NO: 5637 - DNA, 1409 bp, Zea mays
gagtttaacatcaatctcgtgggtacgggtttgtaatttctatacccacgggttttaaacccgttgccatccctaatcatgggctactgcctactagacgggtgcgcacgtttcaggtaggcgcggatccgtcggccgatgcatgtgagtcactccggtcgctcgtgacgacccatcgtttcacagagcgtacgtacgccgggatcgggcgtctagcgagctactatcgcagaccaacccgtgactccacacgggtgaattccttcccgtgacgtacatgtaccgacctcgaaagcttcatctaccgctatgaagtttagtcgcggagtactgaagccaaaggtttactgaccgacccgacacgcgccgagatggtcacctggtctgaagacaaactctgcgcgcgtgaggtgtcgatcctgactgaacatacagaacagaatagatgaatgcaatcgatcgatgacgcagctgcctgctgccggcgccggccgggtaggcgtcgtactttgacttgcttgccgtcgtatcgtatccactgctcgcccggaacctacgtcgatccagctctgctcggcgtcacgtaccacgtctacgtcatgggggcctcaaggtcctcgttcgctgctaaaatccggttccaaactraactaaaatgccaggagctctgttattcgtaaaaagaagaagaaaaaaaacagatccgctgtcaaatacagacgagtttcagtcccggtctgtagcacaaatcagaaagggggtgaagcataaaaaggcctggacacggtttggttcgaaatccacaaacaaagtctgcgaatgggctgtaccaactcgatgcctctgatacgggcccgtattcgccgcagggcccccagcccagccgctcgcgcatgatcccagccgacgactggtctttgcgttccattcacgtccgtcgtctagccatgacatgacgaggagaggaggcaaaggcagccagtcaggcaggcaggcccagtccgagaaacgcgggaccgacaagttttttttttgttgttgattgcgggaccgacaaggttacttgcgtaaaacacaccaaacccggggggccgagcgctcaactgaaacctcgaccggttcccctcgcccaccaggaatggtggcccacgggccagagactgcgcgcctccctttccgagccgcttcctccctccgtcactcctcatgggtcatggcattggcagttgcgcactaggcagaacagagtggaaaatagaattaggcctaccctccgagagtcagatctgaggcgcgccacccgcgaccaccgcaccgcgtcgtcctcctcctcgctctagcgacgccttctggaagctttgggaggccgcgctacgctacgcgacgctacgctccggcgggcggtcggg

SEQ ID NO: 5638 - DNA, 204 bp, Zea mays
tagctagttagctgcattaggtatgagggtaaccaatggttaaatctgtatcgtccaatatatatagaaacaattggatctataccattaaaagatccaaactttagatatataccatggaccccacatgtcattgactcatgtggacccacatgtaagtgagatagtaatggtatggatccaaagtgatgatcttttaatgat

SEQ ID NO: 5639 - DNA, 640 bp, Zea mays
gcacctttgtctaataaggccagcctgattcaaccgagacgttgcttgccacttctgatgcaactaatcctactgtttaatttttttggtggggtgggcccacccccattgctgtttcctggggggaggggggggggggggggtgattggtattggtggtatacatagcaaagtcatttgcagatccatccatgatgcaggactgagatagacgatatcacctgtgtaaacttgcagatttgcaatgtgtcctcatctcatatgtatgctgagttgagatgaaatgaataaatcatcctacaagttttttttgagtcatcttcagaaatgtgttgtgctcagtcagaaaagtaaccatgcgtttctgtgccgattcttgctagccctaattaatataaggcgaaacagataatgcctatccattggagggattagaggaaggttcttcccttaaaaagaatgtgggtcaccaaacaaagggtaaacgaaccgaaccgaaccgtgcatatcaacaacattacaacaaagtaagcatgctcttggttggcagtagttaccacttgataaaaagaagagggagaccatgtgctttggcttcctctctgagccatctttcttgctctagccttaggccttagca

SEQ ID NO: 5640 - DNA, 57 bp, Zea mays
ccgccgcctccggcagatccagccagcagctcccgccgcagaaccgccgcgggcgcc

SEQ ID NO: 5641 - DNA, 1467 bp, Zea mays
tggatgttttgatgattaggaaccttggagaggatcaacaaggacttgggaaaggcctaggtgttgaggaggagcagcaaggccgcccacaacaggaaggagatcaagtctgactcggctgcggctccatctcgggttccaggacaagtctgcactaaaatggacgcccwagatgcatccggactctgattgcgacggacttgatatggttggaaatataaagagattatctaaccaacccaactagttccaccctaaatttcatccggagtcaacgggaatcgtcgaaacaattcagcgttcagattctgttttggtgctgcgacaccatctgttgggccgttgggccgtgtatcgtgtcggagcccattaggggcgagtccaggggtcgcgcacaccctaatactctatttatttagtagctgccgccacataaggtttgggttttgcttagatgaattctgtcatcgaacagtgtcgccgtcatcggtttgtgagaccccatctcgtaatcaatacaattttggttgcgtttctttcttgttcttgcctgtgttcttgattgcgcttgcagggataagccttcgtggcgaggtcattcgtgtgtcatgggtgataaccaacggagctgtggtgtagtgattgcgaggaaccgttcgctcggagccttggataatcaacgtcgagatctccattcaatcaagttatcgtatctcacggaaggtcgggccgcgtcttctatcaggacccctaggcacatggaccaatacaaaaagcattcattgaacatccaacaacaccgagacatagaattcacgcctttgctttagtagattgagatttgggcactagttttgagctataactctgttgtgctgttcttgttctcttctctctcgttttgtgtgcgtgagtcgctgcaagtttgtcccatgtgtgtggttctattccctcccttactcttgtgatttacttgtgatcaatcgtgtaagggtgagagactccaaattgtggagattcctcacaaagggaaaacttgagataaggaagaaaaccgtggtactcaagtttgatctttggatcacttgagaggggttgagtgcaacccttgaccgaaggaggtcacaacaacttggagtaggcattggccaaaccacaggataaattcactgtgtcacttgtgcatctttccactgtgattgttttcctccatagagttctcacatattcacttgtgttattgttcctaagtttaatacatatcttaaaggaaaaatcaagtgaagagttctcttctctttaccgctattcatatcatcttggttttaatccttctaacacttattataaaccaagtttgtcttgtttagagttaattattgcaggatcacctattcacccccctctaggttctctcaattggtatcagaggcgtactcttcattcagggactaaccgtccgaagag

SEQ ID NO: 5642 - DNA, 1485 bp, Zea mays
tttggactagatatttcttccttttttcgtcatatattttgcaagcgtacagttcagtgtatcgttctctaattgttatatgttggatctgagattatggctaagacacaaaaggttttagttactgcagctttaaagcagtgtattaacgatatacaatcagttttggcgtatcctaacaaacgaaacggtatgttctatgcaaggtccgggaagtcatgacagcgatatcggagagcagcagaccagatgtggagcttattctgggtgggacaacccttcttaccccagacgacatgtttgagttgatgttgggatcgtcaagctttgcttaggctcaaccttcactcttgagtcatgtgcgggacttggaaagaaatcggagcatatttttttcttattctccagaatagttacttgtctgatgtagcagaagcattcagactcggaagaggatactaccagaagaaagcagtccattcagagtcaaaatagtttgcaagatgaacctacgagtattgctggaaggtgtaagaaacagtgtgtctagttatcagtggctgactcttgttgtaaaacatgtagcagagatatatcaagcaaaagatgcgtaagaactcaagtaatttgttttgtcactaacatgagcagatgccgtttggctccatgatgaattgtttgtcggcagtaactaactcgctcgtaatattttactaaattaaacttttattatattatgtgggtaaggcttggcgcttaaagatatcttttttcagatccaagggctaaagaagctaatctaattaagaatacttggattaacatggaaacatttcagagtagtacaaatgctccatctcagaatcgtcattaattaccctacggtccagtttgtttcgttggaattgaattccattttaataattataatttagataaaactaattaagtttatatatttatatatgtaatatatttgtatattatcttaaataatatgagagagatagttatatgctatattcatgtgctataagaaaaataatatttaaatctataaaatcaattttatcttttactctatgaatttaagatagacttatatgataactttggaaagcagtgaaatgtcagattctaaaaaaatagtttagacctactggaaaaacatttcaaagcactaactggagaaacattccatgattcttttgcaaatgggcaataatttaggaataatctaggaataatgtagctctgcaggaggcagaaaaagagtgacgatgcatgggggcatgcagtgcaatggcggcctttcatctgtctagcccttgccgcatggtgcgggagggtgttgaccagccctgagctgacagtcagtcgatcgttctatttatacggtacgctctgtgacccgattgatctccatccatccagttagttagttagttagttagttgagggagaagaagcaggggaggggaagcg

SEQ ID NO: 5643 - DNA, 1500 bp, Zea mays
ggttgatttcacccccctcccatccagtccaaacaaattctactttaaaagtcgtgacaagccctcatggccaggccgccagggcgacaagcacaagcagacaacgagccatcttcaggaggtgcgccctgcactgcatgcacacacacacaatgccctctgatgtgttatgaggccgggtcaaatcacacaacaatgcccctcacatcgtttagcgtacgctacacctacaaaacaaaaaaaacagagtactattggcatgaatcagtgaccacggaccggggggccagctagctagtgcatcggatcggtggctagctagccggcccagggtaacatggcgggggcgccgaagttgccgttagccggagcagggtccctctcggaacagctcaaccaactgcagcatgtgtcctgcgacgcattacacgtcgtctagggtggggggaggcgagggcattggccggccctccccagcacactcagatggctacagggagttcgatggcaatgtcaatgtgggcgccagccgccaggccagcccgggggtccggcggtggtggtaccgatcgccgatccagggcgtactgtgcccgtgtcccacccccactccccgtcgagtttgtcaccatcggcgagggccaagcgagaattatgcttgctcggcaacgctgagcgcgcggtgtgcgtcaactggatctatcaaaacgtacacgattcttatgatatcgttaccatgtcagatttttttttgaagaaaccacgaaagttcatggtttttcattttttttgtaccattgggagctgagcgaagatgtgcaatccaaccatccaaaaccagagtgacagaaaagttccccattgaaaggagagactggtctagtaaaagaaaaaaactttgcagtgtaagcagtgagtaatggtggcagccaggcacgggagcgttgtttggacatccacctctgccgctgcacctgcactgcggctcctgtgcactcgctcctgcgctgtccaccaccactgcctcgtgcctccccagttccccaccccacacagtcccacacacacctcgccgtccgcttccttcactacagtatcttcgagacgagacccatgtctctgcgtgcgccggtgggcgagatccaatccaagtcacccgtgcaggggcagggaaacaaaaccactgcggctttatccgccaccagcggcaggagcgggcaatatttcaaaggccgtagccccgtataggcctgcctctcgtctgcgccctactccccaccacttccctcccttccccgcctacaagcaagccgccccagccattcatggccatcaccaccaccaccatgtgtcgccgccactccacctccacctcccacccactcctcccaccgcaccactaaacccgcctccctcgctcctcacccgctccctgtccgtccatccatcgcctcgccgccgctctgctgccgtttgctccagctgcggccgacgggggcc

SEQ ID NO: 5644 - DNA, 1078 bp, Zea mays
aatttaagcaagtttctgtaaataaatatcttgaacctaatctaagcggccaggaaaatcaattggtacttcaacaaaagatcatgcaccttgcgaacagcgaaacaggtgttattgtttacaacgaaaaaggtgtaataagggcccaaatgatgagcactcctacaactgaaccatatccttcatgattcctttggcctatatctgtctccttttattgctactatattgtaggctaaaaaagaaacctatgaaggtgttgagaagaatgagttaaataaagtggaatcataccatattttgctctttttgttgttgcctgttaacacatctgaaattctgaactaacatggaacattgaggtcgataaaatatatgatgtttatttttatataatctttgtgtactaacattttgtcgtaaaaaatagattaatgtacaagatgtcgacatatttgcttatgattaaacattctatatttactctttagaaataatttgtacgatattaataatgtttgttcgacatcagtgtaatatatttgggttgacgtatttataataatattgcgtatttatatcatgatcactgtactcacgtcgcccgtcgctagggtccttagtcgttgaaggctcgtcaatttgcgttccgtggtatcgcacgggcacatagctagtattgtatatatatatatataaactggtttattaaaaataaaaaaataaccgtgccgagctggactaacacgtgccgagacgacgacttaagcacgactcacgtcattattaaataagccgggcctcgtgctggtccattggacatggtctatttaatcatctattgttagaatgaactatatgctagtatagatatataaaattcgagatataaaattaaaatttcatttattttaaaatataaaagggaaaacaagatacctctcgagcccaccttcctctttgtctcaaaaggaaaaagaagaccgcatcccccggaactcaggatccccgtggggctctccgtgcctgatgccaccattggcaaaaccctgaaagccctaaaccttccgagacaacc

SEQ ID NO: 5645 - DNA, 1500 bp, Zea mays
cacttcttcgcaaccaatgatgcttatatcaaacttatatgatgaactcctctcttgtggagcagaggccatacaatgtcattggcaattttggctataattacttggatcaagaatccagctggaatatgttgttgaatctgtctgatatccctatctgatgaaccaggatgatttttgcctcgcacagacattcctttggaatacatcttcaagtcactcttctggtaatgtaacttaactcttatgtatcaccaacatgattgactttggtctgtcgaattttattagactaggtaatataccaatatttatctctttacatggcccatgagtttacaaattacaactatttcggctcttgtaattaaaaatcattgcttgttcaaaagttcatttgagttttctaatgtggaattacataagcaacatatatttcttagtaaggactaaggagcttaaataacaacatttggaaaggtgtcagtttgaacattgattgttaataaaacctaggtttaggcgaacttcttacaaatagaaatcaggcaacacaatattagtttcatgattttttggtctgtactcagggtcgaggatttcattacgcaagttggaaccggatgtgtattttgttatggttttgcttttccatacgtttgctcatacttcatagtgtgtcccagttagctcttatgctgaacaaacatatgtttgtcatatgctgcattttgatgatttgtaggtgcaaaacaatatgataaagtttgaaaaaactgaacacaactaaccagggaaatcgcaccgggccaagacctccaaggctacgctgtcactgccagttaatacgacgccctcgggggccaatcactagcagcacgccggtaacgcctacactttcagggccgctcaaccctcttctgtcgctgctgtgcaccatggctcctcttctataggtgattgattcttcatctcctccataggtgattcacttattggcaccactaacaatgttctactagaatgggataatctgattgtatgtgtactctgtcatcaacttgttgctctaagaatgttgctgcatttaaggttagtgaaaggtctcctccagatatttgactatgtctaacctatgttagtgatacatggttgcgtgcatattctatgtatactgtcctagcactggcaatgtatattactggcaaaagaaggggtagggagagaacaattaagtgttactaactccaccagagtcaatttcttcatcttaatttcttatccacatacttcaaatgttttttctctacatattgttttctttgtcctctagggatgttggatatggtaatcaaagaattatactttatatatataattctagtgatgcactttgaagtttgaatttgtatatatttggttatttattatgcaggtattttgcttggtgctgtccatggcatggtggaggctcttttcaggagatacatagaataagga

SEQ ID NO: 5646 - DNA, 463 bp, Zea mays
ctgcagtgtctgaagttgtatccttgacacaatacaaaaatatctgctgttcaatattcacttttgtctctttctttagtgcaggaaatccacacgatgtgttaatgttcttaatttttccagagtctgatatgacagtatgacaccaaactcgtggtatgtgtttacctgagatttaaaactaatcatggtatactaatgtctctactttattgcatccagtagggcatacaagtagaacacatcgagtttttctgtgaggttttcaagataattttttttgaaaaaggattttaattgataaaaacaactcattgaactttctggtatgaatatttttgtatcatgtcgtataagttagagtatttggcatgcctcgagttgagatcctattttatgtgtcttttttttaattctgtccctttggatttatgtccttgacatgatattttagagaaaaaga

SEQ ID NO: 5647 - DNA, 1432 bp, Zea mays
ttctatactatccatattcaagaaggaaaaagtattccatgaaaccattaaaaaatatttttattccaaactacaaattacaaatgattttatttttcataatatgctagaaaaattatgtacaccatttaaagtattaaaaatatttatatgataaataaataattatagtaatgttatattactagtgacataaaatgataaaattaattaatattaaaaaattaattctaaatacattacattattgggattttttgagtccaaaatacaaatatacctagtataaaaaaatatttagaatccaaaatatctaatcaactacaactcttcactttacaatatatagattgatttgttcattatttttatttaaattttggtgcacacattcatatacttcattcattttggaatgacatatttaaatttcttaacatttttactattttataacaattaaatgaattactagatatctatttattgaaattgtaaaataatatgtaaatgtggtacatatatttataaacatgacataaatttttattgttaaatactatatttttattaatgaatatgctaataaggtatctattgctatgattataatttacttgtaacatgatttttttgtcacctataacaaattaataatcattataatattatgttctaagtcatgtgagtatacgaattcgaactattcattttatattttatttgataatattcgtatttatatctatatttaaattaaaatatgataaatagtgaccattcaaattcatattcgtgcatatccaattcgaatcatctctaataataacgagaccggcgtaccgaggaccgtgtccacgtgattcctggccccggtcacctcgccatgtcagcagatgcccgccccggtggggcccgcgcctccccctccctcctctccgtccactagccactagctccatcaaagtcacccaccccactccccggaagcacgccgaccatcacccgcgcctgcaccttccgtcacaaccactctctcgcttccaggcgggcccagggtttctctggtcccgcacgtctgtcacctgctgtggaggtcaccgcggtggagcgcccccttcttccgtgagcgtaggcgatggtcccaccgcgtagtagaaaaacaatttaggtcgggacatgcacacatacacacgcgcacagccgcactcggttccagctacagagaattcgtccaggaaagtaaaaaaactcccccattcgcgagggacaggagggaggagtcaccgcgtgagctcaggaggaagagggagaaggagaggccgccggcggcggcgcggcagaccgggaaccgccgtgtagcactggggtggtggacccgcgcgcccatgcgtcggtgaggtggtggggcccgcttggcgctcgagttgga

SEQ ID NO: 5648 - DNA, 1349 bp, Zea mays
atatcggggtgagtacattaagtctaggtaccaatctacaagatcttcgggtatcctatccagtgyagtatgttcagtgcacaccggacacgttggtatttcgcttgttctcaacaaagcaattccctatccgatgcttcatatataaagtacactggacatgtctggtgctaatgcaacaccgccaactcacttattatgagcggtttttaagttgggttcaaactcctcgtgggctcttataaattcacatagcattagaccattagttatcacaarggtgcattaccgcttctaactagacttttataggtcaaattacctctttacaccacttctaactattagcataagtggattcacaaacaagctcccagttacactcatgcatgtcgcgcttgtatttcataagaattgccttagtctggatgctaaggtcaccgcacgcgattcacacaagcgacaccagcaacctactctggattcgtttcagtgtccaaacaagttgtctccctcagaaaatgaaccgagcattgtgcacaagaacagtgatggctcacggtgatttgcctgtaggtggccaaaaccacgaactgaaacagtccagccatgtgcatctaagatgcgcgtcctagttcagctttaaactatcgtctttttaggttaagataactagagcagatatataaacgaacaaaacactgttcatatagcagattaaactatttacaaagtgaagttagactatacttcctctgttcttaaatatatgacgttgttaatttttttaaaactttgacaacttgttttattcaagatatttattaaaaatgtaaaatttcaagtcatgcgcaaacaatattaagtgataaaatcaatcataacaaaataaattataattcatgttttttaataagacgaacggtcaaagtttttttaaaggtcaacggtgttatatatttaagaacagatatagtactatttatataatagagtttgaaataaaaagcaaaaatataatctatcgtcgtgaacttagctttagagggctgatggagccatggatgcagacggagacatatattctccggtcagctcaccgatacccgggaaaagaacacacacaaggtcgcattcgcctcagacacagtaccaaagcgagttagatagaccggcccatccacctggggtgaggcacacaaatctttcgctccatactgataccgccccacgcccccccaaaaaaaattcccaacaacctgcggtataaactacggtcgcctcttcgtcctcgtctcgtacgtgtaatcgccgaaaaccccaccgccagtcaccactattcatcggcc

SEQ ID NO: 5649 - DNA, 190 bp, Zea mays
atttactggatcgacctcgaccagtggcgatttaattggctaatgatgggttcatgatcatgcctgcctttggggctggaatgctggatggagatgggagacagagacaggattgtagagatgttttttttttcatttcttacgagagtttcgctgctgtcgtgagatctgattcgataatagagagaag

SEQ ID NO: 5650 - DNA, 596 bp, Zea mays
caaagcacgagtaactagctagataaataaaggaggagctcgtgccatcgccagttgggttgctggcttaaaaagggggaggggggtctcaccgtcccaaacgtttctgcagaacgtgaagcatacttcctaaaaaaaaatacaagtggccgctggtggtcgacaaggcgaaaagacccgcacctatttccaccaccgaacaatcagaggcaattaggcattctctttctcctcacgtctccatccgacacacctgcccttcctcctccctcgcggtcgcccacaagaatcacgtgttcttcgtgcccaccggcgcgcctcacgtctccaccacccgccggaaggacgaagaagaaaaaaaaaactaatcctaaacgatttctccccacgtgtcctctccgttgccttgccttcccctgccccgcccccatctccgatctcccctataaaacacaatgctccccgcgtcgccccccgaatcaattcccacagcaccaccaaaccaataggcaggcagcaaacacaagccaataggcaacacccgcggcgacgcaagagggagaagcgagcgtgcagcggtcctcctctcgatccac

SEQ ID NO: 5651 - DNA, 512 bp, Zea mays
gttttgtttatcatgtttaaagttcttcgtttgttttccttataacaaatctatttggtggacctatatgtgcttgtactcagatgcagtacatgatatgatgtattataatttttttttgttatttttctaccttaacacaaggtggttggtaattattgcccaattttgattactttatgttacaagagtagattacatgagtggccgataagcactgtattttaatatacacggtggatttgttcgatgttaaaacttatgtaaaaattcttaactttaaaagatgataaaaacataaaataaaaaatagatttttttattttaacatatatcttagccaggtacgtacgttcacctagtatgggctatgtgacgctttcactgcacactacaatcaatcagccggcttttcctctcttcccctcgacagaagcccccaaatccgataccttcccctatccacctcgagtcccttccttccttagcggcggcgcgaaggcggcggagcc

SEQ ID NO: 5652 - DNA, 231 bp, Zea mays
ttccggcaagcctcctctccaagcttcgaatcgtagagaaaagcaagcccgcggggccgacccggtcggcatccgaactcaacgcctctgagagccttaaaccccgacccgagcctgtcagactgacatcgctcgaccattttcccatttccattcccatcccaattcccagcggtttcatttccacctcctccttttccaatttcgactcgattcgaaacaggataccaa

SEQ ID NO: 5653 - DNA, 1316 bp, Zea mays
taaccgcagaatcttttctatttatctgtaaacatagtgaataacacaggcaacttgtatggtacagatgtctgaataaaggaaggatgaaggaaaattgattgactatgttccttgttgtttccttctgactaatgaatacaatgtttccatttttttagtcctgagctagacaaaatcagctaggtatggccttgctgttctctttgggagataaattcgtcgcctctagcatttggcacaagaaaagtttgttttacactttgcttcattaaccaagccactgcttcagccttttgggatctaagaggtctgttaaatattcttyttctcttgcttgtycatttcttttacctacaggctgcatctccgcatatatacatgccatcatgagatgctcccaaacctatactgacgcacaacgatcgacagaaagccattcaggctgctatatctgagccagttactgagagacgaggacatcattttgatgcttctgcttgatggatgcttcgttgacaacatcttatcgtggcatgatcggaaggaatgacacatactgcccaaagttggatgctagatgtctggacgaggaacatggaactccagcgggaaatgcctttggagtgaagcttggtggccaattggccatgatcatgaagtatctcccagctggaacgcacacctttttcttaatttaataaaaagaaagaagggataagtaaaaatactggaatgcgcaagactccgctgcagcaatgcacgctgcctgaaattgaaatccggacctaaactgatggatggagccactgccaattctaccagcatctgcttcggattctacaaagaaactcgagactgacggcggtattagtgttcagtatcaagaacaaatgaggcggcggagtcgttttgaggagctgttctgactcctggacatcattttcagcagtgacgtggtaaaaatccctcggcaaattcgttttgatcagtgaaagcattgggctggagcctggaggtcagcaagacaaacgtcgcagtatccgtggatccgcctcgcaaattcgtttacgtaaactctctcttagaggatcgtaaactacgccttcacagttgattagcgggggcctttagaccggaggaagacgcattctctctccacagtccacacaggcacacacacaccactacaccagacgaaccgtctatctggccaggcctcgccacgcctatccgcaccctcccctcccctccccttccctcccctactctctcggaagcggcgccgctgccgccgcagcggcgaggagccagcc

SEQ ID NO: 5654 - DNA, 1500 bp, Zea mays
aacgtgatataccgtttcaaatgtggcaattgttattgatcgggaaaaatataatggttaagataacgatgaataataattaaggtcatatttaaatgcattaaaagctaatagttagatactaaaattatgggaagaaatccaaacacatgtaatagtacggatcggaggacacgatagcgcatgcgtaggtgaggtcattttacacacgagaattaccacatccctgcttcatccaacgatcaacgataactttgcatgtggtgtacgttcggcagtaacgtagcagcatcattcatttaatttgcacgggtacggtgtggtactccacttggcacgggccgaagataaggttggacatgtgtacgagccgtgtcaggcaggcaggcctggcgctgggtcattgtccacagcttacatctcgtcacgcggccagaaaagggcaaaaccatttggcgcgtgcattcctttaaaaggtcaccaccagaccagcagctagctgccaagtgagcagcggcgcaggagcaacaagtgtgctgcggaccctggacccaggcctccacgttacccaactctgccgggcccagcgttactaatgcccagagaagaaaaaaaaccaatggtaaaaagaccagaaaccggcgcccgccgactgccgagcgagcgagatttggccgccgaagtttaactcgccctcgcccgtgtcgcgctgagggtgaggggtcactactactggtcccggccggctctctggaccggcaccggccggagacggagagttaatccagccaaaaaccgaggcctgcccgatttagaaagagccgaaaattctagccacacgacgcacgcctgcatctacacccgatcgatggccggcccggccagcgcgcgcgtccgtccgtccgcccctcgatctggcacagcgcagcggcgccgtaccgcatcgttgcatgcacgcccgaaaccctagccaagttgccagccagcagacacacggaagaatttttaatataataatgtcccggccggcgcagcctccgtcccgcccctgcgcccctgttatatatccggcacaggctggcccgcttgttgctccggccgcgacacccaccggcctagtagctctcgccatccacatcgcctgtagctgcatgcggtgatcgcggcggcggtgcaggccacagacgtacgcgcgcgggctggctgtcgggcgcgcggatgcgccggccgcggcgggcggtgacagaagagagtgagcacacggccgggcggaacggcaccggcggatggtgccgtcgcggacgcgtgctcactgctctatctgtcatccactctctcccccgctccgctccggtcgctttgccgccgatctgtcgaagcaccgcagctgactagccgccgtgatcaccgcgcgcaccggccggcgccgcgcttctggcactagtagctagctaggtggtgcaccgctccacacgcccatcttcttgttcgcgtcattgt

SEQ ID NO: 5655 - DNA, 493 bp, Zea mays
gaccaatgctaggagcctaggacactggacacgtctgcttgtggacttgtggttggtagttggttagcacgtccttgtcataaaggaaggggagaagttgttaactatgtgaggtcaatcactttagatgtgtttggtttgatgtacaaggaaggatagaagaaagcatccacagtttttatagtgtttagatgagagtcacatggaggtgagataaataacagagtaatttttggtgacagcgtgatctcaaaaaatggagaggacggtgtcgttctcgactcatcctattttaacctcaagtcaaacacattatcagagcgcgtggtaaaggagacctgaataatggaggccaaattgtaaaagcaaatgtatgcatcgatatgagctaggcttccagtttctggacaattcaatccattcacatcacagctagctagctatgtatgaggttacctgtccattcttcaatcctctacgaagtgagtagtcc

SEQ ID NO: 5656 - DNA, 1429 bp, Zea mays
atcctcctatagtcgatctgcagcttctatcacaacatgtatgcctatccaaattaagaacaagtacttaactttatgcttttcaaatgtgccatgcacttcatgtttcgttacataacaagtgtgtatatatgtctaggtgtgcaggtctttgaaaacaatttgtgtaaacgcaaccgaactctagatattacaacaaacatgttgactcttaccacaattgacctaacttaattttatataagcctatctattctagaatctacttaattgttctgtgatttgtgcaaatgtaatagttataacagatgagaatactttgcctacaaacaatatagcatcttcgacaataaaattgcaaaatatttttgacgcgcgcaggacgtgcgccagtgacgagtaattttaaaagtagataataattcatactgacggcatagcaggaacaagtaacaaaacagtgaaagtttgcacatgccgcacaagcaaacagagtttctttttgaggaatcagcaaacagagtttcttgtgaacaccagagtgcctggtggattgctgaagcgtgaagcagcaaaaaagtgccaaaaacgtttcgtcggctggagaaaggccaaaacccttctgacccgcgcctcactattttcgcattcgagtttagatcaagaattcgccaatatggaactcatttctctctaatctcacattcattgcaaagaagactatcattgccattggctcctagcaatttgcacttcgataacttacaattgcaacgcaggtaatgtacagctggggctcaatgaccgtactccctagctgaaaactctaatctctgagataaaatactgtagaatcaatataatccgatacagattaaagctaagggcgtgttcggctggctacaagccgacactgttgcagctgtttggactgctgcagctgcaatccatagagagaaaaatactgtagaagccgcagccgcagccggattgcagccgcagcaagccgcagcgaacaagctgtaagcgaacagtcttggtagactgctgctgcagctgtctattctcagcagaacactgtcttttccaattttctgaaaactataaaattgttggtgtagtggaagaaatcttgcgttcaagagagcccccaaccatacacaagctttgcatccaatagcccacccaccagctgcgaaatctcctccaaacaacaactgaaccggacaaagaaagaaggccaaaaagggagtctcctttccaagttcaaaattcgaaacgtcccaagagaaaccgaaaccaccataaaaaccagcaaccaaccgtcatcgccgcacaagcgcacgcactcctcgccgtggaccaactcccagctcccaagccccatcccgtcccaactcccaagagccgaacgcgagcggcggccgcc

SEQ ID NO: 5657 - DNA, 749 bp, Zea mays
atactataaatttaaacatttttaaaaatatatttttaacctgaatataaaacaaaataacttatttatgtcttctaaaagtttataacttcagttttatgattttctaaagttcctaataacatgcttcataaacttgaccaaattttatgagttgaacgggaatctaatggcccacgcaaaatgggaaaacaaaaggaaaacaaaaatggagagggaatatgttatgggaaaggccaagcgcaggcgagcacgaggagataaatggcaaagaggacgaggcaagagcaaatccgaaccaaccaatcccaatatccgcaggcctccctctgcactggaccacaccacaccctcgcctttcccgcaacccagagcccctctgccaatctctgcacaacatcatcgattccccaggcgaaaaaaaatactctggaccctttttttcaatcagattttcaatcagaggagggtagattggatttgtcagattatccgatctccactgcagcctctctgaagagaagaggcccatccagtccagcctttccgcagttcctggagcaatcctggctcagtgcgtgaagcagcttgattcgcctgcgcaactgatagtcatagaagggagccaagagcttgttcttggctgcttgaccgattcttgattgagctgctgcggatcttgccaaagggccaagagcttgctgtgtctggaattcttggtcagccgtgccggatagggtgagggtgcc

SEQ ID NO: 5658 - DNA, 916 bp, Zea mays
agtcgtcttcttcacagcagacctagatctcgcctcccgggaggaatcccgttgggggaaaacagatcctagagtgtcttagcgttgacaggccacccaagatgactctagtcttcatatagtcttcttccctcatttggctcatcaagtcttcatatagctgttgctcatcggccgataggcttccgaacatcggcctaaggataatatctggagagatatcagtgtgatctttagaaccagtcatttaggagcatgattttagtagatttagacacctggtccctagcggagtcgtcaaaacatgtgttggcgccaatctaggcgccaaacactaaaacgaaccacctggcggtgctctctgcgaagacgcggacggtccgcgacttggatgcaagagcgactccttctttgcgtacgtccggacggtccgcacctagtgctcggacggtctatgatgacactgagagtcgtcttctttacagcagatctagatctcgactcccgagaggggtcccgttggggaggaaagatcttaggttgtgtcttagcatcggcaggccacccaagacgtctctagttccgaagaaaggtgaaaattcggggtagagaaagactaaactagggtaaataatacaattctcatacttattgtcctaatgatttttgatagcttatggaaaataatagcatatgcaaactgctaagctgctagcttgttcttggtttttagataatttgtacctctggttaagaatggagaatgtgggagatgatcctagagacagcaggtcaaagatacaaactctcatggttgggttccttctattttttatcactcataagggaaaattgataccctccctcttaaatgtttagacatggcgtacttcctggtatggtgcctgaattgggc

SEQ ID NO: 5659 - DNA, 1500 bp, Zea mays
gctcctctcatcgtctctattaatagtcgctagatcttctataaaaaaaactaacctaaacttatcacttttaacctcacgtataattttcttcatttcaaccaccgtggctttataacgtgaactgagccacacatgtcgttgttttaaataatatgaaacaatcctatattacgcaacttaagttttgtaaaattatatagctagtccgttcggatgtcacttgatgacatccaaataaactagctatctattctttcaaaaaaccgagtgacatattttcgattgactcgaatcataatcccgtgtrgtctctcgacaagtcaatttctagagctattaaagccaaacttacctaaaaagacccaacaagtgtcggctaccaaaatattcttaataaccggaaatgattttggaggtgcattggagggtccacgaacccaacagcggcgtgcgtgattgttaatgccgttatggctgaaaataagttagaggccgtttagatctagatgactaaattttagttatatcgttatggatgtttggattctagttagaaatattaaaatcacttgtttggttttatatgactaaactttagtcatttacttttagtctccatgttgccaaataaagagactaaaccagattccccatcttttcttaatatctgcgtttggaaatttagagacaaaaagactaaaaaggaaaggatcattatcctataaaactaaataaaccttaaatataatctaactataaaaataattattcagacacctcctgtatcccttgcccttcctcctccccgcccccagtcaccgccagtcgcatgtgtccaaaagacgcggcagcgacggagcggccagcccgtaccccaggtttctagaaactacaggaataacttcactctgtgtgtgaaagagcctgatgggccccaaaagaaccccggcccccgggttgggacgcggcacgccacccctaggaagatggagggatggatcagcgtcatgccggcgcgcgccaagtatcgtagggcagtacccccacacctcccgacgtgtcccgaagcgctagcccccgccctccacctcgcgctccgcatgcctgacaccttcccaccacgcccccacccttcgccctttttccccatccccacccccaccaggtcgagcgaaccctcactgaccacgggccacccccagatcgtgggcgccaggacttgacggcgttagcttatcggggactccgtcgtctgccttatccacggttagctaaccgcggtcgggcccgggtcaggcgcgcgaccgtccgctttataagcgcgcagcccttggactcgtctccctcgtccccaacccacacactgcccaccggtctttctcacacaacacagccacacagggatataagctcagtccacgagatctcccgtagaccagtggcgagggaaggaacgaaacagagcccgatcctagcgacaggccagggaagatcgcc

SEQ ID NO: 5660 - DNA, 1500 bp, Zea mays
aatcggaaggggtagctctattccagttcaaaaaatggagccatttcattataggcgtgtttggttctcgtgctcgccccgcccaagctcatcaggtgcgttgaccgcatgcaaaccggtgattggttgcctgaacgcttggatgtcggcctgtatctgtggatgcaactcaggtgttttctcatgtgtctgcctgcgcgcgtggagacgtggggagagagcatctctagccgcccaggccgctacgagcccggcgcccgtgaacgcggcaaccaaacatgccgtttgtgaatgaataaattctgtaaaacgtcaacagcactggatatgctgtggcttcggttgcttgcatgttgaagttgaagacgacattgatattttgatactgctgctctttgtggactcgcggtagatcggtctttgttgtgttacctgctgttttgagttttctggttcctggctcggagacaaggacttcgaggtacagctgacgcgtttcctcggtctgcctgcttgcacttgccccctcgaccccgaggctgattcaaattgcatcgtgatcgaaccaagtttatgccaaaggaacttgggttccatattgcacccggtccgctagacacgtacgaagtccgatgtccctattccctacgaacgtaccagaagttcgatacggtgcctatgaatttcgttgacatgttatgttgtggctagcagaccgtgtatatatttgtgtaaaatattgttcgctttgattaaaaatcggctgcaatctatatagacaaaaaaatttataaaaactgatacagattaaaactaaacgaatatgctgattcatagtcgtataaagcactattttgtttatatgatattggataggtaagatagttagagatagccttaaccgtgtatatattagccgtcacgacaaggttccgccacagcagttgttcgtacagcgaccacatggcactgggacccatgagctcgtggtgactggtgaacagtcaagactatatgcgtatatttagaccgatcggcccgacttggagcccaaaaagcatgacccgattcaatttcgacatgtctcgtatttatttcgagcataccgggtcggctcacgggcttagtccttggttcatggtctagcacgtaattgtttaaacgtgcatgacttttttgagcggtttaaaattacaaaaaagacagaaattcacatcatagcataaaaatccaaaccagtttaaaaaaaaatactagatatagattcaatttttttggacctgaaaaaagtaccatttccgaagtactactactaccgcatggcgagcgagtagacggttcttctaatgggccgttccgtgggcttcattgtttaacctggggctagctatatagtaataccatcccaccccgctcctcaaaaccctagctagcgccgccgccgctgcagactcctccttttcgatcccttcacaaagcgccgccgtcgccccatcgaac

SEQ ID NO: 5661 - DNA, 1320 bp, Zea mays
attggagttgctcttaagctgctaaaggctgagaacgcggtcggctttgaaacaaacgaatactgaggatgcgttgaaggtgctccggatctccagcggcggtggctgcattggacctctctaggtggtccctacagacgacgggtggccaaggcgggagaggcttccctccgagcttcgcgacgagcggcagccttgctcctgagagttcctgctgaacaggaactgttggagccgccagccggggaaggaaggaggatttagggttatgtggtttagtgtttctctgtttggcctttgggctgcaggcttcgactttgggtaattgggctggtaatggggtgtaggactgcaggctgcagtgtccagccgtgctgtgttgtttgggctggggcgttgggctgtgggcgtcctgctccatctgctgtcaccctctctatttgctactattctctctatccatttgaggctatattcctatattttctgtttttatttcctatttttatatattactaaggcgtcgcctcgccttacgccttaacgcttaaaaggtaaaatggrgattgatcgcattaccaccttaaaaactatggttgtggtgccccaaaggtgtgtgcctacctgttcgccatcccgtcatacatrcctgagtggagccccgagcccccgcccaacacgacttttgggtgaatggcatggttagcgtgcactgcatacagaatgatgaaagacatgtgaagcttaatcaataggagctcagaaaaagagatgttcattgttttttctctctccatgcaattggagcctggagatatacataggctggatgcacataagacatacagggatagcttttatatcgtctcggttgtactagagctgtcagctacattatatctcaaatggaatttgatagtggatgggacagaaaggagtcacgacacacattagtcgagacctgttgatcgctgtaactccttaattgcctggagtttcaccggcgcttctgtatagtrcagtttggtttgatgtagtagtccaacttttattaagtttcgtgctatcagaggtaactgggtggataagatgatgtggcttcaccaaattgcagagatatctgctagtgcggatctcctatttagttatagaagatgtagcattgcaggatatgtaagttgtgcttgacttttggaatgtaaatatatttctttatttattatgccaattgctctagttatttctgtgttgagaaggtatgatatcctgttggctattacaggttatgtaggctctttgggtgataaacctaagcgcact

SEQ ID NO: 5662 - DNA, 168 bp, Zea mays
tgttatcaacttttaaggtgtgttctctgaagtaggtaggtacattgattgaactcttgtggtgggtactggagctgaaacttttctgctcaaacagatctatattcttttttgagtagtcattcaaagttggcaatatgctagtaatgtccacctaggccctgaata

SEQ ID NO: 5663 - DNA, 788 bp, Zea mays
agtatcttcctgcagcagctgggtggcaagagagttgtatcctggtaggctcagcggtatcttcttattaatttgttaactataccggatttcatcccttccttgctctaccatacatacacacactagtgttgtttgtttagatcactagtggtgcttgtttagatctgtattgctttctcacttgaactacgccgaggtaataatctgattagcgaatcctggtcccatcatctgaagctgcatttttaggccataccaatgtgtcattgagttgcttggcacgctgtttgttttcagcatgagcatatatagagtgcagtaacgttatcttcctgcagctgagtggcaagagagttggtatcctggggcttggcaggatagggtcagcgatagcgaaaagagccgaggcattcggttgttccataagctacagctcaagatcagagaagcctttcccagactacaaattccacgtgagcgctgtcgacctggcagccaactgcgacgtgctcatcgtgacgtgctcgcttaccgccgagacccaccatgtcgtragccgcgaggtcatcgacgcgctgggtccagagggcgtgcttgtaaacgttggccgcggagcacacgtggatgaacccgagctcgtcgccgcgctcctcgagggtcgcctgggaggagcggggcttgacgtgtatgagcacgagcccttggctcctgagcagctcctgggcctggacaacgtcgtcttggtgcctcacgtgggcagcgatactgaagaaacgtgcagggcg

SEQ ID NO: 5664 - DNA, 178 bp, Zea mays
ggtttcgccccgggtctctggcttatctggagattgtttcacgcttttgtttatatattaacagtgttcattgcatgaactttcttcattgtacaaggatagatgttgacttgtttctaaatcatatattgtgttgtaccaattgaatcatactgttcagatttcattggacagagtt

SEQ ID NO: 5665 - DNA, 1500 bp, Zea mays
ctatctcatttatacgagtctatttagatgatatataaaaaacgtagtaatgcacgaacatctaactagtgatttctaatgcctcatcaatgcttaatatttccccttgacacaagtttaccttcagtacgcaacagttgttagatcaagcatacaagggatattaatagccctctccaaatcagtttgctcccaaaaaataacagtatggtaataaaaagagttgtattgaatgtttcaataactggcagcaaaaccatctgcacgggtgcatagtttagtgtaagattcagatcgtaagattggagagcaaagttgtgcagctgttggctaggctaggctggttgatacatgctagattgctagtggaaggaacagttgacttcagcgttcttggtacttcatgacactatgacaggctggtctgtttctcctgcctgctgtgcgttaagcatttagaatctgaatcctgcaatttcaagatgatcacatgccttccaaatttcttatgcgttggcaccttaccgaatgctgaacaactattagttgcatgtgcaaatctcatggctagagttggcatgctatcagttaaaggagcaagatccactttattaggatcttatgtctatcgttaaaattaacaggccaataatggaccgaatcatcagcaccttatgatagtttatttttctgaagaaacttcaactgcagcactcccatttcattgattgtttttttttatttagctgtcctccatgttgaacgagatgaaagatggaaagcgaaaattgacagcaggaaaatagacccaaaacatcgatttccagttgagtatatttctgtacactctcatatatatacatcaaaattgtttcgatgatcagcagatcctctaaaacacggatgctaatcgcaggcactagagttgttgtatgatctatctacaaagtgagagtgttcagaagagagactctgctctggatcagcgtcctgaacaaagtcgcaactccgctctcaagatcaacaatgtccaactccaacgcctgcaattgctcctccttgcacacgaatttcttcttctcaaatgccttggacacaagagaccacttgctagcgctgggcaacgtgatcttcttcgagaggagatgtgatgtcgattcgagcatcgacacagcaatctcccttgcttcagccaacagcctgactatcttgcatccttcaatgtcagaggcagccttgctgctgatcttcttgaactgcttctgtgccttcttggccaagcgagcgtaagactgaaccttggcctgaagagacacgtcgtctcctctcttgagagccagctgcatctcctggacgctgaccctgagctctgcaaagttctcttgcatggcgttgcagaggtcaagcaggacaagggagcgatcgagctcctcctccactgccttcctctgctgacgttggttgccggccaaggatgtgagctcgtcaatgcagctgtag

SEQ ID NO: 5666 - DNA, 723 bp, Zea mays
aattcttttattgttgcacatatttttttgtctaccataatggtctttgttgaagcaatccttcgtcccaatctgtttgggcagaaaatgcagttgtgtcacagcgcagtagtgcgtacattgtttttgtaagtagcctgaccatatcttgtattcaggtaaatgcaatgctatgctaattattcagcactataaaaattgcagaaacacgtgggtggccaagcatatacgctgctactgcacaagctaatccaccctgtaatgatgtgattatattggaatcgagtgattaaatgcgactaacttgggaacctggtgctggaggcgagcaagggcatctagctgttccttcctccactgacaacttgtctgttcatccatcatctcgtgatctggatcagatgctcatcttgctgcccttcaaccgtgcaggcgagtttgccgctcatattgcagacatagcatcctcctaatcaagctaagtttgtgatgcttcttgggtttggtggcttctgcggaagttcaccagttgggtacacatgagaacgattcttgctgtctgctgggtgctggctcagctatgcagttgcttccacctccttcgctttcgctatataaagaggaaagacagagccaggaagaccaccattgcagcaccttgccttctcttccccatttcaagagaaaaaagaagcttcacaacttcagcttccattcaaagac

SEQ ID NO: 5667 - DNA, 484 bp, Zea mays
ccgctggttcttgttgagtgattgacgccctaaaaaggggtcaacataaacataaaaatcaaaaactaaaatgactaatattttgaaatggagggggtatgtaatatgtcgacagctgcagaacgaccctattagatgagacgagagaggatgccaacattaaccgatctacgtatacgttggatgggcacttccaacgaattgtaggcctttgaccattgacatggacctcaacttaactgacgtgcaagttagtactaccactgacgtgatgaccgggccgcgacagcatagaagctagctagggagtcccgagttggtcagttcatcgccgccgctcaagctctctcgatctctatataaacccgccatggtgcccttagactgcacacaaagcagtgcatgcactagctagctctagcttcgccattgcattcgcttactgggagtacgtctggtacttgcacaactagctatatatatc

SEQ ID NO: 5668 - DNA, 1500 bp, Zea mays
ttggtaaatcaagtagagcttgttacatcggatagagctggttaagatcagcttgttagttttggatagagtttggggctgctaattttggctaaggaataaattaagcagataagtaccttgctcgtgcttcccctaactcatccattgttcatctacgaatctacgatactcttcatcgacgagtactgttcacacgtgaacaatactgcgccacccttgccaacagtcctcattctaggggggttctgattctagatatcagacctaccactcgtactacctcgataaccctagttccaacaatttggtatcggagatgccaatttggtattggagaatggtatcttccggaagatcacaaaatgatttctcttttttttccggcacgatttctctctttttacacgcacacatcgttaagccaacctacagatgaataaacgggtcgcccggctcggcccaggcacgacccaattagacgcggcatgaccaggtctatcgggctaggcctgcacaatcatgcgtgccttaccaagggcccaggcatgaccctttcgggtcgggccagcccgaaaagccctagcccaaaacagtgtcgggccagcccgaagcccggtaacagaaaaaatacaatttgcacaaaaacatacataaatattgagttgttggcctagctcccaatctttgatgcacaccaacatctccactgtctctgagttcaagcgtcgtcgccgatcctcaaaaattctaccagacaaactgaaagtagactccgaagaagtagttgaggcaggaacagacataatgtctctagccataattgaaagaattggataggttagtttatgctcatgccaccaatttaagatatcaaaatcatcctcatagrcagccacattgtcactgtcaaggtaaacagttagctcacaaatacccacaccaggtccactactacctgaagaacctgatgcagttgaggatctagaagaacatgttcctccaaaaattttaccccaagcctgttttctcttacctgtcatacctgattgatgtgtggttctagatggcctagcagcaccaaacttagtttcatacttggcatatagctcatacaactcagtcttaacatcagcaaaataagtactgtaattataattgttagattgagaaagcagttcaagaacattatacaaacccctcattttagctctagggtctagaacaaatgcaaaggaatataacattggtatagacttccagtacttcatgaacttagctttcattggaacaacaacatcacttagattagtatcatgttcatgttcatgcaggtgactagcaaattcaagtatgtgatggattaccaaaggactggtgggataataaacaccaaacaagacaacagttgattcataaaacagctcaaggaactccaaaaccttttcagctacataccaatgttgttcattcagtagaggatagccatagtgtgtatta

SEQ ID NO: 5669 - DNA, 1500 bp, Zea mays
gaagcagggatcgaaaagtataaagcagtagtgataaaggctaataatgtttctttttttattggtttgctgatggcttaaattaattcttctgctaattaacctagctacatgtgtgcgtgactggctgactgactgactgacacccacgtactgcatgcagaaacatacaaccaatctgagcattagcttgtggtgaaaggctagcagctggctcactgcaaacagaaagtgaactagtccctgctgtctagctagctagcttagaggtgtgtaaaacataggcaacttccttttcagttgcacctcagttttgcacagtcgcaggccagccacacacacacacacaagaatgagctcaactactttgcgcacacaaagatagtaggaatactccctatgtcgagctcatcagttactaagaaaaactaaaggttggttggtgctagcttgcttttgccaatgcctcaatggtctgtgtgcatgtatatatatgttaggccttttttttctttactaatacgtacattttcatcgtctggtggtaataaggcaagtaagaccaactccagcagcactggctatcccactccgtatccctattatacacgctctgagtcactatttcgctctccagcagccttcgcatccgtctccgcaaaacacacgcagtgtacctgcactctccttttccacggtttctctctcctctccgcacaagactgcatgcgccccctcctgctcgcgggccccagttgtcatagactgcatgcggagtgcaaatacggagtctgctggaaacggagacggatacggagaggagagagaaactgttggccgtgctaaatacggatacggagagggagtctgctggagttggtctaaatactccaatgacacagctgctcaggttgtaccactccacaccacatgtcgtcattgcatgcatgctagctgccattgataaaaagatagatgcagaaactaaaggggggaaaaaagagagggaggggcatagcaatagcacgtctggctggatggatgggcgtggctttttggacctgcagagggagtgcactcgattgcagcatctctctctacacgtatgttgcccgccttgccctggctagctgcagcaactgcgcctgcagagggcaacgccaaaccgcctgcagactgcagtgcactgctgcctccccctgacgccttttttccccgatcctctcctgcaataatacaataataataatctgattgccctcctctcctctctcaaataatcacgcttggacagcactagaagcactgagctagctgagaccacagaaccacatgggtctactatatatagaagctaggaagtagagaggggatcagtagctagctaaagcttagcccggcggccggccagaactgcaagagagaagaccaagaaacagagagagacaagcgcaggggacagcagcgggtagctagctagctagcgatcgacgacagacg

SEQ ID NO: 5670 - DNA, 672 bp, Zea mays
taatattattaatagtagtagtaataataataatatgtaggcattctttcataactactcctaaatgaacaatttgtaaataaagttgtctggtacaagtcgtggtgtttggtttcaaggggctaattttaaggttgactatttgactgtccactgttggccttgtgagctgcttacttgcaattttagttgtgtcaaaggtttagataaagctttagaaagtaaattaagattgactagctagggtaaaacaaagttatttgtactgggtgccaaattaaagggagccaggtgtgcatgataaggaggtgggtaggtgaaacgtgcatggacacgtttcaggcagcggttggaccggccagcccagcccagaagagccgtggtgctatcaaatcggacatgcagcttcaggcacctcgcccgccccgaaagctcagcggttttactgtgcgtatactagctatacaacccaagcaagcatgatggggattaattaatgggacgattgattgaaaaccaccaaaaacctgggcggcatggcacccatcctcaccacacaagcaccagtagtggcagctgtactatatatatgcgtcgttaccttcattcatcgattcttcttcttcttattcagacattatcaagaagttggcagcagcagcggcagtagcc

SEQ ID NO: 5671 - DNA, 90 bp, Zea mays
ggtacggtatggtatgagagctagctgcttgctgctgcctcctgctgctgctagctgctgctttgtctcttgattcgcgcgctgcatgcc

SEQ ID NO: 5672 - DNA, 672 bp, Zea mays; identical to SEQ ID NO: 5670

SEQ ID NO: 5673 - DNA, 489 bp, Zea mays
tgaattggcaaaacacttgatatatattaaaatatgttgaccccaataatcctatcaagattttcctttggtattatatatgtttcatacaaatttttttactcccgtcgcaacgcacgggcattcacctagttctccaataacaacattatatatagaggtaaaagttagtattatgagcattcattagatgatacatttattgaaaccttttaccaaaaaaaacaactgttgaaacaaacatcgacaagaaaggaaaagagatgcaattcaaaggaaaggaaaggaaataagatgagaaaaaaaaacactactcgtagtgggctatgcctcaagccggcgtggttggactgctgggccgtgtgttttcacgcagcccagcccagctcaccactgtcgacgctctgtcgctaacttcgccccagcgtcagcctcggctcagcccccgccatcgctgattcgctggccatcagagtcggcggccaggcc

SEQ ID NO: 5674 - DNA, 566 bp, Zea mays
tgcagtaggtcagttttcttataagctaacgactcccccccccccccccctttccaatcacaaataagtgccattttcgacatccacatggtctcaaggacaactttgactacgacttgagagctatacttttatgaaatgatgttttaaaacaaatatggtcatcatttttggtgtccaaactacaaacaaagtaatttgtaaacaagctttggaatggttgacttttgagaacctcaaaacatcacttatcaggcgactagagtgtgtgatacattatagttaagaaaataagatgatagcaatacatcctaaagatcagtctgcattttagaatcaaagatttgcatgttgttgttttgtttcgtggagtattgatgcttttgttttgtgcttgtctaaatgcattgctgacggactcatgtcaaacaggttctgaagcatttcgaagacgatataggattgatgtagatagtgagtgcggtaaaacgtatgctttgactgatcctctcttctttatccaaaaaaaagttattctgacatagtactaggagttaatttttctg

SEQ ID NO: 5675 - DNA, 629 bp, Zea mays
tattcaactccgtaccctgatggaagcattctctattgagatcctaatcatggttatcaagactaaaatctgatggaatcacgcatataggagctaaggcatctaactcatcaacttgcctaatagagacgtaaaaaatcactacaataacttcatatcgtagtgatataaggatatgaaattattgtagtgttcatatgcgtgattgtggtcaacggggtgcattgcaatacacattctaggtggttgtggttgtaattatacactttaaaatagatgaatgatacttctctaaactttgtaaactataatgataccaataaaaaagaaaagaaacccttcaaaaaaaagccagattcatcaggctgccacaaaaggacaggacatgcactacgttcaggattacagagcgaartagcaacggcagcaggatagcttggttacgttacgtgcgcccctgtcctactcctaccagtgggcggaaagagaaacagcatcaacagcacacggctcttttggcttttccattcgcggtgccagtggtgggctgtttgcttttgtcgtcactggtgaacgggactatttcatttcgactcgtgtgttcgtgagctctgtgagaaacaaagacc

SEQ ID NO: 5676 - DNA, 92 bp, Zea mays
agtgatggatagctatgcgtatgaatgataataatctgtctgtatatcagtataagatgaatgcttaacgcagtctggaagataagtattat

SEQ ID NO: 5677 - DNA, 1034 bp, Zea mays
ggtacagctacacggcgctttccactatcgaaacccaggtgtgcgcttttggaaaaacaagcgcccttttgatccacttcgtggcaggcggtttctcacgcgagcctagccggcagcgagtcaccgccggtcgattggccactgcgtggtcacgggcccaggtgtcatgagactgagacggtgcaggccgcgtggcttgacggcttctgtcttttgcgtggtcccggggtttccgttattagtagcgccacgtcatcagttcttcttcttcgtttttttttcgaattttaaacgataattctggtcttgatctcgtcctcgaggcaaatctctttgggaatcgcctgggaagtatcagtagaacgggggagagcttgaggagtagccgagtagggttggagaggcgtaggggcgcgtgtgggcgctcgagctgttgttgctgggcctcgccggctccgttttcttccacctccgcgcgcagcggcagcgcggcagccagcgggggtgggcgtcaagtcaaggcagcgccgtcgtttcatgtccgcggtcaggtttggtgtctaatgcaggtgtggtactggagtactggactactggtcctgtagagcagttcgggggcgagggagatggactggccctggcccctggtcgctgtgccgctccgaactggggcgagggcgagggcgaggtgttcgtgggtaagggtcgcgggcgatgtgcggctgggaggcgggctaccgaggcgtaagaaataaagcagtagtagacgagagagccgcgatttataaagcgggtttgtgtggctcgctgctcgcctccgctccactcctctcacctggtgactgctcctcccacctcgctgtttcttctacgggatcaggttgctgcttgctgcggttcagatccttatccccttctgctttagatgggcctcgcggagcagtgcatggaggtggaggaggtgcgggactcggcgaatcggaggtgatcccggtcatggggtagagtggagtggagggggttgagcgtgtggt

SEQ ID NO: 5678 - DNA, 665 bp, Zea mays
aactcactctgaggatggacagctagagcaggtcgcattactttccccccaacaatctgctggtccgctgaaatctaatgggcctatgcagcaggaagagggcactctgggtccggtgacccactctgacgtagggccgctggggcaggtcacattaatttccccccaacattctgttgggccgcttgaaactgataggcctgtctcgccccagtgtcaggtagcagctcacttctccaccctcccgcccatttctcccaggtcgctggagttgagtgagccgctagaataagctaacttaaactctcccatggtccagagctgcagaatgcatccaaatgtctacgggacatcacttaaagtttatagtagaagaagacaacgtgtttcagttggacaggttgacgcgccagaggacgtatctccttccaaacagcagttctttgagatggtgtccaagaaaattggttgtttacttcctactccaaaagctaagaagaggagagaacctgccatcccttcgcagggactccgtcgtagtcgacgggtggctggtctaggcgctgagcacattccacagatccccagggccaggattttggtgatgaaggctatccataatacttcagacacgaatcagctcaacagtgaggatctggagactt

SEQ ID NO: 5679 - DNA, 798 bp, Zea mays
ggtgaaggtagtttatttattttcaaagacctaaaagttggaagttgaaacagcccggactacagctagatatatactaggccagctggaagagagctagcacagcctgttaccgaccgatggcaaaaaaawaaaggcgtggagcatggatgctgttactggtacatcagcagcagcagtgtgcggtggttagttgccgcggtggttttgtatgtgcgcccgacatggcggggggcggatggatttcatttcaccccggcagcggcagccggcaggccgtgcttttcccagagatttttaaggtcgtgcgtcacggctgccgatggcggccgctcgcctttcgccgcccctcttccgtgctcgctcttccccttccgtttgtttccatgctctcaccctcaccctcttccatggccgggggtccacataagagacagagctttggttgctctccctctcatggttggtggcacttccctagcctggcgaaactaatcccactaggcggtgtcaggaggggagctatatataaccacctccattgtatagcttgtttccttgtaatacccggcccccatccatcaccggctcgatcgaggcttctggctccggcggccgtcaccgatcattcattccctttgcctctactccttctgctggcttgttcttccatcgatcaatcccgtcgggtactctgaattggtactacatatacgtacagacagacccttcttcttccttgttagctccatagccgtcactagctagctactcctgctttgggcggcggccgccgtg

SEQ ID NO: 5680 - DNA, 1500 bp, Zea mays
agggtcatctctagcttctctgactcccaaaagctcaaaacccaccaaaaagttgttcggatgtttcatcgtttttgcgagttatacagccaagcctccagcgacatctcgtgaggctgtctccagcaatgtcctctatatacattctctatatctgtcttttacagttttctctaaaagatttcatcctctatatcttcttcctctccaataacattctctaaatcacgtcctctatactaaaatatctatattagagacattttttatttttattttttgtacatacgtatttgtcgtactctcaaatgtattgtactccctccaggtctaaaattcttgacgttttagacaggatctcacataccaagaagccattaactagagtgcatgtttcccgttttacccttattaaataaggtcgtgtggcattagaagtcattatattctcttagctcatgcggttgggaagacgtttttgaaacctatggtctccggttcgagtcctggccgtgcatttgaggcccttttttcgtggcgtttttttggctgcatccgccattttttttcgttcgcgccaatgttgccgctgcatgccattttttggcgccaatgttgctgatgcatggcctatttagactccggctagctaccactacttagatgcattgcaaacgtacttgtgccagatatccaaaacaatccagctaaccagatactactactgtactaattgtggtgcttgttcatgatggatttgaatatggaaccaccgaacaatgaaattggtaagtctagtacttgtcggtcttcattttcttttctttttagctcgtgacaaagtgtcggcgtttcgagacaggggggtccctaagccgactctcagtgtgctgcgtgccccagcccagatgggtcgagcgtgtgggcgagcgcgaaggggggagaggcgaggtggccggagacgggcgtgagagaggtggaagtcccgcggccttcgtgttcgtcccgcgcccaggtcgggtgcgcttgcagtaggggggttacaagcgtccacgcgggtgagggaagcgagcggccccaagagagcgcctgtcccgtcctcggtcccgcgcggccaaccttctctaagaaggccctggtccttccttttatagtcgtaaggagaggatccaggtgtacaatggggggtagcagagtgctacgtgtctagcggagagagagagctagcgccctgggtacatgccaatgtggcagccggagaggtcttggcaccttgctggcgtgatgtcgtggctatcggaggagcgacggagcctggcggagggacagctgttggagcggtcgagtccttgctgacgttgccctgcttccgtaagagagctgagagccgccgtcgtcacagagcttgcggggcgccatcattgcccatctggcggagctggccagatgggacgccggtcttgttctccgcgacccgagtcggctcggggtaggatgatg

SEQ ID NO: 5681 - DNA, 220 bp, Zea mays
gtaggcatatggatgtaccactggaaactggatcgcgaggctctgtacccttgtgtatcgctcaggatgaatccaacgagagaccttgtccttgtaatgcagttagttgcttttgtgtacacttttttttgaaaaaaattgtatttgtatacgagtttgaaatcctagttgaagcgatcctgctttactttgcttgttaaattgcgggctgatttaatcc

SEQ ID NO: 5682 - DNA, 854 bp, Zea mays
gtaggcatatggatgtaccactggaaactggatcgcgaggctctgtacccttgtgtatcgctcaggatgaatccaacgagagaccttgtccttgtaatgcagttagttgcttttgtgtacacttttttttgaaaaaaattgtatttgtatacgagtttgaaatcctagttgaagcgatcctgctttactttgcttgttaaattgcgggctgatttaatccatgcgttggagcttatgcggttcagatattcttatgattgcaagtttgtgcgggtatttccagtgtgtgtctccgtcttgtccatcatcgtgaaactaattgttgcattagcctattgcgccgtcctttatttgcagggctagtttttcagctttatggaaacaagttcatgatcaacagttgcggtgtctgttgggctgatgagccaagcttcagagggttgccgtcagccaaatgtcggcagaacatgtgactatgtgagcgaagtctgtgaaacgaagctttggtccaaaacggagtgtttttatttttattttttgaaaatttgatcatgtggttctcagaattcttcgcccgttttctttgccccacagtcgtaaaataaaatctcgtagaaactgacgcgttgtcgcggagtgcagtaatacggcacgccgttcaatctaccgggacggcgagacggagaatagaagacgtcagcactcagcagttcagcactgacccgtcggccgtcgccctcccggctcgcaaccgcatctctctcggcttctggcctcttcctagttcctaactaccaccgccaccactaccactggcctcaatctgcaaaccctagccctcgtcgccggcggcc

SEQ ID NO: 5683 - DNA, 219 bp, Zea mays
ggtgaagcggtcgcgccttcccgattcgacgttccctcaaactatatataaaagtaacctcccgtcccgagcgacgagccggtcgcacaaagaccaccaatctagtcatcccttacgcagcacagcgagcggcgagccggcgacggcgattaacctcgactcagcggcgagaacaggaagaacaaggggaaggatccgtacgtgctgcgcggccaatcc

SEQ ID NO: 5684 - DNA, 548 bp, Zea mays
cagaatgtggaaccgacttaaagatgaaaaggccatttagacctcgatagattactatagaattattatcaagtgtaaagggcatgaatgtaattctgtatgggttgtgccccgtgcctataaataggtgaacagtacccccgtactattcacgctgatttggcatttacttttgcgtcacgcttgtactttcatccccttcaagttaaaggtacatgctgtaatcttatcgattacttctgtttgtacatgataataaaacataattgtttatgttgttcattatattccttatagttcatccttcatcattatataatgtatttatgaaggtatgcccttcataaccttcgtccgaaaatcattatatcctgagaggaataatgcttcgaaggacgaaggactttaccgattaacattttctatgttgccttgttcctgactcatagcattcaagaacaagtctccaacattggcgcccacctccggtgaactcacttccactctttgagttttttgaacaccttcggcgatcataaaccttcgtt

SEQ ID NO: 5685 - DNA, 513 bp, Zea mays
cggtgcagatttctttccttctatggcgcagccgaccgttgaagatccatagccgttggcacaccggacagtctggtgcccccttctgaccgttggcttggccacgcgtcacgcgcggattactcggccgactgttggcctggctgaccgttggctcaccggacagtccggtgcaccaccggacagtccgatgatttatagccgtacgccgttgatcgcttcccgagagcagccagttgatagccgccagcctggcgcaccggacactgtccagtgcaccaccggacactgtccagtgcacccagactgagcagagtcttggctgcttagccaagtcttttccaaattggtattttcctgtttctagcacttagacacaatacattagtctccaaaacaatgtactaagtcttagaaacatacctttactcttgatttgcacttggaccatcaattggcatagattaacatttaagcacttgtgttggcactcaatcaccaaaacacttagaa

SEQ ID NO: 5686 - DNA, 186 bp, Zea mays
cctgcatcaaaaggaaatagaccaattcagctaccttaaccgaaactagattaacttattatttgtgacgataattttttgcaagtgaaagcaagttacttcgatttgttcactggataaagcaatatgggaccattgttgctatctttcaggatcttgccaaagacttccttagcaaatctgcgg

SEQ ID NO: 5687 - DNA, 1430 bp, Zea mays
tcgccgcgcggctgcagcgagcgagtgaagcaaccgccggctggcaaccccgtcggatttggctcgggcgacttatccccgtcggtcgcttcgctcgagagtttgccgtttgaaacgggcccaacataggaacaggcccattttcatcaatagcttgcttaggcccggcccagtatccgtagcgtgggcgtgcacgtttaaaatccaaaaaaatgaaaaagaaaacagatcaaattatgataaaaaactgcatgtttttatgcgtaatctgatatgtcccatgtttaacaattatttgttagataaataatttgtattttaggtaaaaacgtgtttttgctaagaaagcacagtttcttggtcaggattctcgacagatttcgaatttcccgactgatttgtaaattcaaatttaatttttgagaaacatgaaaaaaacccgataggaaaacataggtatgtttttgttttggcttcgattctaaccatcggcttctagccgccaaaactcttcgtttgttagtccgattttgtgaaaattattcaaatcgacgtggattgagaaaccgttaaatcgtcgcgatggaagaaatccaccgctttgtaaatccacgataatttcttccatcgcccacgctttctaaatcgtataaactccttcatctccattcmtatgcaaatctcgtgatatttaggtgctgtttggttcacatatttgtaacgtaatgggtaacggataacgttaaatcatgtttgttttagtacaaccgtaatcagataccacactaaaatttaatactagcctattcaaatttgttaccgccagtaatcgagccgaaacaattaccattaccatttgcgttacaatttttgaaccaaacagcaccttagattcttgtgataactagattaggaaggaacctaaattgtaaacaagcacatggtttttcagacggggttcacaaaagccgatttttaatttgaatttgaaaactggctaggaaattcgaaatccatcaaaaacctttcgttttttgttttcggtggttaacaggaaattaaattaaaacggtttttgttaaccctgggcagagccgcaggccaccgcaagtgtgctcggctcggccgcaccccccgtcgcgcacgttctggctcctcaggtgatccggtgcgtgcgttgcgacttgcgacgtcctccgaactcccgcccgagtcacgtggcgccggacgcggcaggcgataatcgccggccggccgaccgagacgacaggctaggtttctcgtagcacacgcttacagttctcgcggattctcggtgtgcgcggcccggccgcacattggacggccatccagtctcgccgccgcgtggtttgatccatcgatcccggatcgatcgtccgtgggaagaagaagaaccgaacggctggttc

SEQ ID NO: 5688 - DNA, 901 bp, Zea mays
gatgaatattattacttttagttagtttacatataatatatttattgttgtaaataacgttagtactttatttatttaacaatatatgctttataaattgacttaatatctgaattaaatccaaaatattcgttttgtactaatatttaaaaacatgtatattcactttcttatttatattcgaattaaaaatataataaacaaatgacatctggattcggtttgatgtgaatgagtgaatccgttccgtttcccgtttcccatgctaggccgctacttgctggctcgcacagtcgcactggtgcggtatagtccgactacacccatccatcacggcctcagccctcaaccactcggccactccctccagtctccacacacacgcgcgccattgccgctgctgctcatcgtactcccaaatggagcagcctgcattcccctcttgctccgtggagcgcattcgctccagcacagggaagctgtgacgcatcgccgccgccaaatcctccacccgacggctaacgcttttctctcgggtctagtcggggtggagatccgtcaaggccatctcgtcgcgttgttggtcagtaatcctagctcgcttggacgaagcaaccagcactatggttcttggatgacaaaattggagcaggccactgctcacactgcggcggtgtccatttcttcgtgtctcggttcttggccccgtccttacctgatttctctgcttttcatactgaaaaaatcctcaaacctttcatccttaatcccctttctcggttccaagggagcttaaaccctaccctactgcctttttcatcttaagctccgtatctcgaaaaatccatcccatttgcatgagcattgcttcaattgcctggctgcacagcaggatcttgcg

SEQ ID NO: 5689 - DNA, 218 bp, Zea mays
ggtttgtaaatgcatacctatctaatctaatatgctaatcctgcagatttatgtcatccatgtatcgaggttttttcaattctttccttgtccttagctgtggctacagttctacggttcagagtcactattatgttgagcatttggtatattctcatgcacttatccctgtacaaagacatgcctctcagttttaactggatcctgttctttagaca

SEQ ID NO: 5690 - DNA, 927 bp, Zea mays
cactctcgctggctttggaggcaggagagagctagcaccccattattgattaatcagcggttagctacgcgctaacccggggcgacggccggccggattaacaaactagtagtggtcggcataattttaagtggcctttacctttcaaggtcggaccaatgggacagcgaaacgaggaccaatgggaggacgagtcttttgggcgagggcgtgggtggccacatcgagggatatgatatactgtagcagcaggcagcagcagctgcgttctgatcatgcaggattaattaattaattagtttagcggtcgcacgactccccagaaccagcctgtctgtgagagctagtcattaagatgcgcgcttggctgatgccgcctgttggcgtgcatctaccggaaaaagggggggagaggaaaaggaggttgctataggagcctagctagtttagtcagatgccctagaatcagctggtggttgacatgagaagtgtcttgcctcctcctccttgctttgtctgctacagggctgggctgtagcggtgctggcgtccctctcgcagtctcagacaccacagcccagcagccatgcactcatctgcagctctctcctctcctagttctagcttccctgttcctgccccgataattcgctaactgttcgatctgctcctcccgggcctccttgtgtctactgctgctccctttgctttcgttgctactgttccatctcgtaggtttcgttgctgtcccctgcaggccaccacttgagcgatctgtaagcagataagattgaggccggcggcctccgaaataaaaaagatcctgcaagaaaaaaaaaagaaatatctagggcgagagaggaagagggagggaggaaaaagaataacctagcaagcaagcttgtgagatcgatcgtggtcaagatt

SEQ ID NO: 5691 - DNA, 285 bp, Zea mays
ggcagctaggcgcctgcgctgtaggttcggcagataagcagatgcgctttgctgctgcgactgcgagttatcagctacacggggtggcgcgttctaataaggcatgcccattggtccaatggatttggcgatttgtgaattattattagctgcgtctggctgctaacatgtgattatttttagagtaaatcggacaccggtacagagagtcacagaccatgaagccagtcatccagagcaaagcaccattgcagcgcttagagcctgtcgtcggccacgacaccg

SEQ ID NO: 5692 - DNA, 902 bp, Zea mays
tgcttcagtttgtgctgtccagttttggatctgaaactgaactaagaggggttcggttctatacaatggtcaaattcagaaaactgaagtcgagtttcaatgatttctagcgatctttggcgctctcctatgttggatccgtgaagaattccatcatggttattataccaaagtgaaagagcatcgatcagtgtacgactttgattaaggacgatttacatgttgcttagaaattgtcggagtaaagttcgtttgaaattgggttgtcatgccggctgggaacttagtttcaattctctgatcgatggttgggcacgcatgctgctgtccacctatttgcctcctgtgtggacgctactagtcctgggttttgccgcttaacagaagccagtctatctgtgcgtcattccgttgtggccacgtatccgtattcactttgagctggcaccatcgagtccattccattgtgataagcacatatgtttctatggaatgctctcacacgtcgggctccttattctacccagccaggctccctcacgcggacgcccagggccctctcaagtctcaacacactcgttgtctctagaatcctccccatgtctcctctctgctcgcctcattccccaacatcgatcccccacgcgctcgcgctctgcaccggctcccaggcacacgtcgacgacgcattctggcacgtgttttcttcctgattggattccccagcaccggtcagtctcgccttggcctcgggccattgcatcctaggccgagctcggccagttcaccagcgacctggccgtggcgctcgccctcctgctccggtctctccatcacgctcggctccagctggtcacgctcctcgcaccaaccccgactccaagtgctgccatgacctcgtc

SEQ ID NO: 5693 - DNA, 51 bp, Zea mays
catcgtccgccagcccgagcccatgggcgatctgttcgaaggagaaccggc

SEQ ID NO: 5694 - DNA, 831 bp, Zea mays
ttccctccaccttaagtcagctaatggcaacaattagtacttgcacggtttgtcacatggtcacggtggtatgattcgtacgaatcaggtggtgtgcagggagaagcaagcttctggagcttctcacgtgtggcactttcttgtggatatggcgtcgacggttgcgccatgtagaataattcgtaggaggaaggcccatttaccagaaacctataggccgacgcaaagaggattagaaggaggtgatttctttttaatttggtgtaattttcttttcagcatttgtttaattggagtatacactataatttatccctaaaaacttttatactatcactaaaaaatattttttgggacgacattttagctttcttttggatagccttattgtaccggcctgacagtacctgaaataatgtctgaaccagtgaatcgacataactggtggagcccacctgtcagccgcacttaatttgaatttcgctgccaaacgacgcggatctccagcagtgcccaaaagcattttctccacgctgctgtctctctcctgactccctcgtggctcgtcccattcccgcaccatctcgacaaaccacaccaactgtcatcggacggcccaaaactgtgccgcgtgttccgttcaacggctatttcagcccgcagaacgcacatcagaagggtaaagccacgaaccccccggtccgcgcctgcgccgccttccctctcctgccttctccgcttcaaatttgcgtagcgttgatttcacgcccggatctcacaacgctcaatccaaacgctagccgcaaccctaaccctagcaaccggtgagta

SEQ ID NO: 5695 - DNA, 1500 bp, Zea mays
aaaaccgccaagccgcgggggagaagacatcgtgtcctctctctctctctcgaccgtcggacacagagatgccgcacggtgacacaccctcctctgtcaggcgcctggggcgcggcggtgtggtggccgcartgtcatgactgaaggtgcagcctagagtgtatccgagggtaacgaggtagcacgaggagatggctgaatgargtcagtcaacagatttctatttcgttcttatggagtcagtaatagagtctgtaatggagttgtgggccatataggccgtattagtgctgtattgggtcgtaaataactggttagtggtggtgatggaaagcttataagtaatgtacctggcatcttgtgcgagacatgcaaaatcagaaaggaatcaaatctgtttgaactacccaactacttatctatgttcttcactacttgttcttgcgtctcacatcgtggtggtctccatcgctggccaagggtcgtgacacaagcaagacgaagctggaccatctcagcgtcggtagcaaaagctagaactcgtctacggtgatgccgcccctgacgacctcatagtcgtctaggtttagggtctaagctacttatttgggacgggagggtttagggttttccggacgggagatctccttgttggccctctgccccagccagtaagtgcccaccttgttcttgatctcgtccatctatcgtctccttcctctctacaaacaggcgatcgagcggcaccggcgatctctctgctgctgccgctgctccggtgttccctcctgcgtacgatctcttgctctgattctaggttaacttctttgctacgcggagacggagaagaaaggaatcgtgggaggtgtgtcctagttcaccaggtcgcgcgttgggcgcgagcgcgaccggatcaaagcgagaagcggcgaggaagatgtgtcctccaccgccgagcaaaagcgacagctctttcctcttcgtatgggaaaaaaccggcagctgacgacagacgtgtgtaactcgacgacatatttcgtcacgtcacgtctcgtctcgcctcttcccttcatcacttcctgaaacctccgccgtgaacgaagcgaagcctttcggtgatacaattgagccagaatgctatgggcctaagatgcacaagcgtaacacacctctcaagtcgggccacaaagtaggcttcgaaaatattcggccacccagccttgtcggcccactatccggggctagggttttaaccaagcgtataagagctcccactcgcgcagacacccaagcctccaccaaattaaaccgccggcgcctccacttcgcgttctcgcctcatctcctcccgctcaggtatccatccctgccccctagtctatcgtcgacctggccgcccgttctctgcttaccatctccctttgcgctgtttgctgatccgtgctctccttttcgaatttcctccgccgctgcaggatccggcggcgaaggtaaggcaag

SEQ ID NO: 5696 - DNA, 1500 bp, Zea mays
ctaataactgtaaaagtgccctccttccttggcttggaccccgtgagctgcgacgctgctggcggcacttggcagccggcagggaatgcattcaattcactgctcgacgggacggatcgatcgccgaccacagttcacggggtaggaatgagctgtgtttctaggacgttctcgatcggcggacgtgtgagaatatgagatgttggatcgtcccccacagaccacccgccagtgtcaggttcaccgcacacagttgacacttgacaggtggactagacagactggactcctaggatcctatcctaggrctgtcgaagcagtttggtccgctgtcacgtgcgttctcagctttgagctttcacaggcttcttccatcgtgctgccagctcgcgcgggagtcgggacgcgggtcggccggacggggccccgcttgccggcttcgtcggtcacggggcagggcagcaccagcagccccgcgtcagctgatatttctgccgccgctttgcctttttttccccccttttctggaaagcgtcgtcgcacatgtacagcaagcagctgccgggtgggctccgtcctcggcgtccgcttccggatacggttatctgctttgccacggactcgggctcggctatcagacgggcgccgcaaaacaaaaaaaaagtccgcttatcaccgtcgggacacgatcactcgccggattttctggaagaccagccgcgccgcgggcggtttgtttaatgcagggctcgcccgggctgacaagctcctcgtgcccgatgccggcgacctagagtagtaggcaaggcgagcgctcttccgtagtccatatgccacgcggtgttgcacatgtgcatgtggtaaagtacagcaactggatgatctatgaagaagcacttgtccatgtgtcacggagtctggctgacgtttaggataaggaatcaagttaccgtgttctcttgtactactatggatcagtacacctagtcacgcacacgcagtcacattagaaaaaagggcgtcaagttactcctactgtcctcgatctcctgcagcgatagatgccacaacctatcacaaaaaaaccggtccacgcacacctgtctgtacttgtaaaccggacacggacgggagaaaaaaaaaccccaacgaacggcaaattaaaccatccaatatcctataaagcgacacacctcacgggataaccaccgtagaccccgcgcgcctcttccccccaccccgactgcagctcaccccaacgcgctttcgccgcaccaaagcgtcgtgagctgctacctaacctaaccccaccgccaaacaattcccccattcctgattccaaccagcccgccccgttcgagtacacactgagcgagggagacagagagagagagagagacgagaacaaccagcgatctcgcgtatgtgtgtggagttggagatatacagtacagaggaaagatccgatattttttgctgtacggctgctgagcggaagag

SEQ ID NO: 5697 - DNA, 589 bp, Zea mays
ggataagatcaaatctgtgaaatatgcataatcaaatgggacactatgaaataaaggaactgcatcagcgtcgcacccagccaggcgacctctttcggacgctcggacctcaagagtttacctggacctgtcgggtgggatcccagggcataaaccaaacgggatgaaggcaacctccgtgccttgaaaccaagcatggaatagccgtgactgaatcaatcgccagatatttttttcccatgcggacaaagtgttcgcgtacatcttgagttctgaatggaattatatcttgtcgttgttatgtattactgcggtgaagagcaaggtctcgacggaagatgaagcgagaggtttgtcctttgttcactgcataaaaaatgcaaagggagtcgacgcatcgagacacggacacggccgcaccagttcgccaaagccttcagccaaacaaaattacaaaacccacgacacccaccccacgtcctataaaactaacccacctaaaaccacggtccacgaccctcgcttcacttgtcacggactcgcgtccacaaaccacaaccagctcactcaagaacaaagaacccaaccc

SEQ ID NO: 5698 - DNA, 733 bp, Zea mays
cctacaaggagataagatagatcagacaaaattcaattgattcaaaaatagataaagcataactctgttatatatgatactagtgcattgtagtcagaaaatcttgtttcactatctggatacataacatgtgtttggttcatgtatttccaatgagtgaaaagagctgatcacgggataagtaaacccctgttatctatattctatgttaacataaactgataaaacaaggcatgaaggcaatcaagaaaccactacaacttaattccaatcatctgcactactataaatcttatgtaactgattaaaaaagaaaacaaccaagagatcaagaaaactacaaatgtatggagatgcttacagttagcatccaggttgcattttcaacctctcttgggttggacttgacatagcggtgattaaatgtgcatccagagtgcatgtccactttatgatcatctcgtagatgtgccacaagaaaaggaatatccccaacaactgaacattcagaaccagcataaggacagttgtatggcctaaaactacactgtgactcatggcttagtttgctgtagtatgggaagacttctggacatccaagagagtagtatctgcaggggagctcaagtgattcagccactttttctaatgccagacacctgatgtcaccgagctcctgtcgacaagttgggcagcggttgtgcacccgagttttgcaggtggaacacagagt

SEQ ID NO: 5699 - DNA, 1500 bp, Zea mays
aagacttacacaacatgtctttcgatagaaaatacaaccatgccattattagactatgtatatcatgtgtatagaatttaaggatataaatataattttatatgatgcccatgccaatttttaccttttcacaatttatgggctcacgtgtactcggaacgctctaacttcgaagctgtaaaatcacaaccatcttcggatattgaacttgtatcccgaaggcatcgccatatgtaatcgtatgtagttgaaagaaaaataatagaggaatatacgtatgctttataattcgtatgtctacatgttttatcttatgaagcatttacatttgtttgaccagactccttggtcctccctctctctataagcggatgtaaagagaatgttacattgatttaattgtgttgttctgttttggtatcctattaaaactttgataagtgcatagagcaaatataataagtctgactaggcgggctctaaactgctctatgtcaccaaaatcatagggtgacaagatgataacatagaaaaagaacaaagtgggtgcttcatgaggaacgtggctccaacgcattctacgaggaaaaagagtctgcttacaacctactatgaaagttaagcccgactcttttttttccagccaatctaaattatttctctttcgaacttagtgtcatctaaaaaataaatttactgtatatattggatttattgttgcctcttgatgatgtggcaaggatatagagcctttaattggttcttccactcgtgatgaaggctatccagaagcagcgggtaaaaaaggtctgaactgtaaaaaagttattgtaaactttgagatataagaatattgttgtgagttatatggcataaaaaatcataagacaactataaaatctacaatctttattttatccttcttggaacaactataaaatgttcctctattttttttccacttaaaagaaatcaaagctaaaagtcaaaagaggattcaatatactttaaaaattatatttcatccattctttttttatttgtcaaaacgttaaaaaaacaaccacaacgataaatattcgagaatggatggctaaaaggtttccttttgaaaaagcagtttagttctactgcattttatccgtttgattgattttctaccttttagcgacagaaacacttcatacaaattgaacaaaacacaatcagagtttaatttgctcgagagcgcttgcataaaacagccgcgctacacagcctctgagatggatgaacaagaagcacggcccaccggcgcatatcatttgccgtgccggcctaagctgctccaaccaaaaccgaagcaccggccgacgaacgtgcacctacaattgtgctgcatttcttgcactgcggcgacaaagctataaatccaccacaaatgagaaacaacaaccctcagcaaatcaagtgctaattaccttgtactgatactggagcataggtacggtagcacgcacg

SEQ ID NO: 5700 - DNA, 145 bp, Zea mays
cgccactgcagcgcgcaagcacgcacgcacatttcaattcatccaaaaaaaaagtgagttccccatcatcttcatccatcccgtcggagccacacgttgattagagcggcagttgaagcgcctagctgcacaaacagtctgcaca

SEQ ID NO: 5701 - DNA, 445 bp, Zea mays
tctaaagtcttaaaagacacaagatttcaacccccccccacgtttccggggtacgatcgggtaccagcgtttgacacgttgcgtacgcggcgcacgggcatgttcgcacgtcgcaccaacctcggttttgagaagtctgggcggaagccaaataccatgggaggaatatggatttcgacatttggtcccgtcccaycgtttctccgcactgcgtcctctctctctccctcccgagtgtctctccccatgttgcttcctcctcgaccgcgcgccgcccctctccgcgtcctctacggccgcacccctccyctctgccttcgccaaccctcccctctgccttcgctacgccgcagccaggtccaggacaccgcgctgcctccttccccgtcgtcgcgccctctccacacacacaacacctaccctcctgtccctcgtgccaccgtcg

SEQ ID NO: 5702 - DNA, 1500 bp, Zea mays
aaaatgacgttgggttctgttccgttgtatatccggacgcctataacgaatattttaagccttcgaaagtggttgctgctatctaactcaagtttagttcgtgtcaaattaaacatttgaatatcaattttgagtattaaatatagactttattagatttaataaatttgtctaatatttcagtctttatttttataattatttttacaattagattatatttaatgtcagtagcaaagggttctacgtagttgaacacgaaggaaagcaacaagtaggtgggaaaacgaacgaggagctgcaacagaaagctggcttgggccgtcgtgtatttaggcccagtaagacatatgatccatgtaaagcctgcgtaagagagaagagagggtttaactacgtagatgacggctaacgctgatgacggcaaggtaaagacacatgttattcggttattcttcgtatctttttcttcttccccacgctatcttcctcctctgagcataatagcagtagtagacggctaacgtttaatatcccatgattatcatgcaaatatttgatgtgtagagactgaattttagtcggcgatattgtgctcgtatttgtagctaaaatcaacgaccgcgacgaaactggccaaatcgcaacaggaacgcgccgccacagtaacggtagcgcgcgagaaacccgtgccgtcgcatcgaccccgcaaaacgacatatcgatcgactcctcccgttgcggccgaccccgcggccccaccgcaccagcgagccgcccgcacggggaagcacacgcatctccgcgcgccacggacgcccgaggcctcccgtcgcggtggtcgctttcggccctggaccccgctgccggaatcgaatctcctyccctcytttctcctccgacctcccccttccccccctccgcggctccgccccgacccgtgacgcctcgcttcgcacccctctcgcatctccgccgcatctccgccgcgatcctcccgactagccgcgactgcctcccctccagcggccaggtaggggctccacctcatcgtcgccctcccatttatccacctcctactcctccccgatctggagattcggcgatgcgcttggatttcgggccattggtgctacctgtttcgatctggaagcgtgcgagatgcggtgtgtagctaccacacagatccgtgagctctcgagcgtttgattgcgtcctggttgttcaggggttatcctatttctagacgtcaatcgggtggggggcgtgggaaagtggagttaatttcggtggagatgttcgtttttacttagaattagaattccctattaccaattggaagtgcggacacaatctcagatggacgaaccagctggatctggcctgctcaaatggaaccgcgagctttcattgcgcctggtgtgatatgcatgtgaatttcagtggtttccttcgcgtttccttaatcatatctcggtttgtttggaacttaggcagagg

SEQ ID NO: 5703 - DNA, 767 bp, Zea mays
gctaagggtccaaaactgcatttaaaatttttttaggtctaatcgtgattttacttctgtttaggggctaaaatacaaaaaattcgggcgagcctgtgacaaaaagaacgggaatcagacgactgaacaaacgaacgaacccggcaggggtgcccttttcgtgaacttgtgatatacgtaaggtttcgtgtatttctattttttgataaataaaaacaatctagctaaatctcttgtgccaaataattactttccaaaacacaaaactcactgcgtgtcgacgccataataaattaatagtaatataaatagatcgtttataccgagattattagagtcttgcccgtgctgcgtaatcctggctgtatgattgctacctccattgacaatttcgcattttctgagcaggagcagtatttctgaattatcttccacgccggtacgtgttaaaaaaaaacaaatcagatatgaggccagcagcaatgcatgcaggctgcagcaaggcaacaagccaacaaccatcccgctcctcctccctccgtcaggctgtcactgtccccctcaccgccgccgtcctcgtcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaggtaacagcgcaggc

SEQ ID NO: 5704 - DNA, 682 bp, Zea mays
gccgagcgtcgtcctgtaccgagtgttcagcactcggtaaaggtcgctttgccgagtgcttaactttaccgagtgcggcactcggcaaagccttctttgccgagtgaccgacaaaaggcactcgacaaaaaatacaacactcggcaaagcctgcgattccggtagtgaatatagagaatgtttctctatcctctctttatacagtctagtttccacctctatctattttcatacatatacgagggtatacaaatatttagagcaaaatatattttaaatttatacatttaaggtatatagaatgagatttctttcaaaattaagagaatgagatatagaagacactttttgtacaagaacgagataacagagagaagaatgagatactctaaccgctcgggctccgctttcctcgcttccttggaagcatacgattgaacttcggagaatactctaaccgctccgactccgagtccgatttcctcgcgtccaaggtagctgcagcgagccagccacggacggcccagcccggacgagctcgagtcccgcccgcttcttcgccagcttgcctataatctgccgccacggcgcctggtacggtagcgctcccaaaacgcccaccatgccgccattcgcaaccgcaccccagctctgcaagctctcgcaacccaccgcgtccgag

SEQ ID NO: 5705 - DNA, 1500 bp, Zea mays
tataagtgaataagtcaatttgcttgctcaatgcgctttgattgatgttattatctttcttagcgccatttgtcatcctattcactgaaagataattgactttaccagtttatctatggagatgatacatgaagatgggtccacgtcaggctgaatgcgacagcgggggacggtttttgctatggcaccactgcactatctatctataataactaaggaccaaagagtctaacactcaacctatacaggcatagatgggtttacgtcagagtggatggcagcggcagcggcagtgggctatggtgccttcactagccatcattaaatcacagcataaatctagaataaatatacgagcatatatgtcaagtcaagaacttgaaacaaactgataaacaggttctatcacaatggacataaccaattgagataagtttagtttgcatcaaggatcatatattagatggtggatttttttttttttgaaagtgttaagtgatagaatagagctatctaggattctagtagttagcagttaccacaagatgacatgcttgtgttaaaaactccagtgatgatcgaactaaaaagaattggaaataataagtattccctccatcacaaaatatatttcgttttagactaaacatacagtcactaataatattatctccggcagcttacccatatgtatctctatatttaaacttcactctacgaacagtgcaatttatacaaaacaatacaaaatagtgttttgagtaattatatgagtaagctgttggacacgatctaagaagaagaaagagaaggagaaagaggaggagaaggaaggacatgagtctccttggttggtgaaggttattcattctcgtgggatttcagtaggattgaggtgtcaatagagagttgtggcttagcgaggggagaggttgtagcgaagttttagtgtggcatggcggacgagcactctggagtgtttggaggcgcgagttaaaaaataataattagtcaccttcacaggaggcccgtagaatttccagtgcatcatgcatggtagtagtgtacttgtttacggaattctttgtgttagtgggtgaatgttacagcgattaaaaaaagttctgttatcttcacccacatttttcaaccatatcgtcgtacgtgcatgcacatatgtaattccacaaaggatatatatatcaggcacgtgattatattacaaacagcaagtggaactgtaacaacaagacacaaatagggctagcatcgatcgtggatgcctactcaaactacacagtgagtgagtgagtgatggatggtgaattgtggagctagcagatcgagcgtgcaagcagtccactactgcacagttacctttatgacagtataaattggtgtcctggctgctggcaagtgttgtagagcagacgaagcagctcgatcgagcacacacacacttgatcactactaatataaacacattgcgcaaaggccgcc

SEQ ID NO: 5706 - DNA, 1500 bp, Zea mays
agtggatgatgttcactgatcagtacgagagatcgaagtatcaaaacacatgagcatgtgaaagaagcgtgttaagccgaggcaggtacgagacgaggccagccaaggccttgcagtcaccacaggtcgttgcagagttgccaaatcttcccacacgagtctcgctcgcaactccgcgaagatgacatgttcatagctacgtactggaaaaaaaatttagcggggcgggggccacgaatgtcttcactgctgactaggcgtgcgcgcgcgcgcgcgatgtgcacacacacacgcgcttgaaggagtcagcaccgtttcaacggggatcaaatggcacaagaggctggatgtgatgtggtctagcgagccgcgatgtgcacaaatttgttcggcgaacccgatgcaggcataccgcagaagagaaggaggtggccccggccgtagcgtgaaaacgactacgattcacattcatcacagatcggttttcgctttcgtccggcaggagaactctatataggaagctgcgtcaatttctttctttctttcttttgtgacaatttcgatggcctggcctccaaaaatatcccaacacctcggcggaccggacctatcgctcgctccgctggccggtatcctacactgctgctagcctgctacgcgccggccgtttcaaaggtgtggtggagctgacacgtggaaggcagccgtggctccagagtccggcgcggacgtcagaatatccagtggatgtgaatgaatggcacggcgccgcacggcaacaaagaagaaagaagcctccatctccatctgtgatgactgatctccaaggtttgcccgtaccaggcgccagcgtctggcttgaatgcaaacggccagagtacacgcacgcaccacacaaccgcctgtgtacgtacgtacgtacatagtacgccccttgagcggcaatcgtacggcggcgggcgagaggcgcatggcatgaccaacaaggaagaacccgcgccgtgccggcgccgctctagggcccaagccggaagacgaaagaaagccagccgagatcagatcacccgacgacccttctcagccgtccgctcggtttggcgactcgtctcagccagccctcacgctccggacctgactgaccaaccgaatgactagtgaaccctccttccacgttgaacacttcgcgggagcgcacgcccgcccgcccgctggttttctcggccctgcacaccgcgtccacgctcggaccacgtcgtggggcgcgcgtcacgtcacgccgcgcggttcttaaacccccgctactctctcctcgccgcttgagaccaaatcccaaatccagttacccggtgcccccctcccgttccgtcgcgctcgggtccctctcctcctctcccctcctcctccttcgcttcgtagtaatcgtaaacccggaccgccccggcaggcacccccccgctccacgcgtgcgagagagagagagagagagagcgcgcgcgcgcc

SEQ ID NO: 5707 - DNA, 1500 bp, Zea mays
actcagtgtgaaaactaaatccatgacttcttaactcgtccaacgctacgtaatctagcacagctgctgctattaaacatcatatcaagtgattaataagaaacacggtacatcttatcgccgagcacaatacagcaaatctaatacaaatgggatctactaagcaccagcgctttcctactagttccgaccacacatcaatcaataaaacagcccaaagataatctccgatttcaactcaaatcgtccaaacgcgcatgtacgtaaccgggccaagcgtgcagatccagcagctcctaggccaaacaaaatcgcgccaaacagcgctactcgatgcgagaaggaagctactcacgctacgatactggagatagggagctcaccttggctcggggcgcaggggaagcggcggcggcgagagtgaggagaggatacgaatgcgggacggggcggacgggagacccgcgaggtgccgagaaaaggatagatagggctcgggaggctagctcactggctggctgccactgcccactgcgaacccatttctagtttagggttttagccctgagggattctaggccgtctgatttgtgatgaacgggtgccgcaggctctgtctatattagcaacatttgtactactctattatcatctagtccattgctacaattattatacatcatataagtagattttattttgctaaaacataaaagtatttgtcttataatgagagtgagagagaaataaactcaagagcataagaacctttactcaaggtaaagttttgtcatgccgttcaaggtaccgcccgcgttgagaagcatggtagggctagattttctaccagaaaatttgctgtccactgtgacatagcatactataccaatccatatgacacgataatattttcgccacgtgaggggcgttagcacagctagaaatgttagaactaaaaataaaagtagatatgcttatttttaaaatataagattttaaaaagaattataaaaataaaaaaaccacccgattgcccacgccactgcccactgcacataggcggaggcatttctcttgttcatcggctaaggcttttttttaaaagcaatccagtttttaagattagtttttattttttagatagaagagactagctttttagtttttaaaaaatgaaaatctaatttctataaattgacccaatttctataaacattttttagaaactgggtgaacagggcagggcgtaagcgaataggccgagcacttggcgtttcatgggccaaattctgagggctgggctgaagtagattttgttcctggatttcgtaacgagcacgggaatcggtcctgttaattttgttgggccaccggggccacggcctacgtcagcaacaaacacttatttttctcctccggccaccccgcccgcccaacctataggcgagaccggagagtgccatatcccgcgacgccgcagcatccgcttgactccacttt

SEQ ID NO: 5708 - DNA, 399 bp, Zea mays
ggtgaataatccagtgatcatattttatagtttagtttgatctcccaacataatgctaattaagtatcccctccctccattcatcaaccaaccagtatatttttcttaactagcgaacgatctctcattttttgcttcctctgaatttttgtgacagggggaggaagaagaagaagaagaatgtggcacgtcgaagatgaaggccgaaccatccgaatgttctgcgtgctatgctgaagcatcaccgactattcctacctccgacgaacccatgcaggccacggatgatgccctggacgcaggactcgacacacctctgcccgtcgatgggcctagcatggacctgttccatgggttgcctgacctggataacgctcatccgttcactggacttggcac

SEQ ID NO: 5709 - DNA, 193 bp, Zea mays
ttagagcatggaatttagagaacgctgctggagacagccttatatatatatacatataccactacgggtctaccaactctgcatttgagttgctcgtcctctccccactttctatcacgcaattcctatctcgcagtcgtcgccgctccccggccgggacccagcagagcagagcaggcagtgtcggcgcagc

SEQ ID NO: 5710 - DNA, 615 bp, Zea mays
ccaagatgtatccggatttgaagcggaagtgttggtggtatggattaaagagagatgtggctgcacatgtggttatgtgcgatgtgtgtcaaagagttaaggccgaacgccaaagacaagctggactattatacccattaaagatacccggatagaagtgggaaaagattggaatggattttaatattggattgcctcgcacccagaaaggatataatgctatatgggttattgtggatagactgaccaaagtggctcatttcattccggtcaagaccacttataagggttctcaactagcagagttatatatgactcggattgtgtctttacacggtataccaaagaagatcattttggataaaggatcacagtttacctcgggttttggaaaagttttcatgagaatatggatacgaagttgagttgttcggcctacctcagactgatggacagactaaaaggactaatcaagtattggaagatatgttgagagcttgtgcccttcagcatggtagtagttgggacaagagtctaccttatgctgagttctcatataacgatagtaacaggccagtctgaagatgtcaccctttgaagctttatacggcggaa

SEQ ID NO: 5711 - DNA, 1302 bp, Zea mays
atgacttgggaggttccgtcacactggtgatgggtgtttaagaccgaaacatgatctcgaccaaaaaacccctgaaccctggcctaccatcactaacgggccgatcaactgcccactctataactgctcagctggagggtagcgcgcaggataacgatccccgaaagcgggcgggacacaacgtggggagtttttttaactaagcccaaaattcgctccaagggggatcgaacccggacatggaggtgatactcgaaagccttaacctttactcttgatgcccttccgcactttcacttttcacacttcccttaatctctggttcactttcagtttagagatggcaatggggctccgatccccgattccctcctccattagaggacgggaatgtgcatgtttcttttccacggggatgtaaacggggaaaattctttccccgactggtaaacgggaaaagggaagcattcctcatctccgttccccgcggggacccgttagactttcacgtgatgttgttttcgtgtactacttaatgataaaaataaacaattatcttatagagagatcacttattattacaaatgtgttaatttcgatgtataaataatgattttttacatatgacaatatatattagtgataatattttatattaataacaaaagatatatgttctaattataatttaagtcgggacggggatccgtatcggggatttatccccgcggggactaggaatgggaaagaaatgtcccccgccagaaaaattttcttcgcggggatgagatgaggagctattctccgactgagaattcaccgttgtcgtctctatgctggactatctagcgtgaagctgtatatctaccaaaatgagttgatttgaaaataaaaaggcagagggaattagttataaaaacaatttagaaaagattaaaactaaaaaatctcttccggacaccctgtccctatcacttccgttggggattgtcgttgcctgtcttttagcgacccgattttgtaacccttttgcgttgctagggttacgtggcaccgccttattggcctggagcactggtaagctttgagggatagagacagtgagtgagcagcagcagcagccacttgctcttcacctcttctctcttccactcatctcctctcctcatcgcctcctctcctcttgcggcacaataatatatatactgccacccatacggatccaattctctccgcctctactgtagccacggcccttggttcccctccattattcgacctcacctcaccttgccaccagcc

SEQ ID NO: 5712 - DNA, 949 bp, Zea mays
aaataaactggagatttggagtatgtaatagcattgaaaagtagaattttgatatttttatcacttaaaaaatcaaaagaaattctatattaggtaaatatgaatattgcaagcatgggattacactgattcatgctcttttttaagaactcgatgctgattctttgttttggtgacatggattcattcgctatggtccaagcacacatctggagttcgttctgtccttcaaggaaagttttggcgtaaacacaatggcaaaagagaaacttcattattaacgacctacatcattattaacattagtatcatcgtagaacctcagagacaaatttatatatctattgtcggcttgtcgccaccgaggtgtaaaacctgttattttattttaatggctcgttgaagagatgccctttaaccttattataatttttctctctctaaatttaacttttaaaatggcttcgcttagtttttttttggttatgtagatgtagtttatgtatcgtttccattgctcggaatatacctaccagacaattaatctagaaaattagtttgcgatgatcgtatcactttttgaaccatgtcagttctatttattgtcaagcggtgtctactagccagtttactactgtctgtcaaccaacaaccgacctggcacacgttctctccatagaatagacccagtaatggcacgatgaaacgacggctgaacaggccacttcgcgtagttcccaagcacccgccacacaactcgcgtccacggcatctgaccggcgtcaaaacccaccggcccagcccaacccgtctgcagaaaccgtcggcccaggcgccccttccaggtacgtccagtcgcgactctataaaaaaaggcagagcagagagcccagagcaaactcacacaccaacacatccaaggaacacgaacagcgagaggaatccgacg

SEQ ID NO: 5713 - DNA, 83 bp, Zea mays
tctgcacggggaggaagccgaggccgttggccacgccgagcatcacctccttcatctccgcgcggaactcgtgccggtccacc

SEQ ID NO: 5714 - DNA, 550 bp, Zea mays
accaaatttctctctaaaagatggtcccaccatgttcagtttcgttgttgcaaccaaacgcgcgttgccgagtcagcaacaccctcccgatcaaatctcggccgccgaactagtggcctgcgcttgcgcttacgtgtcgtccccgtccactccctcgaggcctctgccggcgggcccatccgcggccttacccaccgtcggcctgctgactcggatcctattcccgggagcgggaatggtcaccgacgcgtctccagacggcaggctgctccccaaattgcctttcctcgttgcaacccgcgtctggcgtatagctgtatcttttgcagacgcttccttctatatagctgtcgctgagcttgagctgctccattcccgcaacccccttgtgtcccgacaacgctgggagcccattctcgcaccgcacttcgttaggttagtttagatcacatcattctcaggtttgttttaggcttttagcctacacctgtcgcctcaattaattcgctgtggagggggagattcggaggcattagcagaatcaaaatcc

SEQ ID NO: 5715 - DNA, 455 bp, Zea mays
gagacttgcttcgatttatcccttctatagaccttactcatgtgagagcctccggcaacggagtctgcccctagatatctgcatatcatgggaatatgaaaaggctatcctgtcctgtatatctatttctgttttgtaggattattaaggatttggaaggatcctagggaatagttgaatcaataattttggggggaaattaccctcatccctccagaatggagaacaagtcagatgaccttcagcacgagcatggtatgcccgatcagacgtcttgtcccttcacttcactcttactgtcggcaacatctgtcgcccaagcagcataacaagataccggttctgacatcaaatcgcttagtctgctgcatggaagtagcttattcccacctgatgatggttacatctggaaggcgcgcgcgcagaacattgttccaggctgtgaatatcccacc

SEQ ID NO: 5716 - DNA, 218 bp, Zea mays
gagacttgcttcgatttatcccttctatagaccttactcatgtgagagcctccggcaacggagtctgcccctagatatctgcatatcatgggaatatgaaaaggctatcctgtcctgtatatctatttctgttttgtaggattattaaggatttggaaggatcctagggaatagttgaatcaataattttggggggaaattaccctcatccctccaga

SEQ ID NO: 5717 - DNA, 1344 bp, Zea mays
ctcttaacttcacatttagatatattttaaatttcactttttaaatttggtcaaaatcaaccttttaactctttagttatatagtccatgaaatatgaattgttttaaataaatggtccatctgttccaactgaattacctacaattgaagctgcgaaggaaccttatactggattgtcgataccgttcgtgtgtatataatacgtatgctgaaaaggataatgctggagtgttcggggaaccttggactaccgccctagctagcatggacgccggatggagactgccgcgttcttccgtgaaatacagcggcgtgcgcgggccgagcacgagaaaacatcgatacccggacggcagaaacgcatcatgagctgctcctgcggataagctcgaaaaccatttcttccatggtcctttccgccctaatttattgccttccagcgtaccccacgtccccaccccacccccacccccacgctggcatgcgcgctcgcccaccccgcggattgccggacgccgtttcaaacccgcgccgcgtcccaggtctacacgccaggcaacgctcctcctgcccacctggactcgggcgggcattcggctaatcggctccgcgatcgaacagaaccccagcatagccagcggagcactctctatatagcacgccttttccttatcgtcctcgaggctaaactcaaaacaagaacccgataatcaacttcagtctcgtcccgtaggaggaatttgaaaacccaaacgtacacctctgatacttcagctggagctgcaatggcaacgcccgatttgtccccggtctcgccggtgcggcgggacgacaagcagtgcgcgccatcctcctcgtcgtgcacaattctgagagtgcaggacgcgtccgcggccgaggcgtacgagcagtacctgcggctgccggaactgtcgagcctgtgggaggccgggtgcttcccggagtgggcgagcgagggcctggtgaagccggcgctgcaggcgctcgaggtcaccttccgcctggcgtccctcgcgctctccgacccgcgcgggtacgccagccgccgcgagctcgcgcgccggctggagtcgctcgcggcgcgggaggtggggctggtgtccgcgctctgcgagggcgaccggagcgcgccgctcgccgagctgggcgcctccggtggcgtgctcccgcgcgagcgcagcgcgtccgaggtgtggcagctgcccgggagcgccgccgcggtcgtgtgccaggtcagcgaggccagcctgctcccgcgcctcgccgcgtgggacaagtccgagacgctcgcggccaagatcatgtacgccatcgagagccag

SEQ ID NO: 5718 - DNA, 503 bp, Zea mays
tgcatgcctgcagcagcaaagcaaccgctcagcgtaattaaaggggaagagataacaacagggactcagggtggacgcgggagctcagctgaccttaaacgcagagcgggcgacgtagcccagacgctgcgactcgcggtagaagaagtcggcggtgccccccgcggccatggttgcctcgtccgacagcaacggcgaggaggggattgctaggtttttagccctcttttcttttccgtctctgagtttagcgcagcgcgggccttgcatgggctgggactgggctggttcgtgtgggcttactactgcgacaagggtgacgtggacgtcctccgagccgcgcgccctcgcgcctcttcttggcttttttgcggcgtgtcggatcggcacgaccttctagatgattctcaaacccacttccgggctgccgccgaggttatctacaacaccgagcagcgagaaggggttggtgtccagcacgaattgaatcgtcgccagaagtc

SEQ ID NO: 5719 - DNA, 1500 bp, Zea mays
caaagaaccgtaagagcatctccaacaacgtgacctataaaaatgccttataatttaaaaataagtaaattttatagaatttagggcaccaacaaaacaccccgctccaacagtaaagccccaaatctagattatagggcagcccactacggtgtagtatatttgaggcacttgagagggtgccctatagttttttgacaaaatttgttgaattgaggcactgttggagtgatttttcctgtgtagagccctatatttcgatttgaggcattagtttgaggcattgttggagatgctcttacatgttataattgacggttcggacgtgtaaacgctttgcctagcgtagttgtcaaaccaaattgtattattcagaatcaagcgcgcagatcgcccgtcagcttttttttgtatatatttaaatatgaaaagggagaggggaaagaaagactcgtccgtccactgctcgcgataggttaagcggcccataagtgtcggagatggttcaactcctcccgatcacgcgagaagatatgccagctctctagcacacttcgtcaacgcgatataaaaaaaaagatgcataaaggatccggagacgcgcgaaagttctcaaagcaggcgtgcaaattcctctacccggcccagaccattagaaaaaacaaaaaataaggagataggagtagataacaacatctccaagggacaccgctaaagcgagaaatggtgcgccttttttttaatcatgcccattactactattttactccctagtttaatttatcgtctaaaatacttgtgcgcatcattattgccctcccccgtagttgacttcgaagcaaagacacatatgggtgcgatgctggaaataaaggcttagaaaactgaatttttcttcttatctccaaagtccactacctatctcatggatggccaagacgtcaccatcattcacacacatacgacgtatttgagcattttacacagaacaccccatctttgtctcaattattggggaagcgattcaagagatctggagaggccagggtgttaatatactccaccacggaccaacacaacacatatgatttttgttagcttacgaatgcttgttatgtttgtttatcaacctttttttagtaccactacccgagatctaaaagtggacctaaaaaaatcaataataaagagagagagacgccagaactggccaaagtggcgaaggcgtgaccacatcgatatttgtaggaatccaacgggctgctccagaaaaaagcagcagcacccattgactcgcatcttcctcccccctcccctgctcagctctccccaccatttccacctataaagccggtccgcggcatcccttccgacctccacctcctcccttcccgacccaattctcctcaatcaaagaaagtccccacgcagagcaagccaagatctgcgccgcggcgaagcaaatcaaagcaaagcaaagcaaagcaccggctggctccc

SEQ ID NO: 5720 - DNA, 1500 bp, Zea mays
ctcgtggttatggaatcttctgacttggtgacattagtattttctctgctgaaccagtctcgtccatggggcagccatttgcgtgtgaccggttcagttttagctcacttgtgttcatggcacccatctgactcaggttttagtgggcattacatacatattattttttctgctgtgcttgtgtcttccatgtgggtacgctttactgaaatccaaacatgatgataccttgtcatgattgcctcaatgcaattgaatttctgcaacttgtctccctacgcagtggcttaaggaagctgaagaggatgatgacgatggagaggaatagccctggagatggcacttgaattctttcatgcattgtgagcgcagaatcctgtttgagtggtctcccggtgagtttgcgacgagcaagttttgtagccttcagtaactgtatgtatttcaacacaatacagttttgttcctaacctcaagtggtggagagtagcaaggagcaattcagtaaccaaaatgatcccagcgtatatgacatgctatacaactactgtactgtctttgcttggttgacgcttgggcgaagttttcgccacatttgtttaactgtccatcatctgtttcttagcacccagccatgcactcgcacagatctttaataaaagctcgtttagatatggcccctgtcttttatcttctttctggtgagaaatgtagtggggaagaaagcaatggaaggcttcttccccgaaaggccccagtggatcatgtgggttgcgtagatccggcactaatcttacctcaaaagggggcacagttcgcttaaagtacgttcttttggcccccaaaaacctttggtttgttgttttttttaattttattttgccatagatcccagattagccttgtctgctttgtgaaacggcccaacaatgggcagcgaaaccagaaaggccatggggagagtaaaagaggaaaaggctggcagcggaaggttgcacttgcactgctggactaagcaatctcgctgttgtgttgccttcgcccatcttctgcagcatgtgccgtttcagtttctaatttgttgtttatttgattctgcatgttgttttactttgaccatgagaaagcagtctctttttctagtctggttataagagcatctctattagttctctaaagcaacccatggaaggtccgtctctggcctacggatggaacagggtgtggggcagacgagatctcggtttaaatccgagtcagcactgcgatcggattggacccagcgaagcgaagcaacgctctcccaactgatacacccgcggacccgccccgcccaccttctggcttctgctcgtctcgtgagccttagcgcttaagcttgccgtcttccgccccttataagaagcccgccgcccgcccgccgccgtcactctcggcctcggcagcaaactaacaaggcacatcgtacgctcgaggagaggagctgcgttcgtggtgtgc

SEQ ID NO: 5721 - DNA, 180 bp, Zea mays
ctgcctttcctcggtaagcccggctctctcatcttttgggggattttttccccgtgagctgaaattggttgcaaccttttgcgcgcagtgctgtgccctctgcgctactaccaccagaagcatccggtcaatctgctgctgctcggcctcttcaccgtcgccatcagctttgccgtcggc

SEQ ID NO: 5722 - DNA, 136 bp, Zea mays
gactacactggtctaaacaaagcatgtccgaaggttccctaccctctgcctcgcatcgatcaaatcgtggattccacttgccgggtgcgaaaccctgtctttcctcgatgcctactcagggtatcaccaaatcagg

SEQ ID NO: 5723 - DNA, 1500 bp, Zea mays
ccagtcgcattgccggttacatcgcgaaaaaaaaacaatccagaacttggcaaacatcccaacaaaggtgccctaacatattacaagtgatgctgtgccgcagcacagatccaaaactcgactacgagggcagtttagaagtgcttacgaggtatgagacgatccgagctgcgggacaactggcggcgagcgagcgggatcgggtatgcgggcggaggaggccgggggcgagtgcggcgtcggcagcgcggggttaaatagccgtaggcggcggtggcagctgcgactgcgagcatccgacggcccgcgccctcccgttccgagcctttcctcgcgacgcacggcccagatctctccgccctacgtgattttcaaatttcccacgctgcgggggcgaagtacccgaactgccctctgtaaatatagccgttccgtcggggggcgcacagggaaaccaggtcgcgtgacccgtctaggctgttcccgagctgccccgggtaactccccgttctcttccccgctggcccgtgtctgtccgcgtagctggccggcacagcctagctccactgacaggtgggtttctctagatttgggtcccacaggccgtttgccgcggtgcgagaaggtgagacagggcagcgacgggcccccatgtccatgtgcggggcggggcgcgctgtcgtggcctcgtggggataggagcggaagtgtgtaatttggatctgacaggtgggtttcactattctggtcccgtggcctcatcatggttgtgagtatacgcgccatgacatgattgtactcggtgaaatgtccttccaacttgtttcacttcccagcaaaatgaaaaaggagaaaggaggagcatttgttcggtggtgtctccaattttttgtgttttgtagctggttctttccatgttggcgtgagcatttgaggaaatgacgaagtcgtcttttgctcaggcccagttgccgcttctaggaaacaaagtccaataggactcggaagctaggcctgtttgggctagtacacttgcaattgcaagttgcaaccctgaatctgatcgagcatgggcactgaacaatcagattgttctttctaaagaacgaacgaataaaataaaggaaaggtaaaggcattcggaatcagaattaccgttggatgggatgaccgaggccacagctgcttcccgcgtgctgccgtcgtgccacggtcccgcacgtcattcagagcatcgatgggaaggcacgttcacctcttcgcgcgcatccggataacgggcccacccgcacccgacccatacccactccactggctcctcacagtcccactccactggtgcggcgcggagcgaggacgacgtcaccttctccaccccccgcccctgcccctgtgtgggagtaggtgtagccgcgtaagcggcagcggcgtaggcctcagctcggctcagctgccgcctcgctcgaaccagaggagccaagcagaggaagcgaggcggag

SEQ ID NO: 5724 - DNA, 1500 bp, Zea mays
tttttgaatctttgatcaatttctcttggaatacctctttttatgtctcaacaagtgtgtttgacttagagataggaaattgaagttgatttgcaaaaacaaaccaagtggtggcaaaggatgatccaaatatgccaaatttgaataaaaaacaattcttgttcaaaattgcattgatgttgcactccttttagttgctttttgttgtgttggcataaatcaccaaaaagggggagattgaaagggaaatgtgcccttgggccatttctaaagtattttggtgattaagtgcccaacacaaatggtttaagtgcaaaatggtggatgaagtgcaaaacatcaagaaggtatgattctagacttagtatgttgtttttgtgtactaacatatttgtctaagtgctagaatcagggaaaacagaaaaataaaaggacttggctgaagcagccaagactcagcgcagtctgggtgcaccggactgtctggtgctgcaggctggattctggtcaataggccgctctcgggaattcgtcggcggcgtacaactaaaattcaccagactgtccggtgagccaacggtcggccgcgcaatccgcgcgtgacacgtggccgagccaacggtctgatgggggcactggactgtccggtgtgcaccggacagtgtccggtgcaccaacggctccaaatcttcaacggtcggctgcaccaatttaggaaagcaatctgcaccggacactgaacagtgcctgtccggtggtgcacccggactgtttccgtgcgccacccgacagaaggcaagaattgccttcctggattgctaccaacggctcctagctgccttggggctataaaagggtcccctaggcgtatggaggagcacaccaagcattctttgaccatctctaagcaccaagacttcattctagagcattcgattctttgtgatagcaatttgagctcctcttgagttaagaactccgtatgtgaacttagagcacaagttgtgactagtgtgcgtgtttgtgttgttgcttttgagacttgtgtgtgctgcttttccctcccttacatccgtgctttctttgtgatcatcatttgtaagggcgagaggctccaagttgtggagattcctcgcaaacgggatatagtgaaagaaagaaaaacaccatggtattcaagtggatctttggatcatttgaaaggggttgagtgcaacccttgtccattggtacgccacaacgtggagtaggcaagtgttgtacttggccgaaccacgggataaaccatcgtgtctcttgtgcttgttctcactgtgactattgtgtttcacaagagctcggtccttagccacttgatttcactgtgctaacacttaatcaagttttgtggctttaagttttaagtttttacaggatcacctattcacccccccccctctaggtgctttcaaatggtatcggagctgttctcttcaagaaagggactaatcgcctgaaggg

SEQ ID NO: 5725 - DNA, 56 bp, Zea mays
ttgaagatgagaatccaatgtatgatgtatctgtgagaactgttgatagattgtag

SEQ ID NO: 5726 - DNA, 1500 bp, Zea mays
cttcttttcacatatttcaaaataaaacgtgtggctttatatccccttgggacgacttcgacatttttcgtcgttattgcttcaaatatgtaaggcctaaaatgtgtataagaaaaaatataatagcaataaaataaatatatgaaggaatgaaatagtaaactcagatatctcaaactatccttaagtgtgaaatttgaggactgaatttctaaaaccaagaagtcttttagaaaagaagtaatagaaaagttttctattcaattaaataatgatgcatatcattaaatgatgcaccataagcatttatttacatgaatagttaattttggagtaacctttacttcttgtcccacattcaaaatactttttttccttttctaaagagaaagaaataagaaaagaaagagataaggaatataaacctcataaagtatatatagaatcatactttaaaaatttgtacaataattgtgcaacataatatgaggataaattgccaccaaatttgaattcaaattggaatttaaatttgaatttgaaatttaagagagaaatactataaaagacaagataaaatttataaatatataaataaattccacactagtatgttaaagatgaatacttaatttgaaaacaaattatgctacaaaaaaattgaattcaaatcctagatttggaaatgaaaaagagaaaacaaaatggggaaataaaaaaaagaaaagagataaaagaggaaaacccttctgggctgaaaaccacctagtcttgcgtggcccattcccattctcctatcccgcacggcccacctttctctgctcctctttcctttcactggctcaaccaacccctgtgcgcgttctacgagcactggcatgcgggcccgtgccctagctccatgcgcgcctgcgctctaccggtgaaggtatacatgtacatgtgggccggcctggcccggcacggcacaggcccacaaaagcacggcccacaaaggcacggcccacaaaagcacatatctaattatgggccgtgccgtgccagcacgtgtgcccagtcatcggcccacggcacggcccacaattagttatgtgtgccaggccggcccaaatagcccaaaatgtcttaatgtgccagaccggcccatatacatacaacagtaatacatcaacaaaaagtataatatatatatgaccaaaataaaactaagatgttttgtggatgcacattataaacctttggtcagaaagaaaaaaaatattacaactagctcacaaataatattcagttctctgtttagtgtttaattgagtactatacatccatacagaatacatatacaatgatcatcatcactattcactatccatatctaggtattggttctcgatggcttaatgaagctctagattctccaagttatgctagtcatgtgggctttgacggaccttagttaaatactgagtctatatttagtgggcctcggtgggccttagttaa

SEQ ID NO: 5727 - DNA, 279 bp, Zea mays
tcggtgggctgcagcacagaggcggccttgatggtgttggtgatttggttggcactggagggcccgattccatggtgttctcctcctcctcctccgcccctggtagtttcggcaatcagcttggtgccgacggcttacaacagcagcagatgcagctggatgcaccacaagattcacaaaatcagcaagagcatcaacagcaaatgtcaatgacatataatcagcagcatatgatgtcacaaactcagcagcagcagcagcctgcagtgaagttggaga

SEQ ID NO: 5728 - DNA, 621 bp, Zea mays
cgttgctggagatagccttactagtacgtagtaggagtaggtgctgtaggttctataaggtcccacagtaggtcctaccactcgatcttttatttcttagccgccagatcaaaaatcgacggctcgtgcaaactactttctccataccttcccttcccttcccttcccactcttcttcgtctgagcctccgatccccggcggccggcgccaccgcctcctgccagcttctcgcaaaaccgcccctgcgctatcccggctccaccagcctcttctcttacctcgacgcccttaacgggcccatatgggccgtatttttaccaaggcgggcctcgagcgaagcgcttgcagaacaggacgggtggatgggctcgaccagtgaactctttttcttcttctttctccgatttctcacaaacagaagccgtgagcgtttttgggtgcatacacgatcaagctatacgctgtacacacgtgttcaagttctggacgtagctctgttcgacgtggcagcggctcagcaaggatggcacgacacgtaaccacagctcgttgcttttataaagcaaaggggccgacggacgcctgctactgctagcaacggaacggagcgcaacgcaatc

SEQ ID NO: 5729 - DNA, 1343 bp, Zea mays
agctgcaaaattaaacctgcagctgcaactaatgctgatagcatttggcgacagcactctgcaaaaagccggaggaaggtttcgtagagcaagcagtagctgtgatgatttacaaacaaactggatgcacggatagaacaacaacgctgagatgcctaagcaagactgaacaggtcatcctaaacagtagtaggttcctgaaagcaaagcaaagcaaaaaaaaaaaaaaatcatctaacagtagtagctattaaccttcaggctatttctaaataaccgtgtaaagtagagggtgaagtttgaaataaggagtctgctgaagatttcagcctcatgggagctacagtgcgtgcagtagtatacgacgacacacagcatgcttgtgactgtatgcgtgaagaccaggcaatgggcgctttcacatttttcttggcagtttctgggatgtgacggtcgttaatgatggagtccgtgtcgttacaggctaagagaaacagtcttattctggttttcatgatgaagcaaagctgcagccatttctctacagccactggccgtcatcagtcaccgttgttcactcggtagtcggtacgtaggcctcggccgaaacatgggccgccagttacttcgaaggcccagcccattcgtagcacctgcattttgccctccattgacgacgatcgcgttgcacgtgtcatttgttgtgtttttttttcttcttctactacttttcttcgcttttttcttcaaaaaaacgtgtccgcggtccacccggaggctgcgacgtcccccaagagatcagcttacgcacgtcccacagttgcaggccgttgagaatttatggtttttgtttggtttgtagagttacttattaagtctttatttaagtaataaggatggattaaagtggattgaggtatactgaagggatagaaaaggaaattagttcatattacacttcaatccactttgtactatttcaatccactctaattcgaaaattacgtagacaagtccttatgtttcatgagataatgtattataagttcatccaaaaaaaatggaacaattggatctataccattaaaagatccaaactttagatatataccatggaccccacatggcattgactcatgtggacccacatgtaagtgagatagtaatggtatggatccaaagtggtgatcttttaatggtatggatccaaatttcccttaaaccaaacacgcgctgccaccgaccgatcaggcgaccccgctccaagaggaaatccaccaccgcggccggggcctcccaggagatctcgctggaggcagcggcagcggcggcggtggggggcg

SEQ ID NO: 5730 - DNA, 224 bp, Zea mays
aaggttgacattttggagcttcatcatacataaatgaaataatcaaacaatagaggtatgaaaatgtaacaactcgagactgaactatgatttctgacgagagatctgcgacgaggcgacgacccaaatggggaaaaccatagctaatccaagatctgaactccctcaaatcccgcaaccgggcccctaatcccttccaaacccaatctcccatctccgatcca

SEQ ID NO: 5731 - DNA, 208 bp, Zea mays
acccgtgataagatgagactctctttcgttttaggattcttgctctgatccttagtgtagatgcttaggcatttttgcatattttacatccataaaagaatattgttaacttggttggggcttggagcttttttatttgttgttctaaatgttcatgtgatattagcttccgattatgatcttctttctttccttataacataggttc

SEQ ID NO: 5732 - DNA, 281 bp, Zea mays
aggcgatagatagtgcgatgatggtgggcggcgatggagggttcctggaattgcgcggccaagagcgagacaaggggaggatgtcggaggcaggcagaaccgtgcgccaggccaatgtgcccacagctcaggaatccccacagctcacacaggcacacagctcctcttggcggcgcctctgacttctcctttttcgtcgcccttctcctttttcgtcgccttcgatcggcggctgcctccttcctccacttccgtcccttcaccgagccgccgccgccact

SEQ ID NO: 5733 - DNA, 319 bp, Zea mays
tgggcgtctaaggcggtgtgtgatgggcgctggtgatcagcgacggcgtggcggcggtttcggggtaggaaaaattcctggtatgccatcatattttatactcatcccttgtgtgccactgagtggcatataggtatatgttttggtgtttatgatatgtgaggccagtggcacacaaggaacaagtatattttccaatggcatacagcgaattggcccttcggggtatgagcatgacctgttttagagcagcggcaacccgggaaggctggatttgaaggcgtattcgttggttatctactagctgacggtctcactg

SEQ ID NO: 5734 - DNA, 692 bp, Zea mays
ttcgacactgtttttctttatttgaccttttccttgctgtgtagtggaaacaacatgtacttgttgtctttcaatacctgttcttcaactgacagtatattaccctgtgtcattccagattattattggtttgttgcaaaatgtctacggaagcgactttgaacaattctggtggttctgaatctgcattgctgttactggaacagcttgctgaagtttttggaaagttaaaaactcacaccgaaacatttctgcatttgcaaaatggcataaaatgggaagatattgaagggcatttcctcagccttgatgagtcgtacagaagcaagtttgatgaactggtagagaaggagaaggcattagaagaaaagaaagctgaagcttgtaggttgattgcagagaaagaggctaaagtttctacaaaagagcatgcctcactgaatcagcttcaggagctaagggatgctgctgtctcttctctagcagaggttcgacaaaaatataaggtggagcttgctgagatacttgaagcaagtggaagcaaagacaaaaaggtaagtacctcaatcaatgacaacaatgcatctcgtgcttcagaggagaatacccctgctagtgggtcgggtgaggcatctgaagctttacctgttgagactaagccgcgccctgtattgaagcaactttgtgaacag

SEQ ID NO: 5735 - DNA, 78 bp, Zea mays
ggtgatgataaggcatagttgtttgacttagcctgccttagctatttcttgaagctaagggaaataataattggtgtt

SEQ ID NO: 5736 - DNA, 935 bp, Zea mays
cttaatacaatgaccggaagttgtcttacctgcaggtcaagatcaagatatttgtagaaaggaagtcactaagtcgcataatcacattagattacatcagtcaggtatggctagacctggtcacctgttcagtcttaaaccagaattcatgtactttgagtgacaggtaaaactaggagaaaattatcgatttcacatgcccaggaggaggaacaccacagagcagcttagatggtgtactacagtagttatgyaacaaacaggagcagtaaatatgacgaagttaaagctcacctcctgttaaataggatatccaccaagttgcatagcgttctcgttgcttgatacgccagccgcctgctgcctgcaaggaagagccatctcagcgaactctgctctgggccgacgagatgaaaccaggggcacaaccgcggagcagtgcggaagatggggcgggcaggtacctgggacagcggagcggagaaggagaggcctagtggagagtgcgaggcggtcgccgaggaaggaagagaggagactcggcgacgacaggctcgccatgggcggcgtgcggaagcaacgcgagagctgtttctggcgtgcgggtgcggcggtgcgggcgagcggcttgtgtgtggtttggggtggggcggtgggcccctgccgtctcccgcgcgggcctgcctgcctggctctaggtctagggcgctgttctcacctgcgtagtaggccgtgggctgaatcagacccggaagaatggcaggccccttctcaaaatttattctgggctgggttgaaatttggaagccaaattagcccacctttaaattgatttgggggcccgaacccgcgacttcctgagacgaggactcctttcccttctgtcatctgagactcggaagcctcggccgccgccgttaccacctccttgcgcc

SEQ ID NO: 5737 - DNA, 678 bp, Zea mays
gaagcagtctataggatttaggatctaagaagtaacagattctacattccatggattattctatgcaagcaaggaacgaaggaaacatgggtttgtaccctcgtggaagctcaatgtttgctagattgcactccatgggtgagctattgatatgtacacatgcatgcatgttgaaagaaaatggttttttgtcgatctatataatctttgctctcactttaacaagtgctaatttagcttaacagttgcttttcaaggaactaaaacaaaataaggcatgcaagatagagtttagctaaagaattggaagatcttaaagcgaagattagctattgagcggcttgttgggcgagaggcctgacaataatcttggacttgaaagatggagatgacatatcctttccattttccgacctggcagggtatttgtcgtccaacaatgcaaccgcatcattagaagtttccatgcccctgaaacctgaactcttgctgtgagcaacctagaaagccgtgaccctcctttcaccttactgtcttgcacgtcctttcttgttccacgtacgcactccggtccgcgtccaagtccaatccatatatgcacgcacacggccacgcagggcagctctctctccgttccgttccgttccgtcccctccaccccgcacctgcagccgcggg

SEQ ID NO: 5738 - DNA, 548 bp, Zea mays
tccgtgttttttttatcaacacctattttcaaatgactttatagataaaaactctttttttatgctcttacataagaaggaagagaagtggccacaactttctctttagagagaggtaaagctaaaaacaattagtttttcacagctctctcttcgttgtcctctctaaaccatatatatgaagctgttttactgacagtttttaaaaatagcttagattaaccccaaaaaaactaagctgtcctgaagtggatctatctaaattgtacccgtatatataataaaataataataattcaattcatcggcgtcacttcgctggtgagggatggtatccatcgatcgattagattccgatggacggcgcagatccgccgattccctcaccttcctctccctccttttttaaccaccccacggctcatctctccctccacaagtcctgagcgaacctccccactcgccactccgccccctccgctcccaaagaagaagacgacgacgacgacagcaaggtgccgccgtcacgagatccgtccgaggtgacc

SEQ ID NO: 5739 - DNA, 1500 bp, Zea mays
atattagtataaaattcatttttatgtgaaattgagggccacattgtgctgtttggttcaaccttttttataagcatttttaataatctggctatgggagaatttagctagggagagaatttgaatatcatggatattatgtatagaggaagataaaaatatccatgacgtttaggatatagaaagtgatggcttactactaattcagcgattcaactgattatgtgtttatgttgattttttcgattttttactaaaatgattcttataaaaactattttaaaaactaatcatttgtcagtctacaacaccttatggtgaccaaaagctaaagaactgaaacaaacaaggccattaattttagattatgtatacactcatgggctacctaaagattttgaacatccttgcatactgatcctactaaattgaagtttttgtcatttccaggaaacgaatgttaaaaatataaaacctactcgtatgacacgaaacacttagaccgtctccaacagcatactctatatctattatttaccgtctcttctaaaagatatagaggatgaaatcttttagagagttctgtaaaggacagagaatattattttaagagatgaaatttagagtatattgctagagatagcctaaaactgttttaggctaccaaagtatgggcctgtttggtttgatgactaacttgccccactttgccacacttttctgcctaaggttagttcttcaattcaaacgactaaccttaggcaaagtgtggcacgtttagccacaaaccaaacagcccttatgtctttcagattctgtgctaagcaggagagtgaaccaaatcgaaaacggaatatttgttctttgtttttatggtgggtacacatgctcatctgttcaagtccttgtcagtcacctcgctgcaggtgcacatcatttgtaggtggctcgcgcaagtcgctgcaggtgcatccaatccaacaacgacacgaacgccgtggcggtaaccgccaaaatatctcacaacctcccagccccacgtccccttcctgccggcttcggcctgtaccgtagcggcggcagccgccggccgagcagattctgcacccggagaggctgtgcagtgggtggccagtatcacgctaaacgccacgcccaacatgcctaaacaaaataaatagtcacagaattcactgttcgctttagcacgtgcgagcatcaatgcaaaagcgtgcgtccacacttcgtggtgggtggtagcctcagcctgggccctggtcactggtggtgtagacgaagacggccacggcgacccgttgccgttgcacgccgacgccgcattgacttttgagccaccaagtctcgagcgatgcgccacactgcccgctgccactgaccactgattagcttcgcctcgctatacctatacatatccggcgggcggcggctcgacaggagcacctagcagccagcagcggacgcgcggacaagggcagcggc

SEQ ID NO: 5740 - DNA, 117 bp, Zea mays
ggtgagttgtatgtcttttcatgcattttgttctgttgtgctgtattaagtcaacatattaattgaaatgtgattgcagtcctgtggcagctgcattggccagattcttgggttcac

SEQ ID NO: 5741 - DNA, 412 bp, Zea mays
cgtaggtcggcggaggcaggggaggagacacaacgcacacacgccggtggcagggccgacccccacacgccgggtctaacccgatcctcgtcgtctgtggttacttcagtgtcatcacggccaccaccgtgcttctctgtgttgccgtcaacgtcgtctccgccacccagtccttccacgctggctatgacgtgcgtggaacgccccgcttgccctgttccattccagtgcaactttccctctcctggatccggctggttcgggtgtggctctgttgttaaatgcactcattcatttgctatgatgtgatcctaagcaactctatttgccatgctcaacactcaatagggaggtgcctcatagagcccccgcttgatctgtggtcgggatcggattggccgccgcgcatctc

SEQ ID NO: 5742 - DNA, 1096 bp, Zea mays
gtactcttctcctgtatgcaagcgaaagtaagtatacaaaaagtataaaggatataactctttgtctaaataaattaccataattactaatcaaatatgtttatataccgtcgcaacgcacggacaatgtattagtatacacctaaaaatcggagggagtatatgccgttgtaatttgcttccacatattactccggccaagtccattacaattgggttcgccttgaaacttgccgttgtaatttgctgccagatatctcgtttagatcctttgaattgaattctattctaataattataatttacgcgctgatcaattaagttaatatagttttatatagaatatatttgtatacaattataggctgatgatacaaatcaattttcaccttcaccttatgaatttgagataggcttatatctaacctttgaaaaacagtgaaaatatcaaattccaaaccaaatagcttactctattaagtagattctaatcgagaaaaagtattaaataagattgatatcaacacaatcatttatgactttgcctcaagaaatgttagaagaaacttttgacgtattgcaaaattcattttaaataatattttgatatcacattaattgctatcgatataatataataatatatacatgtatactcaaaaaatattacacttacataggacacctaaattttatgttcgtcctagatcaccgaaatgttcgtgcgattatgccattgtggtggtggtggtgctgaatgggacagtcacgacgttcggctcgagccccttctctcccatcctcctgaacaacctccccgcctcgtacatcctccgctgtgccgccttccggcatcccgtgcccaccctgatgcgatatccaccgatgcggcggcagtaccaggaaatgagcaccgtgtacgtgtaggtgtccggcttgcagcgcgcaccgggtcgctccatctggtcgagcaggaaccgggcatcactaaaccgcccgttccggcacagcgcagcgatcaaagtgttgtagcactgcgcgtcaggggcgcagtggagctggtgcatgcgacggaacgtggcaaactggcaaatgc

SEQ ID NO: 5743 - DNA, 1002 bp, Zea mays
ggtaatccaacttgaaatacatcgtgttttccgtcgattcttgaagcatttttcgttgattgaagtggatttgattgtaacccttattcttcgtctaaatgtgtgatttgtatccgattatacatctctctaatctgcttattgcgtcgctcattgcatctatcttttgttcaggagccccgatcttagggcatctgcatttcttctagatccagtgtatctctcgacattcatagacctagacgaaggcagtggatcaggtatttattcatgagtttgcatagagtacatttatacaacattagtaacacatatatgcttattgtatttgatatatatgcatatcgtcaagactgtttatgcacatttgtacaaatgttttgaatattggtcgagataatatgcataattgtattgttctatttacttcaatcattagtttacacacatgttgtattatatataaaatatacttattggatttgatatttatgcatatcggcaatactgtctatgctcatttgtacagatatttatgaacattggacaagataataagcataattgcattgttctatttacttgaatcagtagtttacactcctgtttattatatataaatacatacagatactgttatttatgcaaaagttatttaaatattcattyttgaatatgagctaaatgtgtatattactatgaaccagttattaaaacatgttgtatagttagttgatgcaaaaaaggctcttattttatcatgatccatttacaattatatgaaatattaaattaatctttatgtttgtatataaccattgttcattaaatgctgtcacataaatgtaaaaggtagtttaagttatgtaattccatttagcattatgtagtatgcattgtagatagttatagtaaaaattagatttttttggcatatattcatgcataaatcactgtatttaaaaacaactttttttcaacagatttattcagtgtttaatc

SEQ ID NO: 5744 - DNA, 118 bp, Zea mays
ggtagcgagccggctccctggctactggtccggatgggattcggcgcgtgcgctcacttaggcgttctggtgtcggtgcaggtcggcggccgcggcgtcggcggggctggaaacgcta

SEQ ID NO: 5745 - DNA, 109 bp, Zea mays
gtgggagacgccctggcatcaaggatggcattggcttccaaaagggagacaatgtcaaacttaatgcccctcctaaagattatctaactgtgttaagggcaaggctccc

SEQ ID NO: 5746 - DNA, 1386 bp, Zea mays
tgcagtttccttgtcagcattcacggtttctcgacagattttgaatttccctatcggtttgtaaatacaaatttaggtgatgtttggttcacatatctataacgtagtgtataactgataatgttaaataatgtttgtttaagttcaaccataatcagatattatactagaaattaatatcggtctattcaaacttgttaccgctgatactcgagtttgaatcattaccattagcattaccttacatttcgtgaaccaaacaatatattagttttttttgcaagtaaaatgaactttacaaatgaaaaaacaaaaaaaaacaggccgggattaccggtttgtgggcggagacaaacgaaaaccagtcctcttgatttaaatttcaagccagtcgaataattcggatttcgacaaaaaccggtcgagtttctcgtgttcgctggtgtccgagaaacgatttggttaaccctagttgcactcgaagtgggggactgccattggcacccaccaacgcccccgacggataatgcgcgagcgtgggtttcaaccggatgggccgaggaccgaggtggccgtcgcgtgcaaggcggcggcaggcgcagccggcagcagctgcgtcgtccaggccggatgcggaccgcgaccgttggcgcccgtgctggtcaccgacggcatggagagcgagacgatcgcggcgagatcgccgtaccagaggcccggagcccagcgccacacagagaacgcggccctggaattaaaaccccctgcgcgtttgattgccgtcgccaacgaccggcgggccgggccggtcccaacggacaaacccgtggcgtggattcgtgtactgtgctgccatatcccacgacctcagtgcaatgcaagtatgatgcaccgcgtggctgggctcgcgatccgcgggcacatgcgcggccgatcgtgcgcgcggcacggccaattaaaggcccggcccccgtgtgcacgccgacctggccgggatcgcatcaaatcgctcgccaacgaaccgcagccccggctggtagcgcgtgcgtgcgtgcgtattttgcgcgaaacgaagaggcgacagcggcattgattggagccgtgcgagttttaaacgcccggccgctacacccgcacacaccaccaccaccactactaccacagggtcaggatccgatgccccattactactttggcattagcagtcggtgagaagcggggagagcagcgcgagagagggcacgtacggtggttcgttcaacaccctactagcaagctcagccctagtccggagccacggcgcggctagggagccgtgcccggcggccgtcggagccgccgcgcggaccaggcggcggggcgcccagggtcgccgggacgcgcgcc

SEQ ID NO: 5747 - DNA, 661 bp, Zea mays
gcagtacgataagtataaaatactctcaagtcaaacgtatcgttatttttaagtgttttaacagtatcaaataaaatctacaacaaaaaagttatatgcatcggcatcgttgagatctacggtctttatataaaaatatctttattggactctataaaaatattttatgcattttttattttttttatggagtcaaatgaagatacccttgatatgagaacgttatatttttttgacgagatctaaactttctagttttagattttagtttttagtcaagatcattaaatcgctaaaaaaagacacattcagcttaaaggaattttggatttttttatacagatattgttaaaaccaaatctaactgaaaccgcacgaaagataaaaaaagtttgaattaataacacgtgacaaatacaaccttatataatggcacaaaaggccttgataacggccccaacccggtcgttgcgctggcagcctcaaagcgcccgcgaaaagagccactgcgccgcgccgcgccgccgcccctccgactccgcgtcggtgatcaaccgtctcgtctccgtgacccatccgtccaccgtgcttctcgcttcctgccgaagaggagggaggtctcgcggcgcggggcgcccgattatccgaccgaccggccgag

SEQ ID NO: 5748 - DNA, 576 bp, Zea mays
ggtgtgtcgagagattgtcacacggcagttactatcctgtttgggaacacgaagattaagcactctattaagaaatgctaacctgtctaatgttcatatgtttgtccagtgttggccgcaatatttagattatgtgcaaacaattattaagatgtgtgaactagcattatggtagatggataataaactattgttgtagcagatgatctatgccactcagtgctagcatatatggttttgtaactgctttacaagcagtgtaatttatgtagggatataccggatgcatcagtaactgacagctcacgtttctcatttggataaatcgagtataacattgtcctagattgtctttggattataaaattagtaacctaggtttaggcgccattttgatgatcgaggataggccaatcttctaaaacaaatatggtttcaattaactttcactttcttttccaatatgtctatatctatgtgtaagaagaaaatgctctgcctctactgtttcttagcagcaaatctattttttcttcttcttcagatcatccgtctgcttgcttcacaatccatcta

SEQ ID NO: 5749 - DNA, 664 bp, Zea mays
ggttgtcactctactgcattgatgttgatgctgcatttgcaacctggttgtcggatgctacatatttatcattatttatttttttattaatgacaaagcatggatacaatgaatagtgtaaacagtctgatgttaacaaaagtagaataatgaatagtgtttttacatattaatgtattcgggcatatatctattatcttcttatgttagttataaatagaatacgtgaacttcatgttagtgcgaaaaaaagttcgtcatgactgatgtccatttttggatgtcgggtgtgggtttcagtttcacgtcgcgattgccgtccaggctggcgtccatccgctatggacaccacgatgatgcccccgagcagataccgtgctacatcattttgtccgtttctacgatgatgcggccggcggcagggcttattggccaatgatgttcactaattaagcgagcgattgattgttcgttaaccacaacgaaatgctgttggatggtttctgtcctgctggagtatataaagagttagtttacctccgaaagaaacccaacactgtgctcttggccgctacgcagattatttccctgttgaggactcgatcgattttgtttcgtcctgtcgatctgaatcttgatccgtctgctcgatcagtcgacgatc

SEQ ID NO: 5750 - DNA, 1288 bp, Zea mays
aagaaacattttgcgtgctttgagcgcgcggttagcgcggtcagacatttgttagaggacaccagtttagcacttgagtgacattgttattctcctattgtttcagaattcatcagttcataaatttgcagtagtaaaataatgtgcgatggttttgaaacttgtttgcgggatatagaagccatccctatgtgagtaatcgtaatcgcgtcagatcgccttgagtttctactgacttaagtcggttgcttttgttcatagggcttagtggccaccctgagttatataagcacgagcatgttgcaccggcttgagtcgttgccgacttaagccgattgctccgttagcagggcatagtggccaccccgagttaagtaagcacgagcatgttgcaccggtttaagtcgttgccgacttaagccgattgctccgttagtagggcatagtggtcaccccaagttaagtaagcgtgagcatgttgcaccggtttaagtcgttgccgacttaagccgattgctccgttagcagggcatagtggtcaccccgagttaagtaagcgtgagcatgttgcaccggtttaagtcgttgccgacttaagccgattgctccgttagcagggcatagtggtcaccccgagttaagtaagcgtgagcatgttgcaccagtttaagtcgttgccgacttaagccgattgctccgttagcagggcatagtggtcaccccgagttaagtaagcgcgagcatgttgcaccggtttaagtcgttgccgacttaagccgattgctccgttggcagggcatagtggtcaccctgagttaagtaagcgcgagcatgttgcaccggtttaagtcgttgccgacttaagccgattgctccgttggcagggcatagtggtcaccctgagttaagtaagaatgtaagtcgaccatgaacaaactgagtatctttgaagccttttttatkgatgacatatttcccattttacagagtacatcgtcgtcccgatagctttttaaatatagctagggataaaacttcctgaggtgttctatattccaggagttcccaatttctgtgtcgtccatctgagtaagacgatattgtcacacccgggctttaaggaacaaagccgggtgcatctcatacatgcgccaagaagacaaccatatataataacagagggtatagagataaatgtcataaaacatcagagtatttattacatagcggaagacttattacaaaataaaataatgaatataaaacgaactaaggatcgtcggcgcca

SEQ ID NO: 5751 - DNA, 346 bp, Zea mays
aatatatatatatatatatataaaactatcgcttaacaattttaaatattcatccttcaaattctctggtgcatggctcctagctatgaattcggcttcctaaaaaaacctatcagttcagcccaagagatagctacagacggcccagcccacggtatggtctaggtttttgattcccagcagcactgcagcagcggcatttccatcccaccccggtcggctagtcccaaggctgctgccgccgcctgccgctaggggatcgcttgctttcctcggaccactctgccgaccacatctacaccgcatcaacggtccttccaagtgagctccaatcccctgtctgtag

SEQ ID NO: 5752 - DNA, 978 bp, Zea mays
acgtacgttttagtcctttactttactttgttctcgttttcttccttgagttggcttggcttctgtttgtttcttccttgaccagctagcagtggaacgcgaggaaatcaacggtcgtggctggaaactgccatgcctatccggaacagtccgatcgacaaacagacgaagccttgatcttgtcttcagtcttcacaaaaggttggaaaacacgggccgggcccatctgatgatctgaaacaccactcactgttttcgtccaggttcggtcccgatcgcccggcgatagatatataggatagacgatattctgcacatgccgtataaatacgtagccgacgtacggctacacacaaccacgtagccgccggcatgcgcggtcgtcgtgttgcttgcgcgcgccccaatcggcggcggccagcgcgcccgcgcgtgcctcatcgcactcgcaagggaaagcggccagcaaccaagccaaaacaaagaaagaaagaaagaaagaaagaaagaaagaaagaaagaaagaaagaaagaaagaaagaaacaaagctttctggcccatcccatccaaagtgggtttctgctcgtgcgcgaccttgacctgatcgccatcatgcagcaccgcaaccccgtgctcggctcttggttgagtttgacccgttcagaatgccgcagcagcagcagcactacgaacgcgaccggacttggtctgatactctctgtccagcactagctactagtctactacgaagctaccaacactcttcctcgctcgctccctagcctacaactacaaatacccgctctcgtgcacccacctctcgccaccacaacgcaccacacaaagcgcagcagcccgcccgagagacaagcagccaaatcaagcctttatttacgatccggccggccgggatctagaccacctctctctcctygtacgtagtcgttgagtctttgaggtcaatcgagcgaggtaaa

SEQ ID NO: 5753 - DNA, 137 bp, Zea mays
agtagtttctacctcttaagcaacatttttctttgagcgacatagttaacgctcgcgattgaaatgcctcaattctgttgcttacggtagcatgcctgtccgaactgcagtttcgaagggaaaagataaatgaaagg

SEQ ID NO: 5754 - DNA, 896 bp, Zea mays
atagcacatagaaatatagggattaaactgcacatatagagaaacacttggtgtttttagagaaagagtatacctatgaacagaatgaatcttgcaaaagtggcacatccaattgcctccaccagacgctctctcacaacacatctacgtggggggtttgtcttatcttcatattgcctggacttgttgcttgctttgattgcatcacctttagtcgttgccactctgcacttcaatttctgaaattactaaacgtctctatcggttcatcttggtctctagaaaagggtggcaaccccgataggcagtagatcttcagtccatccctaaaaatagaattggttcagttaaaacataaaccaaaagctcagctaacagtttacatgatgaatactggagagctcagctcgcgccagaattcaatccgctgaagatgcagcgcagccatcagcgtgatatagcacacccatctttttgtttcagtttcattatcattagtagcacatgaatgagtgaaaaggagaaacgtctcagagagagacgagaccttcccaactttcctccagaattaattattatcgtcactaaggctgctgttactattgattaaaatttcaagatgccaccagatcagctagagtagagagagagagagaggccatgcatgctctcatggcgaacaccaaccacaccacaaatatgctacgtgtcttgcaagcaaaaccagcatctaaagccactagcagcagcagccaccactgtatttcgcagctttcctgtcacatacacatgctaaatccatgccctccacggccaccacctctaagcatgtaacgtaccgcgcgcagctgaactcggccgagcaatttctgctctgagtttgtcaggtccgagag

SEQ ID NO: 5755 - DNA, 1389 bp, Zea mays
gacgccactggtccttttagatattagtatagtttagtatagctagaataatgtagtagtaattagtgtaatttagtagtagtggtaatgtagagtagtatattgtagttttagtagtagtagtaatgtagagtagaattagggaagtaccaactcataaagagttggtttgtaatctcgtcagcttccctttaatgaagtatatcgtttatcccctctttttgatgacttaccgctgcttttgctgaatgttgaactgattcttttgatatagtagaaacagcgctgagcgatgtgaagattgacatcagcgtttttagaagtagcactgagcaatcgaacacaagaccagcattttagaggcaatgccgaatgatagaaggttggcatcggcatttttagaagtaatgccaagcgacaaaatacggggccggcattttagaagtaacgccgagtgatagaatatcggcgtcagcattttagaagtaatgctgagcgtttgaacacgtggtcggcgtgttaaaggacacgccgagtgattgaaggtcggcgtcggcattttagaagtaatgccgagcgattgaacacgtgatcggcgttttagagacagcgccgagtgattgaaggtcggcgtcggcattttagaagtaatgccgagcgattgaacacgtgatcggcgttttagagacagcgccgagtgattgaaggtcggcgtcggcatttttagaagtaatgccgagcgattgagcacgtggtcggcgttttggaggcaacgccgagtgattgaaggtcggcgtcggcattttagaagtaatgccgagcgattgaacacgtggtcggcgttttagaggtaacaccgagtgattgaaggtcggcgtcggcattttagaagtaatgccgagcgattgagctcgtggtcggtgttttagaggcaacgccgagtgattgaaggtcggcgtcggcattttagaagtaatgccgagcgattgagcacgtggtcggcgttttagaggcagcgccgagtgattgaaggtcggcgtcggcattttagaagtaatgccgagcgattgagcacgtggtcggcgttttagaggcagcgccgagtgatagccagcttctcaagttactttgaggaaaatgaccgagtgatgaggtggcacattggctttcttggaaataactgttggatatccacgtggcatgctgggatttcggagatgaccgccgggtgatgactgggcacttttgaaaaaggtatctggctcaagaatatcccttaagagtcgcgcttttagccgcctttgctttccgtgccctagttcttgcatttccgcatctgagtcttctctgccactcgcctcctgctctgtttcgccagcgagaagcaag

SEQ ID NO: 5756 - DNA, 1030 bp, Zea mays
gagggggttttaggctagtagttgggtgctgtcctcttatggattcttttgggtttctggtttttagacctctgtaaggaagtctaaatttttgttgtacctggtcttgttagacctttttatctccttaatataatggggcgcagttctcctgcggttttcgagaaaaaaggtagtgggtgagttcagtttgttggcttttgtactgttcctttgagggttcttttcccctcgttttttctcttcttaatataatgatacacaactctcctgcgtgttttagaaaaaaaggtgtttagtaactcaaactcctcgaataacaaactagttttacattgaggtcccgtttgtttccttttatttttgaggaattggaatcttactattaatataggctatttttattagaatgcgacattccaccactttccaaagctatcatataagcctatctcaaattcattgggtgagagatggaaattgattctatagatttacatgctatttttctaatatacaactcataacacactcttctaatttgcttcgttataacatgaatatagtatacaactatctctgtcatatgatttaagataatatacaaatatattacatatataaatatataaacttaattaattttgtctaaattataattattaaaatagaattcaattccaatgaaacaaacgagccctaagagcttttaatttttgaagaaggtatccttatatttgttgttataaaaacgtacggatcaaaccttctattttaactgaatttatataaaataattgtattatttatctctctaaataaatttattgtaaaattagattaaacactatatatacgatgatatcaattatatatagtataaatattgatatttagatttattccgacggagagtatcttgcttttacacgtacgacgcagcagcacagctcgccgcctcgccgtctcttagctgaggcgtccgacgccaccgcccccaatccggtgaatctgactcaccgctgccgcc

SEQ ID NO: 5757 - DNA, 1500 bp, Zea mays
cttttattcacagccaaaatacatacgaactggattgggccggctgaatttaaaacagccgaaaaatttgagcggtaagagaaataatcgggccctagcgagaaatgcgattttcgattttctcgaaatttctcgccgagaaagttttccctggttcggatacatttttattttagtaaaatgccatgttttattttaaataaaagttagtaaaagaaaagttggtatgatactgaagtggctgtaggacgatgtaaaggctctaaactagagcactacgatagatcagagctaacgatagttgatagtatggccggtagtgacgtagtgtggttgatatctgacgtggtggtcgataagaattggttgcactggaaccagactaatgtcttatattcgagtacatatattagatgatggagggagtgtaatttgtctatcataaatataataataatatctaaatttgtcatgatgtgttaggctggtttcagtgctacgtatctatatcgaccgtcacatactattaccaactatcattagcccatactagcgctaagtgcacgacctttattaataaaatcatataatttataaaaacaattaaaagataacttaattcatgataataatatctaagtgcaatctaagttatgcttcattaaatcattttagagctgagtagtatggattacagtctcacgttgcatactgacatgcagaggctggaataagttatttccttttcaaaaaaaatagtgctgcagtcactatgtgcgtgtttgattcaacttaaaggcaaattctggccgccagctgttacggaacttcaaatgtctagttttttaatttgcttctaaaaaaatccctttagtaaaaatcgtcgtgataaaaagaatttgtcacttctcaatttgaacgctatagactcgttgtctccctccgtacgatgcttaaaattttccttcagccatactcagattttttccatagctacatcttagcaaaactcattagaaaaaagcttaaccgaacaatgctactccctccgattgaaattagcaggcgttttagctctataattttatgtctatatttatatagatgataataaatttagatatatatagaacatatatattaactattgtataactctactattaaaaaggtaaagcgaattttattttgaaactaagaaaatatcaaggtatgagcctgacatcgtacaatattggatcagaccgtgcttagatcaaactaaaaaattatgcttgggaccgagcggtcatgccaatacatctatagattgctccatccctttatatattcccctcccctgcctctccgcaaccttcacttgccagttcccactcctaactctctcttcgtttactcttcttcccacccccagcgttcgcttccatccaagctcatatcatcatagatcgacggactaggccacgcgccccaatactcagaactagtcttgagtaaagc

SEQ ID NO: 5758 - DNA, 870 bp, Zea mays
agacgaggtgggagagaagtgggcacacacagagagaggggacgtcacatgtgggtttttgcaaaatcgctaataacacacgaagggaggtgtgcatgcgatcgaagttggattgtgggtttgattttaaaacttataaggagcttttcgcaaaagtgacgatgatggaaccattgaattatggaaactggtgctttataataatagaatagagacagataatagattcttttagatgattctatacttaatgaatttagatatagaggagagacataaaaaatactattaaaacaaattttacgacaaagtataaagaaggactagtataatgatcgtacgctttgtcgtgtttagcttgagtgcttacaccccttctgtcgtgtaacaactcatgtgtgatgtgccatgtttggttattctaattctacgtggattgaagtgtattaatatgwattgagatagattaagatttgctatggctgacttartaccataccatccatatgaattaatggtgaaacaaataaactccttgttcggttattctaattctatataatttagaatatattaaaattaattgtaatgaattttaacttactatagatttaaactgactcaatataatttattcattatgaattaatatgaattaagggggaaacgaactagctctcaaagtcaataaagcggctacacgtttcgcccaagttcaaatcccatccagagattatcgaagcaacgagcgccgctccccttcacccctccgcctccctccaaaactcaaattgacctagcgagaagcagaagaggcgaagagtgataacgaacctctcccacatcgatttccccaaatcgcctggcgcg

SEQ ID NO: 5759 - DNA, 311 bp, Zea mays
ttgcatgcctgcaggtcatatgattgcaatgaatcctgacatggtactactgtcttggaaacaagtaagctgccaaagtgtgtgtttgcactgtgtcattactcgtgtgagatgagatcacaacaactacagttaacgatttttaacagaataaataatcttctctctctctctctcttttggccgcatgataaatactagcttccaccaacggtcgatcctgtgaaacactaagacacccgttgccactggaaaggagagagcaaagtgatttgctgtctcctggcgatcgttgctcgtgaggcctagtg

SEQ ID NO: 5760 - DNA, 1216 bp, Zea mays
actaacatgtgacttaaatgttacatctaaataattaataagaatagatgaaatagatagagataaaataaattgatctcaatcatggtttcacgtgtgttgttccaatacgtcgaaaacaaatagacatagtttaatgtcgataaaaatagtttcagctatttcataataaatatagtgatatatcgtaaaaatctcatgtaatattctaattaatgtcatgatttttttattcataaaactttcatatcaaggaggataacggtggacaagacacgcaacgcgacccacactttttttttgtcacaatgaaggctcaatgcaatctgcacccgcgcagcagcctgccggctccggtggctcccaattccacctgcaggcagcaggcagcagccagcagagcagcaattggtgcagtaggaggcaccgtggccacgcacttcacccgataagcctaagccggccggtacgatgcctgctgccctcctaccctacaacggccatcgccatccggatgcgccccgcgccagtacggcagcacaccaccgtccacccgcacgcagcccgccgcccgccgccacccacgcggctactagtactccgcgggagcgggcccagaggcacggcgccgccgcgtagtctgggagtgggtcacgcacgcactcacaagtcccgccgccagacgcgcagtgaacctccttttgatgcgacgcgacgtgagatcctgcggctcgtggtgggtgaagcgagccacgagggccccgcttccgtttgaccgctcccaaacgcgcccgcggaccgggtctcgcgcgcggcgcgccatacgcctggcgtggcgggggcgagcggctgggcggcaagctggcaaccggggacagggatggttttgggctgaagccgcccgcacgggccggatttccttaggccattcctttcatagattgggcccaccgtggaggcccaaggacgcgcgcgtggttgccaggtcaaggcgccacgcggtcgatggacgggaggcgccgcgtttgccgcgcgctggaggagccgagccccaccccatacatccgcgggaagccgctgcccgcgcgcgcctttgcggtggtggcattcctcgaggcccgagttggccagctctccccgtcgtcgtccgtccctctcctcgtctccgcctccccggactccggcagggagggaggtgaacgggccggggagagag

SEQ ID NO: 5761 - DNA, 1282 bp, Zea mays
gctatccgcggaaaggaagcaacttcgtggagtacacgtccttgggcctcggaaacggcaagcgagtgtacactggagactgaaagccaagccaagcactacatggctcgctttggctttgcaggcatggtagcgcgagctcctccttttcttttctctcgcctttgctctgctcccaacaggagtagcgaagggcaatggcccatgggcaagcgcgagagggaagctccggcgcggcgcttcctttcgcgccttccaatggaacggagcagcactgcagcaggcggtgctgtccattcattcgttggcccaaaaggcgctcctgctctgccactgtttcaatagccaggccgacttgatgaaaactgccacgggggcgatggcaaccaaaaaaaaaaacaccactacttttggtgccgagaaaaagaaggcacggaacgtgccgttctgtttcaggctttcagctttccatcctgaagaaagaaatggctctggcatcagcttcacctccatgggtaatttaacaattgaattgaattgatggcttgcattgttcagggagatgcgatagaattagaaccccacccacccaagggcgtgcatgcaacacgcctgctcaaaacaaccagcttgagcttgtgtggaaccaaggaaaggggtacccaaaaaaagaaaaaacaacgcctttgcaccgatgctatgctttcctcttccctcccttggcaattggcacaggcaggcaggcagcagacgtggacaacgaggcaggcatagcttgatgctaagctttgtgcaaagcttcgcgcaaacatcacagtccgcactcgtgacaggaagaatcaaatgctgacgacattcaacgcatatgaatcagggcacattgaatgttgacgagagttctcttgcaagttcattgttgaactggactaccgaacgaaaggagcaaaaatatggtacaggggggctgaggggagggggagaagagaggtgagaaattggatgggataatccaccctcctccaatcctggcatgctcgtcatcactcatcatcagagtgcaacaaatccgccatgattaaacaaaagcaataagaggaaaaagggcgtggagcaggaggcgctccctgatcaaaacagccactactggcactgatgagtactgaccttgacgagaccacgcagtccttgctggtggtccccttcccctaatctacaagaaccggcgagcggcggcggtgggccacagcccgatcagttccaggcgccccaaaccttctccccg

SEQ ID NO: 5762 - DNA, 1500 bp, Zea mays
tttcgatagttgaatccggtaaaatttcaattaaaatcggtgaccgacgaaaacggtcggtaatacgccgtatcgattcatataccgattccaaattaaaattatgaaaaccaatatcgatatcgtttccaaaaaataccgataccgatgaattagaccgaaaaaaatcggacagtttctgaaattccaaaaaaattccgaaaccatttccatcctacgcgtagtcatcctatctgtgtaagtctgcaggctcatagggctccaaggcctggccggtatactataggcttggcctcccatgtaaggccatgaaatactatatggcgctgagccaggccctctatagtctgtcttgtgccaatagtcctagagggtgttttactaacaatcgacgcatgtctttctctgactgctgataatagacgatatcataactgcatgcatgagtagactcttcgtgtggatggcttatatctagagatataattttagtggagtttagaactataagatatatctagatatgtagatgtagctagactagttcaatacatgtttaataggatattttttatactattaccgaaattaacttctattatggatgtcttggtcatcataatataaatcatagatttcgaattttatgataaaacagaaatagacatataatatccttgttctaatttttaatgagcatttcacagttcttttctcccgttgtagtagtatatgagcacgttggctagctagtaagagtttattttgtagaaactattgaaagtctatcttaattattaagcatgacagagccatagtatagtttcatatatagtcatatatagttgggaccgctcttatatatatatatagctacatcctacatggtataggttccgattctatacggagtgttagacatattaaagaaacaaggttttgataggactatattaatactaaaaccatatcttgtgtgttgctcgaggtaatgtggtatgctggtttggataaataaatgtatgttagtagttgacgaagatagcttatatatatatgaatagatatcatatatagttacatgcgctagtaaggtattgatataggtgtagacatagacatagacatagacatagacatatatagacatagatatagatatagatataggtaaacatatagatataaacatagatagagatatattcatgcatagatataaacatagatagagatatattcatgcagggtcagtttatctggacctcccatggaaattaggggatataatatgaattctaacccaaacctgatacggaactcaacgattgtgtggcgtcgttttgctatagaaattaagggccggaggccggagcagatatatacgctgcacctactacacaaacacagtcagctaggcgcagctagcaatttctctcttggtttggttgcattgcatgccccccggccggccccttcacacacgcatagcacagtcgc

SEQ ID NO: 5763 - DNA, 572 bp, Zea mays
tcctgcagagaggaaaagaaaacgaaagcagagcggcagcgtcggcccagcacccaaccaccaccaccatctcctcctcccccactccctgtccgcctctaccgctcgcgaaatacttccccctccctgtcagtctctacccagtcgccgagtcgcgtatggtttggtctcactgatgtgtactccgtagcatcaattcctcggaggccggctcatggctcacgctggcagcatctcgtgatctgtgtcccccttctccgctcaacatttcccagctcctggaaagctcagctgcgtagatacgagcacaggcacctaatccgtagctacctctcttgcttccatcatatcatatgggcacaattatttggattttggagcagaaactcacgataatgccgttctccagtgagctgctagagcctggcagtctcaggagggattgtctcaatatttgagatagaggtagctgagatttataagcactggggctctgtttctttatcctttccttccctttcagcccaccggccggggttggttgttgtcaccgtgtgcttccgtcgtctccc

SEQ ID NO: 5764 - DNA, 580 bp, Zea mays
cctgtacgacttacgatacgaaagagtataaaattgtgttcgagagatatagaagcaatatgatatttataacaataaataaaaaatatatatatacatatattagcaaccgcggctttcatctaacctccacgtgaagcggacgttaccccaagtctggttggctggttcccgccagccgcgggctccaccagtcggccggtcgcgttcgggtaagcgagagcgggtaagccatggcgggcggtggctaatgcattaaggtattttatttatgtgacgtcacatgaagacaaacagatgacgtaggctgtagaccccacccttcgcacattgatgcctgccgccccattctccatcccggccattactcggccacgacttgccgactacgatgccagcgccaagcctccgccgcccagctaaaaatcccccaggcgttcctgagcacccgtttatcatcacatgaccggagtcggccagaatttgccgtagctctcgcccccgctcgccgtgcgcttctcgtcccattcccccgggatcgtagattctcgagctgagctgagctgagctgagctgagcg

SEQ ID NO: 5765 - DNA, 1500 bp, Zea mays
gccccctaggccttatatactcggccgtggagcattacatgtgttacgataacaacaagtagctgaaagatagtgaacctcttgagtttatccttacgtaacctccgccgacttatcctcgcatggctccgttgcatgggggcttcagcgcgggaaagtcgggtctctgtttgtgattcattcgttcgacgttgtgggccgcctgtgtttgcactaatcagtcccacgtcttctttattggttgtctttccctaggcccacgaaagaatgaccttacgaattattgggcccttgggcttttcgtgaggccttttacttctttagtggacccaggggatatctatcccccacaagcccccgatctttgagttaatttagaggtaatcaactcaaagatccaaggtccagaaaatgacttcctgctgcctcctctggctctgatcactcgttcgaccaaagtttggttttgtgcttgtgccttagaggtcggcattttggattgtaagactcaggacttcattgggtgcaccggaggtgcacccaatgggtgtagcccccgacctttgagtagattttagaagataatctgctcgaaggtcttcttccaaaggttatctccattcgcgctcctgtgtctcggttgaggattggtcttttcaattttgctctacgccttagaagtcggcgctatgttgatttagaatgataatccatggggtgcaccggaggtgcacccaatgggtgtagcccccgaccttcaaatggattttctaaggataatccattcgaaggtctttctttcgcttgtggaaactggcatgaggctattttgcattatgctttagaggtcagcattatgtcatcaatattttgctgcaaaggtcagcgtatattttgtctttagcagccgagttcgcgatccatccatatcttgctaggtagtgcaatttatttgcttctgcgattgattggacgtttgacggacgttctctgtctagtcttcacgtcgcttctgtcggccatatcttgtactttgctgactatatttggctttcctctgatccttactgatatctcatttttgtcttgaggtattcactgcgtgctctgcacagatgtgaccgtttgaaaaatatactgataattcctgggcgtccccccccaatgggtgtgggcaagggacggcttggtacgctgagtgttttagccggttgcctctgagtagtaatgcgatgggacggctagtgtaatcatatcctttgcgctgttgactggagtcccaatgggtgtagtgttgcatgaaacggcgtccgccgtctgacgtgtcttcgggtgggtggaagtgcttattgaatgccttgcgactgttcagtgaccgcggttagaagtgagcggttgcctttcccttctataaataacccctttgcttctctggtttcttcacatctcttcgctgctccttactgcctcttccctttcttctctcctagagcttcaacc

SEQ ID NO: 5766 - DNA, 1082 bp, Zea mays
ccatataaaaaatactgatatatattatatttgcattctaatatatacatttatagacttaaatgttaaatctacagtgttatatttcgaactatatactaaattattatatattaaattaaattatttataaaaaattctaatggcatacctcacggaaaattctagctacgccactgtgtgtgaattcaagctcctctccgcaaacaatatcatctactacacatatgttccctattctacacgatctgctgctgtgggcatcctataagaattcctaaaggcattcgatacgcggcacaagatctatatacattatataagctaccatctatttattgcaatgatgtgaggaatattcatcaatagatttttggtttacaaatcaattaatcgcccaataaataytttgtatgtatcatgcatgcactacatgcgtaatgttttttatatgggtcaagctagctagtggcctacctcacaagcctttgttgccacaattactcggttagtacttacttccctacccacacccccagctgtaaattaattacgctgtcacaatcacaccacctttgcagtatgcttttattttattcaaaaaaaaaactgtaaaagccaaagtaaatcacaacatactatctgatgacacattgacacatcttaatcccgatccgatgtccaagtagcatgacgcctagcttattagttaaactagacctaagctagccaattaattagacgacctagagctcactaatagcgtattaattcatttgtcctaataaccaaaaccgtgtgaagactttccttcctaggcaagacattattcatacatacataggagctgctagctaggctggccaccggcctcttcctctggaaggatcagctaccgctggtcgtctaactctaacccgcgcagcagcactataaaacttggcttcctccttctcctttctcccctttctattgattccctccatctttcttgttcccacaagctagctagcagcagcagcagcagtaccgtagttcttggcatcatcatcatcaattattgaagatattatcgatcggcc

SEQ ID NO: 5767 - DNA, 164 bp, Zea mays
cggycgaccccctcctcctcacgaacaaaccacaatttcgccgcgccgccgctgcagcgacttccatcgaattgatctgcaccacagcagatagcacgggcctcgccctcgccgctcgccccaagcctcttcccggtaactgaagacttgtctccgcggtaacc

SEQ ID NO: 5768 - DNA, 311 bp, Zea mays
tttgtgttttcttccttgatcgtactgcaaagagggggggggggggggctatagaggagctcttgatacccagctgccaaggatgtagtagcatgctcccattagacttggtccggcaagtttctaactggtggttttgcaggatgttcgtggaaacctgccagcgccttcgtctgatgaaaggttcagaggccgtgaacttgggtacgtacatgtttttcccctaaagcctacctccatgtgtttaaaaacgtctgctttttttcacagccatcgctcttgttcattttcacagcaccaagagccgcccg

SEQ ID NO: 5769 - DNA, 617 bp, Zea mays
cccagcccatagcagaaagagtccagcgaagtgaatgcaagaggccaccggggatagcagagaacgaattagcccaggtccaaacccgccagccagagtcccacagcataagaaatctgggcccggtggcacctgtcaaccggcctcacccaaacagagcaacacgctacaccgacaagcaggagcaggcaaaggatcgacgcggcacggcggggttgcatgccccccgcgtccaactccaaaccccgccacctgaccggccacgagatctcatgatcaagcgtgatcaccgttcattttataggcaagccttccagtggcttctccctgcccaaccgaagcacgccacgggcgcacggaagttcctgcacccgccacgcgtccgcccgccctctcgtccataaccacgtgtgcgtcgaggtggccctggtctccctggcccgctcctattatatcctcctcgtcgagcctcctcaccccccgcaccaactctcgccattgccagtcaagctcgctataagcagccagagattcaggacaagagaccacgatcctaacacacagcgtctctgtcatcttcgatcgcggcggcaccaaaggtcgcgacgtggacggcg

SEQ ID NO: 5770 - DNA, 690 bp, Zea mays
aggctgttttcgatggatggtgcaaaataggggacgcgatattatttgacactatttgcagagtgaagtttgaaataaaaaatacgatagtgatgtaatatatgatctgctggagatggccttacacctgaattcatagtaattttttatttactcacacccatatagagaggtacaaacatgatatattaggagagatttgatttttgccattataaagaattggctttgcaaaattgttatcataccacatttatgaactcacaagtcaaagactcggtggtaattataggcaattataaaccagaagattcttttaggactatttggcaactctagttttctaagtgattctcattttttttcaatttaaaataaactaattttctttaaaaaataaaaatcctttaaaaaattagttgccaaatagcccttaatggactaaaaaattccaaatttctcgatacatcagggtccgtgattgaaatcgacaaaaaaattaaagagaaaaaccattctcggcttcctcatccgtcccatcgaaccgcaaaccctaacctttcgattgccgccgcccgccgctcgctgctgcccgccgctcgccgcggccaatggtacagctccatcctttatctctcacgttcgtgttaaactgcagctgtcctgatcaatctcgaccggtttttgcag

SEQ ID NO: 5771 - DNA, 564 bp, Zea mays
agtcttaaaaaatacggttttataccgcgactgaacagaaaaatctaccatttgagattaattgagagaatgtttaatttggtacttaacttgatatattttacttaatttttttttctaagtttagttttttaatttaaacgactaattttagagcaagcgtaaaacagttagccgataaccaacaaaccatcaaattacaaacttcagcctgaagacctactttcctcccccaccgcgcaggcatgtcaaggagtaggacatatccgaacgcgcagtccagctcactgcggagggcgggccaagtggcgccggcggggcacacctcacgcgccacgacaccggcgaccatcactctcgtcgccaccgcgccacgtgccgcccatgcacggccacagcgccagcgtcacccacgtcgcacgcacgcagcgtccccgagggcgcaagcctagctgcttatcaagcggcccaaagcgcgatccaccactccgcagatcgcagcccgtgcggggacggggggagaactcagagcagagattctagctgccttagttagcttgggtc

SEQ ID NO: 5772 - DNA, 566 bp, Zea mays
cgtagacggtcacgctcgggttctccaagtctggctctccgcgagcgggatcattgatgcaaaaggctccaacaatttctcagaccaaatactcgataatctggacttctttttactttactacaggtttttattagaaaataacttcggtgtcactgacactgacacatgagcacgcgtttttcggttcgtgcaactagatccagagacacgcacacgggcacggagggaatcaacgaaccagaagcagcaacgggacggaacgggagggagtagtagcagtctagcagaggagaggagagcagcggagacgagacgcgaagcggaaggaaccaaacaggcaaacggaacggaacatctcctcggctccttcctcctctggccagctgctgtcgcccctcgcccgccacggcacctcctccacttccagatcttcccgccgtcccaaaaatagtgcccaccaaaaccctaccctccccgcccgtttcatcccctccctcgcggcctccgaccccgcccttccgccgcctgactaataaaccctagcacccacctccgccgctgcc

SEQ ID NO: 5773 - DNA, 304 bp, Zea mays
gtggtctaccatgtgcaaattttcactgtggtgatgaataaccgaaagcatgtaaataggaaccttgttctcgtcttttggacaacgaacatgtttgagtgactggtcttgtgttgagcgcgtaaaggtcatgtatacttaggttagtactattttcgttcttaaatatttgtcgtctgctagtgatagttcatttttgaactaaaacgttacgaataaaaaaagagtatattactgtctgcatggacatggctgtttcagtaggccgtggcaccgcagatggcgatgctcactgcaacctatt

SEQ ID NO: 5774 - DNA, 123 bp, Zea mays
tttacatgaccaattgactaccagatgttttcgaggaagctgaggccaggctgatggaaaatatgataacacatcaattgccagtcgtcgtccccaccgctggccgcgcggaagcccgcgaat

SEQ ID NO: 5775 - DNA, 1443 bp, Zea mays
ggttccatcaacacagttgtgcccccgaataggacgcgagaggtctggctcggacccctggaacccaacatgaccatgcactgctgcgcatgtatatagatgtttgtgtttttgcggtgctataaaggaactcggtcggggagggaaagaccatcctcccggtattatattaagaagagaccgaaacatggtcccgaccgagaataccctcaaaccttggccccccatcactaacggagtaacgggccgatcgactgcccactctgcaatggcccagccggagggtggcacgcaggatatcgatccccgagagtgggcggggcacggcaaggggagttttttttaaccaagcctgaaattcgcccccgaggggatcgaacccgggacctagaggtgctactcaaaaaaaaaactcgacctgcggggggtaagacagccctcgggcattgtattaagaagaagaccttctcacacaggtcgagaaaacccccgaacccctgccccacccatacacagcggcatcgaagcccatgtgagaacgaccacgaccggggctgagccttagatctgtgctttggcgtgggacagacgaggggattttttttaaccacagcctgaaattcgctcccacggggagtcgaacccaggacctgaggagtgctactcaaaccacctaaccaactcagctagaggccctttcgccctagaggtgctactcggaagccttaaccattatgctagaggctatttcgcttgcggtgctatacaaatgcccttttttccatttgctatcgctaactaggttgtgttatgccactggtggtgtcttgaaaactaaataattatagtgcaacaacaacaaagccttttagtcccaagcaagttggataggctagagttgacacctaatagaagccacatatcatggttcaggcacacaatagagctatagtaacatttaattcattttctactgagcccgaaattctaggtttctgcatattacttatgcttagactcgtgttcatattttttcttggagtagtggttgactgataagggccatatggatatttgaatccaggagctcgctattcatacatcattactatgagcctcgttgagagagcttgaactctaggattcatacaaagtttgtaatttacagggtaaaacgaagtgttccaggcatgtttttggtctaaaaatggggacaagatagctcactctttaaggccttagtctagctcctgcgcaagctctacattcttggaacggttccaaagataccctatacgctatatatttgcagttatattgcatactgttcggtaggacaactcatacctctatgattttgctctcattaaaccatgcctgttgtactatgttttgtgaaacttagatcatagttctttacacttccagggattcgatgagtac

SEQ ID NO: 5776 - DNA, 1500 bp, Zea mays
cattctcatgggcggcgtgtagattgcgatcggacggagagaggagcaacaattgatagacggaaggaatcagctggcaggaacaaaccctgctagctagcgcgcatctcaatcctcatgcatgttagtatagcaagtgtgtccaaaagaactcgtcttttctttggggaaaaagttattggtatagcagcagatcgatttgctagcttctggatcgatttccttcagggcctgttcggttccagtggattgagcacccggaatgatttttagctggattgttagtctaatttatataagggttgatgagctggaatgattcttggccaaatccggcataaacgaacgcacccttattctgcttccaccacgcgaggtgcacgcagagcgagagtttctttgagaagagaaaagcaggcggatcttaatttgcatacgtatctggcatacatgcaacaccaattagaaatatattttgaatttttcgagtaataaaatgcctttatttagtttatcctcattctttgaatgcttctatatgagtagacgtactgcatatcgtgaccaagttgacaccggatgcatcatatttatgtttgtggggagatgttgctgaaatttctcacaaaagttgtcgttattcataattttagagtgactgttacagttcggttagaaccgaggaaccgaaccgaagaaccgagaaccgaactagtcggttctgatttctttatcttgctatttcggttctagtttttgaagaaccgaatttctacaagaaccaaggaaccgaaccgaaccgaagaaccgaatgcccaggcctgcaaacaacaacaagtgcacaatgactataatttcatagataatacatggatgattagaggttcaacataagtcaataacacaacatccgaagttataaacacatgtaacaaattgaatctaatacttttgggtttttcggttctttcggttctttcggttctttggagtgcagaaccgaaaatatctcatttatttcggttctcaaaaaaccagaaccgaaattcataacggttccttcggttcggttagttcggtttcggttctcggttgtttcggttcggttcctcggttccggttctttttgcccaggcctagctgggacacaggcgagtgagcgcatggctagtaactagtcatctttctttcatacgtacgggctttattggtcctttcaacgtctcaaaaaattctaaagcataatattctttctcatcttggtttggttcgttttcatctttatttcatacgtacgagcttgatacggaccaattaaccacctccttagggtgtgagactgatctaagcatcaacaattaaccaccatgcatgcagctaattgattattccagtctataaattgcgatgtcccagccactgaaatctgcacatctcgagcacattagcggcagcttaaaagaaataatttggaggggagactgagagagcagctagcta

SEQ ID NO: 5777 - DNA, 1500 bp, Zea mays
aaatagcaaagaaatccatgaagtgggcagtcagtcagcgcctggtggtgcaccggatagtgaacaataccctttccggtgtgcaccaaacagtctgcacagaggggcccgcagcgaggcgccctcgggctgtagcaccggacagtctgggtaatggttggatcaatggtcgactactacagaccacaacgatcggctgacgtggccagggcaccgacagtgaacagtgcatgtccggtgggcactagactgtccggtgcgcacatcaacagaaagttgttgcttctgtccaacggctataattgtgggggaggctataaatacccccaaccggccatttcaaggtgtgggagcccaagcaacatatcaagacatattgtagacatttccaagtgctcatacactcaagtgcttaatagaatcactcgatgattagcgtaggtgctttgcgaagtgcttaggttagttagaccgcttatgcgcttgctctaggtgaatcctagttagttgagtgagtttagtaaaaccacacaacccctcggctcttgcgcgagccgttgtaattgtaccgagtggggcgagagtcttgcgagactgtgacaaccgcgtttgtgtcacggctgccaccgtgtactggagggaacgagggccgcggcgtttcggtcggaagcacgatagtggagacgacggggagcgtccgagaggagccgaaagtggagcaccacttgtgtggagaaggcccgcgactctctattgagttattcgaccgtggtgcttggccctcgtgtaggctaccctttgtgtaggggcaccaacgaggattagtcgggaccttgcgtggttccaaataccttggtaaaaataccagcgttatccatgagtgtttgcatctctaccttgctctttaccttccgcatttatattaagtatttaagtttcaatcttgtctttctagttagattatttaggattgaaacttagccaatgcggtagagatagcaacacttagacaaaacctagcttgcacattctagattgtttatttgcataggttttgctctaggatttttttgtggtctagttaagagatagcttttagaagtcctaattcaccccctcttaggcgtcactgtttcattcaattggtatcaaagcctggtttggctcatttgaatcgctttagcttcaccgctaaaagagccgacgctttttacagaaaggtgatggatacccataggccaccacacttcgacggcactaacttgccatattatagtgctagaatggcttgttacctagaggtcgttgatctaggtgtttggagagtcactcatgacgggatgaaaccacccaagaatcccgagaaacccaccacgagtgaggaaaaagaaattcatttaaatgctagagccaaaaattgcttgtatgaatctcttagcatggatatttttaaccaagtcttcacattaaaaactgctaatgagatatgtctaaaattgc

SEQ ID NO: 5778 - DNA, 528 bp, Zea mays
taaacatattgtgcgcatgtgcattattttgttcgtttcaaattaatggttgagaaagtcaaatatttatagaggacgtaagaagacgggacatcacattacttgaagctcgcccttgtactcgtggtaaaagtgcgctctgtttctcatcgtcaagaagaaaagacagaaagaaagcaagaaaacaaggccaaaaggagcctacgatgaatccatcgtcaacgaagcgtcaatggcagccagttttaccagatggcgaggatgacgtgcatggcgccctcagagacgcgctcacacgtacgacgcgcctcgccctcgcttgccgccacgtgggccgccgccccagcgagcaggctccccccacctcccctcgccytctataaatgcgagcctggcactgcgccgccgagcttacctggaacagagacaggcaggcagcaggccttcatcgcagagaggacagcagcacctgagattgacggcggggcagcgcgcgggcccttcccttcggagcactcagcgtgagag

SEQ ID NO: 5779 - DNA, 537 bp, Zea mays
  unsure (1)..(537): unsure at all n locations
ttcccctctgcacaggtggacagataggtacagatgatatacaatgagtactcnntagtatatatgccaaaggggcataggttgatccttgtgacgtcaccacagttggaacagaaaagagaaaagacatccttttttgttctctcaaagtcagagagagagagagagagagagagtaaaatcttcaatcccaatccgtgagaaagaccgtggcctggaattatttccatgctcagagctccgatcaacaaaagatagtgggtgggggagggggaaggcgccgttctgatccagcttcagttgattggcagctcgaggaggaggattggctgatctgagatggtcgaatgaatcatgtgagatccgaattattatctagagaaatgtacgtaaaatgtaacaaatgggaggctcgatttgatgaggactgaggagtccattgactgctgctactaattctatgtactactcaatgcatacatacatgctgttctttggaggcaccgtcgatggtgcattgcttagttgcttcgatgc

SEQ ID NO: 5780 - DNA, 187 bp, Zea mays
ggctacctcaaagggccatttgacttgatccccaaaacgaaacagttgcagcccctctactcatgaattctgtccagccaccacccaccccctgtgcagtggagcctaccactaccagcctcagcctacttcgtagtagtccccgaagccgcgagtcgcgcatacctttaccgcacgccgagaaagg

SEQ ID NO: 5781 - DNA, 602 bp, Zea mays
gaagaataaatgaaacaattttaaagagtgaaaatgatgagtaatttctactaaatttttgagtagtgaatcttttgtcaaaaataacctcaaataagcactcttaagtatattataagattatgataatctactttgagattatataatttggcacaataatctgtccgtttgtttttcctaaaattaaatatggatagattataatcgaaacaaacatatcataatcaaaagttcaaaactttgtttatgttcaaacagccgattgaccagttgagagcaacgtccgccggctcaacgagtcatcagcagcacctcagcggtaccagggcaccacaagcagcgatgctaaccagttggttccatcgttctaaactataaaatattttagatctataaatattaaaatgtcgaaatataatttaggaagaaagatgtacttacgtgtatacgccatcgttctaaactataaagtatgaaagtaataataatacgtattataaaatggaataaataattgcacacgccgtcgttggtctgttttgctttcgtagcacatttcgaacggacaacagagagaggacagagggagaggcaaagca

SEQ ID NO: 5782 - DNA, 690 bp, Zea mays
cacaagattactctacaggattactgaatgttttctacgcgcgcgggacgcgcgcttaagttactagtatttctattaaaaaggagcgagcagaagagcgtgtcatatgttgcaaaataaaacaaagatcagtgatgcataaaaacaatttccatatatgtcctatgaaaacaatttccatatatgtcctatgaatataggataggcttatatctaagctttagaaaatggtaaaatattaaattccaaatcaaactaagtaaaatttaatttcttcagatgaaggagacgactcctttagtgcattcaaacatagagctagatcagctgaaactcaagtctggaaatcaaatctactgaaactctacctgaagagagcatcccaacatggcaacatagagctagatcagctggcagcccaccacgctgctggtacgacacagaccacgttcaattcaaaacccaaatcaactccgacgctcccagacaccagaccaccgtcgctcgctcgcctgcacaacctctccatccaggccacagctcgagaccaacgaccgacgcctagacgcggctgggcggtcggcctcacctcgttcccccgcctcccttcttcctgctccgcgtctcgatctcgactcccccgccgcgtcgcgcgacccggccagatctcgcccaccctgcgccgcggcc

SEQ ID NO: 5783 - DNA, 151 bp, Zea mays
ggtatccattgaactcagcactatatcgtttaacctatgtagtactcttaagaggactatcctatacttgatgtttttctacttctaagtatactttcttgcttttatttttgtgttggccgaatgcacgtcttctatttgtttcctattt

SEQ ID NO: 5784 - DNA, 1177 bp, Zea mays
gaaaactgggtcgttttgtggtgtcttattaaaaacattttatcaaaaggaaaaaaagagtgaaattagcccaaaaatgtttaatcttaagttcaatgtttccggagtacagttcaatactataaagaataaactcacaacatcatttttattttaaactaacaccttctatttcaaaataaatttaattatataatctgaatagattataatttcaaacatacatgcccatagttagggtcctgttaggcgggttcatatgcatgcctttatgtccaaacacggtccacatgttctgctgtgccgctagaaataatttatatcatgccagttttgaatcgtgcctctgccgcgggccagttcgttaggcccagatgtacctgtatattgatagagcccatctctgccttgcttcctcggttgttcctcccccttcttttattaggttttttttgtctcattggatttgcgcctgtgctgctcacctgagcgcatactagtctctgcatcagctgcatcagagagtagagacctccgagctgctcttcaacacgcagattgggcagagccgcaaggtgcctgccgggagagagtgaaaagtgagagagcgcgcgctcaagggggccaaaaggaatttttttttatccagcttcttagcttgattctatctgatccgggagagcagccgccagtccaactaatccttgctgttggtgtgccggggctttgattgctctccagatctgaggcacctgctgggtggattccaggaatcctagcacgaagttgacagtggagttctcaggtaaaaggtgagctcctttttcttctccctccccatccgtccaccattgttaagcttcagctgtcacctcttgtcccttgacatgtttctgccgcctacactggacgacgcttgatgcatacgagatgatgagttggccgcaagttttcttggatcccagcatacgatacgatccaccagctcacccgcacacacaaattattgactttttttttagctcgctttgatttggttgcatccgttgtttccgttaagcagggaggaaggaagaggctgaaagggcggcggagagagaaaggctataagagcgagctgggtccctcgaggatgccatcaagaaaccgcgtggaggggagggcgatgagatgaggg

SEQ ID NO: 5785 - DNA, 986 bp, Zea mays
gagatttagagttttaggagaaaattcgaattacaaatagtccgaaagattataatagacttttttcccgttcgtataaaagcctggaccagaaccagttcaagccctgggccggcttggtgatgttctgtgcatgctctgaaaggcgttcggcccggctgaaaaggccccgtcgagccccagcaggaatttctcggcccctttcacacaccaaaaaaaaaaaccaggtgaggaatctaccaattgattttcttcacccgtccacctcgtcttgcgctcctctgtctcggcgacgactgtgctaccgccgccgccgccgcaagacttcgtcgggcactttgccggcgacgatttcccaccaggtatactacccaccctattttcccttacttctgtgcgaaaaaccgaggacccaatgaccctaacttaagctatctagctatttctactcggatccgatctatttacaagcccaacaggatcagaggaggtgatggcgaggagtgacagctgcctggcgcgcgtgggtgccggaattgctatcggtggcgcggtcggcggagccgtcggtaaccttcgtccctaaacccctaaacactaggcttgcagcatcaatccgtccgtgcgagccgcttcacccgtcggtgtttttttttttggttggaagtagattagtgtgcgatttcaggaatcttctcgagctagctagtagctacatccctggtatgtctggttagctggcggctatagatgtaataactaggtggcttttgttaagagttactagtgcttaggtagcatcttctgccttctggttctggaggtggaagatatcgatgctcgagttggagtttgtttgcccccaattgcttgtgctcttagagctgttgccgatttggtgtactgtgatttggttagtttccagctagtggtgaggacttgggatgaaacatgcatgattttctatttgcttttgatttgactga

SEQ ID NO: 5786 - DNA, 1500 bp, Zea mays
aaagttgtctataatgtcgtagtgttgagcatatagactagcgagctctgtccactcgatagccatgatggtctcgtcttgctcattaatagaatccgtgtttgtcagtctggctgcttggtgtgcatgtcgcaaatcccgctcctttgttgtccatctatcacagaagtcatctcgcagatgggaaactaaataagggactcaaccaactccttgatagactaggtactctatgtgccaatctccctcatttaagtaggtaatagatcgagtggtcatagagcgactacacgagatcagataccctttactatggtgtcctctgtatcaagatgacaacatcaaaggtattgaactcatattgtgagaccaaagcacatactactataggattttcaaatcctccttatatccacgtttcgctagtagggtcctcctcataacgtcatttaggatatggcacataggtgtgaattcataatgtgcaatgagacccatctggaacggtagtatgaaaaaagatgcaacatgtgttgcacttaaaaactctattgtgagggcgtctcggtgggtctgttgtgctatatagcataaattgtgttggcgggtagtaaactttgtaagtctaagcctctcctttagtagcactcgcatagagtgtcacacaacttctgaagttaagttgaaagtgtttgcggtttagatacattctaagagaagcatataattcatgaacctaagactcgatgtataatcttggccattttaagagatctatcaaacatgtagatgattctgataaggaaaaatctccttctatagcaataacatcatatttgtatgagccacacgaaaagctatatgaatagtactaattagtggcgctactacaatgctacaagttttgaaatataacattatgatttgtggaatgtaaccgaatattgtggaaggatttcaacacatattgttttttacattgagttttggcttcatttttatggacttacatactacagagacgtttggtatggctctgtttcttcctagagcagcttcgctacaaaactccaaggagaaacaaacgagttactctgaagatctctaaagatctatatgtggcttcaaaactcttgcaactttagaattgaagtatttaggtggctattgacagctcatctttcaagttttgctctgggaagatccacgccgacaaaaaaggaaaaaaaaaatctacgtatccaccacgtgtcacgtgctcccgttatattacgagaccgcgcaggccggacagctaccgtgcaacgtcggcagtcggcatcatcatgcttgactcgccgctcgcgttgcgcgccaaccaccctataaaacgttcggcgccgctagcgcccacggttcagtcgcccacctcgcttgcccggctccccctcctctcccggctcccgccacagaaaaagacacgaggagcgcgcgtgctcgcctcggcaggcacgcatttca

SEQ ID NO: 5787 - DNA, 935 bp, Zea mays
ccattacgttgtcactagatgctttcacccatttcgatttcagacgatgtcttcggacgttgcgggccatgtgtccaaacgtggttaagtgtggtcgggaaatacccgatcgaggttgagttcggccttcgctccgacacccagccgtgtcattactgtcatatatattgtagcaatgtcaaaaaaaatcaaaacattgagtatgacgtatagggcacatatgtcattaaacttattcagtgtaatgatatattatcatcacgggacttttttttaatgtatgtattagattacctctgccatgcactatacaaacagctacgccgcagtcgcaagcaaacaggctctaaaaggcttcagtcggagaaggatatgagagcggtgagtaccaaacgggtatcttccccttccaaatgatataagcctacttgtttgaccccagcccgcaggcagtcatctgctataataggctaatacaacttgtgtactctagtctgctctcgccgcgttgtccgcatgctgaacccgcgatgttaacacctccctgaacgagtcctctgttcctcaactgaaattcagcaataaaaggaaaaatccgcggtccctgtccctgtccagcaccgcactctcgcacttgtgctgcaggcttctgagctcggcacctgctgctagctgctgctatatatagacgcgttttggggtcaccaaaaccaccagctgatcaacagctagcttcattcctctgcctctctctccctccttcgccaactggccatctctgttgtctctcgctagctagctcgctcgctcgctcgccagtcaccacacacacacacacacactgtgtgtctgtgcctgacgccgccccccagtttcaaacgaacgacccagccagaaacgcgcgcgcgccaaagctacgtgagtgacgtggcagc

SEQ ID NO: 5788 - DNA, 1222 bp, Zea mays
tctcgcgcacgtccctggaacacaccaccctctatttccccagccgccgcccccttccggccgtaacgcgatccggggagcaccgccaccttcgtctctctcgccgcgaccgcggactgccacctgtagcgcgagttgggctccaatcgggacaccagcgaatcgtacgggtcacgaagtagccgtctgtgggcgcaatcggatcacsgtgatcgggacagcgagaattgtgatcttgatgtgtgtaagactgtaagtgtaattgctggcagattatgtgtgtaattgtgatcttgataccagattatgtgtgtaagactgtaagtgtaattgctggcagattatgtgtgtaattgtgatcttgataccagattatgtgtgtaagtgtaattgttgtcatattatgtatattatgtgtgtaattatgatcttgatatcagattatgtgtgtatgtgtaattgctgtcacattatgtgtttaattgatttttactattatctgggctaatgggcggcacgatacatttaagcccaccgggttggaagcccgacacggcccgtttagagggtccccgtgccgtgcttgggctctaagtccggcccgtgggcgggcccggcccgacccgttgttgtttgcgtgctgggccggcccgggcactattcgtgccgggcctgaccgtgcccgggccgggttagcctggcacgcccatttggacatatatagtagtaacgcacagttaccgaactagtaaatataaataatataaatttaaaatagattatagtctaactcacaaattagaattcctcctatatctgacgttggctcgccaaattgtgttttgcaaccattcctgcttgatgcaaaattgttgacgctatgcctcatagtaatacagacaaatcatttgcatcagctctcacaagaatatatagaaaaatgatgaggattagcatcgtgggcaataattgattggtgtccacaggccacacatgttggtggacctaacaaatcaccttctcgtcaaccgggtcggctcgggccgggcccacgccagctccccctcccaatctcgattctcctcatcacatatcactgccgatgaaccttccagctatcctgaagctagagcgccggagccatcggtggcatataggatttgctgcagagagctcaagaaagatgtacgtggtgaaggatattggcggcgccatcgggctg

SEQ ID NO: 5789 - DNA, 609 bp, Zea mays
aacatcacaggcggtcggaatagaaaaccgcttgtgatgttatacatcacaagctggttgttctaaaaatccacctgtgatgtgtatgtagtataaaaggctcggttccagcgcaggaaccctaacttccggagcccgacgccgctaggctgcacactactgtagcggcggcggatttttttgatctacggggagaaggttttgtttttgattttcgggcttgatttcaagagtttatgcatatatatgatctccgtttgttttctttctcattttgatacgattttttgcctcaattttgtaatatagaccggaattgaagaaaaactcaggaattccaagatttggacttgtagttgatctaatttaaagattttttttgaagagttgtctcacctcaaggtacctatattgctgcaatcttgtttcattttcatgcacattaattcgttcatgatttagggattaaattcaattaattagggatattttaaaattttttgtctcatgtgctaggtacatctcgatatgatcttgtttcactttcatgaacatttattttttcatgttacatctcgatattgacgttaatcaatatagggataggta

SEQ ID NO: 5790 - DNA, 1500 bp, Zea mays
atgggggttgtgtggccattgatcatagaccagaggctcatacacctcactacacatatgtttccttgccatacatcacattcttggatttatggtggagaccatttcttggtcaaaaatccgtaggtgctagccttcagtgtcattgaaaatggtcgttcatggctattttcgtcaaaaaatagggttgtgtggccattgatcgtcgaccagaggctcatacacctcaccccacatatgtttccttgccgtagatcacattcttggatttttggtggagaccatttcttggtcaaaaatccgtaggtgttagccttcggtattattgaaaatggtcgttcatggctattttcgacaaaaatgggggttgtgtggccattgatcatcgaccagatgctcatacacctcaccccacatatgtttccttgccatagatcacattcttggatttctggtggagaccatttcttggtctaaaatccgtaggtgttagcctctagtattattgaaaatggtcgctcatggcttgttggggacttgttctcaaatgctaagagttaagaacaaggcaacataaaaagtgttaagtgttaaagtccttcgtccttcaaagcattatgtcccttcgggaaataatgagcttcggacgaaggtcataagagacataccttcgtgagcataacaagtaatgacgaaggattcatataaagcatgaaatataatataagcatcatcatagaatcatttctattttattgacatggaaaaatagaaatgattttagattacaaatgtaccttcggtcctgagagaagataaaaagcaccagcgtgacgcaaaagtaaatgccaagtcagcgtgaacagtacgggagtactgttcatctatttatagacgcgggacgcagcccacgtaaaattacatccatgtccactacatttgttaacggcttatggaaatctgtcgaggcccccgaagtcttttcatctttaagtcggttcccccttctgccatcgcgccgaagcttccctgcgcacagcttcggctgcactcgaccttcgtctggttcaggcttcgtcctggccgtgctccatattcataattctggattcgaaaatacctgttcacataatccactcggaaaacattgtcaaatcatgtttttgaggaccttcggaggacgaaggcccccaacagtagcccctcgcaatattaatttgtaaataataaattcagattgcgatatggacgaaggccttgagccgaaggtccgaaaaaacaccttccctttgctagaatagcaacatccactgacaagcggggcctttcaattttcaccgccctagacgtataaataagatcacatcgcgaactcatttggtacgcacactagccttctgcttcgacccacttaaaatttttagctcttgcactaagatttgttggtctttttgattttgaagcttcggcctcgggaacaattttttagcgtttccgaag

SEQ ID NO: 5791 - DNA, 994 bp, Zea mays
ataatatacccaaagatttagctttaaataggagtgtatgaaaaacaactatacatgtgaccgaaccttgacttgtggattgcctagtagggctgatagtagtacactggagaccataacaaaaggtagacttaaggtataaaagatgtataccatggtagataatttacagttttcttactattacagtcaacaaaacaaagaataagtcaatgttcaagtggtgctgatgtttgcaattcaatattcttcgtcacgtacttcaccatagactgatggaacaaagctaagaagtaagctgaatagaaaagggaaaggtacaagggctgccattgcttgcaaggggattgaacgtccaagaagaacaagcgatgatcgctttattgatcaagtgcatatgttttcttgctcctttctatgtacacttcagcccacatcttaatttatctttctgatgtcggggttaacaaattcaccttgcatgtctgaaatacatggatctcactgaggaaatattgctgcactaggtgctccacagacatttttttgttttgcttttgtcctatggaagtggagaaacatgaggggaaagtgttttctccaatttataggatattagatctagaagactagggccgtgtttgggactgcttttgatgaaattatcgagtgctggccgctagaattgtgccaaatagagcatgacacaggcaattcttttcaccgcacaaggcacacgccgcaagtttgaactggccactccatcctgatgctgtggctgcagtacgactgccggactgctactgcagatacaaacacagcctaggactgtagaaaatcaattttctaacaaagattaatgatgaatgccagttcttttaaacatgtcatgttcaataaccgattaacagctttgcattttagcagtcaatcattggcatcttccttgcttaattcatgatgttgtatgtaacacagtgctatgtaaaggtgg

SEQ ID NO: 5792 - DNA, 508 bp, Zea mays
ggcggcgctaactcctctgtgaccttttttttttttgtttacctcacctgatgaattgttgccatgcctggccttgtcggatcatgcgtttattatgctcaacgaggagcagatgaacaatcttttttttctttttgcacagaaccttcaatggagggttcttttgaagtggcaagagttgcacttgatgccatgagtggagacgagagtttagccatgtctggataatggacatgtagctggatttgtatcggctggttctttccttctttctttcttcttgttcttcttctycaaaggaagctgctgtagataccagatagaataatcagcaatgtttggtacaggtacagccacctctttttctttttcttttctttttttttaccgtcagtcactttgatcgcggaaccattgacaaaaatgcaacaaactttggtaaagtctcttgttctcttgcaactgcggcctggacggtcttggcgcttgacgcacttgctgttcacac

SEQ ID NO: 5793 - DNA, 90 bp, Zea mays
aaaattgccgttttcaggcataaaatgcagagtgactggtgtggcaaaatattgacggtatagtaaccgcagctttacaactatactgac

SEQ ID NO: 5794 - DNA, 1500 bp, Zea mays
tccttcattaagatatgtattttgtatttttttgcactcccttgatacttcttaaaatatgggtgatttatgtgtgacattttcgacctgtcctacgtcgtatcaatgtcgatgacagcgtgtgttcagcttgtgaatgtatctccgattttttttcttacgaaatgttaatattactaattgaacacctgcatgttaatcttcatgaatatcaataataaacctagaattccaacaatggcttaaaatatgtttttgtcacgccgtgctccgtgcggcacggaatggacacgtataggagcgagaccgaacagttgctgtcgctcttggccgccgccggcgcggcatccgaaagcagtgacgagcggcggtccgggcaaacgcaacatggaagccaagcatcgcgggagccacctgcgatatcgcggcgtcgcaaggtttggatcggaaaaaaaactggccgttgtcgtctctgtctctgctggcgactggtgagcgcggtctgcgtccgtctctcactctctcctcgcttccttcaggattcagcaacgtccgtctgcctttattgttggtgcaacaagacgcaaagggccagtgcagctggagggccaatagccgtagccgtagaccggggccatatgcagactctaacaaaggcacagtactaaggcaacgactgctatgcaagcagtcattctgtgcaagcatgcaaacaaatcatttgattcattagatcgtgatctaaccgtagatcacattcaatcttaaacccttgcaccaccagctcaataatctttataaaaaacccctaacaaactatgattgtatctatagttggatcgtaatctagtaaatcggatgatttgcttccacgcttgcacagaaaagactgtttgcatatcagtcgttgccggtcccaccgagactggcataaaatccttacaagactgactatagggaaacaaattaatacatggatcaagttattattaaaaacaaaaaaaaaacatattatctttaattaggtataaccttactgttactactaataaagatgacaatgagtaaccacgactcaattagctaaactaacagaaacttagttcagatatggtaaattgtttggtaacctacaacatttcctaccgatcgaagtaaccagggggggcttgccccataataccacgacacgccgaggaccaagtccgcaaaacacaccgagggagggccgtgtccccactccccagtccacacacacaccgaattccatttatttcatcctctcttttttttttccattccacgcccctcccaacactcccagacccatttccctttccttcccctccggctccgcctcctcgaccactccgacaacccccagcgcctcctctccggcgagctccacctctccaccggcggcggcgagaagcgggggggctaactaagtctgtaggctgcggcggaggtgatcccggagccggagccgagtctagggcg

SEQ ID NO: 5795 - DNA, 1500 bp, Zea mays
aagtttgtgatcataattcataaacatgatgttcaaaatttctggaatgttcctgaattaggcttcaacttgtgctcaataacatgatatcaattctgcattcattgttttttattattcgaatgacttgcagttgaaatttgaattatctgaagaaattcaattaaatgtactaaatataatagatatagaaagcactttaaaaaatgtgctcaaattgaaaatgtgggtccaagttcctaatcttttgaagttgtacttaaagaagttacgagagagcctgtgtgttaaagaaggtacgaaaggttaagtagggttacgagagagcgacaatcaatttgttctcttttgaagttgtacttaaagaatttgtggtcggcttctccaagttcctaatcttttatccagttggcttcaacctatggttttcgacgcaattcatctacgtacgttgttcttaatactgtgcaagcttgtgtgtcgtgcccgcgacgacatctttttaaagatccaaggactagtgcacgtaatatataccaggatatggaattctaacggttcgcgaacgagtgaaaggacagggcatgaaggatgcaaactagtcccaaaggtgacccctacttgcggcggacaaagtacatcaatcaattgtgctgcaggtagcaagacaagccaacgatgctgcacgaggacgagcaactgccgctgcaactgcaagatgctgaaaccctagctgacggatcatatcattggattggatggtgggttgttcagttagtcttttaacaaacacgcatgtcagttagacagcttcatatatcattggacgccgtttctttctgctgagatctgtctatctgttgttgtttttttgtcagttcagcgctcgtgcaaatgcacggccgccattattcaaaacgcggatctgattcgggacaagtactcatttgctcatcaacttgatagtatgagattactagtttacgcgcgtcaactgatttctggtatcgagaagtgaagaatttatagaggcagctagcgtgtggtgctgcagataacagaggcatgctagcaatgctaggcaaggagatgcagctgcaactaactgtcgactgacagagtgttggaaggtgaagtcgggtacgtactacgtagtcactcaatacggcacatgtcggattgcatttttcttctgttccagggtttccggccttggtttctgataacctgctcgtgcatatggtttgctgaaacacggcatactgtgtcaagctcacttgttaatgtttgttgcactgaacataaccgatgattgcgcatcatcatgcaagctgctccatcactgagtgagaaagcaggggaagatgcatgccttgccaatcagccaattccaatcccagactacaaataggcaagatctccgtcctttctccttccattccacgcagaaaacagaaccgaagcatatagatcatcacacccacaccatccctcgcaaca

SEQ ID NO: 5796 - DNA, 357 bp, Zea mays
tgcgaagatattgttaagggcctgttcggttgtaccggaatgagccaggattcattccagctcatcaaaatctatataaattagagaagtaatccggctaggaattaatccggggctccaatccggaacaaccgaacagggcctaagtgcgctgcacccatgttataggtcattgtctcgttgttttctgatgaccaaggacaaggaaaaggtagccagtggcctgccagatcggaatttgctgtttacccttttgacctggcgaaatcgaatcagaataaaagaaagctctgcacttcgttcatcgagagcatccatagcaagaggaagcggctgaggttggctcgggtgagcaac

SEQ ID NO: 5797 - DNA, 1382 bp, Zea mays
cctgtggggaatctgtggccggaggtggtctggtccctggatycacgctcggcaattggagacgacaagctagataaggctggtgccagtggcggccctatgacgtcttaggcggtcggtattgactccatcggacaaagcagcgagtgatacggccgccggccggtctaggtgatatagctagtattggagatcgcgcggccaatcggtaccgatcagccccttgggaccacaaccgctgccgatcgaattatttgtatttaaaaaattataattttttttttctaaatccaccctataaataaattctcaaatcgtctacttcgttcatacacttgtatctccgtttagagtttagagtcttttgaaccttcatatagatccgagatggagtcccaacaacaaaactttcactgacttgctcaacaagtaatctcctcaacgtttggtgtaagacaagtcttctttgatagcctttctcccacccaccatcgatgagaggaagacaccgctcgttctcgtggcctaactcctcaacctctctttccttacttgtatgctcctcctccatatccttaccgatcaaatgtcgatgaccctctgttatactccgagcctccaatgaccaacgctcctccttctagcattgatgaagccccttccatcaatgtccatcctccataaccttccacttaatcgtatccttctctgtaccgctataggtatccatacgctcctcctccatatggctcgtatggtgctttttccatattccctcccgcgtatggttctcctaccccttctcgtgctccctctggcagctagtgccaccaagcatccacaacaatgcagccttaaaccagtccgcgtactccagtgcgttacatctccaacgacgatagaactaggctaagacggaggatgaaacacatgtaagtatacatatatcttaactaggtgagtgaccgtgcgttgcgacgacacacaaacatatttaatatctataaaataaaaaataaatttaatatcagagtgaacatatggttcacatatcaaatattaaactgataagcacaaatattacaccttagctaaaaggctgagaaatgtatgagacccgaggtggtggtatgtgggagcgttgcactacgtgtagcttcctatcatgttagacaaaaataggacaacatcctcagtgttacaacaacactacattgctcgacagtagcaaatagggtagcctgaatagctgactcaaagatttccttgtagagcctttgagagcaatcgtacatattgaaaagctcttttgcagtcagtacagaggacggtaccaacaatccctactactctataagtccttattgtaggcgtccaaggag

SEQ ID NO: 5798 - DNA, 186 bp, Zea mays
ctccagctcaaggaccggcttcaattgagaatagccaaaacacatgggaacaacggcagccattcaatgaaaacaacctgagaaagaagtgaaatggcggccccgtacgtacatacatatgcctgtctcgtgttccattgcgcaattggcattcccacgtcgagaactgcctgcctcaaggccgtc

SEQ ID NO: 5799 - DNA, 375 bp, Zea mays
aaaattgtgattatgttcttaacaaggtcgcttgagctacggaattgatggtagaacagcggtcgtctcctaatcaatgctcttcgataatctggaatacagatagccgttgcacctcacaagaagccacttttctccgtacgggtgttcttcagcaagtctgtcaagaacgcgtcaaacgccacgtgagatgagccgccttccttgagaacctccacagccatatccttggccgtcacgagcctctgcctaagctcctctccgtcgccagatccgggcgccatcaccagcctcacctttgcttccacctcctccgcctttaccagctcctcctcgtacccctccatcaccacgccaaccttcaactcctccacc

SEQ ID NO: 5800 - DNA, 128 bp, Zea mays
ttgtgccttacagaatctagtcatgtaccagccgagcaaataagagagcaattgcagaatccggtggtgttcaggtcctgctggatcttatcagttcaagcaatcctgacacttctgttcaggctgca

SEQ ID NO: 5801 - DNA, 234 bp, Zea mays
ccctcttcttcctcagtgcttatccgcggcggaatccaatcacctccctcatcacgtccttctcccgagcaaagcctcccctcgcttttggcgtatgcccccgctggcgcgcccatgattcccgccgattcctccgcccgttcggtccagcaaaccttgctgctgctgctgcgctgcggctagttcggtggcggggaaagaggaggagggatcttggagtagggcgaagcggaa

SEQ ID NO: 5802 - DNA, 95 bp, Zea mays
ggtatgtggcgtccccccttctccaacattttcgtttgctcaaccaaatgggttcggcgggggcgacgtagatctcagaggggctctaaacaaac

SEQ ID NO: 5803 - DNA, 1117 bp, Zea mays
ttcttgttaagtgattggtgccctaaaaagttatcaacaccatcttcaccttatgataggccgtaggtgcctaatcaaacaaagtgcacctttttttaaaacccatttttgcacccggcaacgtcgtttgttttggaagcaaaaggatttctcaaccgtcctgacttcccatgttgtctttcgccaacctttcgtccttcctactactcgtacaatgctgtacagtcctaacagtagttttcaaggcgatgcattactctctggttatttttgtgctataaaacttgttctctcttctcgttagtctaggtgacgttcattcgtaaacaagtcgagaccctggatcttagttaacctatttacatccgtgactgatataccgtacctaactcaaaacaatggcccaagtccaaccaatcaccagctcgtcaagactaatgacgtacctcctgctgctgtgctgcatcacatcacatgatcaaacaattgaagcaaccagatggcctgcttcgattctcccgtgccattttgcagccatggtctagtacagcctacctttgggatcaaaaagttttaatcacacccaagaaaagtgagaatctaagtgaaaacaatgattagtatggttttaataccataaacaagctgtatttatttccttttcttggacctgacagggaggtacaccagcccaccttgcacggcagggcacccgtccaaatgcagcagtaaatgggcaaaagaaaaaatatatatattgaggagtgaagaaaaagaaaagggaacgaaaatgctttcaaaagtgggaagaggaggatgacaacaaagtgtggggggcaagggcacatcacgcgctccactgcagtctgcagagtttcaggcggccagcttcctcctccccactcgttcggctcaccacctcggtgaccgctgcccttgacgcctgcttcggacgcggcctggccctgaaatctccgtgcgtgtttggccgaaatccacgggagggtgctcgtctttgctgagctgctccggcctccggagcggagctctgcctacttgagttcaggcttgttccgccatccgaggacaagattcggagcgtcgccgaagggaggcg

SEQ ID NO: 5804 - DNA, 608 bp, Zea mays
ggtcagtgtgaggttttctcaattctttttatagttctcatttttaattgtaattccacctaaatgattatgattctgggctatttttatttattctgactgttttctttactactgtctaatttagttctcaatttcttgtgcagtgtccatgtactatcttgtgcrgatttcgcgcaccatatcacctcctaccggatcttttcagctcttcatcaggttacactttttacccttgctttaggttgactcatgctacttatgtttcagattttcatacagtcatcgggtgctgtttttggctgagttagaagccatgtttaggtcggcagagcctgcttatcttgcacattttcctgcactcacaaggtactatgcaatttcaccatggtttaaccatttgattaacaacctgcttatggattatacatgtgttactctgttaatgcagcattcaactatctttcacatgtccattttagtatatttctcattccattgcaaattctgctaattgtaatagcttcaaccattgagataccttgtgaggttaatccataaatatgacacgataggaatgtgcctggattccagtgcctcgccggagc

SEQ ID NO: 5805 - DNA, 484 bp, Zea mays
ggtaaaccatccgtccggtagcagtttactgttgtgatcctgatccgaggacggctgaatcgacagcagacggagccattttactccgtgtactgtatccgtcgagctgagctcacatgtcgcatgagtaataaagcaactggtatgggtatgggttggagaattattataggctgtgcaacattggmatgtgcatttaaaccatggaccgtgacatgtgtgctgataatggaatttgatgagatgtttcgggcttgaatcggcggtgactgactgactgacggtgcgcgattcggtctcgtcgacaggtatccaccgcacggccggaaggcggccaaggaggaggacggcgtaaagtggaacagggtccgcgcgccgccgctggccacgccggcgcacgacctgcacgcgtcggactgcctggaggagctgcgcccgggcgaccatttcgagatccagtggcgcaagaacaaggacttccctt

SEQ ID NO: 5806 - DNA, 1428 bp, Zea mays
atcaatggaagcaagatggtgtcgttccttgattatgaagaagtctagtatgatgggttatgtaatgtctgtagcggtttggtggctctctattttgaacgtttatacatctttgtccggttatagcggtctgggtgttatgctcagtcgttgtaaataaggctaaagttcctgggtacttagtctgaggctaagggtagtttgtcccctagttggttcttaccaaaactccgctatgttttcctatttcgtaatgactagtaacctccgcgcgcatgtaaaacatagatatttgtatatactgtagactatatatgtatcaaagatataacaactgaatagattcataacttcgtttgcgaaacaaaaaattcatctaaaatagagtttggtgaaatacgactgctagttatacctgtttcaacatttgaagttggattgttatatacgcacaaactatccctgaaggaatcaacatgcatacatatataaggctgtgcatagtagcatacgctgtatatggatattgttatctagtgaaacacaagcgacaaattatattttgtttggttagcaaatgaaaaggcataaaacttagattgttgttatggaaaaacatgacaaagaagagtactttttaatattgcaaaatccactgctgtaccaatacgtggagacgacctagaagtctctaggtgcatctggtgacgagcgaggaattctagctgcagcgctttgactccctttcgtgatgtgttcgtgcttcccttgcagtgacgtggacgaacgatgacgcatgtttgcgtcttgctttaatatatagaaatttgggatctcccttctagttataaaaatattgtctataaataattataaagtttatggatttgtctggaataactttctctagaaatttggactcctaaataatatagttattataaaagaggacatatccagtgcacatggaagttttgtgcacatggtgcacatattaaatcattaatatccatttcagatttaacgtctctggttgatcattataatttataaataacactttacaccactacaacctatcacatcgcagagtgccattarcaaatataccaaacaattataaacgttagatttaaaataagtgataatgatttaatatgtgcatcatttgcactaaaatttcatgtgcattagataccttctcgttataaaatttggtgtagtgaaagataaaagaggataggatcgatttcttccgtcccgacgattcgcagattttacattctgattttggacgattttggtagaagctattttcacggaatcggactccaaccgaagtgtttgagtggcagaagccgattcccacggtcggaatctggcaagccgaaacaaacaggctgactgggttggcttccggtttcggcg

SEQ ID NO: 5807 - DNA, 192 bp, Zea mays
ggtagttgccaaatttgttgggggcaaacacaagggttccaagacttgtgtttgggtacccaaagttcttgtttctaatgccaaaggacccaaaacctgtttgggtacctaaagtcaagaactaaaattgttttgtaggtttatgcatccgggggctcaagttggatactcgatagcgggtgcacaaaccac

SEQ ID NO: 5808 - DNA, 387 bp, Zea mays
tgttttcttgagccacgaagtatctgaaactcttttttgtctgacaacataaaaactgccttgaatatttttatttcgatccctcaatgattgagaaattatgaattaactattcccttccatttcccatcccctgccgcgctgtttacgcccacatctccttccgtttctcggcatcgtcgacacctccatcggcctccgatctctccacgagcctccgctccaatccgaggtacgcaacgcgcgatttgcagcggctttgcccgcatttcccgacccgatcatcgatccgcgcggcggcgcgtcatcgtcagggcttcttattgggtggatctcggtggcacgcgtgctgcaggatctgcggcggtgggcagtggtcggccggcg

SEQ ID NO: 5809 - DNA, 1195 bp, Zea mays
caaaagtgtgttggcaccgatcatgtgccaacacgggaacgaaccgcctggcggagctctctgcggaggcgtggacgatctgcggcataggaccagacggtccgcgacctggcgcaggagtggatcctcctttgcacacttccggacggtccgcgcctagtgtcgaatggtccacgatagcgcagagggtcttcttctccgcgaagaaccctacaactcgccccgggagagatgccatcgagggggagagctccaaggggttgctccggatcggtaggccacccggtgctactctaatcggcgtagagtcgagtagagattgttgtggaagactaaactagatctaattctaaggctaaattactcctactcctagggattaaaagaacgaaaaagtaaaactgataaatagatttgatttaatcgattgtggggggttcaatcggccgtagcccttcatctatataaaggaggaggtctggacccgttacaagtcgttttccgagttaatcccgcagttgtaactaacaaatcacgcaagaaactcagaagcttaactgattctgcgcacgtatggaccgtccgcactgccaatttacgtcctcaacaggtactagtcgcctgcctctatatgccaggttgcagacattgaaggcaagaagattttaaaccgtttttaaggcttaggaagtcgaaagatatatttaccttacaacctcaactcatcagcgatatatattgagtattgcatctacagatttcatatctacttatttggtctacatgtttcttgaagatttgaaatatatcttattactctgtcatatttaacatcaattatatcatttagttagtttatcttaattagtagcctctcctttgatcggttcctagatccaccaatgcgcgtggtgacgctgataatcttttttaatgtttttcgctgttctttgttgtttctctttcacttttaatttaagtccacgtactttaaaaggacgcagtggagcgcgtcagcccggtctagtaaaatataatagccaattaagaaaatgattctaaaaaatgatccatgtgcaaattgccatgtcttgcatgtggagcaagtaattctacacaccagctggtctatatatgaagccagatagatcaaggtctaacacaacaacagcatcatccttagctgctgacacaa

SEQ ID NO: 5810 - DNA, 1500 bp, Zea mays
ttgaatttaaattttataagcaacacaaacactgaaaacaagaatcttggaaataattaaaatttggatagccaattttcatttcaaaaaaagttaggaattaggacgacaaagaaataaaaaacccctctaatacttcctctagtactttgtaatttcaaaagacaacttatatttgaattgtggggttctccaacaaggaaatccccttcaaaaattggcgtatgctgctatttgcggcgcacacacggtattctttagtaaaaggcgaaagaatagttcgctctgtgtgcaccgcgcagctgcgtggcttctcttggctgcccaggtcctccttatatgctattcccacgttctgcaacagacctaaagcagcgaggtggtactaaaactgctggtgcccgtgaactagattgccgcacgcgctctgctctatgtgcgcccgcggctgccgcgaactgggcctggcccgttactccgtgagggcgcgcttgcaacggttggtgctaggccatctcagcagagatggatagacacctccgtgagactactgtgagaggttttttttttttgctctttctctaccttggcacaatggcacgttatagacacttggggactgaataaattggtgagcaggagttttatgctcaaccagtccgaatagatacctagtcatcacatattctctgtaccaaccgtacgtcaatatgtatgttacttcagggacgaacctagtacaaaatatgacttaggatgtgcttytaaggatgaactctaaaataccatagcagtggcatctaaattaggctgagtagggaacctcatgttaaaatttagactctagtacttgacacaaaaaatgtgcggcactcggctctacttgggtccgccctgcattagttggaggataaataagattttcttagtacacaagtttatagtttctgttcaagtgtcgcctacaaaaggtagaagaggatatctagctataataagtgttttataaatatccgttctcgaatatttatcgtcggctactttatttttttactaaaatgtgataaatgaaaaagaacaggtaatgctctaattgtgttttttccgtatattagcattgcttcgagcacatacctttctaaacgagaaaaatgctagccattctagatcatatgggaggaatagagtgtagctcctaccaactcaccaataataatacggatgtaagaaacaaaagaatgtacaaagaaaatccaaatgaataaaaggagaaacaatgagtggaaaatgatatggagcacccaacagtatacgcatacgccaggcaccacatgtccatccgcgactccgcgtcggtatccgtcaagaaattttcaacaaaaaaaaaacttaattttccactcctattcttccccgacgccggggaccagcgccagcgccaccaagaagtgacccacccaggtagccaggtaggtaaccgcccgtgccccgtcgccggcg

SEQ ID NO: 5811 - DNA, 501 bp, Zea mays
cctgccagtgccaggccatcagaactgtacatactattacacagctggtactatagcaggcaatgcatatgcatataggcggaagcggaagcatgtagagaccacgtttcccgaggcaggcaccgagtcaaagagagcaaacaagtccaccgtagccgtccgttccatggtggtggcgactggcggtggcgaggcatgcagctgtggagcccaggacccaggtggggagatcgtgggggtgtgcctgtgccactgccactggccagtgcgtgtcgcgcgggcatggcgcgctggccctcactctccctcgcgcgccaccatgccccactgcggtgtagtactgtagcacgacggcaggcatgtatatatgtgctttgacggttctgctaatgtgctatttgggttatatatatatacgcatggcatggccgttcttagctttgcttttgggtggcagcagcacccagcacagcaggggaaaaaagaaggccacacacacgc

SEQ ID NO: 5812 - DNA, 191 bp, Zea mays
ggtgagctacagatccgttgccggcgtggtccacttcgtagccccgttagttttcgcgtgaacatttaactttgtggatatttcctttttttgactgattgttgttcctttttctccctttctaaaatctagattggataggagctccgaacgcgagccatagacggggagttgatgccaccgggcaatgg

SEQ ID NO: 5813 - DNA, 772 bp, Zea mays
ttgaaggtcaggtagtgaagtagaccattctctaaagatcaatgtttatgtagacttattccatgcgcaatctacatgaggaaaaacacggaaaaaatatgccactgatagatgataaggcaatttcaatcaaattgtcattgtgtggatttagagctggtgcataagccaaacagattcataatggatctcagattcactagtagacttgctctcggctgaaatttagatctagatttactttttcaacgctctctgctgaattttagaccttgattcggcaatgacactgtgctaaacagacctagtacaaatcaccagctctagaaaatagatatatttcatagagctagatcatctttttgtagaagcgatacatttggtaggttggacccaaaatgcaaatgtcaaatggtaacgacagaaatgacacagttttattttgttgacacacagccatgtccatgttggacagagccaaagcaacacaaacccatcattagcctccaaaaccaccttataacccggactcagtttgcactcaaccaccctcgccattcgcaacgggtactttggcagcggccaccttatgacattttcgaagtcgctgctgcacctttggcgcgtcgtggccttttaagaccagatcagtctgctcctcgcttgtcagtcactcgtactcgctcgtgagtcgtgacttcgtgagcagcccagatcgccgcaggaccacctcttctgcgtcggtgcccgcagcttcggcttcgcggagtcc

SEQ ID NO: 5814 - DNA, 121 bp, Zea mays
aatcgtccgcgaacgatggggtggatcaggcgattgattggtggtgtcaaagttgtgcattgctgtgttcgattgggttgatctgcccgtctacccccacggctgcttttgatcttgctat

SEQ ID NO: 5815 - DNA, 836 bp, Zea mays
cgtgcttcgtgaggcacacgggcacggcggcagacttgtacgacgtccacggacaacggttgccgatgcagcgccagggaaactcctcggacctgctcctgaccgttctagtgttggagtcctgtggctgtggtgtgtgtgcatgtgtcactttttttctgtttgtttgtaagctccatctcgtgccatgtgtatcgacattggactccggtcctgtttcctttgtcattcgagtagctactagcaatttggatatcagttctcaagatggtagagccgacctgaaaagttgaaaaaagcttgggcttgacaaatgacaaactgtgattaaaaactgagaaaaaaaggttggttaaaaaaaaagtcggaaccttttggtctcgcacgcgagattttaaaggcccaaacaaggaacaacaagcccatatagtactccaacggatcagcctgacgctgacgcgtcagcgccacttttctttggtttctgcgcctccctctgcgtcccgcacccaccgttctgccaaagccgaccgttggaatgaaccctcgcatcggcatctcccaccaccacaccagcacgagaaaaattattaaggaaaaaaagaaaccgacatctccagcagcccccgccccttccatgaccgttgcgcggttcaaacccctcaaaacggccactccctgaagccagtcaagcgtagcaccacaccactgcacagtctgcaccacacggccacaccggtcgagaaagcgaaagccaaagccgcgaaggccgcggcggttagaagagaggagagcagaccgagagccgagaggcacgcgtcgtagcgagccagtcg

SEQ ID NO: 5816 - DNA, 220 bp, Zea mays
atcggacgggcggacggacgcgcgcatgcatggctacagtgtgcgcgtgtcaggtagcgtggcagtacgacatcgctcgtaccgtcgtacgtgtgctctgcacgcccagctgcaccacgcatcgccgtttggccatgcatgcatgcatgctagccgcccatgagttgtggacgccactactgtcgtgtactcgtgtctgtatgatgtaacatacacggaa

SEQ ID NO: 5817 - DNA, 1500 bp, Zea mays
tatattggctaaattccaagaaacctttgcacttaaattatgcaaactagttcaattatgctctttgatattttgctttggtttgtgttggcatcaatcaccaaaaagggggagattgaaagggaattaggctttcacctagttcctaaacatttttggtggttgaattgcccaacacaaataattggactaactagtttgctcaagtgtatagattatacaggtgtaaaaggttcacactcagccaataaaaagaccaaaagttggattcaacaaaggagcaaagggccaaccgaaggcacctctggtctggcgcaccggactgtccggtgtgccaccggacagtgtccggtgcaccaccggacatgtccggtgcaccagaggactccaacgcaaactcgccaccttcgggaatttccagaggcactcgcgctataattcaccggactgtccggtgtacaccggacagtgtccggtgcgccatgaagaagcggcctcaggaactcgccagcttcgggaaactccaacggctagtccgctaaaattcaccggactgtccggtgtgcaccggactgtccggtgcgactccggagcaacggctatctccgcgccaacggctctctgccgcgcatttaatgcgcgctctgcgcgcgcagaagtcaggcgcgcccatactggcacaccggacaaggaacagtgcatgtccggtgtgcaccggacacccaggcgggcccacaagtcagaagctccaacggtcagaatccaacggcagtgatgacgtggcagggggcaccggactgtccggtgtgcaccggactgtccggtgcgccatcgagcagacagcctccaccaacggtcaagttggtggttggggctataaataccccaaccaccccaccattcattgcatccaagttttccacttcccaactactacaagagctctagcattcaattctagacacacccaagagatcaaatcctctccaattccactcaagcctttagtgactagcgagagagatttgtcgtgttcttttgagctcttgcgctgggatcgctttctttctttctcacttgctcttgtgatcaaaactcaattgtaaccaaggcaagaggcaccaattgtgtggtggcccttgcggggaagttttgttcccgttttgattgagaagaagaaaagctcactcgatccgtggatcgtttgagagagggaagggttgaaagagacccggcctttgtggcctcctcaacggggagtaggtttgcaagaaccgaacctcggtaaaacaaatctccgtgtctcacttgcttattcgcttgggatttgttttgcgccctctctcgcggactcgtttctttattactaacgctaaccccggcttgtagttgtgtttatatttgtaaatttcagtttcgccctattcaccccccccctctaggcgactatcaattggtatcaaagcccggtgcttcattagagcctaaccgctcgaagtg

SEQ ID NO: 5818 - DNA, 1500 bp, Zea mays
atgcaccagcactacatcatctagaatagattgactcttcaaaccaaacacccaccaaataacagcctgcatgaatataactatctctgcccattaaggttttaatgattgatcccaatgataccctactgtgaggtttggagaagaccatgcagcaatattctttcgagcatttaccacgacaaacgagcaaccatcaacataaactccatgcagctgcaacacaaattgataatcatgtgcacacaaattgcaaaattaaaataatccatgcaaatttgaatgtaacctaaccccaaaactcaaataacaagcagtcaagcatagctgcacacaaatgttacagcttgacactacagaatactacagttcctcaacatcataatgaaatatgtgacctgccccagaaaagacctgtgctctgggcccacttgtgacccagtgattataaatgtttattttgaatggcacatcaggccctcaattcaatctcttcaagccttgaaagcgaaaccagtaaagtacctaaacaactgctgaaacaatggctgttcaaccaccacattctaaactccagcatttgtattaccacaaattaaacagcacaaatctgacatagcattggtactgcaagttgtgatattagtattacccatacactacggagcgtccccgaattcaaaaccagttatattttagagttaaaaaaaacaatgctgtgcacattactaaccagtaatccaccgtcacaaacaaatgctaccatttaccattaggcaaacacaccctatgtccactataacatgaaaaaacatttctgaatagacttcacattcctaaccaaaaaaatggggaaaaaggtctagaggcattgcaaagattccacaaatcagcacctcgacagcagattcccactggcccaaaaaattagatcgaataatgacagacaccgacgggaaaaacaccgaaaattatgtttacaagtgtctcacctggagcgcgcgcttccctcggaaaaaaatccagacaaaacaatctcgaaatccagttaaccaatcaaccccacgccgccgccggctgcgcctcgttggcctcgccccacgtcacatgccaaattccgcggcgagaggaagccccgagcaggaggccacgcgacgagcaggcgggacgcgcgggaggaagggagacacagaggagggagcgagaacctccggcgtccggcctcgtcggctccccagcgatcaccggcggcgagggggcgcggcgatcggacggagcaggggggcggagggcggagccgagcgagcgccaagcgttgcagatttgggggccgggcctcgggctcgcccggttcttgtagtgaccaaaccggcccgtgaaccctgtgcccgggcccgacccgcggctgaaccagcacgcggcagaggcatctcgtaagcagcagcagagagctgaaattgagagaggcgaggggcctttgcggcggctgcggagacggcg

SEQ ID NO: 5819 - DNA, 129 bp, Zea mays
ggtaaccttggctctacagtcacccaatttctctggctgctaactgtcaccgcttcgattcctagcccccctcgttggatccggcgctgagcttgatgcgatccgggatggggttttggcagggaggtg

SEQ ID NO: 5820 - DNA, 163 bp, Zea mays
ggtgcgatttgactcttttttagccctacctatatttccttctcacttcaataactatagtgacacatcagcattttgcttagttggcacactaattaatagctatagaaaccatctagtttctgggttgagagtgccctaattattcgccatgtgaatgtaa

SEQ ID NO: 5821 - DNA, 475 bp, Zea mays
tccagctcggtacccctgcatgatatttttgacttgttgagaaaaaaaaagcgttaaaacaagagaacgggattattagtcgtcgtcgtgtcgagctcctgcgccactcggttccctaaccgaagttgacttccttgacctcaatgcctttccaaatgaacggaccttccgactcacgtggatgctcatgcacagttaccggtctacccctcccctcctttgcccgacgtcatacaacgcggcgcctgaagctgctggcccaccatctccatttcatgcggccctttccactttcccattggtccacacacacaccttttttttctaatttatttatttatttattactattttgtgcagccggaagcccggaagtccaagtccgtcagctttggcttcttttgcgtgtagccttgaccctaattgacacaagtaaccataaagcccaaaaccttcttcttcgtcctttccatcc

SEQ ID NO: 5822 - DNA, 1500 bp, Zea mays
tgcaccggacaggtactgttcactgttcactgttcagtccacccattggggtttggagcgacttgaccattggaacctttgtcttatagctgcaccggacagtctggtgctacaccggacatgtccggtgtgctctgacttctctgctctgacttctgccgtgcacttttcccttttgcagtcgacggttggcgccaggttactgttgctccgttggctcactggacatgtccggtgcacaccgggcagtccggtgaattatagcggagcactcctgagaaattcccgagagtgagctgttcgagtggagcttggcctggtgcactggacactgtccggtgcgccataggtagcacactctcatgtcctttgctccaaatttgtttaagtccacaactgaatttctttcttggtttgtgttgaaccttatgcacctgagatgaatgacatctaggcaaactagttagtccatgtggtttatgatggacgtcaaccaccaaactcgattataggaaaggattaagcccatttccctttcatggcacgtacatggttcgcattcaatttgcttcctaaaaccgagtgtgacagtagtcatcataggtttaagggagagcatatgatcttaaatcacaggggtcacataatgcaacctagtaaagtatattttcgttctgaagcaggagagcatgttgtagtcaatgagtgtggtgatacttaatcgatcattgtcatgcattggtctctatgtgtaaacttgtcaagggatgaaatctagaaaagttgagtataaggaatgtagagaacaaaggaaagattgttgggtgtgtcctctacatctgatcatcagagaccggattgggcttaacccaattaaccatctccttaatcggatccttgattgggagggcctatgctaacctcgattagagcccccggtcacatgacgctatataaaggattaagaggtcacaggaaagccaacgctattacctcacccctaaaccctaatccacagaataacctcatctcttaggtgtcggagtgactagaagagcgacaccctaacggtggcatgcgagaacggagccgacgtcggtaaggatcaaatccatctccactactgcggggcgaaggtatgtctctctgtttatgcacatagatccaagaggatcaatctatctgttattatttagtactctctggttgattaagtgagactcagtagatccacaacttctatcaacatcatctagtagctagcgctgagagacttggacatcgtgtgctttccctccagtccatggctactcacgcccgagctgttcgccaccacgcattattggacgttcgctgaaattagttagctcatgcagatgtttccatccccatcctcacgactttctttgtcctatataaaaagagagatcgacattgttagttaacgtggagactcgttggtctacaacgtaaacgataaaggctgcggcagcagcaagc

SEQ ID NO: 5823 - DNA, 234 bp, Zea mays
tgaatgaacaagaagaaataaagtccctttacgtactagctagctgctgtacggtggattatttgcgagctagcaatgcgatcgtcaactgtctccgatccgcctgtgttattggttagttacgcgcgcgctcatcaattaacggtcaccaaccgctttttctctccctgtggctgcctgcctgggagtgactcatagctatatatatatataaagctctgcttcacgatcgag

SEQ ID NO: 5824 - DNA, 1255 bp, Zea mays
aaaagctgtttttcagatttaaccctttagtttgacttttggcttttaagaggcaaaagccaaacccaaaagtaaaaccaaacacactatcctacctgcttatatagcctcctccgcgcgtgatgcaggacatgggtttacagagatctagctactctctccgttgtttccgttgttttttaattgtcgtgatttagcttaaaaataaactaacggacgataaatattcgagaacggggtacggactaagacagagatacggtaccacggccttgctaaagacgcttcaaattttttttctaaaaaatgtctgtagttgatagtgatgggatactgtcatatactgcaacaatatgccaaacaagataagcattgggcagtcgagtggagttgatctgcgcatgaacctcatagtagacgccatcttcttcaccgtcgttttccgtgaagacgagtagttcgtcttttacgccccggccaccggctgctaacggttgaaggcttcaggaaacagcgatttctctctcatcacggtttctctcgttgaaataggcagctgatttggctttaatccgacatagcttctactgtttttacagtgttttttctatatatattacaactgagcagtctaaacagatgactttaatacaaagcgaaaacgcttcaaaaaatctgcgtgccgtacaagaagcaatatggtatgggtttggatatgctttttttttgtgaagcgtaagaggaaaacgcagcaaagttcaagaatatataagataaagatattgaagcaatgactgggtgcacttagggcaatacatgtgattccttgttcaacttcacacctagttgtggccttgtggcaactcctataatcttagtgcgttgaccggacaagacgtgcagcaaatgccccatccatagagtgcttagttggatttgaggaatagaaaccttcatctgtgataaattctctaggaacatatccacatacactctgaagagcaaattcctacagcatatcataaattaattaatatacagatgtcaaaaacatataatcaaaataagattttcattgggttattaaaaaatacaaaatacaagtgacaagcaatataggcaccagaaaaagaaactacacatgatttttattgacttagagaaagtttatgacaaaatataaaaaaaatgttatgtggtgggtttcggataaacataaagttctaacaaagtacgcagtactcgttaaggacac

SEQ ID NO: 5825 - DNA, 157 bp, Zea mays
gtcccccaaagttcgacgaagacatcctggagggctggtatggttggaactcgatcacagctcactgaactgaaagatataatgggtctcctttcttcgactgtaaattggggctcacctgatccacggatgatggagctgaccacacacccaaaac

SEQ ID NO: 5826 - DNA, 1500 bp, Zea mays
attttccagccctaaatacgagtgcagataaataaggccctgtttgaaagcgcccaattttttaaaaaaactggtttataaaattgagctggttctaaaaatgctagtttataactcaatttataggaattagattcttagcttccttaaaatcaagaagctggtatctactaactaaaaggtaccaactgctttattaaaaactgagttactttcaaacaggatctaagagaggaaacatataaattaacggcagtttgtttttggtatgctgcacctcatacgtctcattcgtattttattctggtatcccgtggtataataggtcctttgataaggctcctataccagcttcttcatgggctttattagggtcggagccgcatgaaacacggcacgagcggaaaaacattttgtacataaaaacagatcataatttacaatttaacactaatttatttttttctatttatatggattaacagatgattggttgtgaggggctcaagagattttatttgcatgacggatgcaaagattattttttccccacgagcaagcagcacttgtggcgtccacccggaagagcgccactgcgcgagcaaacacaaaaatacaaatgaacgatcgcctctaatctggaagagatagacttatccaaaagaaactgccgtagcgttaattataatagaaagaaagcggtggatatactagaattacctacctacccgcgtccaaaagcagtataccgccaaagaaaagcagcggcaggacaggactgcctagattcgtgaaggctaccaaacccaactcacagttccaagttccaacccgcaaacaaacatcgccgtgcatattgcatactgccctccccccgccatctgcatgtgtccaaaacagaggcgccaccgccagcccgcagccgcagctcccagccttccacccccaccccaggtttccagaacctacaggaagcatggcgggccgaacccgacccgacccaacccaacccgggacgcagatggggccagtgtcttgccggggcaccaaagtatcgtaccatgccgtccccccgcacctcccgcccgacgtgtcccgaagcgggcgccccacccccacgctctccacatcgcgctccgcatgcctgacaccttccctccacgcgtccgccactcacgcgatccttggcgcttccgcgttcccctcatctcactgaccgcgggccaccccaaaatcgtgggtgcccggacttgacgcggcgttaccttatcggggaccccgtcgtttgcctcacccctagttagctaaccgcggtcggctcgcggcccgagggtacgaccatggttagcaggcagctttataagcgagcagcccttcggcctggtgtccctcgtccccagcccgcgcactgcccccggtctctctctctcaacacaccgataagcccagtccaccggatctcccgtagtccagagactgagttgaaggaaggaagccatg

SEQ ID NO: 5827 - DNA, 265 bp, Zea mays
aacagaaagagcccgtgtgcgtgacgcacggacgccgtgactccgccgcaaagagagggagagtccactctctgaagaagcaacggcgacgcctccgacgacgagcacagctgcccagcaaactagcagcgccctcgtcagttccgtctcgttcccaacctctcccggattcgattcgattgacccgtccgctccaaatcgaatctaatcagcagttttggagttgcggaagggagaaagagagagagagagagaggagaggggc

SEQ ID NO: 5828 - DNA, 192 bp, Zea mays; identical to SEQ ID NO: 5807

SEQ ID NO: 5829 - DNA, 199 bp, Zea mays
taggcattttatgcttaattaacacctttaaattttataataatattagtttcattttcaaataataagttttatttgtgcaggtttcgtcggtctctaacgttgaagcctcggaagaaattcgatcactggcaaataataaagcagaaggggaccaggagttgggattgggatctgttgtagattcttccacccgagc

SEQ ID NO: 5830 - DNA, 1500 bp, Zea mays
catgtctgtgtcgtctgattcccacggccattggaccgaacgagagccaacgagatttcatcctacacagtccagttatctgaaactgcctgccttaatgtggaggcccattcgatggtttggtccaggtagagatgcaagtggttcgtggactagcccatctgtatcccagtcccagggccatgtggccttgataggcggtctttcttcatttgttgccgcgtctagtacgagacagcgcctgccaagaaaatgtggtactgttggtctgttgcatatgaaccggtcagtaccattggtgtgtgactagacaagaactacaggagattttttatttgtgtttcttctatttttgttttctctctgctggcgctatcgactagtattaggctgttggggacaaccggtccttatttgcagttacaacagatcgtgtaaaatagcagatttatatgtagagtgaagtttaaaataaaggataaggcataggatatgatacgatacggtagctgtaagagacagactaacgtatcctcggatcaacgggtatacgctgtcatccatacgtacgcactgaacgcgccttttccaggcatgttttgcggtagtatttatttatgctcacatacttgccgagacaaagttgaccaaagcatagatatgcaatgcacgacatcttcgagatgatcactgaacacgcaagcctttgcctgcaggtgctagccaaggatcgagaggtggggaaaaggtcagggtatcggttccatcccagcaccagcttgcaaacccatcccaccggccggcccgtggttttagccttggctaacctcagcagctactactgatcacgaagccacgtcgagatcaacatgacgaactgatgaacaatgaggcaagccatattctgttaagaaagcgagagtctctagtttggttttttggatacctctcttccagttgaattcaatgtgattgcccacaggaaagagacctggctgggcactgatagatacctcacgaacgactgctgccttcaacaagtagacttggagacagaaaacagccgagaagcttttacaaatttgggagtcttggacccagccaccgcttcttgggctttctagacaggtcgagagagaggctcggggatgtttaccagcgccatgattagcatgtgcagctggcaatgcgctcccaatcgtcagaaaccaaaccgactcgattacctttcgcctcatcaggcgaataaagccaacctaggctcctacgagttggatgccaattgggcgggatatttggctcgactccgactccgactccgactccgactccgactccgacgatcttttaaacaacctcagaacagaacccgaactcttcccaggaatacccctatatatatagctgcctctgcgcctcggccttcctgcaccaccttccttttcacagccttcgtacaccggagaaccccgcaagaaacctgcagcaggtccgccaggc

SEQ ID NO: 5831 - DNA, 1406 bp, Zea mays
ggtgaggcaccggacagtctgcgcggagaggccgcagaaaggcactctctggctgtagcaccggactgtccggtgtgcaccggactgtccggtgtgccaacgggcagaaaggcaacggtcggatccaacggtcgactgctacaggcgccaacggtcggctgacgtggcggcaccggacatctactgttcagtgtccggtggtgcaccggactgtccggtgcacccgacgacagaaagctgctgctttctgtccaacggctagttgggggtgtggaggctataaataccaccccaaccggccattctctagtgtgagagcccaagcaacattccaatacacatagtgcatatttccaagtgctcaaacacccaagtgcttaatagaatcactcggtgattagcgtargtgctttgcgaagtgcttaggttagttagaccgctttagcgcttgctctaggtgaatcctagttagttgagtgagtttagataaacctcacaacccctcggctcttgcgcgagccgttgtaattgtaccgagtggggcgagagtcttgcgagaccgtgacaaccgtgtttgtgtcacggccgccaccgtgtaccggagggaacgaggcccgcagcgtttcgtccggaagcttgatagtggagacggcggggagcgtccgagaggagccagaagcggagcaccacttgcgcgtggagaaggcatgcggctctctacggagttactcgaccgatgtgcttggccctcgcgtgagcttccctttgcgtaggggcaccaacgaggattagtcgggaccytgcgcggttccggatacctcgtwaaaaataccggcatcatacacaagagtttgcatctctactttgctctttaagtttccgcgtttatattaagcatttaagtttcaatcttgtattcatacttatatagtgtagattgaaacttagccattgcggtagagatagcaacacttagacaaaacctagtttgcacattctagtttgattatttggataggttttgctctaaggatttatttgtggcctagtttagtgaaagctttagaagtcctaattcacccccctcttaggcgtcacctgtttcctacaagtggtatcagagcctagtttggctcatttgaaatgctttagcttcaccgctaaaagagccgacactttttagaggaagggatggatacccataggccaccacacttcgacgccactaactttccatattatagtgctagaatggcttgttacctaaaggtcgttgatctaggtgtttggacagtcactcgtgacgggatgaaacccccaagaatcccgagaaacccaccacaagtgaggaaaaagaaattcatttaaacgctagagccaaaaattgcttgtatgaatctcttagc

SEQ ID NO: 5832 - DNA, 1500 bp, Zea mays
acctatttgcgtttctctcctctttgctgaatctctcctcgttgtcgttactattcacgtggtaattattatattttttttttgtctccccacgaacggattaattcgtgcgtgttaattgtatccttgagactttcaccacctcggatcgtgattgcatgcatccgtaattcgttccgggaatatatatacctctttttgttgttattgcgaaacctattccggaaatggtcatgtttagtgggtgtttggatgtataagaactaatatagttaaccgctaaaattaacctagacattcaaacagtctagataatgattcaactattagctactttttagtaaattaactactagttagctagctaatttaatcagtaatttttaatcagctaactattaactatagtatattcaaacaactcttaaacagacgaattacgtacgcacgaaagggcctacacctgtcctggctcgttgcgggaaattcttcggtcttcacattgagccaagaaccgaatcgtgcagtatctatttaggagaagataacaaacaatcttccggtgtgcatcattcttggccgtttgttcgagatggcgccgcggctcggtccatcggctcctagcaggcactgtacttctagatgagtacgcgcgctcctggtcctggattgggcgtcaaggcaatcttctagatacatacactctcacacgcacacagcggcacgcttgctcgttcctgccttccggacagggctgggcaaaaaacccgtaacccgaaacccgaatccggaatacccgaacccgaaatacccgaaacccgaattttgttcgggaatttcgggtagcaacttgcaaaacccgaaattatttcgggtaattcgggtatcacaatcgggtacccgaaatacccgaattacccgaactttcatgtgtcatgtactaatgtcatgcttaattattaatttgtacatctataattatgtgtaagtgtgtataacttgtgattgtagattgcttgtgttttatatgtccatgtatatcattattcaaactatatttttatactaatttaataaggtgcatgtgtttttatgaagccaacacaatagttcgggtagttcgggaatacccgaacccgaacccgaaattccgggtacccaaattttcgggtagtgaaaaacccattataatttcgggtatcgattctcaaaacccgaaattttaaaaacccgaattacccgacccgaaattttggggtaacccgaacgcccaccccatacgacggcgttgctgacgaggtacctgtgccactgtggtgccccacgccagtgacgcgccacgcttgcgcctttttctttccgcccatttttcccactctcgcaattttccaaaatttccagctcgacaagttggacttgttagagaccagtcagtagctgccattcatccactcccctttcccatcggaggaggacgagagatccgtcctgcggtgtgcg

SEQ ID NO: 5833 - DNA, 1500 bp, Zea mays
tttgaaagggaattaggcttacacctatttcctaaatgattttggtggttgaattgcccaacacaaataattggactaactagtttgctctagtctataagttatacaggtgccaaaggttcacacttagccaataaaaagaccaagaattcggtttcaacaaagagagcaagggacaaccgaaggcacctctggtctggcgcaccggactgtccggtgcaccaccggacagtgtccggtgcaccagagaactccaagtcaaactcttcaccttcgggaaaatccagagtcgctccactataattcaccggactgtccagtgtacaccggacagtgtccggtgccccagggaagagcggctctggaactcgccagcttcgggaattcgctccgctataattcaccggacatgtccggtgcacaccggactgtccggtgagccagcggagcaacgactacttcgcgccaacggtcacctgcagagtcatttaatgcgcgccagagcgcgcagaagtcaggcacgcgcgagacggtgcaccggacactctatagtacatgtccggtgtgccacccgacatccaggcgggcccagaagtcagagctccaacagtcggaacccaacggcctggtgacgtggctggcacaccggacactgtccggtgcaccatgcgacagacagcctccaccaaacggctagtttggtggttggggttataaataccccaaaccaccccacattcaagtcatccaagttttccaccttacaaccacttacaagcgctaggcattcaatacaagacacacccaattgatcaaatcctctcccaattccacaaaagcattagtgactagtgagagtgatttgtcgtgttcttttgagctcttgcgcttggatcgctttcttctttctcattctttcttgtgatcaatactcacttgtaaccaaggcaagagacaccaattgtgtggtggtccttgcggggaagttttgttcccggttgatttgagaagagaaagctcactcggtccgagggaccgtttgagagagggaaggggttgaaaaagacccggcctttgtggcctcctcaacggggagtaggtttgcgagaaccgaacctcggtaaaacaaatccgcgtgtcacactctttatttgcttgcgatttgttttgcaccctctctcgcggacttgattatatttctaacgctaacccggcttgtagttgtgattaactttgtaaatttcagtttcgccctattcaccccccctctaggcgactttcaattggtatcagagcccggtgcttcattagagcctaaccgctcgaagtgatgtcgggagaacacgccaagaaggagatggagaccggcgacaagccaaccggaagcccgctacaagccacgggaaagcttcatcggaagagtcccgcaaaaagggaaaggggaaggagaagaaagcctcttcccacaagtcgcatcggagtggcgacaagaaaaagaag

SEQ ID NO: 5834 - DNA, 240 bp, Zea mays
ggtgagtcagtctcagccagcgagcgaccttgttgcagatatccacaactgctgcttagtgttccgtttccgtcgatgatcttctgctgaaactgaaactgaaaccgctagctgtctgcctgtctatgtgcgcgcgcgcgcccaggaggcgtgtgggctgcggcggtgggcacttcggtggcgtacagccggaggaaggcgccgcagcggggcacgggcctgcgcctcatccacgccagg

SEQ ID NO: 5835 - DNA, 625 bp, Zea mays
tgcagatctcttcgtggaaggtgcaagcattttgcatcgccttctcgcgaataagggaggcagtggggttgttcaggctcctgaaatctctagaatgaagagcgctgcaccatcagttgggcgctggattctcagaacagaaattcccaaggtgtacatccatggctctgccttttgcttccaagctgctgaccctgcataggtctggactctgtagggcgtggattttgctggtatattggttatcatcaagctgcgtcccctgcatcatccccgaaagacattgaggagaaacaaatccataggtctgacaggttgggttcgaggtagagttagttctgttggaagtgtccacggggcttgtcgttcttgtgcagtaggcaacaatggcaagccccgtagttggtttgctcgaaatgagcgaatggtacggtgaactcagaaataaccgggatagagtatccgactgtcagtcatacttgctctacggcatggtatatttattcattagcctcataaacggttgcttgctatttaggctgtcatacctgtatttcgaagttcattgttacatcatgcagatgtgagacagctattgcctggcataccgtatcatgtagtacgt

SEQ ID NO: 5836 - DNA, 161 bp, Zea mays
tgcagatctcttcgtggaaggtgcaagcattttgcatcgccttctcgcgaataagggaggcagtggggttgttcaggctcctgaaatctctagaatgaagagcgctgcaccatcagttgggcgctggattctcagaacagaaattcccaaggtgtacatcc

SEQ ID NO: 5837 - DNA, 737 bp, Zea mays
cctctccattccaaaccaggccctcctgcctccgttcctggtaaatccttgaattctcgtgctcatccgggccttcttgtttgctgtgtgtgtatgtagacgttagcgcttcttcttacatggttctgaattctcatgtcgaatcgttgtttgctagtctgtatttttttttctgtgtggttgtgaatcggacgagaatggggaaaaaacgaaggtggtcaattttgtttccatcgcgaatctgatgatctttttccccacccacacggcttgttgttgtttgcgtcagtaatggaataactttggctctgtcattgcatatcattttcagccgtctggcagttgaaggggagtcccggtctgctcattctttcgcagtctgatgatatatatgtatattcttttgcgtttgaaggactcctgtgtgttgttaaattaaactggtttccgcgtccgttaggacttaggagacctcatcgcgtaacagccttccaaaaaaataaagagagcccccttctcaaccagctgctgattaattggtgcagggctagctgtcaggacggctcagctccagctttgcggccctccagctctccccagttcaagttcaatattggcgagcatgcgagtttgccctcttccgtcgtcgtcatcatcatcgtcctcgcgatcccggcgtccctgtttcggcctacgcctcccgtagacaacagttgcgccctgctctccggcaagct

SEQ ID NO: 5838 - DNA, 419 bp, Zea mays
gacatggatctgtcgagtcgatgggcggaaccgctgaaggaagcagaaggcgaggtggatcagtggatggcgtattggtgtcgcgtctcgcgtaagcaagtggggaagacttcatcgccgtgcgcgcccgccataccgcgcaccgccacctccatcgcgcgccggccagcccccgctcctccacctccactacacgcgccggccagcccccactcctccacctccactgcacgcgccggccagcccccacttctccacctccaccgcgcgccggaagcccccgctcctccacctccactgtgcgcgccggccagcccgctcctccaccgcatcaggaaggcgagccagagatcgagcggcccgagaaaaggaggaaacacaagcttaatcagaagccgaagcccagggagctcaatcca

SEQ ID NO: 5839 - DNA, 1500 bp, Zea mays; identical to SEQ ID NO: 5817

SEQ ID NO: 5840 - DNA, 268 bp, Zea mays
ggttttcaaggatggacaagcctctcttctttctgaatgccagagtgatttatagatatactaaactggttatcatcatgaaatttgatcagaaaggaaaccttgttgacaacagaatataatcaaacaagctgctcagctcagatggaccaaaataatgaacgcacgcacagtatattgaaccaaaatagtgaacgcacagtagaaaacagacggagaagttagcgcatgttgaacgcacagtatgtattttactgtaaattaattg

SEQ ID NO: 5841 - DNA, 1500 bp, Zea mays
  unsure (1)..(1500): unsure at all n locations
ttggggtagaaccgaacaagccctaaagtggtgtggaaagtcttagcttgggaatactttgatgtatagccctcattgctactctaagagcctttcacaacaacacttgtgggaggaaaggtgtttcaatgatacgatggtctatccgttttggaacatgtacaaggaagagacaaaatttcagctgtatattggaacctgtgttgaaggtcgcctgccctcaagagcaagagaagatattatgttaagaaagaggaccatcgatagagtgcgctcttcagcgagttttgttgtatataaacattttttccatgttaagagcatctccaagtgtgccccaaatagatgccttaaattgaaatatacggcttaatccaaaaatatatactccaatattgccctattataaaatttttgttaaaaaaatacagggcacgtgataagtgccacaaatatattgcacctttttgggctgtctcatcttaattgtaacgaacctgaacagtcacgccgctctcctccgggctacccacgatcaccccttccytcctccctgcccttccctcctccgccaaagtcacatgtcatcgccagaacacaccctgccctcytccgcctcccctcatcggccattggccgccacccctcaaatcttcacgctcttgctgcgccactgcctcaggtccctgcaggattgccaacgaccgaggggcatgcaagagtgccaacgaccagacatgaagctctgccgcgtgggaccgatgtagtccacaccaccaccattcactacccatttgccaatgttcctgtttttggttcgatgaatgcaaggcaagagtcgaaatccgaacgtttctgcggtagcttgattctgaatatacaagccatgattctacagtgtcattttaatgcagtgtcatgattctgaataagtcacggttattgatttgattatagtttcgattaatttatctgaaacaaaagagaacacgtgtgctgccttctcatagcagagctttcatttttgtactccttctgccacctacaacagttctactggaggatgaacacagattgttaggtttgcttgggatttctggtgatccagttgcaaccactaattagtagtgtttattttcaattcctggaatttgccttagcccattagatctcttaggccccgtctgtttcctttcattttgaggaattgaaatcttactaatggaatagactatttttttagaatatgacattccaccactttccaaagttatcatgtaagcctatctcaaattcataggtgagagatgaaaattgattctatagatttacatgttattttcccgatgtacaacttatagtgccatcttctacttgcgccgctataatataaatatagtatataactatctctctcatataatttaggatgatatacaaatatattacatatataaatatataancttaattagttttgtctaaattataattattaaa

SEQ ID NO: 5842 - DNA, 398 bp, Zea mays
ctccatctgatcgcacagtccaaaaccaccatgcaatcataacgacgtccgtttcgtaccgtttctgcatcgagaagacgcggagcagcgaccggatcaaacccagccacacccacaaacagcaacagcctggagaacgggcctgcggccgaagagtcgccggcccacctcggtcaacactcacaggtcaagggacaacactgtctgatgtaggtgtacgtgtagacgtgtagcgccgacttggccagcccaccccagcccagcccaacggcagctcgctttgtactatataggggtcaggaatgctccttgatagataataatataaccacagaaatccatcgacgaacaactgagaagagctgcgcctgcgcctgcgcctgcgggaaagggagaac

SEQ ID NO: 5843 - DNA, 1278 bp, Zea mays
aactgtgttttaaaactgtgccgtaaaatagactgtcctgtgaacggcggagcttagcagttttgatctagagctgagcggcggcagagcgggggagggagaacggcgaacagatttgataggggcaaaagtgtccggtcactagctgccaatataatcaaataaggttaagtttcaaataaccccctaaatggcattttgtttgtaagacaacgtttgataatggtctcttagcgaagcgtgttcccataatggcatttgagcgaatcctaagtttcataatggcataaatccaattttctcgcctatctctgttctactgtctgtatctcatattctcattgcattgcacggaaattcacagctacgtgcccatccgattctcgcttgacacaggggaaattcacggcctgctgctacagagcatggccgctgagcacactgtggtgcccgccgtgacaacctgtctccctccctctcgccagatgcctcggacaggcgtctagttgggggggggggggcggagatccgcgtccaggcgaggtctgctctggtcacctctggcgatcctcctccctcgcccatcgcctccgccgatcaattcccttcgctggcactcagagatcggcgtcctcctcccgtcttcccacgcttgcgggtatgcttgtgctaatcctagtgtagcagcggtttctttctgtatagatagttcccgcaacagtggcagctttgtattatcttttccgtggttcggctcagcgaaatggatgaagayttgatttttctgatccagccacttatgatgtataattcgatcttcaagcatcacagaagcyagaagccattgatgcaattggccatggctaagctgtagcatagccttctttgaatttgaccacatgagttcagtttaatttcagttcagttcaggaacgacgtaacacggatggtggtttcaaaaaccattttcttcttcagcataaagcacaaattggaagatgaattagtcaaccgtgtgcttggttttgctctcgatgaatcccaaattttgtcattcttctccattcagatccttgtgtaaccctactggtgtagtccaatccatgatccaattagtgcctaatgcgactccacttataaatgctgcattaagaatgtcctctggttatttattatgtgatgctaaactgcaaattaccaaatcaaggtgtggatctgtctgtttacctttctgctgttatttgctctgcaggcactaactcagagtagtgtcgctca

SEQ ID NO: 5844 - DNA, 1500 bp, Zea mays
gcatcaggcacatgcgtgcatggtctcctggtccaatggctacagccgtacaggctaccgaggaaggacgggcctacagtacaattattatagagcaaggcaggtacaatggctcggttcggcgctggatccggcgccacggcgggccggccggcgatggagccattggcgcctttggttggctgggagctgggaccacggcgtccgcaccagccatttgatgcgctataaaccaactgtgccacggtactgcaacgggtgtgggaggaaggatccatggggttgggctgtgtgttgcgggagacgatggtgattggctaccaaccatgtcgcgaacttaacccaaagaagaatgtttcccttctgattgttgcgtctctctgagatcttctttgacgacgggagtgaaccaggttttatagaagctaaaattaaagagtcatcacatatataaccactaatctactgtgaaataaaccatcttacaaagcagaccgcgggacagaaacaagcgaacaaagaaacagaagacaagacgccagagaggcctgaacctgaagcaacaaccagaatcaactaccaataactagcctacagaacatcttcaacatccatgtcttcggcccttctccaaaacccttgaagccgccatttcatcgtcttcaacttatcatccaaaaatctgacatcccactctctctctctcaaaaaagtgccatctctgtaaaaaaagtgaagattttatgaaagttttcattagaactcttcgaaaatgtgatgctctatccctattttgtttcgtacattccacaaaccacataaaatagcagtagctaaaatggaaagttctatatgataatctctactccccatagcaatcctggacttcatctagatctatcggaaccctatcccgtcctaaatagaaaatcattcaccattctcataaaagtacccttcaacaatgtcccaacattcttgtctagacttagattttcgtcaagcaaaacataggtcttttgaacaatcctatctttttagctttatgattagcctcaaagtagcagctctcaaatgttcctttagtatcaattcatttaagawtttctattcyatttgcctccaaacaatatcacaatccctcactgagattctctcgcgccatcttgtggagtgtgccatataggatcccatctcggcccatcaagtgctgggcctggcaagcgtcttgcgccaggcgcccagacaggtggttcgggtgcaaagcccagccagacgcaacaaattagaatggcccatccatggcaccagcgggcgctacgccatttgcagtgagagcggaactgaaaaggccatttgtagtgaaaagcaaggagaaggaaaaacgcgaaagctttccccctgctcaccacctgctggctgctgctacagtgctactgccattacgccaccacacgagcttgcgcggcgactcggcggcggtggacgaagcgggacgcc

SEQ ID NO: 5845 - DNA, 72 bp, Zea mays
gggaataggcagcctgataccacattgctattgccatggtatctttcacctccattttttgtttgatttgac

SEQ ID NO: 5846 - DNA, 669 bp, Zea mays
ctttccggtttttcattttgtagtaaaccgatcgatttttaatgcaggtaagacgattgttttgcctgttgcagctataatccatagagataaaacattgtattagcagtagaaactaatacggattaaagccaaacgaacacgaaccgatatttttttttaaaaaaagaatgcacataccatagtccggcgatacaatctctccatatatatagaagcatgcaactaaacagtcggaatgtgtgcttgcatggctgaccgacgaaggtttcagtttgcgcacacacgaaattttcgaactgatcattcaaaaatgccattagtaagagaataacggaaaattccttaccctccccccgtgagtccgtgaccgaaatcaatgcctgataattctccttttacagttgcagccttcttctggtccaaaagatccaccgttggagtccatctcatacccggtgtaccaggaagatacgatctatatatacgttcgttttacatcggcagacgtcacgcagctgaccaagcccgcatccaccacagcgacggaggataaaatccgccgcggccgcctccagccacctcgaatctctcgcttctccaaaaaccccagtcgcaagggggtggagccgtggagggaagggaagggtgtacagcagtgccgtggcc

SEQ ID NO: 5847 - DNA, 632 bp, Zea mays
ccagagagcaccacgtttccgcaacacatatatgtgtcacgtcggctctgtgatggattctcaaactccaccgttgcacttttgaagatggctacctttagagttggcttggtaacctgaaaattgagagggatttataagagaggaattctcctactatttaaaattgaatagcaagaaatttttcttagtcatcaaatcagtcctagatatttttttttttttttgcctagaccgaaatcgccttcactgccactagcgggtccatgacaacctggccccgctgctgagtatatttggagggcccacttcacactcagtccaatggactccggccgctccggctccgctgcgtgaacggtagtcgcgcgcttttctcgttatccaacactcggggctgctacgtgtcccgcatgggcctcccccactcaccttttgtctcgcccacagccgcacagccttctggtctatgcccgctgggtccgccagcaccgggccccacttaattggcttctctcctgtctcctcctcggctctgccccacaccgccgtgttcccctctcttgtcagttgtcccctcccccgcttccctttccttctcggaagagacgggcgcagacggcagagccacc

SEQ ID NO: 5848 - DNA, 1500 bp, Zea mays
tcatccacttcaattcaatgcaatcgggatggatgcatgcagagacggaatggacggaacaacaagcagattgtttgttgcgataggggagggaggcgatcggccggagggcccggcggcaatgatgacgaccgacggtggcagccgagcggcgcagcacagtgcggccgtagtacgccgcaggggcagggtgcaggcgcagagagagagagagagagagagagagagagaggtgtcagggggagtcgaggagatatcgcatcgcatcatcggctccgcccggcccgctgcggtcgatcctgtggcggtggtggtcgcgcagagttaaatgcgaaaatgctcgggcggcctgcgggcctcctgccgcgcgcggcgtcgcccacgaggcctgtgcctgcgcgcgggcgccctcacacgtctcctcgctcgcgcagccggccacaggccgggccccccagctgctcgatcaggggctatccgcactcatataactctaaatttctactctaaaagaaatattccgtccttgtcagcaaacttctttactctataccataaatttccgcagtcatgtttactctatatttcaatcctatactaactaccgtatattatattcttttttcaatttttttatacacactatacctatgctggacccgcctcacacctgcagccgtcccacagttgagcgctatatctggagtttgaggctgcctcggcattgatgcagtagagtgtaccgtccgttgctgcaggctgcgagtgcacgctaaagggtataaggggattttaccgtccatgagtgcggacagcctaaaagacgccatcataacgaaagtctatttgtgaagcgccagcaaaaatctgcatagcaattgcctccaaagacctgcatagcgtccactgtggttgtgaggatccactcgattccgatgcttatcttgtttggcgtctcattgcagtatctgacagtatcatatcaccatcagcagatcatgcatgacccgaccgtcatcatcgaacggaaagctctcgctcgagaacaggaggaacacacgtgtagcaatggatcacttggagactggagtgtttaaggccctgttccaatctcgcgagataaaatttagcagcttttttttagctacttttagccatttgtaatctaaacaagagagctaatggtggtaattgaagctaaactttagcatttcaattcatatagctaaagtttagcaggaaactaaagtttatcccgtgagattgaaacggggcctaaaactggcgtgcgcctagagagaggcgtgaaagccgtagaccgtagtacgtgttttatctacagccaccgtccacacccccatttttttatctccgcttccactgttccaccaaaccaagccgagaaatttctcctaaatttcagatcaaatcctcctcctcctccccctctccctctccgaggattctgcccagcagcgcggcgatccgcctcgatccgga

SEQ ID NO: 5849 - DNA, 184 bp, Zea mays
ggtgagcccctagcttctctgttttggttggctgcgaaccttagccgccatcccttcccgtccggtcttgtcgggacgcgattcgcgctgttgcgttgcgcggatcgctgcggaatttcggtttccctgatgggatcttcccgccgctttgccgtgcaggtagttctggttgatttggttcaag

SEQ ID NO: 5850 - DNA, 556 bp, Zea mays
tgtaatcagatgtgatgtttatgtgtctactgatatcatgaatattgtatgaatgtgtagatagtatctcctgtcagtaacttagtatgcaggaattatactgtcggagtgaagtcgactttctgtgggactttctgtggatatatggtcaacgggaaatacttattttcctatcaggtaaaaaaagtattttttggcggtagaaaaccggcagatataattccctgtcagtacatcgtatttttctgtcgtcattagccgacagagataaaattatagatcaggcggcgactgataatttttctgttcagcatgtgctgtgctgtgctgtggaattctgcgtgacttctagcagccgaattaattgacctgttcctgacgatatcgcatggctgattcttctccactcgcctgccaaactactccagtcaagtagggacaacgcgtataaatgcgtccctttgcctcttccattgatgtgtgcacggcactgcttagttctttccaaagagagaaagcaacaaaacaatcaggggtccatccatttttgtcagcc

SEQ ID NO: 5851 - DNA, 715 bp, Zea mays
gttcagacactagtgccgtgtcggtatgacacggctattaaacgggccaaacaggccgtgtcctaatcatgtcatgcctggccgtaatcggctcgtgtcgcgccgggccgcccgtttggccatctatactccagtctagtctaacatctatactccagtctagtctagcgtttgaaaccaaactaaaaaactgttcacgcctttgcagcattgaacgtaactttgccgtcgtgtgtttatatattaaattaatgaacaaacaaacattaaatattcaaggacgatggaatggaaggagtactatactactgcgtgtgctgtcaatacacttctttttttttcttccaatttttatctgatactatatgttactgtatgcatgtaataatcaaatgtggcgcttataatcttgatttttataatgttcaagagagtccacagcagaacggcaaatgcacgtctctggcacaagtattttaatataccacacatacttcacggctacggacctgtcccattggccgttgcatacagtaaagtaaagcgtaggagcaccgtatggcttcgtacttaacaataatacaaatctgtagcttcttatatatatatacacgcataccaccaagctctaatcaccaaatcaaaaggcatagtgcacagcatcagcagcaacagccaattgacaggcctgatcgatcgagtagcgtgatcgacc

SEQ ID NO: 5852 - DNA, 1500 bp, Zea mays
ccacacccgcgaaattttttaattgaacaaagaaaagaaaagcgagatgaaaagcacggacgtgaggtaaataaataaatatgctgtttggtttattcgataacgttaacttatgtttgtttaagtctaactgtaataatataccatattataaattgatattggcctatttaaatttattgtcattgttactcgagtgtcagtcgttactgttgtcatttatattatatttcgtgaatgcatcaaagagtttacgctacatgatctatggttagggaggagtctgcgtacggaggagaggagggtctcagtggccagcaagagaagagaatggacacgaagcatggcagatggtgggggcaaagcagtccattcacaggaccacccccgatcccatgggcatcagccatcagctatgcatggccaccccaccccaccacagcagcttttaaagataaaccaaatccgctgtcgtccctgccctgcatcgcaacttgctcacaggacacagccgataagcagcggccaaaacagaaagcgcgatttgtttgatcgcttcctcctccactaccactagctagcctgccgccgtccgccgtgcagtgtgcgagctccgcccgccggtgccggaggcagaggaggaaggtgagctgccgctgttgttttctgtccccgacttggaattcatttctgcgtcgaggaagctttttctcaaatctgcatcgcgtattttccgcaatgtccttttttcgcagaacaaaaaagccgttttttcctttcctgttagttattggagtcagttaggaatgtttttctgatgatgttggtttggtcctttcctcgtcctgaaaagctgcctcttcttctgccctttgtccagttccctctctgaaaaaatcgcagatttctgttagtatcatcaccagttcgccatcatctccgctctgtgggggcagaagctccgcttcgttccaagaaaggcccccgcgtcttcctccgcaaaacctcccgggtcatctcatatccttggcgctggccgagaggctcctctcgttgcctgccggcgcactggcgcaggtaggtcgcgccattgccgtcaccccaactgccccccacacccgggttctttcggtctcgtgctttaaaagatggtcttactcttatagggggaccttaattgccacaaattctccaaggtcggaaatgatttccaatgttaactgaaaataagttgcaaacttcctcaacggtgaggaggctggcaactggctggacatcaagtgatcgagccactggaaatgtttctctgtcaataagtttctctcttttttatataaaaaagtgtccagaaccactggtctgtggcttgcaattctttagtcacggtttgactgcctacatgtgcctaaaacaacacaccaatttcgccatccatccattcatgtgactgctcgcagaactaacgagctaagattcctcccctcaccggcgcttgttccc

SEQ ID NO: 5853 - DNA, 1500 bp, Zea mays
ttgcatgcataaatgatcggctgatggtttctagtcaaagttttgtacagaagtatattttatataaataatccattgtagtatatcttggctcactgctgacaactcgatgaatcgcacgggaaaattaattgctggcgcattgctctgcgccgagcgcccaaaaaagttccctggaacgaaaattttccacagagatttcatcttgcgattctcaaagctccagttcggctctatagctcggcggagtccgaatttttaccgtttcctgtcccccaaacattgttagccacacacacacttatagttcttcctgggtgccaaacaactggagagcaacaacctgctcctttgatacattcactccctatggagatcggagaagataaaggacttgttcgtttgtgctgaattagtgggtcggaacgatttctaaccagattgcttctctaatttatataaattttgattagccggaacgatttcgatacaatccgacacaaacaaacaagacagaaataaactccatttatctctcaatctcacccctgacccccctatccctacggggaatggctgacaaagagccactcgtacccattcttatcaccctccgctgctgcgccaagcatcatgtaacgcctgaaggaccgagtcgcatcattcgctcgaaacggaatcggacaaaagatgaatggcatcactgtaccaggcgtagtgccaccaccgcccaccccgtcagcccgacgccgacggcttcgaccgtgaccccgtgctggcacgccgcatccaaccaccctcttccggttccggaataaagtcctgcgtcctttctgcgttcggtggcgtggtcggttggcgtcggcttgtcgcggggcctgcagctgcaatccttccttcacgactgcacgcatgcaaatgcattcagactgaactattcacaacaggtgcccaaacagaatataaataaaaaaaacaaccatagttcctccaaacgaaagagtggtatcgataaccaaccatccttttcgtacctcttcttgaacgcagagttctgcgaggagggacaactagcccctccgtcaacactcaacacaaaggtgacacaagtctgactcatggcgcatcagcaagacagcaatggatcaggccggccgcacgtacgcgaacgcgcaatatattgcttccttcaaaaaaaaagataagaaaacaggcagaaaagatgcaaaacagtgggttggcgagataaacaagctcacctcctcagcctgcagtgccaaccagaacagtccctccctcggcctatccggctactcagcaccaagaacagacggccaagtgcactcgcgcctttatataaaggaatccaccagcagcattagctttggtttcttctccttgtatgcacacaaacccatcgcagggcattctcgagcatagcttctctgcctctctctcccctcctctcctctcgtccactcctttgtccaaagcttcgag

SEQ ID NO: 5854 - DNA, 299 bp, Zea mays
gggtgtttacatatatagtttgagaagagataaaaaaatcctacaattaagccctctctatatatatctatatatgtactcagagagtacatcgttaattatatgtgttgtgttatggaattaataccttatttcctatttctgagggtttaagccgtcgaaaattcctcgttttagtgttgtgatatgtcattagttatgaatgctgctgcaaaatatatatgtacatgtgtgaggtgtttgctttatgatatgtgtattaattgttcctgatataaaaaatctttatctatatcatc

SEQ ID NO: 5855 - DNA, 264 bp, Zea mays
ccagtccaccttgagacactagttagtggcatgccaaaaactagtgtcggcgtgcctgccaacctccggtagcggatagggcccagcgccatacacccaacgaggcagccagcgaagaaagggagaaagaaagacacatcaccgcccactcccaccgcgttccttgtctcttccctgtcccgactcccgacccgatctcccaycgcgtcgggatcctcctgcccgcctacccgcccgcgcgccgccgtcccgttcgccagaacc

SEQ ID NO: 5856 - DNA, 727 bp, Zea mays
tttttctctgcgccgcgctatccaaatccaccccgcggaaggaggctggccaaaccgccgaagccggaatttcaccgcaagtttgcagatcagcccaaagcatttccaaaaaagacccctgttgggtcgagacttctaatatagatcctgtgttttttcagaaagacacctagcttcgatcgctgatggcaatcacggcctatatattttccaaaagaaatcctaattcgggtcgtgactcgggagtaataatagccgcagtttcgcagattagcccccactcagggaaaagtcgccgcaatttgactacagttggaccgttggacgcactaacgaaagcaaactctatgctatattaggacacagaaaagatcaaaatctcgcgttcggatcagcctctctgtcatgtcgccaatacagcgcagcgctccgcatccacccaaatcggagtagggtcgtcagtacagcgcgacgccctgccagtagccgccgcaaccggccgccggtcccgcgcgaggggaggaggagatcactgcggcggcgtcttctgccggtttgaggtagctgcggtcatttccgttcgcgcttaagctaattggagttgttaatttggaggggaagaagattcagctggcttactccggttcgggttttcttcttcttataagtggatcgtcaaatttcaggattcggggcatcactgcagcagctggcgccaggctccagc

SEQ ID NO: 5857 - DNA, 120 bp, Zea mays
tgtaagcttgttgacgtcaatctcaaaagattcacgtgctgtcattaaaggaatatccaaattttaactttgtttacctttgttttctggtacaatgctcaggatgctctggaaccttac

SEQ ID NO: 5858 - DNA, 73 bp, Zea mays
ggaacagtgaaaaaggaagaatctctgatcgaggttcctgtccggcttgcagaatcttggcggccagccatat

SEQ ID NO: 5859 - DNA, 199 bp, Zea mays
ggtaggctctatcacaatggatacatcttttcagatgaattgcctgttgctaactcattgaccaagatctggtatctattgcagtgacacaatttggacagaaaaactatatttttcatcagatgctgcctttctggggtattccctcattttggcgatactgcggactttaaatttaagagacgaagcatctagagtt

SEQ ID NO: 5860 - DNA, 149 bp, Zea mays
tcgccaccgcgggtggcttcttgctcaggaaggcacgggaatcaagggactgaagagccgtctgctgagtgtgttgtgtctgatgtctgatgtcagagtgagtgacggcaggaggcgaaggcttgctcacttttatagccgcagagcag

SEQ ID NO: 5861 - DNA, 1500 bp, Zea mays
gggctcttccagaaccacctggaacatatatataatcttattggcgcaccgagtcatcatgtaaatgaagatcaagcacaaatgtggttgttgtacctgagaatggcaatgaaaactaggtcatgtttggcagagatgatttggtttctaaaaaaaatgttagagagaaattgagtccgatttacctgtgacaaagaagagttttctggtttatagttccagtgggaaaaaaacggaggaatatttttcaatcctgactctgaaaccccgtaacatctttctaggggtcgacccaggttctctctagaaacagtagaatcactacgaagaaatacactcaaatcagacaagttaggtcatgtttggttcatagcttatttttagaatctcattctacaattaatcttattatctgccaaacaactactagatttattctgtattggattttctgtcgtcataatctcacgatctcaacataaggtgatacagtaataacatatgtattgaattttgtgcggtatccaactcctcaaaatctacggcgcatcaaacaccaccttagaacaccaggcaacaagaggtacaaaaggctgtagttagtcttgccgtggttttagttttagttttaatttgagttccatatatatattagctaactagaacaaggggtgaataattaaataatgtctttctttcaacggtatatgctgcgcgatcgtttatgaatggtgatacgaacaacaaaaacgaagaagatttcgatgacgaactttagccaacgcctctctgtatagcgactaattaaaaacgcattaagcatcaacatgatgagatgcctaccaaatacgtagtaggatatgtacgtcgtcgtgttcatccgtgcctccaaatgtcaaactcatcgttttccaggtgctaagcagtaagcgatcgagcgagcaagctacggatttctttgctattgtatcccggccttttgatgtaatgacttggtattttaatataagcttccattatcgatcgaaaaaccttgagggcctgttcggttctagtggattgagcacccggaatgattccgggctggattgtttgtctaatttatataagagttgatgagctggaacgattcttggccaaatccggtataaacgaacgcacccttagaccttgttcgtttccgtcgaattggacccggaattgttccagctaatcaaatttatataaattagagaaacaatccggtcagaaattattctgacccaccaatccgacagaaacgaacaaggacttagtacttttgaacacacgcgcccagggcggtccgccaccgcagcagcagaaggtatgcagtatgctactgctgctctccgcctagcggccggcggctatatatatgcatgaatgggcggccatccttaagcagcaaataaaggtagcatatatagctcgctagacgagttgcagagagcaagtagattgctatatatcagcaatata

SEQ ID NO: 5862 - DNA, 1500 bp, Zea mays
agcaagaaaactgtgaatagctagctgccgccttcaaacaaaaaaaggatagcgttaaccttgccgaatcatctcagatttaaaatgaaatattgtgcgctggtggtcttgaacaaaaaactttaaccaatgcaacaaatcaagcaacttaaagaagggtgatacgaaataataagctgtcagataataaaaatcaagcaatggatttggcaaaaagatgccaaataaatggcatgacgagggacaacaacgtagctaatttccctcggcagcgataccgtacctctctacccgccgttctcgccaaaaaaaaaccacgaaagcaatcatggagaggagcgtaataatcagcaggttggttaatcaaaatcagtaacgcccaccaaattctgcagtgcgcccaagcaaccatttccttagagccaaaacaatcaccggcaggctaatttaattccatttatttatgctatggaggggagggggggcaccagattaggcagccaaagcttcaattgttagcaatacacagcaccaatcacatgaaagcaaggaagcacggcttccattcgttgcggcatcaatcctccccctatgtgactgccgctgcaatctgacatgcatgccgatgccatgccaaaaaccgtgtcagcatccagcaagatttccatgtcaccaaccctagctatgtgactgactgactgatggttgatgatgctaccaaaccatatacgaggggagggaggacaggaggaacaaaccccatggcccccacacacactccctctttctctcctttatcagggaccaggaaatagaaccagcaacgaataataaacaaaccaggcaaacaacctagcccgagaaaagcaaagccaaggagggtggaaattgcactgatgcattggcaggaggccaccacaatcatgcatgaatgggtccagtcctcagtgccccaccacctccaggtttcctctctctttaaaactgaaggaaattaaaaaaacggaaagaaaaaagagaggagatatgtgcctcaaaagctgagaagagagatagatagaacatagaaaggtagagagtggggaaaaaaaggacatgagagagagagaaagagagaggagggtggggggagtatcaagaaaggagaggctttgcatccaagcgtgctccccgtgaagcaaccctcccctccggtcagcgtccctgttgaccgaacccgcaacggaacggaaacggagtggtggaaccgaacccgcgctcggcgcttccccttcctcgcccaccccacgccacgacgcgacgaccatgttgtgcagttgtgctcctctccttgcctgccttgggcttcctatcctatactatatataactgtcctcctccggcaccttcgccataacagatacaggcaccccctcctctcctctcctctcctctctctccctctcatcaccaaagaactgcaactaggaacggttcgccacaaaaaaagaacgtacggct

SEQ ID NO: 5863 - DNA, 1500 bp, Zea mays
acatcaccattattccatccccctgataacgatcgagccccagccctccctcgctctccgggctgagctagccggacgaattcgggcgtgcggcttcgagctctcgcttatatcagcgccgcgcgcgccggccggcggccggaggagccactatcatccccggcgtttgattcggccagagcagcggccatggtcgaatatatttgatctctctcgatctgatctgagctgagccggctggtggcccgggaaggacgaagtgtgtcgccacctataatttgatgatgtttgtaagtggttcttaatggatctacaattctatactacatatatatactacacgctagctatgccggattttaagttcttctctctctctctctcctgttcttaattgctcatatatttgctttgtttacactccgagaaaaataagttttcattttacactagtgcatacgtcacacactcccttgtttttatatgtgggagtacttgttttctgtcttttggggaacaaaacatatataattctttttttctcttttagtatatatgtatacgctaagcagcttgcttccccaccttcagagcaagggattggaagaggcacaaggcagcccagggacccatttcaatctgatttttcaaggcgactcttaattttatttgttcctcatccccattattctccctccgccggtttctaacttatttctccagcatttgttgttaatgagctttggataggattatatataggtgctagctgtaggacttttaatatttttcttgatgaacatcgtatatttaattagcatgtttctataacacacaccttcgaattacactggctgctgtttttttttcttttttggaagaggattctagtttactgctgcttgtggagtaaggaaaatttaagcataagaggaagtataataataacaggctacaagagagcataataatggtgagctggagcaaagataaaaagagggaaggaaactggccgggttgtaagtctactgtcagtttctacacaggaattaagaaactttatgaaataaaaaaaatcgatcagtattagtattgaagagctaaccactctatagatataggctgcgaggacaagctgtatcattagttttgctataaataaagagagctacagtccactatccacccaagttcatgtttcagtgccatatatatgcccatatctttccgtgattcgatcgatctgaccagtgccttagtagcaaataaggctgctcgtttaccagtggacagcagtgggcagatcgatccatatccacatgttgctcaccagcaccagcagcagcacgcactgtcatctggatgcgccagcgatctcatttcatgcatgcccaattaacttcccctgcagtagtctcgactgtctggttcaattctgtactatcctgatgatgatccgttattaggtgtcatcatgatcggtggctagcagaataagag

SEQ ID NO: 5864 - DNA, 1452 bp, Zea mays
taaccaattaatgcattatccaacaagtatccgatatccgataaaataatatttgtatccgtcacttatccgcccggataaatatccggtccctgtatccgtatccgtcccgtttctaactatccgtatccgatcccgaatccgttttaaatacattagggtaggatacaggatgagctactatccgtccgtatccgcccgttttcacccctatgcagcgcaatgcaggccgaaagagacgccgggacgggccccaggcactgaccattggtcaatccactgctgctctgtagctgtagctgtgtaactgtactgccccggcctgtgccctgccccccacaatggcaatggcaattgcaatgcaagctggcaccggcgggagcaatggccatgacccctctcacaagccaaactctagaagtgcacaattcagacacagagagagagagagagagggggacattgcatggttgattgcggcaagcgagagattctgattactattattataattctaatcctaccgtgtgtgagtagatgataaacaaatgatagagagacgacgacacgagaagaagatcatgagacggcgtccccatccacatgcctgccctgcttgtatggtcgccgcccgtcggtatgtagaggagtatataaactccccgagggcgagagatttccctcgaaaggtggaagaagcaaagcatctcattccccaggccaccccccctctgccctccctcacctccccccctctaccttttgtagctttcccattccccctcttgcgtgcaagcatcttctccggttctccccgctctcccatctttaaccgccccccctccctccctctccgtggtcttggaggagctcgctgttctacggctggctgcctgccgcggcgatccctgtctgttcgtttccgtcgcgcgggagccgcggttgcttttgcttgcttgcgttgccgcgagagaatcgtgagcagagagtgtgacctggccttattggcgtcttccgtgggcgggggcgggggcctgggccggggccgttgctggctgtttgttcgttgcccatcgatacactcctcccttgtctcccccgcatgcaatccgtgtgtgtgtgtgtgtgcgctctgcctctgctcgccggcgttggtttcgtgtgtcgcctgcctgtcgtcctcaccgcaacgctactcgttaccagctatcaactagcattgccttctccttccgctacaagaatctgacgagcccccctctccctcccgtcccggcgctgttcccagctcgctcctttcgagagtgtactgtttagtccgcgcgcattgctcggaccgagccaccgagttcttgccgcgcgccgcagcagtagagccattgccgcgttcgctcgcgccgcgcggttcatgcgccaggagtctgaggcggctacctagttaacggcgggggc

SEQ ID NO: 5865 - DNA, 1500 bp, Zea mays
ttctctgtgatcgtctctgtttaattctgagcatgtttaggacttgacacgcgcatgtgcacgttatagtactcgtctaacttattgttctgtcgcggagcatgatcttagtaacacatatgattacacactcgtctatttttaagtgacaaatatatatatatatatatagttcgtgtaaacgctatgatcccgaagaatggagataaagggtcggcggtggttggtgacggcggcgcgaatgacggtgtcacgggagagggggagctagctaaggatggcgaggttgcggaaaagggagagggtcgagggataaaatatgattcataatattgtttcttggatttgagtaaggaagagtggttattcggctatctgaaccgttggttttgacagtgtgtaattctggttgtaatttttttgtggattttagtcgaggttatgggtcgtggggtggtttggctgagtggctttttttgcaaactttaaactgatagattattattagtggtacatatagatagagtgtgtatatatttttctcatatgggacaatttcttgtatgccaccaacattaaccaataccttatttatcgtcgtaaatgttttaattcattttgtgccacttagatagtggtacataagagattatgacatgcaatttttttagagcgtgtttgaatgcactataactaatagttagctactaaaattagtcgaaacatccaaacagtctaactaatagttcatctattagatacttttagcaaattaggtaatagttagctatagctagctatttgttaactagctagctaattctactaacaatttttagtcaactaactattatctctagtgcattcaaacactactaacctcctatatcactaatgatagtatggaaggataaaaagtgctatagaagtgacgttaccaagtaaaattattgtagcatacagagatttttttcgtacagggttcacgcgtgcatgttttcaacgagtggaataaatttcgtatgatgcatagcaggtggaatatttggttcccaaactatacttccaagtcccaagattttcaccatgcatttactgagtatacagcatacactactacttgagcttcagtatgaacgccactttccgaacctttgcgtttgttcctactcgtcatcaaccttcatctattctctctgctgtcagccaggagatattcaccccactcttgcctcttctctctttctctctcccacacacactttctccatacccctctctctctagtgagcttccctttcctccactacaacctcaattacacctttagggctgcaagcacacgcttctctttcactctctctccatagggagtacctactagcagctgcaaccctggccatctcatctctctctctctctataatagttccccatctccctcccagccacagctcttcctcttcttctctatcttcagctccactccaccactccacc

SEQ ID NO: 5866 - DNA, 139 bp, Zea mays
acgccgctccaaattagttgtgctttgctgttatttatagaacaagctgttttcttgaactgaaattgcatgtactgttagcgagttttcttactctggtttgcagagtattcatgtggttacaactctggagaacaat

SEQ ID NO: 5867 - DNA, 1500 bp, Zea mays
ttttaatactttaaattattgtagcttgtttgtaagactgggtccatctgttttttttttcagaactgaagttcgttgaattggcatctgaacaatgcataaacaatttaaactctaaattatcgaagcttgtttctatgaagttgaaaacccaatagttagcagcactaacggttcccattctggtccaaatttgtattcatgtacagtaacaaacagtttaaattatctagctgcaaaaaaccgcttgttgcactttttacatgagaacataaccctttagcctcccataaactgtagtagattgagaacataactctgttcacttgttcgtcaaggagtggcatagatgctcccttggggacctggtgaaacgtcttaagttcgccaaaaaggagcttgagaaatggagtgcgatgctgtggttgggaggtggaggatgtttataggaaacaatgagttgttcgtttcggattaaagtcagttgtttagactgttgtagctagtacgtcataggatccgtcactacttccataacgcatgctgaaaaagaaatcgaataccaaatcaaaagaggatgggaggattggatggagaacaatcattaattactttatgcagattttcagggcaagttcggttactgcggagggtcgatcacaccaagtcctagaagatatgcagccccgaaccacaaccgtgatgcacaagatgctaacgatggagttctgtgtggagcgaagtgaagaaatctaaacataaaattttaaaactacaaaaaattggacgcatttatgtaaggtttaataataataaaaaaaaactatgacacaacataacgtacggcctcacgaaaatatatatcgtacctaataaatgcacgtgaattgtgatgaatatttgatacccataaaaatacatttaatatcagagttaatatatagtctacatattaaatattaaatcaattaattaataaatattacacattatattaaaaaatccgagaaaaatataagttaaaaagaacatgattcttattttatagactgctcctcctctctcaactaacaaatataagttaatagagcagagatagatagaaaataaaatgataaatgtttttgatgccttttgtgttttgttcttccttttgttctttctttattcgtacttttttttctctaagtcgtcatcgtacgggaaacgtggaagcgcagtgctcctcttctttccttccccttcccatctccgccgccgccgccccttactcctccagagttgcgcctcctcctcctcctctccagtggcgccgtcccccgcgccccttcctcctcgcagtcacggccgcgcggcacgtgctccgcctcgccgtcgccgttgccgttgccgtcgccgccgccaagtaaagagagacagggaggcgcagtagacgggggcgtggtgaggagggagtcaagcggaggaaggaagggggactgcggccggcggcggactacc

SEQ ID NO: 5868 - DNA, 166 bp, Zea mays
ggtgtgacgtgcatagctaccagcaagtgatcgaaatcgaactagcagcatcgggtcagctgcacgtttagttgcattgtgtgtgtgcctaagtaaatactccctagatatatacgtactatatgtcttctttttgtagggacagagggcatgcgtctatcttggg

SEQ ID NO: 5869 - DNA, 1500 bp, Zea mays
ttcaaaataatgggggggaataccgatttaagagtcgttcactactgcaattcaaaaaataataataataatattatatttattatattattatattatagttttattttattatattatagttaattatattattatattctaattttattatattatagttaatggttctaatttgttctgaattttgcagcctgcgactggaaatccactttttcttcttttcttctttgtcatctcaatagaatagaaagaagcgggaagttttctagtgttagcaatgtgtgttttaagatagaatccatcgaggagaataagcgaaactggatccaaaaaagcagaaatctattttttgaaaaagattctaaaaaagtaagtagaattagattcaagataaaagaaaaaaaggttttagtaattagtaaaaaaatgtgaatgaatacttgctcttttctcgattttagatcggattttttggcggcatggccaagtggtaaggcaggggactgcaaatcctttacccccagttcaaatctgggtgccgcctgatcaataaaatacttaggattatagtactgatcaaactcgacaaattcgtacccccctaagttggggcacgagagtaactaggtttggcgatactggattttgagaatccataccatagttctaccctcaaactagggtttgttttgtgggcagtggcccaaacggctaccaatagggatgaggtagcgtttccttattcttttattaatttaaatcgattcgattcgggaatttaaaactacgagactaagatgtcagaaatcttcgtagccaaaggtccctaaggggcattcttttttcaatctaagattgaagaagggactttgcgaagaaatagaaagacttcctaattatcatacattttatttatcgtacatcttactacatacactttatcgtacatcttactacatacacttcgtacatcttatgctacctacatacactaaagtaaaggctactgattctgtcgagaattagattgaataggctgatcaaaaatcaatttttggattgtggataagacctccttactctttcatagaaagatagaaagcggggcagcagtagggtttaggtcaaaaataaaaataaacatgggtaagttaggtatccaataaatatttatctatcctaattttatggtgtattcttacgtcctttgcttataaaaaaggtaacaaacgaaagaaaaaatctctctattcccgcgtcttctattcagagcatcccctactcttttttagggaaagagcgatgtatcatatttctacttaatgctctccaattctaccagaaatcatataagaatttgttaggagtaaattcctttaacggattcatccatagtcttagggcagaatggccttttgactctgtacccttgattccactatgattattgatcaatagtagaagaattctttcatagaaataggagacataatttac

SEQ ID NO: 5870 - DNA, 169 bp, Zea mays
ctcccggagaatcataagttgccaaagaatatgtacttcgctaagaagatgctggctggtcttgggatgacatatgagaagatcgacgtgtgtcccaacagttgcatgctattctttgaggaggatacgtcacattgaagcatcagatttgaacacgctaatgctatat

SEQ ID NO: 5871 - DNA, 1500 bp, Zea mays
aaacgagaaatctttgctatccaatctttttagaatatcataaagtttcagtggcagaatttttttytaggactgttttatcaattcatttttattccatttcaacccctgctaaattcgaactttcgtcgaaatcgtctctattcatatgtatgaaatacatatatgaaatacgtatgtggagttccctagaatttcatgtgattcagtaaacagaatatggattccatgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggcttggcggacgaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagaggaaaagcccaaagccatcccagggaacagtaaagcttcatagggtctttctgtccaggtgcaggtagtccgcatcttcacagacatgtctatttcaccgagcctctctccgagacagtgcccagatcgttacgcctttcgtgcgggtcggaactttgtccgtgtcaacaaacaattcgaaatacctcgactttttcagaacaggtccgagtcaaatagcaatgattcgaagcacttctttctgttcgtcaacacgcagcaggcccctacctggcgcgccaactgtcggcgtttcgaacccgggggggtccctggaccgacgagtaaattatcgccgcatgccccagcccagatgggtcggcgcgagacggagcgcgaaggggggaggcagtcggagggagactggcgtgagaggtggaatcccgcggccttcgtgtttgtcccccgcccaggttgggtgcgcttgcagtagggggttacaagcgtccacgcgggagggagcgagcggcctcacgcgagcgccgtcccgtccttccccgcgcggccaaccctctgtaagggggccctggtccttccttttataggcgcaaggagaggatccatgtgtacaatggggggtgtagcagtgtgctaacgtgtctagcggaggagagctagcgccctaagtacatgccatcgtggcagccggagaggttttggcacccggttcgtgtggtgtcgtggccgtcgaaggagcgctggagcctggcggaaggacagctgtcggagctgtcgagtccttgctgacgtcctcttgcttccgtaagggggctgagagccgccgtcgtcatagagcgtgcggggcgccatcattgcttgtctggcggagcgagccagatgggacgccggtcttgtttcccgtagcctgagtcggcttggggtagggtaatg

SEQ ID NO: 5872 - DNA, 530 bp, Zea mays
cgacttttttttgtcgagcaccaggtgacattcgataaagacaaaaagtattcaacaaagaaacagttgcgatgtacaatttaccgagttttcttttatcaagtcacacactcacactcgataaaaaaattaccgtaccgagtacgctggtgcccgacccgatgtttgaacacccactaacctctgtatgatggtgccggtgtcggtgtaaccgcagtccattttggaccatctagagcgacctctgtatgctagtgcgggctacagaaaaatgatggatatgcatgcactcagctccacgactcgatcgatctactggcagtgactcgcgtaacacgtgttttttcaaataaaaaaagatagatgccagtcccggtgcacatggcatgtgtcccggcccgatcgatcaggacacacccggcctatatattgagtacctagttacgtgtgcttctcagcagtgacgaactcgaagcttgcgttcttgtagtagaggtcggcagcaagcggtagagcgagaggtcgagaag

SEQ ID NO: 5873 - DNA, 145 bp, Zea mays
ggtacggggatacgatacgacgacgatccagctgtgaaacgcatgcgttaagttgctagcgtgtgatgtacgtacgatctggctgcaggtcgtggtgttcctgctgcccccaggcgcgaccatccctctgcacaaccacccgggg

SEQ ID NO: 5874 - DNA, 1500 bp, Zea mays
ttgtccaacagtccaacaaacaaataaataaaaaatacataatcatgtatctcaaatatagaaaaataaaccgataaaattaacattatgcagttcaaagttactaatcacaaggatattatagaaccaataatacaattttaaaaaaatcgacaacatatcccttattttaggcataattcacaagtctacaagtatataatagatagtagatagttgacattaactacatgttcaagtgttcattattttcatacactaaataaaacaacacaaatataatattacatgttaactactgtcgtaatgggaaagtgtaacaggttaataaatgttcaagtgttccacaaatgtagttccatactgctacacgttaattaacatgtccatttgctgcctttgcttaatgtcgtaatgggccatctggattccagaggtgggccagcagggaacatgctagcaggcaggcccagccgcccagaccccaccatactccagtagtccacaacgtcatcacgcaacagtatcctacccgaaatttacggatacttatcgagtattagtgatttcatatcctacttgtatctagagtttaatatctgagtactactcatgtccgtcctaataaaaaatatgtgtattcatatccaaaaatctgtcatgtttttataaccgtattcgatactcgtctcgggtacctgtcctattttcatctctactatctgccctccgtcatcacgcgaacacagtaacctgcacaagggcatatactaccctaagcccttagaacagttttttaaatataagagatagataagagactacatgatataaccctgagcatctagagaataaatacagccaagacacaatatgcatagagagtcgtgtagagacgcacgaatagcccgtctcttgatttttttcayttagctctctaaagaccccacaagaaacccctcatttaagagcatgtataagcttgacatcgttttacgacactctaagtataagacataactaatgcacgatatgatacaatgaacgtgtctaaaacttatgttttactatatttattggacccaataagaatattcaataagttcaatagaccaatcaactatgtcctccatctcgaacaaagaggtaagacacgtctttgttaagagatgtgacttgagtttgtttacatttacctttttagacacagacaaaaagacgactcaaaacatcggacttatttaggagcaatgtattagagaggattgaaagaactaaaatcttttttattcaaaattgaataatgaagaattatagcccctcatttaccttcgtaatcttgttccccactgttgtacgtgccctttgggttgtatataccctaacacctcacaggctgacatatcggcccgccgcatccccatggcatgttcccaagctgaacctttgccgcctgcggcctgcccgggaggcggcggctcattgtaggatgccacaccg

SEQ ID NO: 5875 - DNA, 952 bp, Zea mays
tcgccggccggacctctcacttccgccgccgctaaccgccgccaataattcagatggacgagcgaacgtggacgcggctgtaaagttgtattagtttcctgccgtaactgcgcctttatttacgcgcacgaaaatcttgtcttgccttatcccaaatcctgcygtaaacgtttgcatggtttatgctatcatgtatcacaacgttatgcagtcgtaaacgtctagaacatgcagatattcgtgcgcgcgattcctggcatgcaaagattccatttatgcatgagttatgcacatttgtacacatatttatggttgcgtaattgcatgtcgcgtgtaagacgggatacgtggttatcctttgcataaatggcgcaggctggcgtccagtgggccgaacgcgacccgatcggtctccctggctggggcttcgcccactaacggaagcccagggcttccattacctcttccctatatatatatatatatatatacatcgatgtaagtactaccaataatgattgaaagaattaaacatatttcttagtttttagaagatgtttgttttttagaactaatttgtagtccatttattttattccctaaaattgctaaatattgaaactacaactgttttaacttttatatctagtaatttagtgaataaaattaaataaaataaagggactaattagttcctaaaactaattaaactagagatggttagagggagagagtaataataacctctcgtactagagagtgatagaaccatggacacatttaaaaattccaacagagtactgacaaaaattgatgtggcatacatggaattttcccttcagaaaaacggcaggcgatgcgatataaggtagggtatcacccattttctcggtctatataaaccgaccccaacgcatccattatattcagcttcttgatctcacacgaaggc

SEQ ID NO: 5876 - DNA, 293 bp, Zea mays
cagtcttaatgaccattgtacgttgccctaacggcatactgaaaaacccatctattgccatctttcccttggccggttgagctgtggccagggccgccgttgtgtccgtctgggtctctcggactgtgtgcttggtcgtttgccaccccctgtggccttgtcccttgaattcgaaccccgcctcctgcttcccgatttcaaatagctggcccgcggtgcctgcagtgcagcactgcactgcacgcctccgccatactgcgacgccgccgtgcatcgcttcacgcagagcagtg

SEQ ID NO: 5877 - DNA, 182 bp, Zea mays
gtctattgacatgtgacagccactggaatctttcgatcgctttcagagtttcagttcagttggtcagcatcgaacaaccgcgagcagaggtgtgtatccctccaccagtctacgacctagcgtcgccaggcataacagtattagaccttgacctcgatctcctttccgatgagcaagcaaag

SEQ ID NO: 5878 - DNA, 166 bp, Zea mays
atgttattaagattttgtccattgggacctgaagggctgtgcgtttgcaaatcatgatagttttttttgtaaaaaaataaatctgaatctctctgccgacttcaggttccattttatcgttccgtttcagtagaaatacggtaaataatcatatcagctatggcct

SEQ ID NO: 5879 - DNA, 1500 bp, Zea mays
ctgttgcttgaaatgatacccctcagattgaccattttttttttaaaaaaaaagaggacgacaagataataaaattactcttccgacgacgaactctagcggtaaggcgtttcgtgtacgcaatgtaacaagagtacatgttaaactggtaaaactgacggataaaatacagggttgtgttgaacacacaaagcacgatggaccttgagctccctgaaagggggtgaacttgtgattgtgcacaaatttagtcgtcgtcttccgtctttgtgtccgcttccgttaaacctgaattctgtttgcgatgctcgtactacgatatctactgaccccatgtacgcaggcacacagcaaggcccgaccggatgctgtgatgcgctgatttcagctcacacagaaaagcaagccagtcatgaaaatttgtcatgctttgttaaaatgaatctaggttcagactaatctgttacttttacggttttaccgaccgtacttcacctgaattttgcgatgactaaaaaaaccctgcaatgacgatttccttgtgctcatcggcttcatggaaacgtggactccagcccagccagccaccgtgacgaggcagggacgacagaggacgcctgcaattgaatagcatgttctttttttaaatcatgtgctgatagggacacgatcacgtgtatattttaaatttagtatatttatctcacatcttcggatcctaaattttataatataaaatttaaagatgagatgatactctatttctatttatttttaaactaaaactattttatatcctaacaaattgtgaaaaaacatttagatcgtgatccattactatctctaatttaacctaactaattttacaaaaaacctctctcatcaattttttacaaagaatcactcgtagctactacagttagatatatacatgtccagatttcatattttaataaacatgtgagcaccatgctactttgagcacatgataatactggatacgtggccttcttttagaaagaggcaaaaacaaatccgcgtcaagattcgcgctgcgggatggatgatggatcacatcggcaccagttttctgcaggcacagcagagcacgactcctccacgtggccatgtaaacatgggccccaccaaaccggtgcggactgtggagggactcggccacggaccacccgtctcgccctcatctaattacgccccgctcgctgtccctctcagatctcttccttgttctcgcctcgtcgtccccaatcgtcgccgggagtctcccgatccttcttccaccacctcaccggtggtgtcaggttagaaaaatcgggtctctctgcggttatcttctccgcccgcccacttttgcgggaattttttttatctgtcgcgtcgatctgatctgcgagcggtgggagaaaggggattccgatctgatacgcgggttgaattgcagggccggctcgcggacggtgcttggactgcccccgtcccgtc

SEQ ID NO: 5880 - DNA, 1500 bp, Zea mays
gcattgagagtagcaagtgtgcatcaacctttctaagtagyatttgttgggtcaagtgagagttctttattgttctttattattactcttggtggtcggcatcacttaaatgatttagtggcgattaggagtttggtgatcacctggtagagattgtgggtgacccaactcaaggtgtaaatggttgtcgataattcaccatgttggagcggtgaagaatcatcggggagcaccatcattgcatcggtgcttcaacaaggactagtaggtagcaacgactctctgatacctctacaaaacaccattatttctgacccttctttactttgagcatttatatttgagtaattcatttcttgtcttaatattactaaaaaatgtcatgatataatagggttggaacccttctttacgctaaatactcacattagagatataattaaattactatatatataacaatttttttacagcgagaggttcctttctaagtcaatatccagcattgtcctctatatcccttctttagactatctctagcagtttatctatccccatccacatatttaaactccactctacaaacagtaaagtctaaagggcaaaaccggattttggatgattatataggtgaattgctgaatacggtcttatagtctactttaaaagattctctcttctatatatgatttctctctaatagcgtcctccttatctcttcttctatacgttaaatactcatattagagatatattttgttctatattttatatatacagatttgttataccatcaaatgttttattttgcttaatctattatttaagttaaaaataaatatagagaacagagataatttttatatatagaggaccgagaaacatttagagaacgttttagaaaacgctacttgaagtatatagaatattttttttctccgtatataagctatcgacccttttgccgtgcgctgctcgagtctgcctaacctcgtttcattacctttacattccgtgctccacgtgccttccgttttaggtttgattcgtcgacttgaatctcctctagctctagtatatattaacaagcatagaaatgacaagatggccatactactaaaaacaattcaagtcgctatatggaatggaacgaccatgttcttgtcatctcttcagaacagtctgaaggcgtctgtggcggcagaagggaaagaatggaaaagcgctctacgcaacacgccgcataccgtgtgccattcgtgacagcgacagactttcgtgtttgtgtgtctcttcggctcgcaatcccattggtcgcttcatgccgctcacgaactcccctccgagcccggccgtccaattatgatccacttggttaactagcataattaatcgcagatgaagcagcagttcatgaaggcaggaagcagctaaatcacccatataaatggtcgcgcgcgctagcatagcatagtagcgatagccaccaccgatcgaagc

SEQ ID NO: 5881 - DNA, 359 bp, Zea mays
agtgattgagttcagcagttgtttgtagaaaatgattgactcttatgtgtccagctaccagcttccggcacatgagccgctgtcctctgagtgggccgcttccatttgggctgcttgaatcgtcggctaaggaggttgggccgtgacatcccatcgctgagtccgtcaagcccacgcatcatcactcacgcgcggggccgtccgaccgggcctctcctccctcgttttacccgcactcgccgcaacgccgagaagacgcgagaggaagggaggaggtgagccaccggaagcggagacgtgagcactcgaccaaccccgtcgatccggctgcggcgcggcgtgctagatcgctaccgacc

SEQ ID NO: 5882 - DNA, 524 bp, Zea mays
atgtgcatttctattcgacaaataataataattccaatcatactggttcttttgatgatcttgttgtggatgccccttagcttcctctttgggggtgttttcttctgtctatgtggtacccctagctccctctgtaggcttagaatgcacatgtctatactacatactatcgtgtttaactttatactaagtttttgctcatttctttattgaagacgaccttattattgttattgtatccctgtacagctaggcagtgttgggttgtaaaatttgtatcgcgtgaatgaactcagagcatctcaatgttaaaactgtaaaaggggcagacctggtgccagaggctcccacatgagtgggttctagggaagggataatccgaagcaagcctcccccctgcaaatgcagagatgtggctttgaacccgtgacctggtgactcagtgagacacctctcaccactgcaacgggcgtgtccttcctcagcgttaaaactgagcatattaattcccctgcttaagcaat

SEQ ID NO: 5883 - DNA, 1500 bp, Zea mays
gaacgggcccaaatgctcataaactgcaatagacttcctgctcaacctgaatgcgaacgccgtgtatcgaacagctccgcaaccacacagccgtagagcacataaaggataacataaataagagtttgaaggtgcgtgttgcggctgtctactacgttacagcacacagcgcaccatggctgcacatgcgttcagatgtgatccttctctcctgccgtgataaaaccgcgttcgatcgattactgatcgctactccctccgtttcgttttaattgtcgctggatagtacaaaattgaactatctagcgacaactaaaaagaatcggagggagtataaggtatggattagttcgttcgatttacgatctgttcacatctctgtgtcatccatgcgcactggtacagagttcagtatatacatgcaaacgtgctcacacttcaaaatattggcttccttgttgggtgttgctcacgggcattccttcttggttgccccagcagccccacgatgtccatggtgctgcgtcacgttgacagccaccggaaagataaaccactttttgatcttggtgaggagtccaaatcccaattcgagcacgtgcccccgaatcaaaattgacggtttgcactggcctaataagtactagtataatacggatttcctgagctcaagcagctatcgtctatcgaccaaacgatggatgtctccacgcccacgtcagccggtcaacccaaagctactgattggaaggcacatgcgagatgcgaccctcagtcgcgcgactggcaagcgggggccccccgggtaaaatctggctgcctgaaatcctgatcgaaccagcgctgccgctgttcatgtgcagatgtctggggggaaggtcaccgccggccgatccgcagtagccaggagcggcgatacgattttagagggatgcatgcatgcacatggcggattcagacggcagagctttcgccggcttctcacatggcgtcgttttgtttgactcgttttgatgcgagaagtcggctgtctccctccccatcccctggtgtgggaagcaatcatattcatattcttatcgggaacagcaggtctgaccaccgatcggggcccaggcgtgctgatttcggagtcaatcatgtggttgtcgtcgttatcacacagtaaggttatttacccattatcttgtatatagcgtgccggcatggcttatttatagcccgccaaacgatggtgatggcttactgaaactggccttctgctgcatagattctacctagtctgaaaccgaatcccgcaggcaacgtaaagaggagtacatcacacaagtcttcctttcgtttctcaatattttgctgtccattttcttttttttttcaaggtaatactagtactaatacagggagtatgacacagcggcgggggtagttttattttaggaacaattggatttataccattaaaagatccaaactttagatatataccatggaccctac

SEQ ID NO: 5884 - DNA, 1500 bp, Zea mays
tttgcactggcctaataagtactagtataatacggatttcctgagctcaagcagctatcgtctatcgaccaaacgatggatgtctccacgcccacgtcagccggtcaacccaaagctactgattggaaggcacatgcgagatgcgaccctcagtcgcgcgactggcaagcgggggccccccgggtaaaatctggctgcctgaaatcctgatcgaaccagcgctgccgctgttcatgtgcagatgtctggggggaaggtcaccgccggccgatccgcagtagccaggagcggcgatacgattttagagggatgcatgcatgcacatggcggattcagacggcagagctttcgccggcttctcacatggcgtcgttttgtttgactcgttttgatgcgagaagtcggctgtctccctccccatcccctggtgtgggaagcaatcatattcatattcttatcgggaacagcaggtctgaccaccgatcggggcccaggcgtgctgatttcggagtcaatcatgtggttgtcgtcgttatcacacagtaaggttatttacccattatcttgtatatagcgtgccggcatggcttatttatagcccgccaaacgatggtgatggcttactgaaactggccttctgctgcatagattctacctagtctgaaaccgaatcccgcaggcaacgtaaagaggagtacatcacacaagtcttcctttcgtttctcaatattttgctgtccattttcttttttttttcaaggtaatactagtactaatacagggagtatgacacagcggcgggggtagttttattttaggaacaattggatttataccattaaaagatccaaactttagatatataccatggaccctacatgtcattgactcatgtggacccacatgtaagtgagatagtaatggtatggatccaaagtggtgatcttttaatggtatggatccaaatttccctttattttatgggcaaaatgcagttataggcttatagcagagtgagaccagataggctgcgcaatgtaggtgtagtaatggccgtccaagtcttgctgggccggaccatgtcgtcctctcgttgattttcaacttatcaagcccacacagcccagtctggccatcaatttacggaagcaacctctatttatcggtagacagacagtatacgagtatcaaacagacaaacacacaaggaacaattctgaacttcgttttgtgccatctatctctgaactgtctgtgtgtgtgtgtgtgtgtcggaatagtccctgtctatagcagcagcagcaacaatctagtgtactttaaggcacaaatgttctgaatctgaaaaaaaggtgatcatccgaaacgaactgaagtttgcaaagtagtagtaagaagctgtatttgcgatttgcttctttccagtctcttccttagcgaatagcgacccagtatacccataggtatgataacgccccgcacgtgcacgcacatggaagc

SEQ ID NO: 5885 - DNA, 1411 bp, Zea mays
ggccccttttattttcgcttgcttgctcatattgatggctaccaccttgttgtttttcttcttcttgagaagataacgcgtggtagcctttttgttcagcttgttggtgcaggtgttggagagctttcttgttagttttttgcttttctccccattcttcaccttccactaaaaatacttgtggtcttttttatggcatacaaaatgaaccatagtttctctgtcatcaagtttctccatttctttgatggtgtatcttgatggagttgggtgagcttcgtcttgcctttctttttttaagtccctttgtgaggagaaccactttttgtttgagctactcattcttccttacaaattcctttgagcatgtttctacaatgacatccttaacacatacttgattgcaagggggtgagatgaatgcaagaagtagagatatcattttttatcaattttaattgtttcaattttaggtgcctcgggggtactaccgatagcttctagcttgttagactgcttattatagtgtgtactaagaatttatattttgtttagcatactatcataagcatcttgaaagctactaattttgcttttcaatgtttcatttatcttcattgtgcatcggaaccacacgttgtccacatcaatctccatcgttgtgatctaactcaaatttgtccctccaaaacattcattagttataataatcttattctaccgttaattatcaaaacacttaagagcttagacgatgtttttaggtgtagtttggaatatagaaaataggacggaaaaactttttttgtccgagtagttaggatgtggtggacaaaaaaatggaattaattttggctcttgaaataatctaaaatatttttttagtaaatctaaaatcataaatcttttattatgaaactatatatttttttaaaaaaggataaaagatagaaatgtttaatctaagataaacctaatatgatatgtatataaaactagtatgcaggaaccaacaaaaggagcatttttttgtcgcatgtgatcttgtggtttacttttttttgacaagttatgttgtggtttagttgagtacggtggagcgcatcacgtttgaactcaatgattatggattaccgttcaatcatcatggaaggtaaactgcatatgggattacggcacgtaaataattataaaacttaaccacagtcacttcagggtaaattcacacagaagtgcagactaaccacggcacgaaacctatcaaagaggtctccacggcgttcatattgctaatgcaaaccgttataaaaggagacacgagtatgcacacttcgccatcccatctctgatctctccactcaatactcgtagaacagctacctaaagtaagctgggcaccctcgatcaagcc

SEQ ID NO: 5886 - DNA, 323 bp, Zea mays
ggttcatggttgcgagagaggcggcgcggccacgagtccgggaccggctcctcagaaaccggccgcctatctctcccccttccctccgtgttcgtcggccccggccccatattttctctagccttgctcgtgtggctggaagagtggagatcggggaagcgtttgtgttgggtacgtagtacagatcgtgatgctttctttccttgagatcgttgcattgcgtcagggattgatgttaatatagatttgggtttcgttgatcctcacctgcattgccgtgttgcatgcgcgtgcactcagcactctggacggccgagcccgac

SEQ ID NO: 5887 - DNA, 161 bp, Zea mays
ggagggcctataaataccaccacttcactcttcgctttccactccatttgcaacaagccaaccgcaaccagactccagagagagagagagagagccacacattgcaagcttccaccatttccaagaacaactgccactgcagagagctcgtacaggaagag

SEQ ID NO: 5888 - DNA, 254 bp, Zea mays
ggtacgcccacccctcggtcttcgtctccccttcctgctgcgcgaaacagagcacccaaaccctaacttaccgtctgcattcggatctgatcctagtcacatgtacttacgcctaccgactttggattgggtccacccctgcttccggcacggacggacgggcgatctgttctctagatagacctcatgcgtgtccgtgtgttgatcttgacactttctttctcttgcaacaggtgtgccaggttgaccgagct

SEQ ID NO: 5889 - DNA, 253 bp, Zea mays
ggtaattgaatatcttgctatgtgattcctgaaatctgaacttccaaggtcactaaaccgcacttattattccatgtgttgacctagactgtcaacaagacaaactagtattcttatcgttaccagaagtatgcccgtgctaacgctgcgacctacgagggaaatcgttttttttttgaagagggaaataataatgtgaaaaaatgacacgagaaaaataccctctatttccaaacacactcaagattttcca

SEQ ID NO: 5890 - DNA, 1005 bp, Zea mays
atttatatatatatatatatatatatatatatatatatatatatatatatatatatatatatatatatatatatatatatatatatatatagggagtggataacaagtcaagtctggctagttacgattggagcgattccaaggtaataaatatctgctttctctgacaaaacaaaaagggaaacaaagagtcgaatcaaagatgaaggatatcaggtattaactcccggggaagtgaatatttggaatccggagtgaatcgaactgcatcccgatgcaagcgccgcgcgtaatattaccctgtcctgcaaagaaacgggaaggaatctgacttggtcggctgcttccaaataaacgatcggggttctcctgttaataacgtgtattaacttgggctctaggcactcgctcaatctcgccgtacgtgacgccgccgtctccttcgtcgtccagctcccgcttcccgcatcgattggcagcgtcgtcccgtacgtacgtgtagcgccgcccctgcaggctgcacaggtatgtatagtatgtatattagcgtacgcgtgactaatgcagattagagctagctagtttcggtgtcttctcgaggagctagcggaagagcgctgtagattcttggatggatctcgatcttcatctgcaacaatatatatatagatgcattagaaggcgctggtcaagcctaggacaagacaagttatctggataaaccgctactagcgctagggctaatccaatcattgtcacaaacaaatattatcgccgcgcgtcttaaaatagctgaattatttggagggtcggagtcggacaggcagatcgaaatgcggcaccgttgcattgcttttatcttcatgcagcgtccatcgtccatcgcgcccgatagaactagatagatagatagctactggtactatataaacaccccaccgttcaggtcacggcgagggcagctagcttttgcttccaaccagcggcagctaggccgcaggcggc

SEQ ID NO: 5891 - DNA, 273 bp, Zea mays
ggtacgtttcttgcgcctaacaaatagccagatcccatccaaacacgctgcgatcgatcccaattccccatcccacgtcggtgacgtcactctgttccggcggctcgggtttgggtaacgtgtttggtaggtcgtacagtaggtgtggactgtgtagtactagacattattcagtatagacagtgggaatgcacgcactgcctgcatcacagcacaataatagaaccatcagcaagcagcgtgtgtctagactagattcaaagtcagaaatta

SEQ ID NO: 5892 - DNA, 939 bp, Zea mays
ctgcagcgacggatcagttcccgtacgtacaaattcatcaatccggcagctagcgctctaaccatgatctcattccgttatttcaatagtatctgctagcgcctagccactatttcaatactatttgcactagctttgcttcatgctgtcagttctttttgcctgtacattaatagctatgtcttccattttgatagaacatgactacatgagtcatagtagtctgctgtcgtcacgtgtctgtggatgaatcatctccggactacgacgatgagttaatacttgcagctgctgaaatcatacaaacgtcgtcacatgctcaataaaaagccgggcgggtctataccagaccaagaccgtgtatacatatatcgagatagagaagttggtcatgcaaaattgtatcaagattactttgcaaacagtatgtctttattagagaaagtaccttagagtctaagaaggtttgtagaagctgttattgaaatttttggagatgaatacttgaggtcacctaatcagaacgatataactcagttacttgcacttggaaaggaatgaggttttcctggtatgcttggttcacttgattgcatgcattggaggtaaaaaaatgtccatcaggtcatcaaggccaattctcaggacatcatcatacacctacaatatttttagaagctattgcttctcataatctatggatttgacatgtttttttttggtttacctgtatctcttaatgacatcaacgttcttcagagatctccactatttgcaaagctatccaacggtgaagctccaaaagttagctacaatataaatggtctcatctttgttgcttgttttctcagcggttccgggctcgaccccaaataggaagcagtgctcgtcgactttctccgcgcaaacgccgacgtctttgcgtggagtccctcggac

SEQ ID NO: 5893 - DNA, 100 bp, Zea mays
tggacacgacgacctgcagcccttcttggtggccaagcccatcttcctgctcgcgccccctctttttccacctctgcgcgtatcagctcgtccaaccccc

SEQ ID NO: 5894 - DNA, 881 bp, Zea mays
acgcaaatggacagctcgtacacgggaaagtaaaaccgaaatcgggagccggcctgtttggttcagcttttttcttaccagcttttatgagaatctggttgtggagagaatctggctgtgtagagaatttaagtatcattagaattacgtgcggaggaagataaaggtgtccataggactcaggatctagaaagtgacggattcctactattgcaacgactcaaccgattatttgtttatgttgattttgaatggtttttaatcaaatgaattttatagaagctgactgaaaagctgagcgtttggcagtctgcggcagcttttggtggccagaaactccaaaaagctgaaacaaacagggcccatgtttctctagagagcttagattttaggaaacgcgcgaagtccgtcgacccatctaaatttgtaatttctttccgtacgattttcaataaagctcaaggtgtttaaattttttaaaaaataaagcaatctataatttagaacggatgaaggagtatatacgaaataacaaaagtgctatatttatccagcgatccggtgttgctgcgagcccggtctccgcggccggtagttcggatcggaatttaccgcgcgctctcctcccatccaccattgcccctctccccctacccctgcacgcgcgcgtcccaaacaaaccacaattgggtgagagacggagacggccatggcggagtctcagacgtgatcgccgagcttgcaccttgcagtgggttggtttcgcttgaaagagagcggataggatagctgggtaagaggaggaggaggaggaggaggctcagttcagttcgtgggccggtcgatccaatccggcattacttatcgatcgatcgatcatc

SEQ ID NO: 5895 - DNA, 106 bp, Zea mays
ggtccgtccgtcccgcccttccggcgaacctgcattgcagcacgcactatttaaatttgtttccttctccttctctccttttttccttttggattggaagtgatca

SEQ ID NO: 5896 - DNA, 531 bp, Zea mays
cgtggttatctgatacctagaccgtcggcgaggcgagacgcgtggatcgatcaagtgccaaccaaaagactgtggctgggctgataccttcgcgcactctgtcgtcgtggagcaataatcgttgggaccggtggcattattggtaacctcggtacgataaaatcccgtggctccacgttgcaagttgactaggcaaatacacagcctagcaacgcgctggcagtggcagatgcatgcactggataacattccgcaccgtacccacccagctgccacgtgcctcattgccatctgcctcaacataaaacacaccccatccgcacgcaccctcctgaccacctaataagcaaagaatccctttcacaggctctctcctctcttccgccacccgcggataaacaaagcgcggtcgcgtcgcgcaccacctctgtcctcgcagagacacgcacgcaacagcatcactgaccctcaccaccgcacctggcatcgaccgatttcatctatagtagctgaccctcgtcgatcgtcacc

SEQ ID NO: 5897 - DNA, 612 bp, Zea mays
gctgcaacgagacacagattctccaacatccaaagcgaggtgagattcttgctgaaacaaatctgtaatcagttaagtcttgccattgtaagcaacaattgcatttattttttcccaattatttacatgtagttaattgatttgttctgctcaagtttgactacactgtccttcatgctgtaaataaacttataattgcgtcgatgccagtagatgttgctacactgtccttcattcgtattgtggattgcaccgagataaccttaaagcaattcactaatctgctgacacacactgttggaaccaatctcattcatttcacaattgctcatacgactgttctgctcctctttaggtaagttctatgtactacctcattcatttcactaacaatatttacgccaagtaattccatggaaccgtgtttctaaattccacaaatgttgacagaattgttctacacatctctatgtatctgaactttacaccatagtttctgttacatctcttgaaatgcagtgttcagttgtggagaagtagattttaatctttacatttacagaatatatttcacagtctagcttatcaccattttgattatgcagggttcct

SEQ ID NO: 5898 - DNA, 599 bp, Zea mays
gctgcaacgagacacagattctccaacatccaaagcgaggtgagattcttgctgaaacaaatctgtaatcagttaagtcttgccattgtaagcaacaattgcatttattttttcccaattatttacatgtagttaattgatttgttctgctcaagtttgactacactgtccttcatgctgtaaataaacttataattgcgtcgatgccagtagatgttgctacactgtccttcattcgtattgtggattgcaccgagataaccttaaagcaattcactaatctgctgacacacactgttggaaccaatctcattcatttcacaattgctcatacgactgttctgctcctctttaggtaagttctatgtactacctcattcatttcactaacaatatttacgccaagtaattccatggaaccgtgtttctaaattccacaaatgttgacagaattgttctacacatctctatgtatctgaactttacaccatagtttctgttacatctcttgaaatgcagtgttcagttgtggagaagtagattttaatctttacatttacagaatatatttcacagtctagcttatcaccattttgatt

SEQ ID NO: 5899 - DNA, 1500 bp, Zea mays
tccatctagtgacattttatagctagctcgtcaaaataggttcatagtgttttccctttcaagagaagaatcattcttttgctggttgttaagccattatgaagtaatacaagtcacgcttcacagctatctagtgcttactaatgatataagggaaaaatattcatacatgtgctgttcttaacttgaccaaattattagctactagctgtaattcactaactaacctgtcacaataatcttgagtgggtagtacgcgaatttagttagttgcagtggtgtgtaccctgaaaattcaggactgtgggcttgttgctgtttttagtctcttgatgatgccttaatttgaagtcaccaggtcctttaaccggcacctggagcgtgaaggaccactcctgctgcttcagattgactgcttgaggatgggcatgaggaacgaactcacttccttgttctcaagcagcagcagccaggagttcatcctcaatcttgactcaagcttggctgcttgctttgtttgccaaaatttcacgggcggtccttgaacttggcaggggccgattctttggtccggggagatattattttattcactataatgtgctaggcagggcccgcagggtggagtggtgcttagtgcctgatagcaactaaacaggttacatggcaggtaatcacatggtaggaggtaggtgggctagcagctagctattggtcttccataatattggttgactgatatttgtttgctgatgtcgtttttctgcggcatttatgaactgccatcacttttttgtgttgtgcatatcatgtggttttctctctctgaatggtagatgaacactttctatatctgtgtcccaatctcctattgtggtagaacacaaacatttgttttgtttcatgatttgtaaatgtaaggagactatctcgctatggtgataactgataaagggcttgccacatgtcacagctgtcaatgtatatatgccaaagtaccctcttgctacattttttttcagaacacatctgtggttgtgaatgaagcaatcccatgggggaatgtggctggcagcagcaggacattatttatattctttgctataattctcttacgttggaagcattttttggttaggacctatgaagtatttttgctgagtttttatttggaactatattgtacaagctgttcaaataaatgaatctactttgtaagatgtagtgcattttagttcagtctttttttctttttgtgtttatgctgtgattgtagagtgactgccacgagttggtaacttgctgtcttatcaagaagtttttgataatgaagtatttctaactttgctgtttcccgaatagttgagatgcactttttttgtaggatttcagttttttccttttcagcccataagcgcgtatgcagcatgcaagtttatgccttttttgtgtaggcttgatatttaacgggctctgggcagagtttaacaagtttcagca

SEQ ID NO: 5900 - DNA, 228 bp, Zea mays
tgtacgccgccatctactgcgtgggccagctcctccgtgttccggcggtgggcgccgcggcagcggctggacggcgccagctgcctgatctcgctcttccacggcacccccgcggcgctggccgccgcgggggccatcctcgcgctgcccgcggggtcccggtccttcgccgcgcccaacgcgcgcctccaggaccacgtcctcgactacagcgtcgcctacttcacc

SEQ ID NO: 5901 - DNA, 1500 bp, Zea mays
atcggttccaagggggtgttgtttaagtaaagcgagaccacaggcacagcgcggctttgcagcatgctcttggcaccagtggtgtggtgtggtgttgctgctgatagactgaccgacggcagaatgagatccacgcagcagcttctttcaaatccacaaaattttctcagtggagaacaccagcacctttcctgcgaaagattttttccccttcccttgcgaattcatttcccttttgcccaaccacacagtctgctgcgcaggtgtttcaatttccttcgctcttttgtccagtctccactgttggttgagcagccggcgttctcgatttcttcactgttctggatctgttgtacaggtcgggactgtagctgccgctgcgctgcgtgattgatggtcggaacagttctgaggaacccacgctcgaaagaaaaccaatagaactgcatcgaccgcaaatgctgtcgtctttcgccatatgcaggtcctgcgacgatgaacagtgatcgttccaggtttaccatcggtgctcagtgatccttagacgacacacagtacagggattctatcgtcacactgtagatgctcgagagagagtagggttgggcattcacgagtctcgactacaagctcgagcagattgtcagtgttaaaagacagatttcaatagcgtcgtagattctccgtttgctttctcatgtcttttagttggaaaaaacaaaaactgttagtagtctccgatcttacagtacagggggcttcattcgctcatcattgggcaatccccggtttgcctattagtgctccatgctccatttgttgattagcatgtgccaaaatgaaatgctacaggagagcccccctacaatatcttaactaggcgctgtcctcatcttccaaattactgcatgctgcatgtatgagcgaaaatatccacaaatgattttacaactgtcaaaaaatttcagcagtgaaccgaacaaatctgctggcattcaaatgttttgattcaacatatggcaatatatttgagcctctgattctgctggcaattgattcacgaatgcattttgtttttatttgattcatggccagcaattgggactggatatcgaacattctgctggactcaaatgatatagcttgcactaggttcctcatgttcatttcatttcccccgaacagaatttgtgatgtcacagagtagggatgatgatgatctatatcaaaaaagactaggttcctcatgttcctcatagtcctctccataaagcactaggttccatcatcctgcctctgcctctcttgtatagtttcttccattcaaagtgagcagcaatacttgattgatgtcgtgtgttcagaaagtatactaccattctggcggacttcggctgaacccgaacctgtacgagagcgggaaagtgtgcctgagccttctgaacacctggtggggcaaggggtgcgagaagtggggcaagtggcaagtcgagctccacc

SEQ ID NO: 5902 - DNA, 148 bp, Zea mays
ggctgccacctcattctaaccacagtaccataccatgtacgggtgtacgaaccatatgtagcttcttaatctttccaaatacatccgagccagatgatgcagactgatgatatgctaaaagccaatttcggatgacaattggtggagg

SEQ ID NO: 5903 - DNA, 1423 bp, Zea mays
ggaaggaggcgtcaaaaacgcccgctggaaatgagaaaactgagggcacgtcctctgctgtagcaaaacagaaaccggggcacacgctctgcttcaaacgtctctaaactactttatgctatgaatttataatctttttaccattatgctcataaatcaatgaagtagtaagagaatacacacgtcgtcaatctatctccaattatttttttattatatataaagtatatggtgtctctgcccgcagcaacatatatctaatattagaatttagaacgctgtgtcataatctaactaccagatctgtaatatttaggctctatttgtttccatcgagaattatatcatagtgtttatggattatatcatctaactaccagatctgtaatatcgagacctgcttatagattattataatctaaattatctagattatataatccacataataataataatctacattgtttgtttagctagccgaattacgaggataaataaacagggagatctttatctgttttaatttaaatatctgctcctaataaatagtggcatttgtatctcaccagttacataagatctgtttacttattgcattagcaacaattgaaagatattcgtcaaaaccttagtaacggggaacttggcctcgttcccggaacggaacgtgggaacaatctcgttccagtagtgttaaattctagtttttgtagcgtttcgcgtaccatgttcccgttccttgatcccgtcgatccgggaacctggtttccatccttcaagttcaagccatggggtccacgtgccggatttctcttctttgttccctgctccctctcccccwwtcctctcttgtagccacggccgcatgctcgcgcgcccgcgccgcctttctacttccaagtgcagctcgcctcgggcttgccagcgccatcttttcttcctcccactccctcacctgacgggtctgattctgggtcgatgtcggtcgccatggtccgacccatggtcggaggatagcggagaccagtgaaggccttgcgcagaagagtggcggggaggagaagcgacggagaagcgcgctgccgcgctcacatggccgaccaaggtaacctcgggacacacagataaatctagtgaatgtttcgtcgctagcggcgggtcttttaccgacgcttgttggggacagctttccatagtttttttagaaaatcgagatgtgctttgcaggtaggcatgtgcgtgcagacatttgaattcatgaaccagatctcgacaatttggattctaagtaaaaatgggcagggtcgctctctcccaacaatagtcctgccattcgttgccatgtacccaacgagcgtccagcaccaagaaaacaagagagagaaagagtgggtgtgagcaccgaactgtcgaactgagc

SEQ ID NO: 5904 - DNA, 914 bp, Zea mays
gcgcaacggtcgactctgacagtgggaatagtgcagcacagtgcgcagcagaagtcagagccgcaaagtcagaaggcaccggactgtccgttgtggcaccggactgtccggtgccgcaagaggacaaagctccaacggtcgatcgcgctccaaaccctaacggttgggtgatgtggcggggcacccgacaatgcacagtgcctatttggtggcgcaccggactgtccgatgcgcccatcgccagcagcctccccaatggctaccttggtggttgagggctataaataccccccaaccaccacaacttcaagaatccaagttttctgaagatcacattcaatacaagagctctagcattcactccaagacacaatacaaaagatcaaatcctctctgagtcccaaattcactccaaacacttagtggcttgtgagagagatttttgtgttcatttgagtacttatcgcttggattgcctttcttcttttcccattcttattctcaagtgctttgtaagcgaggcaagagacaccaagtgtgtggtagtccttgcggggtcttagtgacccgtgagattaaggaagaaggctcacgcggtctaggtgaccatttgagacctcctcaacggggactaggttctttggaatagacccgatctttgtgacctcctcaacggggactaggttctttggaaccgaacctcagtaaaacaaatcaccgtgttcactcgccttatttcttgattgatttgttttccctctctttctgacttcaatttaattctaacgctaatccccgaccttagtgcgtgtttaaagttataaatttcaggtttcacctattcaccctcctctaggtgactttcaattggtatcagagcccggtgcttcattagagtctaacaactcgaagtg

SEQ ID NO: 5905 - DNA, 226 bp, Zea mays
taattcagaagtataatcctttctgctagaaacgtgaagctgaccttacagtgaccacccatgcacatctgatatttgaagtacaaagcaaccggctcaattctgtccacaacactgcctgaaccagaccaaccgtatcagcatcagcgtaccggccgcggaggagccatctctctctctctctctctctctctctctctctctctctctccaggcgcatcaagcc

SEQ ID NO: 5906 - DNA, 131 bp, Zea mays
aattgttggagtgtgaccttggggagagcaagtgccactccccgagcacaatcatgaagatgttccagagttctatgttctgtttgcagccccagggtgactcctacacaagaagatctgcctttgactcg

SEQ ID NO: 5907 - DNA, 1500 bp, Zea mays
gtaggagtaggagcaggtgtagtaggccaggcagccgttgttttcgcccggaagtgtgacccggtgcttgcgctaagcaacagcaactgtggacagcggcttgtttattttcgcgagctgacagccacggtttcattagatgatgacggaaccgagcgagccagttgtttagtgctcaactgaatgtgttctgttctgtgctgtctgctgtctgctgtctgtgctcaactgagccatgttctgtgtgcctgctgtcagacgatctcgtttcatttccttcccgtacacacaacacacttgcttcaaccaagtgccgttggttgcgctgtaacctagctgctctgcttgcaaaggaggaggagatggagcggacgacatcttgccccttgaggccttgagtcatttgtaagggatggataggatagccgaccgaggagccgtcacggtcggtgacatcgacgtgtctccaagattttgtataggacaggtcgcgccgcgtccgtccaccgcgtgttccagacaggcccatgggcggcggcagcggcagcggcaggaggagccgtgtgggcgcgggtgcgtccgagagaggggaatcgggccgctgcttccggcgacgcaggtactgactgcagtgcctagcgactactcatgctggagtatatcattgtggtagatggtactagcagtgttctgtgcagcgacgacagcagctgtcaataaaggaaagctagcttctgctctggcagtttgatcgatggccacacatccagtcgagagttagttgctttgcctggttcattgtaatctgttgccgtattattattgctagtcgttcagtgcccactgcccacccgttcttgcatgcacggctggttggattggatccatctgcgctcctagctggacggtggttggcagatgtgatgagacgagaacgagactacgacagtgagaagagagatcctagccaaatgcaaatgttacaactgccgccgccgccggataggcttccaatttcatccgttgcatacatacgagtgctctcatcccatccttgttttttttcctacaataattaattactccttcccgtcttgcgcgtgcgtgcgctctctcactcagtcactctgctccggcgctgacgagatgaaatgacatgaggagggagcggtcgagacggcgattgacgacgcaccgcacgccatcggatctgtcctctacttctgcctcatgttgactcctcggcgctcatccgcctattattttaaaatggagatgaagaatcgagatcgtccatgatccgtattcctccctcctcgttgactgccgcggccagcgatctggtcgtcaccttcctggaccgaccccaggccacggtgcagcagcctgcactctagtccgtgcgtgtcgcgtcgcgtctgcgggcggcattgcgtatcgtttctgtaggagcagaggagcagctgcctgaggcaattgttcccgtccccgcagagcggc

SEQ ID NO: 5908 - DNA, 172 bp, Zea mays
gattagcttcacctgttgtcctgttctttgctctgatcttccgactcctgggtggtggccttggccattgtcggtgaaagtaacaagtgtcaggtgtatccgtgtatgtgcttctgcagtacaaaggggccgaacgttagatgatcatcattgttgtagttgtagtcagtct

SEQ ID NO: 5909 - DNA, 988 bp, Zea mays
tctgcgagtataaaacacggcgttaattagggatgtttggaagaacgtgcagtgtatctttctatatacgagatagtacctattatcagtcttatgttacagaatgaaatattagttcaagcatttcagccctggagtttacatcattacatatactcagattattttatctaaacaagaaagagcatgatctgtgcacaggaggatacagatgaaagaccagcactgaacttagcatgtgaatctaacatattaagaatctaatgtggtcacctgtcctactaccaactatggcttcacttcccacgcccagcacatgcaaaaatagtgcaaaacaagcactcgaactcacacctctctgctctagaaatttgtggctaaccaccaaaccacatgtaccttaatgtttataaataaacaataattatatttacagcctagccgccgctccccatattctcccatccagtgtcaatgcactgatacatatctagtgatgtattaatcagtctatatcactgaggcaatatatttggtgcacatattaaatcatgtccatcggatcagatccaacaaacagcttcggttttggagaaaaaaatcctcccgcaacctctcttcctgccctgatacgtatgtgaactttttttttcttgaataagccgttagatctaatatagatgattttgatttaacatgtgtatcacatgcatatgcaccagatacgttgcgtagataataaaatttcaccggaggttccaataataaaagcaacgaatttaaacatactgcaaccaaatgaaggaaacagataaatatgatcaatatcacacccctacaagtacgaaaacaaaataaaatacgatcaatatcaggctctctacaagtgcgcagtgatcttcgatcgatcctgcatttcgtttaaaacaaacagtgacgtacacagttgtacagcagcctgtgatcggtgaaggccttgacgctggtg

SEQ ID NO: 5910 - DNA, 1500 bp, Zea mays
tcaacaatatctagccggtggaccagttcacatcctaaagatgatacagtacaagacaacatattccttacaatcaaaggataaggtcctaattggttacaactagtggtgtaatttgtgcttggattataagctgactaggtctatagctcataaccgacttgtaactgtagcctctcgatatataaagagagctagggatcctccatataggcatatcgacgcatccaatcgtagacgatcacatacgacccaaggtgattggaactgagtatatctgatctgatctacttcgatcgggcataaaatctcacggatgcgcaacataagctcaaccaccctatataggacatacggtacaaagatttggctgtctaaatctcgtgctctttgtcctatacttcgtcgcaactctttctttgcatcctctacgaacaaaatccaccacgtggatcaccccaaggtggattgtgtggaactaagcactaatagtttgcacgctataggtagatgcacaacaaaaacgttgctgcgatggtgatttttcgctaacgtcttcatgtttccgctagatgaaacttcatcttcaggtcgatcacctcgcggttcacaagttcagcgatctctatatcgtcaccaacacactttagacgagagaaaacttgtctaccgtgacaactcaagaattctactcgccgaactcaagcaaatatgttatgcattagatcatatctattgccaaatcggatgtggaatcagattccgtgtgaaaaaaagtatggtttttcgagttatcgatccaatgtgtaaccgtctgcaggtaagaactatataatgtcaaagacaagacaactcaagtctattaaaaccggaaggatgacctctaaaaatttggctagacggaggggataggccggccaatactgactatacacatccgcagtgcttgttagtttgtttcactcactagtgcatcgtgcttttgcacgtatcgctatccattcaggttatctctatcatgtatgttgtaataaaaagctgttttgtattgctgaatgcgtagagtttaaaataatccatgatatgaaagataaaaatggttaaaattcgccgaaacggcctcagcaagccacacggcgcgctgggctggaccaatgaagcagcgccccacgcgtgaccgaccaggaacggctgccccgccgagtcaaaaggccgccgagctaggtgagcgagttccgggacgggcggacggacggtggcccacccaccaacctctgaccccgacccggcgcgtctcgccctgaagcttaaatactagtcttggctagctactatattatactagccgtctagccctcgagccgtccagggcgcggcgacgacacccacaggccacagccacaggccacacgacaccaccgctcggtctcggcgtccgcctccacgcacgcttcctcccgcaggccatccacccgatccgatccgatccgagcgtccacc

SEQ ID NO: 5911 - DNA, 114 bp, Zea mays
tcgctgctggcaatggtaatgcagttttagcataccacaccaccttttcctggctcacaccaccttttcctggctcagcattcttggcttgtgttttagcagctaagttaatac

SEQ ID NO: 5912 - DNA, 1093 bp, Zea mays
aattggaggcaaagcattgaagctttactttcgaagggataacatacgaacgaagccgaatagagagacttcgtcttggtgtcatcaatatacgaagcaagcgaagaagaaaaggttccaaaagcccgaccaacgcaacagatgcaagaaaagacatctatgcccccacgaatgtcatagatcatgtaaatagggcttatgggtatacttgtaatttcatacaaagttataccttactactataaatataggagcagtaccatgcattagggacacaatagaacgaggtattctgaaaccgctctatattcaaaggtgtttttactgccttcaaactcctttttgtaaggctgaagttataattgtaatcatctatgtttataaaaagatgaagaagagtaatatatctgtaacgaattatttattacatctctacgcttgtatttcttcatcttttgtttgtctttataaccttcgtcctttaattaatctctttaaaaaattaattaaatggtgaagaaatggttgattcatttgtgttgtcttgttttttatttcttcaaagtgtcaaaaacaagtgaacaaaaaaaatcgataggttgatacaaggaaagacaaagggattttgggtggtattgtccttgattgattcctggtgttgattacagaacatatagctaaaacctctatccaaatatggtaacaaattgggagagcacttaagattacaggaacaatcaaaagattataccaatcatattaagattggaggactaagaaaaggagaatctaaatcctaagagctagtttgagttttttgacagctctctacggacgttcgcacacgcagcaaccctcgttgccattttttctccgcgtcctctgtgccccaggtagcgatgctgcctttataaacctccacctccaactcactcgtatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcg

SEQ ID NO: 5913 - DNA, 266 bp, Zea mays
ggtaaccaatatttgttttgcaatgtaatgtttgtatgagttcgcataactaaattattaatgtaatatttgttttgcaatgcaatgtaatgtttgtaggatgagtctgaagatgaggtagagacaaaggaggggagacaggtgggagatgttgaagatgaggtagagacagaggaggcggagacagggtggggatgccatgatactggtggttttggacatgatagccatagtggatggcgtgaatggcctgaggatgcaagtgg

SEQ ID NO: 5914 - DNA, 629 bp, Zea mays
tagagcaggcaagattgactctgttggctagagtattgcatatatttattttgtttgtacatgtaagttgtagttacttaatcaaaactaaaattaagaccattacttgttatgggtctctggcagcagttacacatttctgtattttaaagatttttagtaatttttcgctttctttcattaattacattattataactactggaacgatttagtagactattttaagtttcttataggttacatggggttctattgctcctgcacttgcagccttcttaataaggctagtcatgttgcttgcatcatgcacaccatttttaactgctcactgttccttttgaatctcaattagctctgtatatcagaggagattttcttatattttggtgaagatgaagagaaaggtgcactcaggaaaatcccgctcatggtggtggaacagtcatattagtccacaaaattctaagtgtctctctgaaaatctagaaggtaaggactatgatcctctatgttcaccaaacaacctgacatgttattctttgctgcacaagatggttcatagtgcctcagtgctttttattcttaggcagttcactaagggacttgcgaagagagcgtcctatgtt

SEQ ID NO: 5915 - DNA, 244 bp, Zea mays
cgtacagcaggagcggctggaggagtgccgccgagtggctccggcgtgctacaccagcatcggacgagctctggctgaagctggctagcttgtccccaaggtgaagcaccgttttgttgtactcatcaagaccggagagtacatagaacaggtgaacatcacgagacggaacgtcgtcctgctcggcgagggcagaggcaacacagtaatttctggcaacctaagcaacccaacggggacggcg

SEQ ID NO: 5916 - DNA, 584 bp, Zea mays
gtttggtcatgattgtatgcttttacgtggcatgcatgcatatatgcgactatagctagctcatacagttgccggcagccagccattcaccaacacaaaaaagtttcatttgtccattccgatccttgctagggcacgagagctaagtaggcagctgaagaaaagtttggctctgatccagagctagctaggtagcttcatttatggtttgcatgcatgcagcgtttcttccatatctcggccgggccacccgccctctcagaacgacacgtatgtctctctctcttccaaacgacagcgcacatatcttgatctaacatgtatcggatcggtcacactgctagaacatgctgcccgatgtatatgcggctggcctgcaccacccaccgaacgtacgtacgtatatacgcggccagtctatatatatatatatatatatatatatatatatatatagtatcagatccgaggctgctgatgtgctagttgagcttgagcaaggagttattgagtagagagactgacacacgcacacgacgcactacattggcccgcgtacgtagtagctagctagctgcaggatc

SEQ ID NO: 5917 - DNA, 244 bp, Zea mays; identical to SEQ ID NO: 5915

SEQ ID NO: 5918 - DNA, 1500 bp, Zea mays
cagatcgcacatggaacggatccgatttcgccgctttttggggtccgtgtgtatttacagccattcactcattcagacattatgttacagtttcagtcactccatcacaatttctttaagaatctggattcatgaataaactaatggtgtatttggttcaactttattcgcagctgaaaatacgggttctcaaccaaacgggtattacaacgaaatagatttctaaaaatctataaaatttcctaattcaatttagaataacctcctatctcagattttgtagattccagtcatgcatgttatctcagatttcacaagaatctggatataatggagaaatatgaagaggtgtagggtttagggggctataaaagcagtggattattacgtcgcgacgaatcgacagaatctacatttatgtcattttagacgattttagagaagcgattctcatagaagcgaactaagaagcaaaacatctaacagaagccaattctgacgacaataatccatccagaagccgacccaaacacttatctgcttcacgtttgaactcggtatttcgatcctcaacggtagaattttttaactatgacgagtgcactcgttctaatttcgcactgcatgtttgtttggtccgatccatacggcgcacagtctcacgattacacaccaattaccccaaccgcgcacgaaattacgaaactttagcttcacacacaacatgaagctcgtcggagtcatactgacaggtccctcggaacagcagcattcagaaaaaaaacgagtgagtggactctgggatttctcctccgtctctcccggtctccgatcgatcaggttggcagagcacgtaacgcactaccccgagcctggtagccagctaggtaaccgtagccgccgcgcagcacttcgcggaagcttcgtccctgccgtctgccgagagcagtgcagtgctgggtgtgtatcgtccagtgtcaacggcgacggatcacacgaactgaagccgcatccagcgcaatgcgcaaccaccccagcggcccgccccaatttccacccgttttctcgaggacgcgcgacctcggcacctataccgatccaccacgccttttctttaagaatttcccggggattttccggaccaagtggtagcgtcagcttgtccctctcgcagtcgcagtgccaagtacttggcggaagcagacaggcaccttcccgcgcgctgccaggacaaggaccgagccgatgccatcgcgccatgcaatgcaagtgaccttcctccgcctcccgcccggcacaaagctgccacaccgcccaatattccttgccctcgccgtcgggtctcgtatatataaagctcgcttccacccccaccaccatctatccaaccacaacccagcgcatcatcgcagcggcggcaactcgtcggagcaagcaaagcaaagcaaagctagcaccttccttctcacgacaagctaataccaagcccgatcgattgac

SEQ ID NO: 5919 - DNA, 653 bp, Zea mays
ctgtcggcgtttcgagacaggggggtccctaagccgacgagtgagtgtgctgcgtgccccagcccagatgggtcgagcgcgtgggcgagcgcgaaggggggagaggcgaggtggccggagtcgagcgtgagagaggtggaagtcccgcggccttcgtgttcgtcccgcgcccaggtcaggtgcgcttgcagtaggggggttacaagcgtccacgcgggtgagggaagcgagcggccccaagagagcgcctgtctcgtcctcggtcccgcgcggccaaccttctctaagaaggccctggtcctcccttttatagtcgtaaggagaggatccaggtgtacaatggggggtgtagcagagtgctacgtgtctagcggagggagagctagcgccctaggtacatgccaatgtggcagccggagagatctgggcaccctgctggcgtgatgtcgtggctgtcggaggtgcggcggagcctggcggagggacagctgttggagcggtcgagtccctgctgacgtcgttctgcttccgtaagagagctgggggccgccgtcgtcatagagcttgtggagcgccatcattgcccctccggcggagctggccggatgggacgccggtcttgttctccgtgacccgagtcgattcggggtagg

SEQ ID NO: 5920 - DNA, 552 bp, Zea mays
tgcaggtaccatgttatttatccactgtccactctttgtaatttctcttgattgtagcaaacggaatttatgttactctccattcattgattgttaacttcctgtatttttttttctcgaaaacgtaggaaaactctatatctttatattatagagagataagtcctgttatgcgaaagggcatctagcgtaatggttaagccttccgagtagcacctctaggtcctgtgttcgatgcctctcggtggcgaatttctggcttggttaaaaaagttccctcaccgtgcctcgcccgctcccgggttacgtcttgtgcgctaccctccggctgggccgttgcagagtgggcggtgacggcccgctagtgatggggggttagggttcaaggattttctcggcctggaccatgtttcggtctcttcttaatataataccgggagggcggtctttccctccccggccgagttttttgataagtcctgttatgtcaaagtataaatatgtgcagttgtgatttaagtgttgttgtatgtatgaccttgaattttcttc

SEQ ID NO: 5921 - DNA, 1231 bp, Zea mays
ccttcatcccaattcccaaaataaaacatgttttagttaaatgcttaatgtatatgttttatatatgtgtatatgttcatttttatctatttgggatagaaggagtatcatgtatgcaagaagttaatggagatctactagagttgttcgcttcagattaaaactagttgtttggactactacaaatataatccatggtgacaaaaccaagaagataatacatattaaataccaagcgaacaggctgtgcatgcacgctcatatttaccgctataattacatctactacgttcaatcctatgaatacacatacacatacatattctagcctataaacgcctcaaaaattaagcatgtagatttactccctctatcgcttgataacttgacttttagagtwtttaaaacaacttttaaaatctcattaaaatttatgcgaaagggcgccaaagctattacaatatttagtactaatagatataccataaaatgtatttctatatttttatgatgcgttcatttgaggatataattcttttataaatccaatcaaatttaaaataaataactttagtaccaatagatatatcataaaatatacatttacattttatgatgtgtttatttgaggatataaatattgttattctttttctataaatccgttaaaacttttaaaataacttaagatagctccaaaaattgatttattcaaagaaaaaaggcaaaaaaaaacactatctaccactaaatatactcatcaaatacaaaagcgctatctattttttcaaaagatttccaaggaaaaatgaattaatttcaccaaactagccctaaaatttagaaaatgatttattgaagaactggcagagtgtattatctaccactaaatgtgtccataaaataaatagagaaaatacgggcatgtaggccgagtctagacatcatgggtgtataagtccagaattcrtgaagtaggtgcactggacaactaagtggtagacaatcttttattcttttagcaaatcgcatgcaccaccataactactcaggaagatttgcaagaaaagagcagaccagagaccatctgcacattatatgtttctttctttgtctacaacatactactgttccaaacctatatatgaagaacaagtagcaagggataagagagagagagagagagagagagagagagagagagagagagagagagagagaccagttgtgc

SEQ ID NO: 5922 - DNA, 91 bp, Zea mays
tggttggtgaggcagccatgttcgccacatcttggtagccctcactcggcattgacatcctctcgttcttggacttgaagttaactcagcc

SEQ ID NO: 5923 - DNA, 625 bp, Zea mays
cgatgtcgatcggtacgggatttttccatcctattttcatttttaccgtccggattagaacacgtataataattttttatcagaatgaggttcaaaacatcgataattttcgtttacttgctcccgtttatctcactttttatttccgttcctgaatattctagaaatgattctattcccagtgataaaatatgtcagactattgtagaccctagccacctatttctggtaactgaatgctgaaacgaaaaagatggaagttttctcgtcagttttcgaccgagaggcgtgcaggtgcaggaaaaagaaaagacgccgcagacaacacgagtggcaggcgcttgcctttgcgaaacgaaaggcgtccgtcactccgtagacaacgcctcatgtcctcagtcctcagccaccgtcaccgagacggaaagccggaaacgcgaagagggatcgcgcaggccgcgctagttaccacactagcactgacacgtcggcaggccacggaggcggagccatttgaatttcaaacgccgccggccgctaccattcctcccccgactctcccctcttctgcctagtcctcctgtcctcccctccccctccgacctccacggtttcgcaggcaaag

SEQ ID NO: 5924 - DNA, 170 bp, Zea mays
tctggagcttgacgggaagctgagagcacctagagggggggtgaataggtgatcctgtaatacttaaaacttaagccacaaaacttggttaagtgttagcacaataatcaccaagtggctagagaggagtctcaacaaaacacaataaccacaagaaatcaatcacagag

SEQ ID NO: 5925 - DNA, 1064 bp, Zea mays
aaggacgcgcatcctgcccctgtcttctctgcattgtcagctgcttgcttggtagtaatgacctgtttgttttgtctcgtgcaatgcttgtttatggcatatttaatattaaagaacaaatgcggaaacacttgattaaggatatctaatattgcataatttagtcataccaatttctgtctgcttatgcatgagaatatgttgtctaatttttgtttatttcttattttcttctgtggtacctaaactatttcacttgacaagcattttcagttattgcgaattcacctctacttattgatctctcgtgtgtcctagatcatgttgtttctgagctcacagctttccttcgtaaggtacttgcatagtctagttgatgtttaatgtgcctgaactgcagttgcagtcataaagctcaaacaatcttgagcatttggttttacattatattctctggtttctgtttttgtgatttgtgttctgatgatgcaaacacttccatttttatgttactcctgcacaagttttcctgcacaaccaactgtcttttgaattctttttgttatttgattggatggccggaccgcgtcgacgctccctcgccgctggggtcaacagagacgaacagccggggttgctgatgtcttatcatattgccacaactgtttgctcctttgccaagtttatatacgatgttataacctttttggctggaaggacatttgggtgttttctttatcatttgcccctctctagaaattgttacatgtagcatttcctgtccaaacagggcctatttagcattttcaggttctcggttttattttgtaacagattccaggtttccagcactcagtaccactatttggataagcatattgtgccttttaatgttagcaacatttattgttactccaagatctattctaattgccaatacttttttataagcagttctgtagttattgatggtattcatgtttactgtcaggaagaggaactgaaaaggggcgagctggaggctgacaaagacaaaatgatgagagagtatagagctcaactgg

SEQ ID NO: 5926 - DNA, 1442 bp, Zea mays
ctgccagcaattgggaagcaatgtctatcacatttcgcccatgtatccatctataaaagtgccgaacatccattgtcaatttccgtgtgaatggcagcatggaagaaggatttcatatttgaaggaaaatgtatagggagccctgcccaaggtttaccaagctccactttagccatccacaaccatttcagcttatgtagtggtttaaacagtaaaggttcgttgagagcaaatcgattcttcaatcagcttagggcttgttcggttagctctcaatccatgtggattgagtgagattgaatgtgtttgaatcccaaacaaatcaaacttcttatcaattttttctaatctcatccaatccatatgtattggtaataaccgaacaagcccttatgtagtttttatcaatctctgcagcactagatctgacctctacaggtggcgagggatcaagagggaatgctttgagcgcctcgcaaacttaaggtgctcttgtgaaaacctttcttgatcaaagggggatttctgtggttagagtagtggcggtaatggcaaatactacctccaatcttatactccctccgtttctttttatttgtcgctggatagtttaattttacactatctagcgacaactaaaacgaaatggagggagtattattaaaaagtacggaaaacgcaagaacagtggtcggcgcgcgctcccacacggcacggcaccaaaagaatatccaacgcatcaagcgacccctcggaacatgtaacaggaatattcgctgtcgctgcggatcgaaaatcaggtagtagtacgtaacctgacgaaagtcaggtaaagaaaaagaaagaaacatgagaaggacggcagtatccaaagcacagcagggagcaagtagacagagagaggctactactagtactgattcttgctgccagtctacaccaatccagtgccatcccaaatgaaagcaaggttcgcatccttttactgattcttgctgccagagaatatgccatcgccgctccatcccgacagatgggcccgacctactacaatcatgcatggtccgtactccgtcgccctcgaacggttccgcgcatggcgatcccctgttcgtccccccgccgccaggctccgtagtctactcctcttcatcagaaatcgacgagtgatgtacgtaactgatccagccaccccggtcgagtgccacccactccacggcgccgaatcgcagataatgtagagtgcgccgcgccgtgacggcgtggatgagaaagcctccaaacctctctgtttcgggctctccgtccccggcgtccaacacccatactctccccaggttgtgtgccacacccacacttcaactatatacgaaaaccgccgggcgctgggcccctaggccctagtcacagacccttgttctttcttcgacgcgcccccgggc

SEQ ID NO: 5927 - DNA, 1249 bp, Zea mays
tttatagactgatatattaaacttaattagttcacgatttgatcgtgtgatgctacaataaacatttactaattatatattaattatatttaataaatttttcttgttgtttagtcatctgctaagtaattatttttataattagattatatttaatacttgtagtaaccaatcgaacatccgatataatatgtactaaattttaatctatggaaatggaacaggggaagagtggcagaccgatgcttttggctcgcttcgcaaggcgcacaccgcatactacggaacaggagctgggtggcagaccggcagatcggatactttgtggttcgcttcgcctgtctgcagctatgcgcttggcagttcacttgcagaccggaaaggcaagcattgtcatcatgcaccgtcgagggcgaatgtgtttgttaacgattctgtaggatttgtccgtaattgtacaatatacaggtcaagcgaactagtcaaatggttggtgcccgtcctaggaaactaaaaatggttcccaatgcaccgaggtgtgtcagtgtgttcgctaaattgtatcgtcgctagtaatggaggttggagggctcaacccagacggtatcttcaacagcttattcatacatatattcaaattacactccgtgcaatttataatacaaaacaataaaaaaacaatgttttcagtgaccatataagtgcaatatacaatagttcatccatatgatcaccaaaacaccgttttgcaccattaattgtactgtttgtagaatatagtttaaatatgggtacgactatgtgtaagttgctagagaggttcaacgagagaatgcataatgacgagatatccacaagtatatggacatgacatgacacgatttttatacccgtatttagtttcttgtttacagtcatgccaatgtttcgccatttcttgacggcacatcaagcgttatatgaaggggtagaatataatcagggcagacaaaaaagcatattgcaaaagacgttcaaggtctaacatcaaattttattctcgccgaacagttccggtgcaatgtgaggatcagctcatctgacgtgcagggtcgaagtactccctccattctcgaatatcagtcgtccgctagttcatgtttgaactaaaacgcgacgaataaaaaaaaacggagggagtactttacagcagaaacaccaaaatcagtttttgttctgagagccctcgacgctcttcctcagcacagat

SEQ ID NO: 5928 - DNA, 479 bp, Zea mays
tttttactaacagtttgactgtgtttaccaacaagaatttatgtgttgaattggacccaatattgtcgttttaggtttttttttcgccatgtgcttgtgttgggtccgtgaatgtagcatggtgcttccatctttatattttctaattcatggtatatatatttttggttggtccttgagctcacttggacagagtgcggcttgccgacccagcagtatgtgcaggtgcggcccggccgaagatttggcgcacgcacactcaggtagcccagtggctggctccactgccagacgcgctcggctcggctcggcgcaccaccaccccgaggacacggagtgagcccgactgcccgagcccgtataaatcgacgccgcgaggggaagcgagccgcaccgcaccgcaccgcaccgcaacgcgccaccgatccaccccgcgtcctcggcctccctccctccggcgagcggcggcgcgggcggcc

SEQ ID NO: 5929 - DNA, 145 bp, Zea mays
ggttaacgtagaaatcttttggcttatggtcatctgtggttttctgctgactatcgtgtttgattatttctttagttttaataggaaaataatgagtgggttgaatggcaaacaaatgtgctggtcaaacgtaatgaagtagaga

SEQ ID NO: 5930 - DNA, 434 bp, Zea mays
ggtaatttggagtagacttctatattcaataaaggagatgaggcttacaatatataggccacacatgtgatgcaccagggaagggtgcggcagcctggtgccaatcagagcaggcctaccaaaagagagatatcctctttcctaaattagtacagcagatctggctacttaaggaaggaacctctagttgccataacagaccatgctgctatactagcctagatagaagtgcctcacgcaggaggcaatccaggaagactaccaaaacagtctaacacaaatgtctggatcctaaatttcattattatctgaaactaatttgataaattccatcgttttccattcatagtaaatgttttctgaagttttgatttataatggtcaatgttctatctgatcactgggttactaccgttttactttgtgtaatgcag

SEQ ID NO: 5931 - DNA, 884 bp, Zea mays
tcgcctttccgtctgattcgatatattcatggaccgtccatgcctatgagcgaaccgtctggccgtgatcagtaccacaaatgctgctcaacaatacgtgatggtcttacttacaaagcctatgcttattgtgatgcggcgctagtaataaaggatctcggaccgacaaaggtgattgttaaaacgggttgccaaggattagtggctccatggaattctagaagtagtaattggtgtgctattaaatcaaatcaaggaacttggccgacaaagcacacatttttctctttgctttatgtaaaggagggtagcaaacatgtgtgtttcattacacaaacaaccaagttcgctttgatttcaaattctgaatatacgtggttgcatgatatcccgaacttttttatgtctcaatgtattcagcatgcagaactctcgtgctaagaaatgaatgaagcaataaaaaggctctttttcccgggtgttttggtggtttagtctggctttgctttttagattgttgtggttcggtgtccgtgtgaactcctggatctggattctggactgtggagtgtttgggtctgtgttttgaaacagagagtcgagactttaattctgcgagggtggtatgtgcaaaactggacgggccgtgcattatcatgagagcctactattatttctacacacccacaaccacaacccttgtgacattattgccccctcttcccttccyaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcg

SEQ ID NO: 5932 - DNA, 70 bp, Zea mays
ggtcagctgcgtgtgtactgatagacgcgcacgcttgagttgttgatgtgtcagtgtccggtttgggcga

SEQ ID NO: 5933 - DNA, 1020 bp, Zea mays
cgacgtcggttccagagaaggagaggttgctcgtggctatcgtgggaggacgggagcgcagccgatggatcgcgagcggctaccgtgccacggacggtccggatcaattaaaggcagaacgacagactactcttaccttcttaataagtagtatagattaatctaccatatggtattgcagccaagagttgggagggacttgcttctattgttcttgtgatttcttggacctacgaaagagatctatgagatcccttagttcatgctatagactcttgagtcttttgcgtctatcagttctagtttatggttttgcaattgttcggaaaatgagtcgagatcatcatggtttcagtgtctctccatcgcttggtcacattcaaccttggccggtataaaaccatttaggctactatttgtaatatctacctcgtttttgcttacctactttcatgaagatcgaccaccctcgagtccccctccccctccattaggccttgttcgtttacatcagattgtacccggaatcattccggctaatcaaagtttatataaattagagaagcaatctggctcggaatcgttccgacccaccaatccgacacaaacgaacaaggccttagtcgggttctatccacgtgccctaattagaggcgcaacaatccatggtagagctgctagagcargtgaagttagaatgtttagaagaaaaggttgaacgtaaatcaatatttaatgaatttgtagatgatgtatctccaccaaacagagcctcgtgatgggcagcccaatctgttgacatcccaaaacggcccatgttgaagtaccatgtaggcctcataaccataccgcaccaaactcactctcaatcccccaacccaacaagacacgaacgaccacgacggagggcagcgatctcggtttttacccaaagacgaagccgacgataaggagaacagagactccggcgagccccagccacggtgaagccgcgcgaattgcaggagcgaagcaaaggag

SEQ ID NO: 5934 - DNA, 186 bp, Zea mays
ctgcagcatcgattcgatttgcatgccgcttcaatggtatatatatgtgcatccggatcaagcctagccttcatcgagcaccactgcactgcacatctcgatcgatcactttgcgatacatcctctaccaagctcatcacgaacaaataagaagcagatattaagcagctagctagctagctagca

SEQ ID NO: 5935 - DNA, 1230 bp, Zea mays
ggtaagaacgctagattctaaatcaacggcacattgtccctttcgctttcgacccatgctccacgcgtgctcttgtgcttgacatgtagccacaagggcccgtcgatctgttttggtttaaaatgtggatgaaaacaacatggagctctggcttatgggggcttctcgacgccagcgaagcccgtgggtgagcttacacaagctttaaatttattgtatttgcctagagtgaagaaatagtttttgactgatatcactacaagtgattggatgagaaatttataatataagttattttgataaaagagactattgcattttgttcttcttggaaaagaatgaatcgtgttctatatgcaacagtttggaggtgattgcacatataccaatctatcaacaagtgtcacggaatcttgttcttagtatttaagaatctgaatgagatttgtatatttgttttctattatattaggagcaattgtggccattggacattggttgcacaacttgataaagtgaagaatctgcttgcgtctgagtttgggagtctataaacatggggaagagcaaatattggtggcctcatacatgagctgaaccatgcttcttgctatgatatgccacgggggcgaaggctcttgcttcgtcgtatcctcttctctgggagccgactacgccgagatcctcgaccggagcgtcgcgtccaccaatagaatattactctaccgtggatattctttatttgttaatgggtacgacatttatttgttaattgtcttttttrtgcagtgcggcatttagttgcatgtgaggtctcagtttctgtgatttcattaatatgatttaaccgtgcacgttatgatgctttgtgttatgatggttccgccttagtaattgatttgtcatatgcttactagatttctgtaatagagggagcaaattattgagatgctatgctgaaagagccattgtgtgaactgtgaattgtctttgttgtcatcctgaattttgatattacattctgaattttgttgttctatgcacattgatagtaacttcttttgaaatttggggatcaatctatgaatagggctttaggttatgtttatgtggttttctctataaacttaccacacatttctcttcagtttcgttgtgtaggcctcgatttcaagaacttgtaactacatctatgcactgctgcagtagcaacatagggatattgagttt

SEQ ID NO: 5936 - DNA, 1010 bp, Zea mays
cacaaatgtataagtcctttctaatggaacatatgactaaatgtataggtagttccttttttcttcttaaagttaagacactttattaaatacaataagagtagtacatatttttcagtataaataaaaaaataaagtttcttttttgtctcggtttcttcttcgtcttcgtcccttcttcgaatcgaccttaattttttcgtttatgttccttcttcgaccctatttcctttttccacacaattccttgtttgtctccatctagagatctctggccaggggtgaagatgctcttagccataaactagcctttagcatagaaaataaaaaaatcaactaagggctacttggtaagtggatatattttcttatttccttcctaagggctagttcatgaatcaagttcttctctatttgttagctagcaaattttagctaaatgatcattagctttagtgcatttaaacaccctcttagtgtggctaaatgagctagtttcaaaaataaaatttccatagtatttattctagaaataatattaaaaaggattaaaatttccacagtattcattagctttagtgtatttaaacactctcttagtgggcttgctcctgctgccgtcatgttcatgggctaggtaggatagcctcttgttctcctgggcctgggtaggagagtaggagaacgttcggagaatctttctgttcgttaccgagcgttctcgcttgtcatgtcgccgtaacaaatccaaacaagacaaatgcgttgcctatgcagtttgcagagagttttggtgcgactccctttctgtttactttgcaaggtaacgacaggtcgacagcacacaaggcacaagcaacctcctcttcacatgcctcgtgtctcgtcaggctgcatgccaatgtagcagtgtcttcagccgacacccccatctttttcaatcctcaggcaggcgcagcgcaggcagcatccacagcctgaatccaccacaccagcaccacccagcaccg

SEQ ID NO: 5937 - DNA, 657 bp, Zea mays
caaataatcagatctatacaatttataacttaatctgatgaatcaaaatatcaaatgcattgtgagatattttgattatttttttgtttaggtgccgaattatggaaattctggaattatatattgtacatccattctcgaatatttatcgtccgctagtttatttttaaactaaataacgataaataaaaaaacgaagagaatattacatgtctaattttttttaatcctcagctatccaaatcctgggtccgcgctactgaacgacactacgatgcgtgcacgatggtggttggtacctggcccaagatttcgtttggctctcatgtctgtttagctgttgcatgccaaattaaggcaaagcaggcaaaggcgcgaggcggcgggctggccacccaaaagctcggggcgcccatgctccgaccattgctcccgccgctagctcgtctccggcccctgcctattcattcgtctctcccagcagctcaccgtcgtgcctcctccatcggcatccacccggccgagagcacaacgtgtaccgtctctccccagcgtgcgcgcgcgcgtggtcggaggctgccgtcgctcgcgtcggccgcccccgccggccagcgagagcgagggacaacgaccgaccgaccgaccagctcgaggtga

SEQ ID NO: 5938 - DNA, 200 bp, Zea mays
agtagatttaaagactcaattaaagtggaaactggagactaatgtttttttatcctctcctgtttattttggtaacggtagatgaatggaggtcgattagattgctactaatgtagttgcaggtcttgcattgttagagaattgacgtagattttacagcagtacatgtaacaatttaagatatttttaacagagtctgg

SEQ ID NO: 5939 - DNA, 286 bp, Zea mays
agtaagtatagatatcaaagacgtcgtgtaataaaagtgatcataatgaacatctttacaacatatggatgatgatgtaatgtcagaatcaagttgtcttagtttctttttgtttaatgagaaattggaaggatagcgacgattccaaagtccgaacagagctagtttctcccgagcgcaaattttgaaaaccctcaacccggcactccgcactcagatctgcctgccaggcccccccacaaatccacaatccaaccgcacaagactcggaagaagaagcggggtg

SEQ ID NO: 5940 - DNA, 1114 bp, Zea mays
gagcgggaagttatattatagtcttcctcctggaaaaaaattatgtacatataggatgtaaacatcatctattacagtccttcacatccaccacttgaggcccacaaaaatatatcaaaatttataaaataaccttttagtaatttatttttcttatatttatatgaaccaacagctggtgtatgtgagaggctgtaaagagattctttacacccggtatctaaaaaattccttcctcctgtagtttataatttttagttgctaaaaaatgagttcgccatgtttcgtgccaccccaagcccttcgccgccgtcgacaatcagacgcttgctctgcccagacgaccgctggccactcgacccctccggtgtgtcgggtcaggatcagaccatggttttcgacccatggataacacgatccgagaaatctccacccaaagtacgaaaaacctgagaacgagttcgcgccgccagtgcgtcaggtcgagctccggacaaagacccgaccgtctccgaccaaatgtttggtcaggtctgagcagctcttgtctctctttcctttctcccctccaccataggacaagatctggcatggttggcttatatagatggctgttggtacctaatgaacaagccgaccgatacactccaaccgaaacaaacagaattgcatccaacatcctgcctgcacaagctcatccgtgtgggcaactgaaagtgggcatttttacacgattctgaatcacatagtaacttagggaagaattttccatagattagacctatcagaacaagctgaaaaatggacattttttgtcatggtttttcagtatgaccgagcctagtgttacaacccatgtgtttggtgaacaacaagagcgactgcctgcctatcctagcacatgatcttcatcagaaagtcgcgcgtctaccacgacgagaaggggagggcctgaatggcggcgccatctgggctgttgttgccctgctcgccaccgctcacatggtagtagtagccatggtggtactgcaggtgctgctgtgttgcagctgcagtggcaggaccgggtgaggacgttgtcagattggaagcctgccggctgtctcccaccctc

SEQ ID NO: 5941 - DNA, 874 bp, Zea mays
tcttctttaccgagagagaaaatgacgcggtgtaattgggttgaacataatcattaagctgaggacttgctaacaatcaagtcctaattaagtatgggtcctatagaaacattcctagtgcccttcttcgcacgcctgaccctactctgtgtgaatggcatggaagtggaacgaagtcttgtgtgcagggtgatgattgattccttgacactttgatctcgttgtactctggttgtggcccggaagtttctcagaagcatcattagttcagtgtgcgcagcgcttataggaaatacctgggctgccctcttacaaatttatgaagacagacgcgatttatatttctctgtgtttttctttttggttgaatatcacaaactaaagcttgttttgtcatcacctcagggcctcgcttccgtatttcacgacgcacacagatctggttcaccggcaacaagaggcggtcaggcagaggaaggccatcaagaagggccttcaatcagacaaggaatggacgggtgatgggttcgtcaaggagaccgaaagcatggtatccaactgatgcatctctgccaccccccaccgggccattccttacaccatgctccaacttcatctttttaataaacgcgcaccagaaatgccacacaccaagcatctagtcctcatctgtacatggttctgaaccttgggccttcagtctatagaacaggccatgaatccacacaaagtcgtgacaacgggtgacattgagcgatatatttgtcatgtgaacattaatttgtagcactgagctgagrgcttgaccttgtaaaatcttggagacttcaatctcgcacaggttttctcaggagtttataattatacgtgagtg

SEQ ID NO: 5942 - DNA, 133 bp, Zea mays
tttgctcctgtacatatccctgatcgtttgcactcagcactgccagcaagtgtgcatgaacgatctgatgaattaagacgggcaaactgccgcaagctgacgctctggcctacgtgcgtcttgaaactttcgg

SEQ ID NO: 5943 - DNA, 396 bp, Zea mays
cccacccccgcattttctccgcgttttgtcaacgtcacgcctcgcccgccgtcctttcctctcccactcccacccccaccccgctatctcccactctttctctgcacggcggggctccactcgtccgccactccaccgcttctacaagatcctacaccacgtcaaaccagacccagccgcggagaaagctagctgtagctacctacccggtccggtctccgcttctcccgcacgcgcagcctgctgcatcctccttcctgcgaccgcccgcttcgttcgcggaacataaaggtgagccggaccggaccggcgacccagccgagagggagcaagaggtgctgagctatcggcgccgcaggtcttgctccggtcagccacggcggcatcggcatcggc

SEQ ID NO: 5944 - DNA, 1500 bp, Zea mays
ataatcagatcatcaggtgctttatataattcataagttgtattacataattctggaaggaggcaaaggagacatgtagtataatctaacttatttcaagctaattatcagtttaaaataagttaaattataaaattcggacggattataataccgaacaaacaggctaaatatttgattttggatgatacaaattcacgtgtgcgtgtctagttaagaccctctcccgacgacgacccgaccgctccaagttaccaacgatttgtttacgggctctatgtttgtgctttgatgtctggtgcctgtctgtgcacacaaaataatctgcgctgtgtattcatgtgagtggatcgagcacgggtatgcatgccgcgcttgatgttggtaacatttggaagcatttgcgtgcaggggaaggctgcaatccctgtcctgcccacttggagcctccgagttgcaacccaagcggtgaggagaggctgcgggatgagaccgcattgccgcgccaggtgcggaaagcgagagtgcacgacgggcgggctgggcggtggcaccggagaggaaagcgagactgcgtttgacccacggagacggagacggacgagccaccgcgtttgggcgtcgagatccgcgcgcggttcgtctccctgctgctctcccgagtcccgcatgtggtgtgcgcttgttttcgccttttcacggaatccctcgtctttaccgcgccccggtaagcgtagcgcagtgattaaccctccgtggccaggcccaggcgagcaatcgatggtacgcactggacgccgacgcaaagcaggagtcatgtatcgtcatggagctcgatcgaatcgccaaggccatggagactgtactcttgccactgaatccgtttgcttcctgctgctgcactccttttcttcacgtaccgcatcggactccagcgcacgccgccgtgaagagagaggacgggacggcaacgggatcgattttcttcgacgcgatccagtacagaagttccagagcacatgcccgtcagccgcacaccgtcgtgggtggcagaacagcaggagatcatagtggacgatcgtacgagataaactggtaccatgttgagatcatcacccaatgattttttttaagtaacatgtatcaacgctcctcctcaaacttggatcgtgttatttaggttcccgatcaagttagagaatccgcttttctggttatctaagtttaaccgagtttaaggacggatactacattttactcaattttctgcttatccaacttgggccaactggcctacccaaaccgcgtctagccccacgaaggcccatcaaacaccggtcctcaggccgggtcgaccggtcgacccatgactcgaacggccgtcgagcccaaacctagcgatcgcagagagttgcgcccggaccccggaccgcgccgacccggctcgcaaactcctccacaaccctcgtcgccgccggctgctccacccccgccaccgcc

SEQ ID NO: 5945 - DNA, 144 bp, Zea mays
tgcagcagcaggatgtgtaacccgatgtatctgcctgcccgttacacacataacccgacaaaacggcgtttccccgacacagcctgaacacatgcggtggatgtaatagacgtactgccggacgcgcagacgtttatccaccgt

SEQ ID NO: 5946 - DNA, 407 bp, Zea mays
agaaagtctgtctaggccgtgctttgctttgctctgctcggctcagttaattaactaccatgcagtagctaaggaaggggctccattgcttgccgtctcctaccacgaatagtcccggattagtacacgtatacgtattcggtacccgtttcaagtaccctgtccgttttcatccctaatatgaagatcaaagaagaaagtctgtctgggccgtgctttgctttgctctgctcgggtcagttaattaactaccatgcggtagctaaggaaggggctccattgcttgccgtctcctgccacgaatggtctggtcgctgtcttcttctgaggacctaacccaagacggtaggtaagtgccagcttaaagtctatctaaaggcggaccaccactgtccacctgggcggcg

SEQ ID NO: 5947 - DNA, 569 bp, Zea mays
gttaaattggagcatggcccttttttaaataggtcgctcgtccactttagctagcaagttggtattatatacgtgggtttggatggtttctcatgtctcatttgttaggcagggaggaaaaacaaatccacgtgacccatgatgcacaaaactagtgctttaatattatgtgagaatttttagctcttccatattctttattagtcattgattgacatattaggtaggagtaaagacaaagaacataagccaaaaccgtttttttaatagttcatttgtcagtgtctgcgtgcaacgacgtcacaagagcgcagctagccctacacaagcgtccactggcgcatcaagcctttacgcgcggcgaagcgcaccaacctacatggatttttttttttattttggtgggtacctacctagtactttcacgtgttcttggtaggatacgtggacaatgtgagaccacgtcgcattcagaaaaactcccggcgtccggacgctctattatacattcattataaaaagactgggcctaggctagactgctgctcaagtcaattcataaactcaca

SEQ ID NO: 5948 - DNA, 763 bp, Zea mays
tcgcggtgcgccggcggcgacggatggtacggaggcgcgtttgtggtgggctgagggctgtggacgggaaaaacggctgtgggctcctctagtagagctaataaattagcgtttggttgagctagctaataaactaatagttagttataagatagctaacaattaacagtgttattaacggagactgtttcaaactaaacaactaagttttagtagctaactattaattttagaggttccaaatagagcctaaaaccgttcgatggaaaacactacatatatattttcacaatttcatttaaaagttgctaaaacagatttagaggtgctttcagttttaccatacgagaaaatcggcttttaaaaaagctagtttctaaatccacttttttttgttaagcttttgatttttagggagcaaaatccaaaaccaaaagccataccaaatatacagttaggacggcatggaataattaattaaaccagtaataattatttttcgtggccgtggaggaggaacggaggaagggtcgtcgaagggagtcgagccgtcgaggcagcaagccgagtcgataccggagcggcccatgggccatgtatggtgttgtcttgggccgcaaatctgtgccttccagtccagcgtgccgcacggtatgcgtctgccggccgttctcattcccctccaaacttaaagccctaaacccatcttgctcccccctcgtctccactgctctgctgctcctcgcgccgccgcagcgacgta

SEQ ID NO: 5949 - DNA, 1500 bp, Zea mays
tctccatcgtcctatgttagaattgaacgttgcaaaaaactctaaaggtaccaccacctctctagagtgtccgtgggccctccactccgagttgtcactcccggcaccggcataccgcaccggtttctttttcttgagccgatggagtcaagctctcccaattatattccatcggccatgcatgctacccgaatcttcctgccgcgactcatgaatcaagttcttctggttttgtcacgatcctactcactgctcccagatgctggatatattaggtggacatacccccccggccggccgcattttaattttttgcaaatgcgcagtgcgcttgacctcaggggctagctaccgatcacttctccttgtctcagcagtcagcaattgatagcacaaaagtcattagcctggggccggccttcccactgaggaaaggaacaacaggtttccactaaactaactttagctctcgttttttttctttcctgcatgcacgtacggtacagagaaggcgcgcgcgcgcgcgcacacacacacactcgctcaactttcatctagtgtgcacaggctatgtccttgtcgtcgtacgtccgtcccagaaatcactatgatgaactgcatcaacaccaccagcagcaactgttccctgctgagacaagcgcactgcgcattatcggttgaatggtttccggtaactgaaaattatcgtacatgttttcatccctactgttgaacaattatcggttgaatgcgcaatgggtggaggaaattcagaatcattgaaaactagtcagtaattttcacccccagcggtccagtggaattcaggcaaataatttatttacgataagttccatcgaagacaatgccatgagaaatacatataagccatcaagacacttcctttgtgcatataagctaactaacgggttgcctgatttgctattcttacatagtcactccataagaagagtttattttaaggcctattccgattgcataaggatcgagggtactgatgggattaaatctcattccattcaattttgagtagaaatatatttaattcctttctaaccaaacaagcaaatcattgaaaaaaaattagtcataactaggggtgtaatatgaacaaatattatccgacatccgataaagaatcattgaaaagaaaattagtcacaactcacaactatttttagtgggtgagcttctataaaaaaaatgctccaccaaatagctgtaaacccaaaccgtttagcctggctacgaaagcccatgaaaatctcagtgggcttgaagcaagagcaagattcggcccaataaacccctcacatttttcacggggcccagccatcggaatggcgggattccgaaatttgaaattctcgcctcctcgcttgcgtggcttttcattcccaccttgttccttccacccagcgtccagcgacggtgacggcgacggcgacgacgacgactcatcgcagcaggggaggacgg

SEQ ID NO: 5950 - DNA, 358 bp, Zea mays
gtccttcctgactgcttctcttgcatgcctgacaccggcagcgacgggctctcacccaactagtctgcgtagcgtaggtaagcgacggcgacacgccgttcttcccctgccgttgaccaaatacatttcgtcttctagcaccttctcgtttctctcctcctcgaccgcccccgagccaagcagcagcacccagcgccagcgcaaacgtcatgtcgcctctcctctgtctctctcgcagctgaagtaggcagaagctgcacacatctatatccattcctagctgctagtcgtcggatacttggaaaccttggatctcgcgcgcgcacgtaggggagcgcagcggagcaagaggaaagcc

SEQ ID NO: 5951 - DNA, 423 bp, Zea mays
gaagtttccatactaaagaaacaaatagggtggctaaaattattgtgctaaagtttagcatatattagctcctccaaaggtgttaaaatgagctaaaagtggtcccaagccctttcactctatcccccactcacaacattcactttttctctctcctcctcatgcttggttaatagtaatgtggctgtaattaatgtgctatagtcttgtattcaaacaacataagtgttaaagtttagaaattttagtactatacaaacaaacagtcctacaagtgaagggaagcggtcaacatgccttgtcagacgcagcacgagatgccaaaagccattggacggcagacgataaagcacggcgcgccaccacggataagaatccagaagcttgcgctccgctgtcccgtctccgctccggcctccaccc

SEQ ID NO: 5952 - DNA, 160 bp, Zea mays
atgaatgataggagtggcagctatattttggtcgttatagctttaccgaaatgacgttgttatttaacaataaataaataccgtctattatgtggtttatttttatgggaaccttgaagatgtttatcagaggtagtggctatgaagatttttgtaatat

SEQ ID NO: 5953 - DNA, 1500 bp, Zea mays
gcgtcggcctgacaaatcctatcaccggtagaaaaagaagcgatcagtggaccatggctgcagctgtttgcgtagttgctacagtatttaggccgtgtcagtagagttttgcaatggtaacaaataaatttagatatatatataattaatcttagagctgtttcactgtgaatctataaaaaaaactatatatttggttaatgtagtagctctcgagtcatacgtaagcattttcattggtatggcctttgtctattgtctttgggtagagtccacatatcgatgtatgtcatcattctttctcctcagccgatacggaaaactaaacatgggacgaggctcggaggctgcctgaagggttcacgacttcacggctatggccaagggtagtccgccgctggatatttcaattatctgtcactatactagatgtctagacgtgagtagggatgaaaaaatggacggaatcgttaggaaaaaacatatctctcattttcatttttatattttatttcagaaacaattaactctaataatattgtagaaattttcatggttaactgtgattatactcttcttttaccttatatttgtgattttaccctaattttttattttttaattactagttctgattttcactaacgttgttatggggaggggcacagcggcttcgtttttaaaatggagaggttgaactacaaagttaaaaaataagggataaagtcacaattacaaggtagaaaggtataatcataattaccccttattatatttagatatctaattaaagatatgtcaggcattatttttttcactaacaaaattttctgtttttaccaactaaaaaggacatggaaaggttcttgaatttgccggtccttcgagaaacgtaaaatcttaacaaaggtggtaaaaaattatggttattactagaggtaaacgatgtttgttggatttaatctctattacattcaaactttttggttccacggtttctaccgttatcgtgttctctatgtatttttatgttttattttttacatttaagtataaatagagaccgtaaataggcacttcgctagttgaagttgaaggcgaaagggtgactgccatttcatgttaccacaactcgccgtatatatacaacggcaccgccgccggccgcgatagctacaactacaacccgagaccaattccgccatactacccaaggaaacctgcgcaccgccatcaccgccgccgcagcctctgttcccacagacgcctctctcctactcccaaccccaatcaaacgcaccgctgaatcgcctgcagtagctggagcgcaccttggtgcgatcctaccacacctctgagctcacgaggaatctttaatggcgtcggagtggcatcgccagccatagcagcctggctggctgaggtgcaggctgccaggctgccgaggcgatcacttgccaaccctctgctctccttttctaggcgcactgtcttgctttg

SEQ ID NO: 5954 - DNA, 211 bp, Zea mays
acaaacatagccaaactgctgtgtacgcacaaacaattgtatgctcggtgggcttcaagaacattaaaaatatataaatgtatgttgggtgattgggtctatccagctttttgttagcatgttatatatatcctagtattttccacttttcttttaaaaaacataattgatactcttatgtgtattgatttgaattgaattacgtctgcat

SEQ ID NO: 5955 - DNA, 1373 bp, Zea mays
taaaaaaattatataatagttaaaattctttttttttctccgtaaggtggatgaattggtattatctcataattttggatgtcctcgatttgacgtgatttcagctctaagttgtagagcttttattagctttacaaaaaaaatccaaaataattaaaataaccaaagttacgaacatactttaggtcctagcctttgttgaatggacatattacagtaataccttcatccgattgttgaatgggacatgttcttgattgcttgggccgtgtcacttggtcttgattgcttgggccgacgtatcaggagcaacaagtacagtggtgttatttttgtctatgtttacgttatttgtaatatgttaatcactgagtgatgcaagttaatgttatattcatcaatttttttgcgctgggtacaaaagattaattgccacgaaaggaggcgaagatacccatgtaaagccgcgcagtgcggcatctgctttcgacgacgtcgcagacaaaagcagggggcactacggcactgcaccaaagaaaagcccatggatggatgtccccccagggaggccggtctttgtgtcagcacatctgggttccttagtcatgaattaaccccccatagctgctgccctttatttcgattcgagacgaaacggaactggtccaggagcgcctttctttctttctttctttctttctttccatggctaagcggcaacttgtcccttccttctctgcttctcatctcacctcgcctctgcttcgtcaacaggaagatcaacgattgtaacacattttattgcttgattcttcttcacctttggccaatcttaaaatctgcttggccaatcttaaaaactgcacgacgaaagcatgggcagacgacccactgcttcaactgggcatgcatgtgttggtagggaacagcacattccaagcgacaatcatgaaacaccgagcatcagattagtactactatttgttagtgccaagaataacccaagctttacctttgtccaccttaagaaatatgcttttctaagataacaaatcaattgctggcagccggcaacgctgtcccaccccacacctttgctggaagcagctctatttttttcagtggaggaacacgagacagtggccccacgctcgaagcctctctctctttacgtattttggaaggaggtacaccaccactaggctcaatcgatcagactccttttaactccaccactccattgtccattccctggctgcctctcgttgctgttgttgttgctgctcttctctagcttgctttcccccaataggcctctctgcactcttgagcttctttgccttgttgaacttggtagctgtggcgttgccgaa

SEQ ID NO: 5956 - DNA, 541 bp, Zea mays
tgagggagctgctggcccgaatcatggcgcatacgacgtggccgggcggtggcggcggtgacgaacgacgacgccccggcggataagagcgggagcgggagcgagagcgacgacgatgactgggtcgagaaccagatgctggctttgctcgacgtggcggtgccgtaccggaagaagagcaggaggctgccggtctttatttttaataattgaacctcttctgccggttcttctccctccttgagtactacttcctggcaatttatcttctccaacaaggtccgacatcaacaagtgattgctcgcggccccgcaagcgagagagaacttttcaacccaaacaaacagtccaatccaattcctagggcaatccggtgaacgtgtgcgtgtgtatatacatacacacggccgccgccgccgcaggcctcgctcctaccgccaccggactcccctttcgcgtccgcttctcttgttgttgctgtgctctcctgttaccgggacccggaggaaggcaggaaggaaggaaggaaggaaggcgggg

SEQ ID NO: 5957 - DNA, 169 bp, Zea mays
ggtaatttagttgtagctgtttcaggagttccacatttagtgttcttattggttcttccttttctcttgtgcactgtatttattcctaggttatattcacaacatatcaaattgtggccactcaccaaatacaagtggctttatgccacaataaaactgtcctcatttg

SEQ ID NO: 5958 - DNA, 123 bp, Zea mays
attgtactattatttttgtgaaatatgaagactcgttcttcaccaccttcgtccaagaaccattatcttcttttggatataatgatcttcaggcgaaggtcagctcgaaaaaccaccttcatc

SEQ ID NO: 5959 - DNA, 176 bp, Zea mays
ggtttgtattactattcatggtactttatccttttaactaagcattctattttctggttgcttaccaccgacaaagtcctctgagcctgagcttctctttctttctctgcaatatcattgacatttttgttgccttcgcagaggtgaccagtgatggtttattttctgttggagaa

SEQ ID NO: 5960 - DNA, 1008 bp, Zea mays
tgtaatgcagtattatgaacgttagtgaaatagttattctccgtttccttaggtaacctgttagggtgttatatgtgcttgctctggtacttgatgtgtcgatagaaggttagtgacttgtttgcttaaacccaaagctaggccatattcttaattggtgaaccatgacccaaaatttgaattttccattatcactccatgaccaagcccatacaaatgaatgcatagacaatttccttactgaacataaaatgtacctaagcttaaaacaagaacctcgagtcatgtctccttctagaaccattcccttattcggttggtgcaagatgatgtcccttatccagtttgcctgttcttgaagatcgccatgttgttttaccaacctaatttaggaaagacatgtccgaccatttccttgagtttggtgcctttggtttcctcatatctatctaaggcatatcaactcaatcttatgattgttttccctccgtatctaaccagatactaatccttgaccttgtgatctctacgatgggcatagaaatatgcttggggctgaaatgacagtctcccgtcatacttccttcattaacaaatttaggttatggccataccttgttcatttcatcgggccatgawtctgtttggctctctacttgtaaccatccttacaagtggagtatctctttgtacatttgtcaccctttgcccaatttcattttgtgtcgcgtgagatttcttattggttatgtctgataatggtgttatgactaaaaccagtggtgccgtgacgaaaccgagggccttctgtgtgtgcgcacatggttgcgctactcggcacacgctagtatcacagttagtagtcataatccattatgagattatatcaatatgttatctctacgcaaatcgttcttatcacgtaagatccattattggtgccagttttgtaatggtgtcatggttaagaacttatggtaccgcggcgaaactgagagcctcctgtga

SEQ ID NO: 5961 - DNA, 244 bp, Zea mays
cacatgcttcgttgcacgactcgtagaaaagttacataaaagaagtgaaaaaagggcccgtagagcaagtgaggcctggacggacgacgagacgaaccaaggctataaaggcagcggagggcttaaccacccgccccactctctctctctctctctctgaactggcatttgggccatcgatcactggtaacgcgcccgctcactcactcgcatcacactccgtaactccccgacccccgcgcgc

SEQ ID NO: 5962 - DNA, 1500 bp, Zea mays
acttttgactatagcatgccatgcggcgcgtgaaacttccacgggcattcaaaaaacagtctccaaccggacgtctacacgtcaaatcttccacggcgtatatgcatgtaggcattcaacaagcgaagactaaattcaacgcggcgcctcatatgcatatgtgcttgtcggcattcaaattaaacggtctccacagggagactccctgagtactctcccctcgtccatattcggccaagacgcagacatcgatctctggccaagcggcccaatctcctgtatccctaagagcatgtatagtgttgtttaatgtacagtagtgatttgatgtctttacactatacatgccccaattaagtattcttctcttggccatattctgttcgattggttaactgtatcatcccgttatagatcatcatgtgcattaactttagttgagcatctagttgagtgtttgtgtgaggatgggctgcataagtatatacaaaataagtcgttctgagaccatttcctttcatgtgcacatacgcccagaattatcatatctagtcgtccaggctgacgcgagcatgagtgcgcatgtgcaacaaacgaattagccggattatgttataagggttgtgtctagcaaatcatgtatataaccatgtaaaacactattttttgcmatataaatagcacttataatgaaatttaaactgataagaggatatttgtttaatattataatttatcaagattatataatacaacaaattttgaattaacatttagttcaaaatttattagattaaataatttagccagattataatcccaaacaaacatcctctaaatactatggttaaagagggcctattaaatagaagttttagggactaaagtttagtccctaagtttttttatatagagacaataattaagtaaaaataaaatatgtaaaaggtatttgatggtattacatataagaatttggagaaaacccgttcgtaatatagatttttggtgtatagagagcattgtgaagattctataaagaagatatagaggataattataataatggacatcgcgctggagatagtgttcgccgtaacaatacaacatggcctcagtccggtctcaccaacgcgatctcgatccggacttggcacgggagtgggtagtcataaaccatactaaaatttgcttagatctatttccttagaaaaaaaaatatatatatatatatatacttgatgtgcaagttcttaaaaatttcggcagagggttctcttagctatttatttagtatatgcaatataagagacagacagacagtgcctggttgactgcctgtgcacaggattgattctcttgggtcttcttggctattttttcagtatatatatatataagataagatagtagtgataagtagtggcgggttgttgaaggagatcccacgaccgaacttctctcttgccttcgctggtcgagatgacgatgaaagcaagt

SEQ ID NO: 5963 - DNA, 1500 bp, Zea mays
ttacgcggcgtgtgtgaaacttttgactatagcatgccatgcggcgcgtgaaacttccacgggcattcaaaaaacagtctccaaccggacgtctacacgtcaaatcttccacggcgtatatgcatgtaggcattcaacaagcgaagactaaattcaacgcggcgcctcatatgcatatgtgcttgtcggcattcaaattaaacggtctccacagggagactccctgagtactctcccctcgtccatattcggccaagacgcagacatcgatctctggccaagcggcccaatctcctgtatccctaagagcatgtatagtgttgtttaatgtacagtagtgatttgatgtctttacactatacatgccccaattaagtattcttctcttggccatattctgttcgattggttaactgtatcatcccgttatagatcatcatgtgcattaactttagttgagcatctagttgagtgtttgtgtgaggatgggctgcataagtatatacaaaataagtcgttctgagaccatttcctttcatgtgcacatacgcccagaattatcatatctagtcgtccaggctgacgcgagcatgagtgcgcatgtgcaacaaacgaattagccggattatgttataagggttgtgtctagcaaatcatgtatataaccatgtaaaacactattttttgcmatataaatagcacttataatgaaatttaaactgataagaggatatttgtttaatattataatttatcaagattatataatacaacaaattttgaattaacatttagttcaaaatttattagattaaataatttagccagattataatcccaaacaaacatcctctaaatactatggttaaagagggcctattaaatagaagttttagggactaaagtttagtccctaagtttttttatatagagacaataattaagtaaaaataaaatatgtaaaaggtatttgatggtattacatataagaatttggagaaaacccgttcgtaatatagatttttggtgtatagagagcattgtgaagattctataaagaagatatagaggataattataataatggacatcgcgctggagatagtgttcgccgtaacaatacaacatggcctcagtccggtctcaccaacgcgatctcgatccggacttggcacgggagtgggtagtcataaaccatactaaaatttgcttagatctatttccttagaaaaaaaaatatatatatatatatatacttgatgtgcaagttcttaaaaatttcggcagagggttctcttagctatttatttagtatatgcaatataagagacagacagacagtgcctggttgactgcctgtgcacaggattgattctcttgggtcttcttggctattttttcagtatatatatatataagataagatagtagtgataagtagtggcgggttgttgaaggagatcccacgaccgaacttctctcttgccttcgctggtcgag

SEQ ID NO: 5964 - DNA, 340 bp, Zea mays
gctgcagctgactcctccccctccccctcgtcgtcgtcgtcgtcgtctctccggccgtgccgccgctaaccttgacgccccacccgagctcgttgtcggggacgtcggacagggagaagccccagcgcagcggtccgtggctggacggcctggacctgtccatctgaacccagccttctgtcttgagagtctcgtacagctcgcagtccaccatcaccgccatggcgccgccggcccgactgtcgaacttcacgctcagctcggtgtgtccttctgtgccgcctccggcggcggggtgttctggtctcaggctgccccgtgggatggcgaggattccaac

SEQ ID NO: 5965 - DNA, 1095 bp, Zea mays
ggtaaaagagtgtacatctgacaaaccaccttggcttatttattgatgtaagtttggttaactgtgcatgcgaatttattttttctacaaaatccatcatgattttttcctacaaaacccaccatgagcctaaagttcatgagatattttcaatgactacttgatgattcttttcctttcttgttaagggttttattttttatttctgtatatattcagattgcaatataacctctgactcgacgtagagccaccactcaccaccctcgccactgtgaatgtatttgtttaatcatatgttgaaggttgaagactcaattagaatgtttaaaagtataaggatccgaatgaatcttaagtaaaacatgggaccaataacaacatttattcaattaattttacctgacagcaatatttaggttgtgaccccatacatgcaattcaaggattgtgagtggcaacttgaagagacaaaatttcagtatgtcttggtatttctggagcctgtgcgaaaatactagactctcaatagtgttttttagcatgcaatatcatagcagtggaaaaagagaatgaagatgaccctcgcctgtcgcctcccaggctcccaattcccaccctctaaatctgcccactcccaccgctactccccctctgccgctgccggaaattcatgttaactatttttttggtgcgtctacatcagaatctcataaggtcgaattactttgtccaataataacgttttgtatgctcgacatatcttcttggctgtgattcagagatctattttttgtttaatttatctactagggatctgcagctatttttggtaaacattagctcatgtatgttagtatattgtgttcatgtggagaaaagaaatgcaattagtacattcctgaaaaatcacatgatttcattttcttacttgcttggataacgcatatcctcccctcccttccattatgatctgtgagtttttctaatagaatagttaccaactcttttcttttgcagtctgcagtcaatttgtcagcttattgagacatccaacttgcatgagttgatcaacaagcccatccctggttcytg

SEQ ID NO: 5966 - DNA, 1495 bp, Zea mays
aacgctgtaactgtaagcctgtaacagcaagctcagtgttcgtgtacttttccgtgcgttaacgtgtactagagttcaggaaaggctttgattctgtccagagtccagacgaataaacgaatgttttttatacttcctccgttgcaatttatactttatttgacttttttacttaaagttttatcggtttgttttattaaaaaattctaatttattattaatttttactgtgacattgtttagcatatataatatacattaaatattgttaagaattttctatttttcataaaaataaatatgatgagccggtcaaagttggtagattggaacaggaataaccctatctgcaaaaccaagcagttgttttctgattagggctagtttagaaaccacatttttatgagaaataagttcattttttctttagaaaaatgaaaattctttgaaaaaaaaatagtttcaaaactagtccttaaaatagtaaaatccaatggaaataagcaactaccactatttccgaaaacaagaaatgtccataggatccccttcaactttcgtgtagttaagggcatcaatttgtgttcacaaatggttcttatatttttactagtatagtgcccgtgcgttgctacgacatgtcaattatttgataaaatgttagttcacaacgattacaatgttttgtgacaatatgttagggtgaaaacagacaatttacattgacaatactttcttaaacatggagttggataggtagagggagactrgtattgtagccaagaagcaagaaaataagaaaagagaggcaaaagtagccacctactgtttgtcccycaacaaatacaagcgtgaagtatggagaagtcgttgaatgtaacataaagagcataacaaaaacatgcagaattatcatccatctacyctttaccctttaaaagaagctatgtaaaatawaactgaatgtggctccattgtgctctccgcatgatgtttctttgtacgcatagcactccgcaatattcaccaaaaagtaccggatcgcatcacaagcggcrggcrgcaagcccaaatcgttcacaaacacgggtatacatgccgcttggcgaagaaatcagctrgaaaatcctacgggatcgaggcggaggggtcacctgragatggagaaccttgakgcttgggtccacggtcggaggggaacgagactgctgcgtaytttaaattttatcttttaaatgaatattctctgtattctacaaaayactctaaaagatttcatcctctatattttcttcatcaccagcaacgtcctctaaattcgatcctctatatctatagtgttaacagaattcatatactatatatttttttgtaatattcatattcatacaatttatacttacataagtaatgcaaaaacgaagtaatttttattttcgaatttgataaatttgaatatcgtattagtacacaattgaaatgtttttacaaaaaa

SEQ ID NO: 5967 - DNA, 1500 bp, Zea mays
ttaaatcctaacccgagagtaacgaactttgagtgatctcataaaaccgaatgcagatttggagatttagggttcttaggacggctttgataccattgttagattctattctgtctaaaatcgattcctaagtccctagaatactaatccgtaactgaaattaaaaccttgatgatgtgtagatctgatctactgatctactaagaggaacgaggaacacaccttattgttrctgttgctatctttatatcgtcgccctgcagagaagcagcagcatcgggatccgagccgctgtaggttgtcgcgtttccatgcacttcgacgcctaggcgatgggggcctctgcggactagggttttggggtgaggtactagcgttagtctttcctgcgacctcttagtcctatatatagcgtcgtgtgtctgggggctccaaccgaggttagcgtgggccctcccaatcaagggcccatttaaagagatagatagttgggtttagcctaatccggtcactgatgaccagctgtagaggacacacccaacagtactttcgctcatactttatctttttgtcttctttaagggctgatttagtgatctgtgatcacgtgagtattggagtggattgaagggaaattagtttatttctcactcaatctcctcgaattctctcgtgattctcttgtcaccaaatcaaccctaatatatttgacgggcatatgtcctgctaacagcattaaatagtagctatgtagcaggggcatgtgctgcatgaaacgaagttgctttttttttagaaaagaaaggcagaaagccatgttgctggctttagaaggttcgagacagattagtgctgtctgacgtgtcctcaatgattccttgattcgttcgttcaatggccagctgtccactttgcttgcttgcttgtctatttccctcttacctaatccgtcagatacgattagtataatttttgattggctgtttatctgactagttctggtccgtgtcatgtaattatccaccgaccggactggctctaagaaacgagaatgaaatctggttcctgacaggccggctcgtaaaagagtcgcggggaggtacggccggccgggcagtgcaaaataaacacgtgtttcgtgtgggcagcttgtgctggtgctgacatagtgacatccaataatataggcacaacgacacgtctacaccactgtagcctggcttctgcgggccaggaccaggatcccatactccgatctaacgcgctgtctccttccctcatgcgcccacgaggccacgacagagctgacgcaaaatcgctgcccgccgcgccgacaagcaacgtgggttcaccagtaaacaattcaaattcgacttctcagctcgttaaatatacggtcggctccgctcgccccttccgctcgactcaaatcgtgaaactattgagaaaattccattccaacgacatcgaaggagcctgcgaagcgagcgagagtctata

SEQ ID NO: 5968 - DNA, 126 bp, Zea mays
ggtacgtacgccgttgctgtttcccatctgatcgttcattcggtttctatcgatcggagaattgggtcatcggggatggatggatggatctgacgggatttgccgatcccggtgtcgcgcgcgtcc

SEQ ID NO: 5969 - DNA, 203 bp, Zea mays
cctgctcccaaacaagaaaccttcaagacggcgaggacaagttcaggaaaaaattcctctgcaagaaacaaacaaatagccaagaggggagcatcccacgcaagaaggccccgcaggatgtgcaataaagctaccgcaagagaagatatacgtatggcgcgaagcagaaggtggctattcaagtgcaagcaaaacagaagggg

SEQ ID NO: 5970 - DNA, 324 bp, Zea mays
tctacataataataatgcaaagataaattaataataatatgcaattgtctatgttatcctttatattccttatatttcatccttcgtcactatatagtgtatttatgaaggtacgcccttcataaccttcgtctggaaatcattatatcctaaggggaataatgcttcgaaggacgaaggactttatcgattaacattttctatgttgccttgttcttaactcatagcatttgagaacaagtctccaacattggcgcccacctccggtgaactcacttccactctttgagttttgaacatcttcggcaatcataaaccttcgct

SEQ ID NO: 5971 - DNA, 1500 bp, Zea mays
cccacaggtaaaattttatacccatacccatcgggtatcgggcggatatcgggtatccgtcgggtatagcagcttggtgcattctccctaaatgaagtctagtgcagttctgagcgtcgcacatcgccatgatcaccggaggcatataatgttgttgcatagtgcagtcatgtagatgtagccctggacatgtgttgctaatgtttttttgttaataaacttccaactcgtcaaaatcgaagagtagctagcatagtcgtctgtgtattaacactctcttagctcaagtacttgtactagatagcactggtactacgtactggtactttatcaaatgtacttgcactagtactaaaaccagatcagaagcatcaacagacagggaggtaggatgagctgtcgaggatggaaggctagctagcgtactggtagtttgaaaatctaaaatcactattttcggatatccgtcaggtacccgcgggtaagaaatcaaatccgtaccggatccgtaataaaatccggtcgggtatgggtaagactcatgggtcaaattttatgtctgaacacgtacccgacgggtcggatatccgacggatatccgaacccacgggtaaaattgttatccctacgcaaagctcgccgattagacgagcattggatcctcagcccctcactcgcaagcaccaatagccggctgacagcgccaatggttccaaaccgcgtctacctcgggcttaccggtgtctttctcgacgctaggtggcaggttatcaaaactatacagtctattaacagactaaacagataattaaacagtttaaacaaaaaaggaaacagaaactattcactgacatgtagcgtttgtccgtgtgtacagtagataaactaaatgatcgtttagtcaaacattgcctctgaccggaccaacgcgcggagagcggcgcccaacgctgctgccaaaagcacgcaagcaaacatggcagtcgggcttggcgtccgtacaaacataacaaaaagcggcggcagcagtaatacaattaaatatcttaccctgccccttgcccgcgggggagagacaggcccatgcacccggacccgggcccggcccggaacaaccaggtgggtgcagcacaccggctgccttggggcggtcgtggtgggcaacgcgaggcggctgaaactgacacacacagacacactctctccctcttcctcccctcgctctcttgcagtcttgctcacacagcacatagcacacacacgacacgctgcgagaggggtaaagaacttagaagggcaggcaggagaagcgacacaggaaactgacgtcgccttcggcggcctgctacttaaataaatcccctcgcctcgcctccggctgcctcttccctttttccttccgcgcaaatcactcaggtgccagttgcgcggcggagatcgcgacgaattccggacggcagggaggtggtcgggggaactgggaagtgcatgtgagatccg

SEQ ID NO: 5972 - DNA, 1304 bp, Zea mays
gaagaagcggtcgagcgccgtgtagtccttggcggctgccgcttgggcgccaagggtggcagcaggagtgggcttgccaataagggattccattgtcgggcgctccatgttgccagagaggaggaagaagcggtcgagcgccgcgtcgaccttggtggctgtcgcccgggcgccaggggtggcgggagaaggggcttgccaatcagggattccagtgtcgggcgctctatgttgccagagaggaggaagaagcggttaggtgccgcgtcgtcgacttgctccgagctctttgtaaaatgagatgtgggaaagcggtaaggaaggagaaatgagacgagatactgactttcctatatttactatttattgaagtcggtccaaattaaagtcggtgcaaaccagggacaaagagagtagtttgattggtagatgcaactatcattctatttatacttcacaggacaaagaaagtagtaatctactaaatcaagactaccataacataacataggagtagaattttacctattattataatattgtgtgctatactactatgtaccttatgactgtataaaggattccactatatgctaaatattgttcttccttgcgcttccatacctacagcaacatggagtggaataatcaaaatcccacttttatagtttgtgaatagtagtttcctaatggaagagtaaaatttcagcctagcagtatattaccattacccaagttgttcagtggatggttaggatttgttgctttcataaagcgtgcaagcacaatatgcttcattgcagcaactttagctataaatataggcccaaattaacaatcatttatgctcttaagtatataacctatcaacaaatcagaaagtaaagcactgagcataatgaacacataccatcatcaatctgattcttttggccaatccaattcaccaaaaacatacaaaacgaatgttatcacaaattaaagttttaataacaatctgaattctttcgatcaattggttcaatcactcaactaaaacatcacacactgcataaatagctaccaatttttactggtcgcatattggtgaataatgaacatattattaaatcctccatgacaacacctgtactggcgtactcatgttgacatttcttactttaattgtttttacttccttcttagataaatatgtttttgcttttgtttttcactttgcaggtagaggtggggcttcatcttaagagaatttagaacaatgtatatatatatgtatgtatgtatatatatatatatataagagc

SEQ ID NO: 5973 - DNA, 823 bp, Zea mays
tggtctctggcgcgtggcggtgcgggactgcgggtgcggcccagagaagggaagatgcctactgtcctccgctaggcgttgtcaggtcgaccgatgcacgtaccaacgcgtggctagtcgtcatgtcggcccacagaagaggttggtggaccgttcaattgttatgggccaacaggagcgatagattgtcgtgggttctccgttctctaccgctgcggtgcggcgctcctttttccatcaccagttgttcaacacgcgcgcgctccgtctctgttttctttttcctaataacttgcgcgctccctcggtccctccgactccgacttccagcggtgcgcagtggcctttctttgtggcttccagcggctgtgactgggcgagcgccgacgctgctctactacagctgcccaggtcttcgtcgggcactttgccagcgacgtgcaccaaccaggtatgcccagcccaccccttccattccgttcctgctgttcgaaaccgagaacccaaaccctaatgtaagctatttgcgttcagatccgatatagtcacaaatgtagacaactagacatgtattatgcctattaacttcgatatttcgcacacaaaaaacggggtttatatgtgtgctcccgtgtcctacatcacgtccaacgctgcttgtgactgacctaattacaagtgtatacatgtattatactgttctgacagaaaataaatctgggaattttgttcttatgtgatgctgatgagctaacatccaaaagtgattctttacactgtcctatatttttgtccagggtagaattttctgcaaaaccacaaa

SEQ ID NO: 5974 - DNA, 823 bp, Zea mays
ttttgtggttttgcagaaaattctaccctggacaaaaatataggacagtgtaaagaatcacttttggatgttagctcatcagcatcacataagaacaaaattcccagatttattttctgtcagaacagtataatacatgtatacacttgtaattaggtcagtcacaagcagcgttggacgtgatgtaggacacgggagcacacatataaaccccgttttttgtgtgcgaaatatcgaagttaataggcataatacatgtctagttgtctacatttgtgactatatcggatctgaacgcaaatagcttacattagggtttgggttctcggtttcgaacagcaggaacggaatggaaggggtgggctgggcatacctggttggtgcacgtcgctggcaaagtgcccgacgaagacctgggcagctgtagtagagcagcgtcggcgctcgcccagtcacagccgctggaagccacaaagaaaggccactgcgcaccgctggaagtcggagtcggagggaccgagggagcgcgcaagttattaggaaaaagaaaacagagacggagcgcgcgcgtgttgaacaactggtgatggaaaaaggagcgccgcaccgcagcggtagagaacggagaacccacgacaatctatcgctcctgttggcccataacaattgaacggtccaccaacctcttctgtgggccgacatgacgactagccacgcgttggtacgtgcatcggtcgacctgacaacgcctagcggaggacagtaggcatcttcccttctctgggccgcacccgcagtcccgcaccgccacgcgccagagacc

SEQ ID NO: 5975 - DNA, 1500 bp, Zea mays
acggcagtgacacgtgaagatgagtgttgtgtggcgctcagctgacgagtggtcccgaggtgtcggcgggagatcccatgcacatgagtgcaggcgcgcacggtgtagggctgggctggcaaaatgtgaaggtgaagcgggccggttggggcggattcggcccaaggagcaataaggaattccctttctttttcttttctatttcctattttctattttgttttcagttttcaaattcaaacttccaatttttgtttcaatttcagttcttaatttaacaattcaaatgcaacaaccaatgaatctcagcatgaatgcaaattttctattaattgctatatatttaagataatgttttagatatgtgattaataaacacacaacaaaataatagtcatttaaggatagagtttccttatagatattctttgttaagagattaaatatatggttcaacaaaagggaaagcctaaatcatattggggtcttttatttagttatttttattaacaaggatatttattataagatttgtaacttgaaaggtaagaaaattattatttagaggacactttaaaaatctttggagaattctatcaatgagaataatcctcaaggtagccatggacaattagggctagtttgaaaactcaaacccccttcggaattagatgggatcgaggcccttaatgcctttcaatctcggagaggtttcgagtttccaaactagcctttaacgtcgatttacgacacatgtgcatgagaaatcatccaaactagcctataagtgttatatcttttctttcacgcctcatttagatcattggaattgaattccattctaataatagtaatttaggcatatatcaattaagctaattcggttttacacaaaaatatatttgtatactattattagcaagatatcggagatatttatgtgctatatttttactatagaggagcgagacgaagagtgtcatgtaagttaacagagtagaaacaaattctactaatgaataaaatcatttccaatcctccatcccatgaatttgagataggcttaattctgaactttgaaaagtggtggaatgtcaaatttcaaattaaataagttaatttattaggtgaattccaattcctttgaaacaaagggatctaaacgtcccgtgagaaaatttgcatgtgcacaaaagttcacaatttgcatgctgacacacgcatctctgggtccgtacgattggtaaaacttgatgaggttgcctttgtctagcatccgcatcaataggacctttgaaacggtaagagttggtcatcgagaacctgaaaaaaaactagaggacaggagttctttattcaagcatggcctcaaaatagcaaagtccagacggtcatttcgtgtaaatagcagacggtgctcctctgtctcttgcaatcttccggaacatccatcgatctccccccagcggcgaggagagccggcggccacaggaaggagaa

SEQ ID NO: 5976 - DNA, 497 bp, Zea mays
gattttttcagccaaccattagggttttgctatgctaataaaattcatctaagattggtggccactgtaaagggctcgagtctggtactagcaaatgtgaaggttttgtagtttcttaaggacttcattatatagcatagagtcgcaccttgtgtttcaaaactttaaatagtaccctgggttactttatggctgttaattgggaaaaaactgaatcagtctaaattttcactttgatgtcgtctttaaatccagttttcatcgttgcgtgtatgcgtaataaaatgtcacttctgtactttgtgctattagggaaaaatccatcaccagcatgggataagttggtatttaacaagataaaagctagaccctgtggacgagtgagacttgtgagtttagtcgcttctccgctatcagcagatgtcagctttgcatttgctttttcttgagcactttgttgctcatttgctcttgttttattgcttgattgtggcctc

SEQ ID NO: 5977 - DNA, 1500 bp, Zea mays
tggcgccaccgtaggattgtagcgcgccgtgggccgagccctgtgctcgacgatggtagaaattggtaggggaagcgagtttataacgtcgtcaattgggcgaggagcaaaggaattagaaaatggaggtcgggatggccagaattgccgcgcgctggtggagagccgccgcaggcaggtcgtgcgccgtcgtcatctgtctcgtttgggggagatgcacttcggccgttgattgttctctggacggctgagattagacartgagataccctttcgcgcgagcgaatctgggtcgttgcgggggaatcgagcggaggagaatagatcgtagatgttttaaatcatggtcgttgatactcgatcgggcggtcgcgggggcgaaacgagaggtgggacgcatgatttaattgtggccctcggttgtratccgacggctggaaatacaccataccccttcgctggaccttttacgtatgagccctcagagaaaatggaattcaacccgtagtccgagtagctaaagctccgtgtcttagggattcttacactagggtccctggacttttgtttattcatgcacccagtccagaagtttaggaaattcaggaaaaataatttaggaaatggtttttgtgtatgaaaatatatccagaacttatttaaatcaaagaaattccatttttactcctttttagtccattccagttcctataattttgtaatattatggtttatcatctagtaccactgttttcacatgaaagtcatattaaaatttatatccttgttgggggcctttgtcttccgaaggtcctcaaaaacatgatttaacaatgtttcccaagtgtaatatatgtacaggtaccttcggactcgggttaaaactgtacacaatatggagagcatggtcgggacgaaggttgatgtaactccgaagctaagcgcaagggagcttcggctcagcggcggaaaaaggaaccgacttaaaggggaaaaggctatctagtccttgttggattatccttaagtcaatagtaaacataaagggcatggatgtaattttacacaggctacgccttgtgcctataaatagatgaacagtacccccatactgttcacgctgacttgtattcgctcgtgcatcacgcttggactttttgccttttgtcaagccgaaggtacagatgtaattcaatattattcttgttcatccatgatgatataataaagagatattaataatgtcatatgattatccatgatatttctcatgtttcatatgcttcgtctttcattaacatatactgcaatgatgaaggtacgtccttcataaccttcgtctgaagatcgttatatcctaagggaaataatgttttgaagacgaagggcattaaccattagcctctttttgtgttgccttgttcttaattcatagcatttgagaacaagtccacaacattggcgcccacctccggtgaactcacttccacttttgagctg

SEQ ID NO: 5978 - DNA, 1500 bp, Zea mays
gcatggagagataaatatctcgttgtgaccggacggtccagtgttctgtgggcctattgggtaagggggcggttcgggctgttcctatgrgtctgtgggcccattgggtgcagttcaaatgcccagattactgttttatatgatgccggcccatctagctcagtgggctggctcatgttgaagcagggtagccaggtcgcctgtttattttgagtttgctagctgctccattagcactgtgaatgcacgcagggcctagccactcaaaagtaaactgctaacgcaaataattactatagaaaaggtattatcaaaaaaaggataaaataaaataaaaaacgacctgtagataagctcgtggtacaatggttaacacatggataagctcgtggtacaatggttaacgccgtgctgcccgtaccgtacgccccatccaacggcacgatgtcatgtcagctgtatgtcacggtttcaactttcaagccggcgaggtcgtcccagtcaggatggtagaatggcccgaacgtgtcagctatcacggctatttaatgttgatgaccactaagcagcatgccttgcagcgcgaaaaaaacatgctattcctaattaagccttcccgaccaagatgtcgatcgagccagctagctagctagctaggttaggttaggtatatgcactgcgccgtgggaacgtgggatcccgcaccgcagtggattacacaccatctcccgtagtgtactcatgcacgatacgatcaccttttttttttttcatttcgccgtccgcgcgccacagaggattgggtgggaggaatcctgccgttttgtgctcgtacttgcgatgcaaactgggacttcgttgatcagcatgcacccaaatacctaactgagacaacttgctgcgtcacagttggttcgcaacgcacaacagtcaccgcacgccgtccctacgtacatccgacagctcagagttgccccatgcacgtactacgagatacgtacaaaatcagtaaattactaagctcttggaggacaccccgactgcgtctttgaccagagagatccggccgggcgggtgcgtgcggatggtaggtggggttcgcacttcacacggacccgtggacacatgccagctgcgctgcgcccaccacgcacggcaccaggccaacgcaggcgacaacgcttcggccgtcggccgtcgcccctcaccaccacggggcacgggccagcactccaaaagcagcatcgagcggtcagagggaaatcaagagctccaaaagacacatgtcccggaaacgacacatcctccaccatcggtcggtctcggtcctcctccccctcgctctgaaatggataaagcgaaccaagctgtgcgagttgactttcaggcctgcgctgcacccacactcacaaccaagcggcggagagagagagtgtgtgtgtgtgtgacagagagggagctgtcttgagctgtgtataaaatcccccccacttcatctgc

SEQ ID NO: 5979 - DNA, 1500 bp, Zea mays
cgtatttgaattcaaatccaaataaaaatataaaacaaatatagttcgagtaatatacttccgtattcagagtgatatacttccctattcgatccgatcacgtacctgctgccagccagccctgccgtacggtaggttcccacgcagcacagaactgcccacgcagcacaccccactgcgccactcgcgtcgcacggatctctccttccctccaggctccagctccaaagcctcgtcgtcttcttcgccccgccacccgtcctgcacactcacaactagacatcgtaccacccaggtgatctcgcgcgccactccctccttccatcccttagccccagctttactctcccctcccgcgcccagatcccgaggctcctacccctcgatcgccgccttccagcggccgatccggcgctggctcgcggcccccgacaggcaccctacccaccgaccggatctagccgccgcgtggtttttgaattgagctcccctcgcgtcgcatggcgctggcgcgggccgcgcgggttcctctctgggctgctgccggatcgacggcgatgctagggtttaggtgtggttcgtgtctagttagctgagtggcgcgtacgcgtttcgttttgtcttggggagccaagcgtggcccgaaatttatctggagcaggtgcagcagccttttggagtgacgggctttgagatttccagtttagggttcgttttgggttggtgggagctcgggtgtgttatggccattctgtgcgttataactgacatgcttataatttcaaaagtgtttagtttggttaactgcagctcatgggagctggagggacctcattcagatgatccgacatttactgcagtttctatattcatagcaagtattcgtgccgtgagatcatttgtatgtggtttaggtcaaagctgtttgtttttaaaactaaaaagctttaggtacaaattccatggcagtcttgtcttgtgcatgtgtaaggttttgggtgactatacagtatacacgtttagaaaaaaatgttttctgggactaccatatagtttttatgctgtatggcggaagtgccgagtgttatagttggtgtgataaaatactctgcaaaaattgatgaaattgagcattaatgaagttgtctgttttgatgtagcatagaaagtaattgacaggattgcatatgatccacgctagtttattctgcgctttaagtgaatagggatcaaggatatcgtacacaacagttaagtaggatcacttgtatctgtcctttaatcttttaattctaaacatgataagggtttatgatattgttttctgaaagtatagtatattttgtcttgaacaattaaattgggtttccttgcaaggcatctcatgctatattttagcttacatttgttccttttgttgtccaattcaggttttgttttatgcttgttcatttgtctatggacaatggactagttgctgcactgcttttgtgagtcacc

SEQ ID NO: 5980 - DNA, 871 bp, Zea mays
ggcacgatttgtctcgggataaaagtgcaatggttcaccaacttgtacaatcctatctataggatgccatgccaaccagatgtgctagcggcgagctcctaaaatcagatgagaatagtatggaagggagctattcccgttttgtgatctggagtgtatacaagacgacgccataagcatgcattatttgtgtacatactagcttgtcttttttatcaagattgttgtgtattacatctgcacactctattcgccctgcccttgcattgcactgccactaccgcacttcaagcacactagcacaggcagagagaggcagggtaaacaactgccctgctattttttttttccttcgctagaatgaggacagccgccgcacttcgagaggcaacataaaaaaagtgactgacgtccactgaaactaacggccgcgcacgccgatcgggttgcgccggccgatgtctccggcgccaccacgggcatgccatggcgttcagccgttcacaccctgttcctttgggcccaaagctacctcaccacatcgaccaccgggcggggaaggctacccctacccaccagcgcgcaccgagccggctgagacgtgtggcggagcttgcgcgacgccactggcggaggcgccctcgcgctgccacgcgcccacgccgcgtgacggtgcgcggctagtgctcgccgcaccggtcgtcccgggccatcacgaggtcgccgcacctacacgctcgacgacactatataagaagcggccagcccacacagctgcgcaccgatcacaaaaccaatcgcggagattcaatcacgtacgtatacacacggccacacgggcacgtagctagctagcagtcgtagcgtgacg

SEQ ID NO: 5981 - DNA, 182 bp, Zea mays
tgaataattgtggaacattagaataatcgcagcagaaccgtttacaccatgccaccatgttaatttttacattccttgaggtctaaagtctagaatagttaacaatttcctacactggagcttgcattacaaatttgaaattgttgtaggatattccctagatttgcaaaaggttagtttgc

SEQ ID NO: 5982 - DNA, 169 bp, Zea mays
gaattcgagcctcggtaccctgcctttcaaatgtgacctgacacaacaaaataagaattctaaaagaagtttagcattgttgcccattccatttcaaagctcctcttaattgtctgtttgattctttaaggtttatggcaacaatgttgagatccaagcatttgcagag

SEQ ID NO: 5983 - DNA, 1500 bp, Zea mays
cataagcatgaatcagcagcgcacaagtaaaacaaggcaaccatatgtaggggtcagatctggacgaaacatgtaccctaaacgcaggaattcgaagaggcgagatatgcagaatggaattcgaataggcgaaacatgtccaatcgacagaagagcaatacgcagagtgatctaaccaaaacaaacctcgcaaccaccggcagaagagcgggtggagggaaccgccggcagaagaagagcgggtgaagggtggcagatggatgtatgcgcacgcacctgacctgacgcctggcggtgatgaatccgctgttctcttctccctctcgtccttgtacagtcccgatggccgagcgagatccgtgtacgccgtacggtccgcctcagactcgcggtccgcgttgttcacatgtatatacgctggctttccggctatgcgtctggccggcgtctggcctggtacccggatgacgtgcaacgcgcgctctgattgggcgatccggcgctgcgacgcgaagggtaaatatcaaacagaacactggactggtggattaacgtgcacgggcagttctcccttaacgaagtgggctgagctcagttgcccaggggcaagaccagacgcggcccagttgctgaggggcaatggtgggccgatctgtatccaggtcaccggagcccattctcatctttttgaaaacagaaaaacagttcattttaagagcaaatataataaaagtctataaactagcaaatgctaagagaaagggagagaagagaaaagagaggagaagcgggttgtaaactaatagcctgcttcgacaaaaagaccaaaaaaatttatgagagagataaatagggttctgttctaatattgaagagctaaccactatacaagtgaggtaaatagcaggctaaaataatccttacgactaattgttgactatattattagaggatatatctggtgcacatagaagcttagtgcacacgacacacatattaaattatcactatacattttagatctaatgtctttcgttgatcattgtaattacatcttccacccttacactcagtacgccggagggtatccttagcaaaatataccaaataaatagaaaccttagatctaagataaataataatgatttaatatgtgtatcatatacactaaacttctatatcactagatatgttctcgtattattaaacttgctctaatctgacccaccgtcctaaaaatggaattgccttaaccaccacctgtgacggagaccagaacgaacaaggttgccggcgcggccggctttccctccctctccttcgtttcgttccctcgcccactccgtcgcctcgcgcgagtggattccaattttgcatcctaaaagaaacaacgacgaaagatttgctgcagttccagggtcctcgacgctgattcggcgatctccttgggaagccgaggcagcaactggtagatagatcgagggcggcagcagggaaggg

SEQ ID NO: 5984 - DNA, 1500 bp, Zea mays
ctagctcggcgtcacatgttatggtgttgagcttgcaaataatacaataactagtcggttgcctgtgcattgcgacggcttacaacaatatccacgtaaactatccatcaaaaaaatttcaagaatttttattgattgtctccgctctctgtataatatattttttgatttggctaactgatattattgtttactccatgcaaatatgtcttggtacaacacgaccaatgaatttatcgattagaagagagttcacaacgattgactgaatgaatagagattataaaatgacataattccatcatacagagaccaaataagagagtttgtgagctcaagtttctaaaataagtcacatgaactcaaacttataaaaaagatagatcaaaatatggagtggttgctaaagtcaggcatcaataaaaactggatgcgctctatataaatatgcaacttcgtagcaattactaacgttcaaaaccaacaaataacctttcattttactattagtgtgacaaatcatcgttgctccatccaattcagcagcctcaaacaacatggagtccattgtatggtctcagaaacgacataatgcttgcaagagccaagaacaccgtgtcgtgcttaggctatagcctcgacccatagtgctggcccgacacgattatatatttttattttacaaaaaatgtatatacatatatacaaattatattcaatatcaaaaacatctgagtatgatgttctatttgttagacatcctcacctagtgtctcccgccctcttccatcaggacataggttcgaaccccaccttctgcaccattttttaacatttcacgcttatttaatcaaatgggccgacagactaacaggtcgtcccggcacagtcagcaggtcggcatgacgtgcctggactagagctgtggcccacgagcgtatgtcctgtgtcgggccgccgtttgaccatctatagacgtgcagcgggttaatttgaaatagttgtgagaagttatttgtaaaaagatgatgtgggacgaccgttaaaactggtgttttaagtatagtagagagtagagaaattgatgatcataattttaatacgtacacactacacaaaatatgtaccatacttgatttattcccatattgatttattcccaaagcaccgccgtcgtcctcgtctgggctggaaagtgttcggccaggatggtggggctgggctggttttgtgctgacctgggcctgccgttcgttttgtttcgcggcccaggcgaaaattaccaggcgaacgaacgagaacgaggtgcgtggcgtgtgtgactgtgtgattggcgccacgcggcttatcctgggaaatcccggcggccaatcacagcgctcggtggctggcccttgctttgcggtgcccctccactccatcaacgccagccgccagtccccccgggcggcgctaccctcagctagctccgtaaaccagcgagtacggccgaccagacca

SEQ ID NO: 5985 - DNA, 1500 bp, Zea mays
tccataaaacaaataaaacagggatagacaaatgctcaatatgtttaaaacataaatcattgactaagccacatgctcagactggaaaaataccaacacccccacataaaacatcatagacagcagcataaacaagaattagtgaggattgggaaaaggggatggattagcatataccagaagcgggtgttgaacagctaccacaaactcgtcgcaagaacaacggatctggaagcctacagtgacgaagaataattttgttggctaaaatcacagatcggaggaggaaatgaagagcatggtcacttgcctgtgcaaagtggcgagatctccaaccagcactacaaaaacaacaaaaacattctaygaggttagaaccctaggctagatttacagacaaagggatgaagaagactcaccaagcgtcaatggtgagcgagtcgcgtgccggcgagttctcaaaccctaggctagattttgacagaagcaagtgaggagaaagaggcgagtgagaaagggaggaacaaccgggacaaatggtgagcgagcgagcagcatggcggcgggtgctcctgttattgccgggtgatggcgcgaatggggaggtaaccctacacgtttcccgcctgctcccgcgcgtccatttttgcccgcatctgcacagccgcgagcacgcgacgagcctggctcccgaggaacggtcgtttttggcgtatgagtagagcctggctcccgaaggaatcttgcatcggtggagcctggcccaagtgaccatccaagcatccaaacatgggcaggctgcatctgtggagacaggcccaaccaaatacagccatccaaacacgcccttattctccacgcgtctgcacttccttgcgatcctctccacgtctggacgtctggtgcatggatccctcgccatcagccttatccctcggctgattttttgtcttcacaacagattttctttcctcagcctcatcctcacgtctctctctgttagatttttttcaagtcgtgtttatcttctacagccgccgcccctggatttctacaaatccaccaccgagcgttccactctcctccggagctcctcccagccagctcgccctcccaactcctgccgcactgagctcattgcacgctcctgtgcccctgcctcgtctagctccagcgctcggtgtccctcagcccagctgtgtctacgtgctgctcgctccgagctccctgtgcgatggcgtcagccgcagttcaccgcgctcggcctcccgtcttgccgcgagtcccagctcgaatctccatggccgcaggcctctggtgccgcgcgcgcgcccttgtcagggtcatgcgcgtcctgcgtcttcttccccaagatcggccgccgtgctctctgcgcgcgactatgctcttctgggtgcgcgcttgggtccctgctgagctcggcgtctatctctctatagctctagtttttccccagcacgctttcttccctgctcggcc

SEQ ID NO: 5986 - DNA, 1270 bp, Zea mays
agcaagtaattctcaaggggatggatacgataggagaataagatcgatatatgtgtaaatatgacataaaccagatcataagggtggtgacatgtatgtaaagatagagatagactacctgataatttgggatagacttgactaggtcgaattactatccattctgatgattgggccaaatacttttcctgtaaccactgcccctccatgtactacaaaaggagggttgggtgcaccaagaggatagattatctgattacattgttgtcatacctggttttaagggcaaaaccgaatgcatatagcatatgtgtgctataatccatttctcacacatatgttgacgtcacaagtgtaaaatatcaaaagacaatgcaataaaggcgtaaaagataaaccactcagtatttacgaaatccggcaaaatttaggtgtttttttcgttttcgcggaagatgaattcgaaatgagatggtgaaccctgcttatatgccgcactagaatctcaaagagggcagagaaacgacatttttgccatgaaatctcccaaggggcgaagaaaagaagaatctcaagcggcagcaattcatgcccaagttcgtcttctcctccacgagttattctgcagaggaggctgctatcgattcggttccatgggtccacgtccatgtccatcctgggccgttgggccacatgcagatcccaaagcagtaaaaaatggcgtaaccgtggacggactcttgcggcgcatcgcccgccggccccgctcgccacagctggagcacaccgtcaccggccccggctccggaatcagatgctccgaccggaccgactacgagcaacagcaaaaagaagaaaaaaaagaaaaacgggatcgccctaaccgtctctgcgtggtgggcccaaccttagcctctccactgtccactccaagcaaggaaggaacgtgatacccgcgccccaccccgcagtgtgatagcacgatagggacactcacgcctcgcctgcccccgtcgcgagctccacccgcttcgcttccctgacacgcaggcctcgcaagcgaccgccctactggagcccactcgccagggaaggccgctgaaaatacgggggaagaaacacgaaaaaggcaaggaattagaacgggcgaagcggcacacaattcgcgcagcagcgtagaaactagaaagaccagtccccaaactccccagcgggggcgagtagaggaggaagagtcgccgccgccgccgccgccgccgccgccgccgcc

SEQ ID NO: 5987 - DNA, 1044 bp, Zea mays
cttctgactatatatatatatactatttttaatgtgctgacactctcgagtgtatttgtgcacataatatccatcaaaagaaaatgtttgtataattttacatttgacactgttgtcacgagtacatcttttttagttgtttgttgaaaaaatgatggatgctaaggttcgaaccgtggtcgtttggattaaagcacccatcctctacctctgcagctcatgtttctttgtgttatacaaaagatagatcaatcaaatatctaatttaagcaaggtgtacatatgtgatatatagataccgtagcaaggtgtacctgtgtgatatatagatacccacaaaactcactttgtgctatacctgtgtaatatataatttaagcaagatgtaccctatttgagacatttgttggagttgctctaacactcacattttgtcgaatattttgtacgccgttgcaacgcacgggcatatacctagttactatgtatgcctgtacaagttccatttcaaacaattcatagttcgcctactgatcttattgttttaaatttgttgaaggtgtcatacatgatcctcgccagggtatccccagtcacacattcagtgggcaattgcgtcaagcgtgtggtggtcattgtgaccaggaatctaaaaaagatttgttagattgcaagcatctgttgcgaggtcatttaggtctcaaacatatttttttaaggaataaggcatatyttaagatctgattgtgttgttgatttcggtttcatgcgagtagagattttgtgccgtcgcaacgcacgggcacatycctagtttaatactaaataactcaaacaaagccaaagtgaggatgcgagacagcggaactgacatgtgcactttggtccagtcttgctgaagaagaaagcgggaggaagccgaagccgagtagaaaggaaccaaataagacctcggtcaaaatttggagaaaggaaccaaacaccccattttttgccgcttcggaggcaccttcgaacaaagcccaaaagcagccagcgcaccgc

SEQ ID NO: 5988 - DNA, 265 bp, Zea mays
gcatacgccatgcttgtcgtttcgtatatatgttttatactatttttttacttccgtggcaacgcacgggtacatatctagtaagtcagaagatgattatccctatccgcctccgcttaccttagatgtcaccgagatccaaaaacaagaacaagagcgagcagagcgtggcgacaaatcacccgctgccttttatcccgcaaccagcagcagcgaaggccgcgagaggcaggtagtagccgcacgccacatcaacccaccacgg

SEQ ID NO: 5989 - DNA, 954 bp, Zea mays
ctgcaactgcaaatatttctcaagttttcacgtgaaatcgagcaggaacttgcaaattgctcccgttgtctactgacacaccaaaacgtactgctcgtgtgctcgtgaactctgcatacgagatcatgacacagtcgtagttcaagaaagtggcagtggcacatgcactgctcgtgtgctcatgaacaaaaaaatgtgcgacgacggtgttgcacatcacagccatggtaagacacaggtacggtacggtacggtacggtacggtggatgaatggcggcagcagtgcaactgctaattgctaaagcatgtacgcactaaaagccaggcagatgcaatcagaattctgaacagacacgcagaggactaggcaccaccgttctgacagacagagtatatatatttgaccatgcagcaacaaaactgcagcgaagatgggttcgaaacaaattacctgcaggtgcacctctgaggataatataataatggaccagtgacaaaatctgaccaaatcctctgcattaataagtttgcatcaataagtttggcagactcagtatttcaatccagacataataagatcatcagctccggagcataggtaggtcagtaagtgcacagagtaggtggcaggcgccgattccaattaaatcttgagggctgcagggaagaagaattcacgctgtccaaagaagccttttccaagatccagacaagctctaatcaaccacaacttttagtttcgttccaaatctttaaatggtggccaaccacctagcagtgcgatgaacatgtacagagccttgcatgcattagcacaactgtagctgtacaatacccttcacactcgtgtgtgtgtatatatatgatccccaaaggagctgagttcagcaactcaagcttctcggccagtttcagcgacgtattcagtctagtctgtagacgttaagagcaag

SEQ ID NO: 5990 - DNA, 123 bp, Zea mays
cgatgccgagcgggtggagctctagccacgcccacgctcccgcctccccggcaaacacactcacgcccgccgaggccacatcctagcacgttgtagacgccgccaccgccaccgcctgacgcc

SEQ ID NO: 5991 - DNA, 1500 bp, Zea mays
gtactgggtgcgctatttttttaagccggaatatgcttccgttgctcgcacgatctggtctgattccgagctttttatcgtccttctctacgcggctacgccggacgtagcgagctgtgacggcgtactgtgctgtgctgcctctgcgactctgcgtgacgatctgctgcggccactgcggcgtagcgtcgagaggagcggtgacggcgtgctgtgttgcctgggacagagcagcgaggaacgccttccacactcgatccagataatttagcgcttggagacagtagacgattggagcacgagcacgacggatccgttcctcaaatgatgttgttcgcgagttcttttttataaaagaaaatgtcagtatacagacgacagtacgtaatctggacgaatcgattcgaggcgatagctgatctgcccgtctcacccacctttggactttgggttgccgtggtctgccaccggcaccgggtcacaaaaatgtctctgcagctcgcgttcagaacaggaaggcatcaggctgccatgcttctcaaagccgggattcatggctggcttgccgttgctgcttgcgcgcggtggccattgaattgaacagtgcgtgagatagaggacggatcatgccggtggcaccctgctcgagaatagtggccggcgttactatttcagcaggccagggccagtgggccacccaccgctcgcctcacgtggtccgcgcgtccgtgaacccgtcgctgctccggtggccttccaaaacccatacacctaagaaagtttcaaattctaacatttcaatcattcaaatatcaaataatcacacaaaaataagcttaacttcaaatattacgaactagatgattacataatttcatagttaaacaaacaatataccaagaatgatttgtttaactaagatagactttattagacaataataacgatatactacaagtacattttatccataaacatgcagctataggtagtatctacccatatccgtatgcattatcaacgaatagagattattgtccgattattgtccattgacatattcaattttatagagattattctataccgtccttatatgattatatcgagtaaaatctgttgcatttctatatcatttttatatcggttaaaactactggtcattgagatttaggtttcgggtaagtattaccatctctaattctgagtgcccacctgagcgcagacgatagcgttgacatgccacacggcccaatcatgcccgtccaaatttatatcctttctccccgtacgatcgttcagattgacggccatgatgcaccctacgagaagcttccctttctccttgtccttgcaaccctccgccctttcggttgtcgcaatataaacttgccggggagcgtggcgaccatttgcccccagcagatcttgtgaccctccctcagccgcgtcgcgtcgcatcctacgatccaaagctctctctggtcgcaggtcgcagcc

SEQ ID NO: 5992 - DNA, 1122 bp, Zea mays
caaaatgggatggagctgcgttgaatgaaaaaaccatatgaatgtagtatttgaaataaagaaaaatgaagtttaagtattcaaataccagaaattcctttattttatttttattctgtaaattcaccatcctcttcgcagcttccctcacaagggaaagtaaaatcattktcagacatctgactttctgtttgtcttcagttaaaaaggcaatgaagtgaaattaaaagtctaagttctatttcactttaaatatgcatatcaagtaaagaactgctaactatgtcttgaatcctggtggttttgggagatgatttctgaaactgttcagggaatggtcaagaaaggtctgaattcactgatctctttgggggcctggatgatctggaaccaccgtaacagatgcgtttttgatggacaaactccyagtctcccctctatccttcggcaggctgatgatgagagaagactgtgggcattagctggggccaagggcctctcttttttggcagcttccttaactaatggctgaatcctgctgtttctattttagtagttttttgagtctggctttattggactctttctcttataggaggtactggcctccgtaaggagcttattgtttgtaacctggtctatttttagacctttttcctcttcttaatatattttaaggcgcagttcccctgcgctttcgagaaaaaaaattggttaaacatgcatgttgctaaccaaattaaccacatttagtctagctgtgaagagtgcaaaattatcttggtcatttctttttctggtggagtggaagttgacatcatctgaatggggatcatactgttactgtattttgtaggaggaacaaagcctgcaaccctggaaactggagctgttgtcactgtgccctcttttgtgaacgtaggcgatgatattctggtggattcaagaactgggcagtatatgaatcgagcataacgaattgaagaggatttctgatttgaggagagtactgcttttttgtttgaccattttagtcccattcacttgtacaaacaccctgggtctttggccccaggaaatttacatttctgctgcatgtgaatcctcactctgattataacc

SEQ ID NO: 5993 - DNA, 124 bp, Zea mays
tttaactttaaatatacatatacagatatattgaaccggcgcttcgaaggggcgtctagcctcctaggccagcaaaccccctctgtaccctccgggcaatcgggcatgaatccacccatccgcg

SEQ ID NO: 5994 - DNA, 1500 bp, Zea mays
gcaggaacggtagaagattgtcttatccatgtggtgagatgcggtgggccgatatgccggggcaggcataacggagtcagagaaatggaccgtggacggatcgagagaacgtatcatggacgtttcatcttctattatttataatgagaagctacttgtacaagtattttatcaaaacaaatttaactacattggcacaaatatttgtgaagctaaagtaaataaaataactgttccacgagtaaaatggagttgtaccagatgagcttggatttttggctttagattaaatacagctgttcggactgttgcaattgctaactatagtagtaaaataatgtaaaaaatagtagaagacaatatagattaaagccaaacaaacgatataacgagcgaattaaatgaagctcggttagttagtgccctttagtgaaacatgcctagctacggtctaattatgtgacttgacaagggtatttgcattcttttagcgacatatgatgtgctcattaatcatgatggtttttgtcagtccagtttagttctccggatatattcgtaggggtaagttgtgactaatacaactctaagccattgaagcggttttccaaatactacatggtacaatcctaacttattttttcytaatactgyatgatataaccatgagtttttagataataaatataatcaagatacaatatgtgtagagagcagtggcgtagacaatgggtggtccgggtggccacgacatatcctaagccggccaccggatcaccagtccaccaagatccatataaaaaatactgatatatattatatttgcattctaatatacacatctatagatttaaatgttaaatttatagtgttatatgctatttttatctttatactttgaactatatactaaattattatatattatattaaattatttataaaaaattctaatgacatacttcacgaaaaaattctagctacgtcactggtagagggtcgtgtagagacggtgctcttcatgaaaaacctgtcttttaaattcgtacttaccctcctagagaccgttcaaaaaaatcccttgtttaattgtgttgtacatgtcctaaacggtgtttggttccttcttcagttgagttattaatgtttagtctgttttagtccctaaaataccaaaggacatgagtaaagtatgccatctaattagaaattttagagactaaagttcagaaaagtgactaaattaaccaagcaccacttaaatatattcatataaagattaatatatgtggtgtatgtgtgtgttataaaaaaatatcaatagacacaggcagctggcaggctggcagccaatgaggcaaaccaaacgtggactcgtcactcgtccgcagaaaaggcctcgcgcgtgtagaataaaagcgtcactagggtgccttctcacagcactgattgtccacccaccactctacgcaagcaatccttcggacttcggtgggggaa

SEQ ID NO: 5995 - DNA, 228 bp, Zea mays
cgtgagtcttgattcacataatcctctcaaaacaattcattctggtacctaaatgtatggctgaatttcattctgtagggtatattggatagctttcacaagccagagttctggtatgcagaccagaggaaccaatccttcaaagaaagcaagaaatcattccagcgaagtgaggataaatggtggttacctgagccatgtgtcccagactctgggctgtctgattgc

SEQ ID NO: 5996 - DNA, 562 bp, Zea mays
tgctgtgcgaagctgcgaaccgtcgctcctctgcggggcgacacgggcggaacccgcgccgccgctgcaagagttcgctcgctgccgcctgagcacgcggccggaggcccgcgctggtgcgagggtggcggcagcgaggcctttgtactctcctcgcgagttccctccccaagcgtgcttgcctcctcctgcctgcgccagctagggctgggctcgatctggtgcgctatggccggatccgtggcgtggcgtgggtggagatccacttgcaggggcacggatccgcattccatgagtccggatctgcaacagcggtggcatcagcgcggcggggggtgcgattttttttcagatgcatataagtccctttactggatccgccccgcccctgaatgcgatgttgcaaatttcagattcaatataacgtcagaaaccgttgtcttccagttagcatgcgtctcaaatccagtgctccttttcaatcacatattgaactaaaacactttcatcattgactcatttgattctatccatatgcgccacctgcagcagttctgtagaa

SEQ ID NO: 5997 - DNA, 304 bp, Zea mays
agtttgggtgttctgatgtgcaggcaccatgttgtttcgcattttggtgcttgaatcctgtctttactgcagatatgatttttttttgtcatttttattctgaaatggagagtttggatttggggaagaaaacaagggagctactccaacttttatggttatgtcactagactagatcctacaacctcagtttctttcttcaatatgctcttgtctattatccactgccagttttgtgactgactcgctatcccttttatgaaatgggtatttaggtggcttatattctggtggtagtgctcag

SEQ ID NO: 5998 - DNA, 533 bp, Zea mays
gtggcgccgggggatggggctggagctggagctggagctggagccggagctggagctggagctggagcggtgggcggtactgcggggcgggatggctggcgggtggcggctgaggaaggtcggcggcccaaggcgagcgagcggcggcggaacgccgcacgggagtgcgggcgtttcatttcaggcagtattcagacatccttggctatagatgttaggcctgctgtctgatctgtatcggaaattctcgtacgtggttttcccagcactttcttctttgaatgtgacagcaccattagatgaggaccacgaggaagccgtacgccctcggcaaagatgcctagcgaggggattagatgacgagccggatccggatagaattatagataagcacgaatcgcatcaggaccaatcaattatcaattaccagaacgccatataagcatacgtcggtcctcggcgctgggcaacatcttccagccagcagcacacgcacactgttctttcgacttccatctcggccagagcagaag

SEQ ID NO: 5999 - DNA, 1500 bp, Zea mays
ggcactgctccggttgaaaattccatcttccaaagagattccgtgcacctcctagttcatacaaatgaactgcaaacgctagttagtaaaagaagcggttgtagtttcgattgtggattttttaataatctcgatatttttgaaacccaggattagagatccaaacctaaagagcatgatctttagtcctggttgcctaaatcagaacaaaaggttttactaatccaaaaaaataattgacaaccgctactccgattgaaaaaaaaaaagcacacacgcacatcttaccaaagagattctgcccaccttcgagttcatacaaatgtaccgcaaacgctagctaagctagtagaaaaaagtggctatctagtcctggatttgtaaggacgtcacccgcccgctggatcctgtaagggtgtaagggcatcctgaattttgagagaaacaatcctcgacagactcgactcatcctagcgtctctctgaaccaaacaccgtttacaatgagattaataacacatacgggcgcgagcctgtccagccgcatacgcacgtttcgcacgtaccggcggatgcagaaaaatagctgtaaaataaattattttacatctactcgtgtagctcacgtctgccatatacagataatcaaacaggtgcttgcataaagtcaatgtatacgatagctcaggatcaaatagtgcagataaccaatcacatggatagaatctcccatcatctctgcaagagcatgcctttgatcctgtgctccgccatttcaccctcttgtacctctaaaggaacaagctgcagactgaaaccctcatcctaatcgatacagcttctgaacccacccacccacccacacaagtctccacggagtttcttggttccttttattacgcaagaggaaaaggaaaaaaaaacgcgaggcagtaggcccttgataccgcaaaagattcgttcgatagcccattcacaccaggccggcccaaccgcccgcgaccaaccccagccacccccaacaagccgcgtgtcggtgagtcgtgagtaccgtagccgcgtcgacggagaggcccagtcacactcgcatcgcacgccacctcgcccgacgtcgggtagtgcttgttgggaacgcgtctccgcgaggcatctgtcatatcgactgcctcgtcggagtcccggcgaggatgagctcctctgacctggggcatgacctgcacgccacgtcgggatctggaacccgcctcgcctcccacgtgacatcatggacaagaagaacggcagagaaggatcggaacggcacgtgcagtctcgcagtcgcagctgacggccgcctccttccttccccacttcagcagccacccctctcgccccccaccctataaatactccccgaaacccatctgcttaaacattacttatccgtctcaaagcagcctagtgccgcaaagtcagtccagtccacaggccttcttcaagcagatatatagcagtaccgtcc

SEQ ID NO: 6000 - DNA, 304 bp, Zea mays
gcctaagtcagtacagtacctctcgagaaaaaataaaaataaaaggcgcattttgatctccctcggcccacggaggatatttgggtcttggcacctggcagcaagcaaccaacccatgggccctgcccctgacgcctgttgcttagcatagaagaagacctggcacaaggagtgagcatcttgcattctcgctgtccagcaaaatactcgaaaaccacctcgcaagacttggaaaccgcaacgcctcttcctccttgccaggacaggagtctcaactctcaaccaagtggagagtggaccgacc

SEQ ID NO: 6001 - DNA, 366 bp, Zea mays
tcaccaccacacttgttggcttttgtccgttgccgcaacgaccaagatctgcatttgaaattaataccagggagcctatgctagagtttgtgatcgctatgtggatcgtggtgcacggaagagccggagctgctcatatcttctactattatagaagaatatatattgctaatttgttatctactgacatcataaacttgttttgacatcaagaagcgagggaggcgtcgcgtcgacttccgcttctcgccgacggccatctccatcgaggacgtccgcgacgccgaggaggagcgcgtcgtcgcctccttctaggaccacctcaccgtgcatggcttcctccccgacaagcacgatgactaccac

SEQ ID NO: 6002 - DNA, 872 bp, Zea mays
atctatttttgtagttaaattattcgaagatataaacgttgataatatcttctataaatctagtcaaactcaagaaagtttgaccgacacgaattccatagcaacaaacatttgtggagagaggtttcgtagttaatttatagcggataaaagatgttattataaagaaaaataaagggtaaccaatgcaaaacccaagtagcatagttaacatatagagggataaaaaagtagataaacaaaaattaagatccagcatggtagttaatttctagaggataagatatactaaaacaaaattaagatgtagcttggttatgtcgtcgtgtactggtgagaaaacagaaaaaaaatcaccactttacgatgctaaccgagaagtttcgttctgagtttttacgatttgacaaaattacgatcttacttgaaggtcagtggtcagagaacgattttgacaacctttcttgtactacaggcggttgttgaagtggctggatgcatggagctcaactacaggcggacgtcgtgctcatgactgcgtcatgcatgccaattaattagccaccactccatcgaaaggacccgatcaaactttagtctaggccagttgcactcgtcctcctcttctcgcagcagccagcagaccaatcgggacaagcaaactcccccgattagtttaagcagcccgggcccggcgacgaccagctccgttccgcgcggggatttaaacgcgcgaagcgagaaggcacgcagcaggcggcagcggcaagcaacgaacgcgatcgcgcgccgacgacgacgcgcggtgccggcgcctggtggtgccgtgttgcggactccgctgcatcgcctcggtcggtcgtcgtcatatc

SEQ ID NO: 6003 - DNA, 593 bp, Zea mays
gtccaataaatccatgttgtgaagggtatcgctagctcaaagagacaacagttcgccaagcactgttgatgcctttttgagctgagaccgacccctgtgatcataagcagccccgcgagaactctcccctacccaggctatcgggccttgtcattgtgcggacgtctgaggtcggagcacttcatttgtttgggagctggaaaaatgaaggtgcactggttggtttctctgaacttgtgaaagggttarcgaaggaccgtactgtaatgttcatggcctggaggaatgatgcagcaagtaggatcagaaatcagaactagccagcgacaatcacgctccagcttctgaaacgttgctgtagccttttgttgatgttcaggactgggagctagattgtcacgatttgacactgaggacgttactgtgcctgcaagcctaacctaagatgtatcaagcatcaagtgctgctgctgctgctatggaaggtcttagccaaaattaaattatgtttctaagctctgcatgcatcttaacctgcgctaataggttttcttgatggcctcaatgggagcagcaggaacctactacttttt

SEQ ID NO: 6004 - DNA, 334 bp, Zea mays
tgtgcgagccgtgagcgtgagcgtgagccatttgcatctgcagtcgcttgacaccatcactttgcgttcgcgcgaagctgccggtaccgggacgcgcaggcacccgacggacggatgggctggggcggctataaaacgcgtcgctccccttaatgacactgtcatcaccaaacgccggtggagtcactcgagcccgcccgggtctcttcctcttccattgattccattcaagatcactactgttaccagccagccagtcgttcgttaagaagagagcgagcgagcaagagagagagagagggagaagggggaagatcagaacgaagagagggag

SEQ ID NO: 6005 - DNA, 670 bp, Zea mays
cgctacttctaatagtcccttattgttataatagtacttatatttaattatttattgcatatattttaacaaaagataaatagtctttttattatttggtttatttaatatactgaatagattaaattaaaatttttagtctattcgagtttgttcctaatattattttaaaaacttcgattatatattttaaaacccaaaaaataaaaactcccaatacgctggaccaaattaacctacccgaacgcccacccctgtcacacctacccacccaaacggcccaaacctgaaaattccccacgtgatcggcgcccacaccagccacgtattgatctagctagcacaggccgcctcctccccaccggtcaatccacaaggcttgccgctgcggccgcgcgagggtccacacgccagtctccccgttccgtcctgttcgcccgcgtagcccacctgcgcatgctttccatgccacagccccgcagaggaatcgtgtacggatggatggaaggcaacagctttggatgtgcttcgctctcgcgcccccgtcttataaatacgcgccctccacttgaaacaagcggcaaaccgcaccacaaaacaaatcggccaaagcgagccaagtgattcaaacagacgagccccgagagaagaggagataaagcagagcgcc

SEQ ID NO: 6006 - DNA, 152 bp, Zea mays
ggttcatttatttatttatttatttatgtttctaaatacgaatgctttgtccttccccgtggtgacagcgcgtgcatactgtatggagaagaaaaaaaaagatcttatacgatactctgctaaaatatttataaggtttgttttggtgttag

SEQ ID NO: 6007 - DNA, 1500 bp, Zea mays
cacggttatagcactgtattatatacagccagattaactattttggctcattgtccgaagcagtgatgaaactagcaaggacatgtcaagccgacggtcttgtttccatccagaggtccaccatgtccacgaggatccttgcttccatgtgcacttgtcgtcggcaccgcaccgggctgcaccacgccacctcgttgtgccctggtccggtacggtgaccaaattaatccaccttgcctcgaccatcatcgtcggcgaaggagaatgaggccaagagggcgcaacacccgatgaccgacagggcatttcgtgctaggtgcagtgcagacaccatggacatgcgaccttattaccaacacccagagcacccatggtgaaggtgacgcgcgagctctcaactctgagaacgctgcacaggcccctaacgccataattccacgctatttctttcttggacgatatctcaatattgaataatactctcgccctttgcgaaatacgctatgtctagatatatgattgaaacaatacattttctttttaaaaaatcaaacgccttatgatattcaggcttcctcagacccgcgagggagaatccataaaacaacactggtttgagaagacgttaagaaaataacgtcggtttccaagcaattcgtagaatagcactggttgttcttttttcaaaaacttcaaccattagtataaaaactacccccgtctcataatatagttttaaagtttaattgttaaatctaaacttcctttttatagaacatctaggtttattgatatgtttaacactattcttagtaatataaaaatagtgctcatatatttgcatgcatttacgtcgtcgtggctactctgcggcaacaaaagtttgctgcatttgcctgacaaattattgcgccaacctggaactggaagaaccttcacctctccaggtcgccaatggcatcgcgtgtccgtccataatggcataaaccgtgtcatttgtgggttgtggactcgattccgtcaccgtctcgccataaataaataaataaaaactaccccgcccatgccccgaacgaaccagttacctctctccagtagacagtagtagtgattttgggaagggaaaaaaaactgtcgcctggcctggcatcaacaccataacgccaatcgtagcatccaattccaatccaaggaaaccgaagtctttttgggagaaaccgcagcggaggtgacaagaaacacgccgtccgtcccttccttcctcctcaccgctagggctcgatcagccgagcgcccgagcatgcatgttgttggctaatcacacgcattgatatttttcttccttgtttgtgttgctagctagcagctatcaatcaatctcgacgtccaggtccaggtcagagctcgagacacaggaccctttatttatccatccatggctgccctccaatagcagcagcgctggcaacaacggcaccccacaacccggtggacgaagcc

SEQ ID NO: 6008 - DNA, 241 bp, Zea mays
gaggtgtgttttggctttctgatttttggtgttcggatttgggactggtatataatcatcaagtgtgtaggatctatacatagctcctttacaatgttgtttacttgtggaattattgggttcggccgttaggaattcgtagactcaactaaaaaaagcatttgagttggtagatcactgcatttaatatctggtatatgatccttggacaagggaatcgcgggggtttggttttgtcacc

SEQ ID NO: 6009 - DNA, 346 bp, Zea mays
ataaacaacgagccgaagaagcatcatcagatgcggatgacttttgattagtatgtttcttttagttaatcaattaagctatgtattccaatttccacattattaattttcacattatttgtttcatataatgtggtttgacattaatttatctacagttgaacatgttaatttttgtggggcttatttctgttgtgttaattttttaatgtgaacgtgattgcactggtttacttgttttattaatgtttgtaggtcatgggaagacttgacttgggacggtacaggcagacgtcccaaggtgaacacggtgttgggtagcctctgtcgcttctactaccctggc

SEQ ID NO: 6010 - DNA, 142 bp, Zea mays
ggtaactgctgaagaagtgctagaggacacagggataactgttgaatttgttgagtagaagcaaaacagcccagttacatggaataaaaatgtcgttgatgatcattttttcaaaactaatgatgttcatgccaatgaacag

SEQ ID NO: 6011 - DNA, 1500 bp, Zea mays
tccttttgaataggcaaatttggactctctatgcctgttcaaaatgctgaaatcattccatggtgcttcaaagttgtcttgtggatgtgattattctgaacttttgcatacatgaaatgtttcacatgcatcccttaggcatctcatctgatgttcgaaatttgtatccctagcttcctgttaggactgccgagtttgcttatgttttcttttttacatatctgatggtcgcctacccttgaattccactgaaaattgtatgcagcatactagttaacgtttacttttccaagggttgctctcttcaaatgttttcagtttggataataaataggtttgtttccaggtatacctttgtagtcacatactccctccggtgcagtaaaagaagtcatcctgcgcgtgaccgagcgtgcacaaaaagaagtcatagcgcgcgtgggtatgggatttggacgttattgcccctagtaattgcacaaaaaaagatgcatttaagaggaatcgaacttgagacctccaatctagaatgccttggagctgctgcaacaaccaatcaagtctgattattttagtaacgttaatgcacccatatccctatttaataggggcaaacagggaaaactctatgataattaatcactccttggtatgcacaatcatgtcctaaacgactacctttactgcactggagggagtacataaagttgaagagacgggtttgatttttttatttatttccttgagacccctttaatgggtatagaaggatttcaaacaatcactacggtggatcccataaacttggtcccacactcccacttcccagcagtaatggcagctcagctcggaagtgcgacatcgccgattcgccgtggcagaaaagttgtgtagtcagaatatcccaccgagccgccagccaccagctctacttcttccactgcctatgggtcccgcatactcctgccccacctgtcacacaaatttcagccaccacaacatgcccgccgcttttatgggccatagccgtcagggacaacacagtcaaggcacctcgtacgcggaccaaaagcagtaaataaaccggtggccagaggcgaaagcgaaagccgggctcgcacacccaccccacagatcttcctcccctctctctctctgctcgtgctgtccccgtcgttcgcgctcgcccaagtcgtcgcccagtcgctgcgccgctcagctccaaagccagcagaaccgcgcaagcgcgcgcgtgtccctcctccgctcctccattccgcgcgccgctagactggacgcgtcgctgtgcggacttcttgcttgcgccggctgctacgggcacggtccacggggtaagctgttggtccttgcgcgcggtcgcgctccggtgatggattttccttggttttattttttgttcggttttttttacccgggtctgtggcggtgggcgcagacctgactggcggctccgggccgggggaggcgagcgacggagcg

SEQ ID NO: 6012 - DNA, 166 bp, Zea mays
ggtcaacaacttcatgattggttaaaaaagttgggatgcactattccttcattctggccaaaagggtaagggaaagaaacaaactgacagtgcagccaaaaaggctgtgttgctgagtggacctcctggtatcggtaagactacaactgctaaagttgttagtcag

SEQ ID NO: 6013 - DNA, 1500 bp, Zea mays
gtcgaaaattaaaaagtgagacgaatctagtacagttggttggttctatatctcatacttttatttgaaagtcaaacgcttgatgtgacccgggctaaactttagtccacagaaccaaacaccccattagtgggaaaagtttaggggacaccactggagacagccttacacctatcaatgtggctgggaacgatatgtatggaacacaagcgtcgctcgtttcttacccctatgcctatcgaaggggctcagaccgacgtgtagcgaacaccatgcaccagccttgctgctccatgcagtagctgtccccatcccgagtccacggctccacgcacagcagggcacagcccaatgccaagctggcgggcgtgtcccaccccaccccggtgtccccatcgcattgcagcgcagccagcgccgcctcgtcccccccatttgagagagcgagagcccttggcggaccaccatttacagacgcaccctcgcaaaaccccgctaattcttccaaacgcacgcacacaggcgtgcggggatctgtctggcggcagactggaggcatctttttttggcagaatacccccctgcctcttattcggcccccgctcgcccctgcagtgccatccgctgctcttctccgttcgaccgcccgcccgcccgcccgcccctcctctctctctgtctcgccgcccggggagaaggagggctccgccgctcccggggaagagcgcgccattgccgccgccggtgagtttccccgcccccctggccccgctccctcccttctctcgatcacgccgtgcttccccgccgggccgcattggacaatatcgctcgctcgcccggtctagtttcgtagatgtacgacgccggagatattttttttcccgcggcgcttgggtggcggcggacctgtggtttcagggtcccaatgccttggatctagaccgagactgctcttgtcgcatccggtgccatggtgttgtgcgaagtctgttcagattcgtgcgaacattttcaacattttcactgcaaaacattatgactcaacaaaaaaaaaagaggcgcgtagacactagaggcacagtcttgtgagttgcgacgcacagtcaagtatcggttgccaaatccgtgcgaacaacggctgtgggcgagtaagcaaggagatgaagattgcctgtcgtgtggtggagccacagccacatgccgatgactgcctaatcagggagaagccgtcgtgggcaagcggggaaaggcgataatcatggtaccctcactggtggtgcgtgtctgctgtctaggcctgaagctggctagttcggcgcggctctccccagtccccaccactgtcattgtcagttggttctgctcatcgccacctacgagtttctccctgcgcctttggagactgtaccttttctgaatctgcctttgcttcctcacctgctgtatgtggtatggtatgtgatgtgggactctctcgtgcagcgctgactggggaag

SEQ ID NO: 6014 - DNA, 319 bp, Zea mays
gaaggataaaaatgaagaaggtgacaaaactaagggtataaatttaaatagcctaggctccgtccaaagtatccgagccaaggatttgcaaatctgcgttgtctctgtcagtattcttttataacatgctatattttaaatttcattctacgaacaatgtgatctacggtacaaatctcccattttacttaatctgctgcagacatcttagttcctaacatagctgcactgcatcgtgtcgcaggagttcgacgcggcggtggcggacatcaccatcacggcgaaccggtcgcagcacgtggacttcacgctgccgtac

SEQ ID NO: 6015 - DNA, 1500 bp, Zea mays
ggatgatcataccgttagttcccatgcccaccgacgaggattggcgggacgtgagaagatttgccaccgtggacaatgactcaatgaacagggcaatactagattaaatatccccctacctcccttctatgctctcgctcaggatcatacgccttccttcacataatcttacatgtggggtccacagaggtagaactagagggtaatctaggtagacctccgactaccttcaaatttgacctagaaacaaactacttctcagtgtttaggttcaaaaacaataaatctatacaacttgcaatctaatttgatgaattaaatgcattatcagacattttttgttattttctgctcatataccgaattgatggaaattatatatgtgtgatcccaaattattgatagtattatatatcaaatttactctaggttcaaatcctgagtccatcactggcactgtagccatcacaaccaaacccatgctcaaattcttcaattcaagagaaaattatcctagacacatcattaaatctatttacatggcattgtttggttcttgggtactactttaaatagactacaaccatactgctataatttagttgaaatctattctcgacatatcaacattgtgctcttagaacagtaacatttttttctttttttaaaaaagatgaccactaggacaagcattaaaggcaatagcatgaacttatttactatctagtaaaacacaatttaagataagaaagcaaaccaggcagaatgcagatacatcgacagtttgagtctgcaacatagtctaaaattgttcaccaacctagtgacagatggacacataatcacataaataggaaagcatataatgcaaaattgagatacaatatgattacacaataaccaaaaagaataatgaatgttatggtattcaatgcaaggctgtggagaaagcaatcgataagaaacccatcaaccaaagtacatcatactatcagatcacttttttgtttatatcattcatgtaaagtttcatagttaccattttacacaatcattaagaacagaaaacagaggagataaaaaaaatataagctcaaatccaaaagaagagatggtgtggcagcttgttcgaggatgtcacagaacagatagaaatctgagcagcacggagaactacacttttgttgtagccaaccttcaatgcaaagatcatcacttatatggcgcctttgctctgcaaattggcttcaactctctttgaaaaccatttctattcaccaaaactgattgaaagcgaggactggaccgcagcccagttcgttcgttcgccaggtgtgcgacggagcatgggtccgatccctaggatcgacaccccatgcctcactctggggtttttcccggtatggtttacacatgtgtgtgcggtcagtggttctgcgtgtttgccacacactagatgactaggcctctcaatccctttcgaatgtgtgtattggacac

SEQ ID NO: 6016 - DNA, 352 bp, Zea mays
agtgagttcaccgttcagtttcacgcactgtagctaatactgataacttgcaggcttattagctttcctagctcattcaagcaaagcaacaaattaatcaaaagctagccatgatccgcccgaattaataagtatccatctcatactatgcacgtgttgggtcgttgtggcagaggcggccaaagaggagaagaaggtggaggtccaagactggcacggcggcggcggcggctacccgggtcacggcggcggcggcggcggcggctacccgcactgccggtggggctgctgcaaccgcgggtaccatggcggctgccggtgctgctcgcaccctgatcagataccagagccc

SEQ ID NO: 6017 - DNA, 1500 bp, Zea mays
ctatatcaagaacccaaccagaggtgtgtaacttcaacaacttttgccatgccgggaataaaaaaaggtttagccagagtatacatagaagccgttggatgtatatacagtacttggccgatccaagaagaacgccttaaaattcctctttcatgcctttccacagcaggtaatctaataatagccttttgcgcctctggattgatacagctccaatctgatctttgcttctggcaacaagttgtctattactgggtcttgcaccatgtaagcttgcttggaagcccattcgagcaccgtgaggatttctgcttgtgccagctcctcgctgtctgggacattgtgtgcaatgtagcatacaagggtgagtgatgcaatctgaaccacctgctcgctgaaatacacaagctgaactaggtgcttcgctccacctgcactgatgatcgctttggaatggtcaacgtgcaggtaattatctgtgcacgcaaacttggtcagggaaattgctgcctctcgagacacatctgcttccctctcatcaagaagcttcaccaacggtccaataatccgagtctctgtagcacggaatgttctggacaagcaacctagagagataatgcagggaatcaggagatcatcatactcagccttctcaacaacacgcaggagctggtcaacaacagcccgggcagcaggagaagttggcttgaatgctgatcgtcgtaggtcggaattctgctcggccacacagcagatctccatgagagccattgcagaattatattgcacgtcgccttcgcctttctcaagaagaacagcgaagcagagcagagcccttgactctgtgatgctcttacagatagctgcatttcccttggcaagctgccataacgccttagctgcattggctttcatgtatgcctttgtctcagggtcttcgaactcccggcctcttatactcgttcctgacaatgacgcattgtgctgcttcgttgccatgacaccaccattactagatacgttgtgcttaccactgcctccattagacttggcagccatggtggactgcaccaaactgtggatctcattcttgctctgggaagcgtgtccagtcggatacctcgtgcctccgtgctcccctgcgtccagtaagtcctgctgaactggagagccggtgatgttctttttgtccattagcacggaatgtatcgacatcttggacgcgacggcgtacttggagtgttcctgcaccgtctcgaaagcgaggtggccgacgagcagccggatgacgttgtgctgcgcgaacgcgtcctggcacttggggtggttggcagcgagctccgagacggcccaggccaccatggcctgcaccttcatggggccctccttgagcaccttggcgaaggccaagcacaccccggcttggaccatctgctcgacgcactccggatcgcggcctaggaggccgatggcgagcgcgcagttctcctgcccctcgag

SEQ ID NO: 6018 - DNA, 483 bp, Zea mays
cctagccccctaaaaaaaacacaaagattacgtgtttccagatctcccaggctaccaagataattagggtgttgatacccttcctcgattccttcccaacattttttgaactttggcaccaccggctagaaaaatgagaacatccgggtcgaggagctagctagggtgatcaggcccagctcttgttaaactgctaaccaggattgggtggaacagctggtttttataggtggaaatgtagtgaattattactaacattttctttatttatttatttatttatgaaactgcggtggagttagtggatgtgtttaatacatatagcaggagttaaactataattaagaaatccttgtttgcgcaaataaatccatagccgttttatttttcttcatttttttggctgttctcagacaattactattcagaaaactgatctcagttaatctggcaaaagtttttgcagttttctgactcttgagg

SEQ ID NO: 6019 - DNA, 528 bp, Zea mays
cggcttgccatgccggtacaggctgtagacctgccccgcaggcacccgcttcaccgcgcagagcgcgatggtcgtctggctcaacagcagggtggtccagatgatcatatggaaaacagtcgcttatcagttgtttctttcaacagacttgcaagaacagcttacagtcgattgaatgactttggcttaatccttatttaacggcggacgacaatgattttcaagcgctttcatcacgttatttgaacattgttcactttgcacgataccgagcctcccacatggcatcctgccggcctgaaccaagcatcatctgcgccagcggccacggagcctgggcgatggaaacattcgggacgaaaagtgcacgatgcaaaggcaggtcttcgacgactgccggctccatggtgattccatggggcaggaagtgacgcagagatgcaccacaccgcgcgttttgcagcccgggtgatgtccgtggtcgaagctcccggaccccttggccacctcatttgcggagaacagacc

SEQ ID NO: 6020 - DNA, 226 bp, Zea mays
ttaaatgtttagtttcattgttcgctattttggtaaacttttgtttaatgtgtgccattaaacaattacattaggtttgtattaatacaattacgctagccgttcaggtttgtacatagaaaatgttccattaaatctgttgtacaccatcggttcggtgggttgtattgatatattctcgagactgtaaagttcactagtttttacaactggttccgcatgtcaa

SEQ ID NO: 6021 - DNA, 963 bp, Zea mays
cgtggcaggtcgacccgtgggcttgacttgaggttcaggcgcgacccacacattgggtcgtgccgacccagaccccacaattaagatggactgtgccagacttgggtcgtatttggaattgtgtgctttggatcggcctatcaggcaaagcacaaatgtacacatataacctcgggctaggtgaaaaccttgtcaggaaggatgggtgtaccgcgacgtgggaagtcgttagatggcaaaagggacccaattccggattcctccagaggaattcttccattagaggatagaaatggggaagtttcttccaccgcgggggatataaacagaaaaaatctctcgacagttaaacaaggatgaagatggggaagcattccccatccccgttccccacgggacccgttaaaattacatgtgatgatgttttaatgtaatagttcattataaaaatagataattaccttgtcaaaaggttattcattgtacaaatgtgtttattttgatgtacacataatggctcttacatatgacaatgagtataaatgacaatgttttgcattaataacatgcgaagtatgtcctaattaagttctggatttgagggacgatcttggtggactagtgcaagtatgccaccccttttacatcccaatcataaatcatgctatgcctatctttggtctgctagaattgcatgatacgtgcagacgaccagatatgtatcatgcttttttttctttgatggtaaggaacaaaacctatgggaaatattcagatatataaccatatgagtataagtgtacagctccacccaggttcaaatctctttgatttgaatttgggtgtctatttcgtctttttacaatgccaactagtaccttcaaggttggtctgagttttttaattaatatattcattattcgcaagcctctcaatgcagtttgtagtttattcatatgcatc

SEQ ID NO: 6022 - DNA, 1500 bp, Zea mays
ctattcaactacatctagagacgcatgccagcggagagtcgagacagtggttcgagacgcttgtcgatggagaagataaagtcgtcaccgcgagtcggacacgacagtggggggttggcgagtcgatggcctcgaggaggaagggctcgtggtggttgcattgttgcttgcgcatgtaagagacaagacttatcttatttgattattatacaagatatgaaggagaaaattagatctgcgtgtgacgcacgacgcacgagtttcgtgttttagaggcggaactcagaactgtgacattagtatgagtaatatgagctatgatgatgataatgatgatgatgatgatgtggctttattatgttgctatgctcaactagtgtgatgaatgagatcatgacatgacatatagtgtcatatggttaggtggagaagatgtggcttcgctatgataggctagattgctagtgtgaaggccaagtcaagaggcatgggagcgatagaccatgtggtggtgatactagagcaaggattttgtgttgatggaccaggtgcaatggtaaagagcaaaaaaaagttgcgatatacgaaccaatatgactgtatgatgacatggagtagattatatcaactacaaggtgtgaagccataactagtgttgattacaagcggatatatagaggttgatgactgtgtagcaccattattgaaggagatgaaatataatggataagacaaatgtataacttgtagacaattttatttcaccaatcaaaggttgtgtagagaagtgcatgaccatatttaagatacatgatcatacttgtcgagggcaaatatcacgggtatgacatgacatgggattaagagataaacaaatctcttgttgtttgagttcgcccgaccaaggctccatctcgctcaacccccaaccatggggcgaggtcagggatgcgaagcatcttagccttgccgacctcgactatgaagggaccgaggctcgaacatatttaactcagatttatgcatcacctgacctctgaccactcgggagctaaccagtttaggtcggacgactctgcctcagagttccgcctcacccgacctccgaggataatgggtaggatacttcgcccgaccacctgaaaagcagggttcccgggttcgtactgcttcaaccataacgaacatggaaacattagatcacatatgatcttcatggaagacaccaaccctgccttttccctgtaggccgcgcgcgtcggcgtcggccctcacttcagatggacgcgtacgtcgtcgctttgcgctttacctgcctataaagaccactgcgttcctcgccgtgcatggcaacgtcggccaagcacgtagtagctcactggcacgagacgagcgagaaagcatacacacagtcagagcagcaaccaagcggggctgcaaggcggcacccgagtagcagctagctaggctacacaacaccaaccagctagctatataggc

SEQ ID NO: 6023 - DNA, 758 bp, Zea mays
ccagtccagattgtggatagaagactggtaaggaaaggcagtcatcctgtggttcaagtttgtattgtttggtcccatttacccgctgatgcttctatttgggaggattatgaggtgattaagaagtgttttccatctgctattgattggggacagtcaatttctagcaaagaggtgatgtcagtacgtggaaggtgctcaggtataagtgagcagtgattcagtattaagaattgagtaatagttgggcttgattaggtggttgttgcttgggccctaatggacttgtaattaatctataaatacctgatccagcggtattataagggatctatgaagatcctataccagaaaggtgcctgggccacataccttgctttcctggaaacttaccaaggttctaccaccaggaagtttgcttccacaagatatgttgctacccacggtgtgggcggcgctccatctccagaggattgtgacatgtggttaggctagggccccacggaaatccatgttcagcttacggcagacttaggtaggagcgtccgtgcgttctctttctgcttctttctgccccctcattagtgtgcacgtcacagggacgtgttcagcagagtcgcccgagtataccgagcacggcagctagcaggtacggctggacccggacgcggccgccggcgcccgcgcgccgcccggcctccacggcccgcaccgcctcctgccgcagctccggcggcagctgcaggcagacccagtcc

SEQ ID NO: 6024 - DNA, 1500 bp, Zea mays
ttgataagcatcgacaccgagcaatacactgtcgagcgccaaagccgaccgttgagcggcactgacttaaccctgatgagaaatagaatggacgaccagtacttcattttggttactttttattgagcatgatttcgttttacatgttaaaggtaataacgttattagacactatgaagccatgaaagatcgcagaataaaagtcaatttgaatattttatctgtttcctatcttatttaatttgatgagacatgaaacaattcttatttaaattatgaatttattgtattttataaaaaaatgcattttattttattgaaaaataccctgtccctaaatctgcctccggcctgccctgagttgtgttaaactggccggtccttaagaattttatggaaattatgcagcactacctgccaacaattatttgcaatccattttgactataatttttgcatgcatcatggactattatatgattaaattatatggtcgttccagtgtgacgtttctagaaccgtgtcacgactcacgaccggttcaaaagcgtcggtccacggcaagtagaagcttctcgtgtgttttttttcaaaagcaaaacccgtttttgggttgcgtggcgctcatccgacgcacggccaagttatgattttccacgagctaaacgtgtcgtctagggaagtcaacccgtctcgtttacctttggtaacctcattttttttttgtctaacgtagaaatggtcaaagatatatctcatttataggatataaaacagatcaagataagacggctaataaatgtctagtggtcgcatgaattcacctggtatcttttctcaggacgatttttttgcttccaaattaaccgcgtggatttggatttggtcgcccaaatactccgtctgaaattctcagtggtcaatactagtacggattaggttctggttcagaatcaagatccacctgccgcttgtatcccaaattcccaatcggataaacttcatcgatagttgaccatgaaagccttctaaaatttcaggaaggcaatattaaatgctggagcatttttttattgataattcaatgctggaacgttgagtgtcctactggtacaatgcaaaggcccaaaccgggaagcggtaggtctatcatctaataccctcactgacctatggaccccgcagcgacacggccatgaaagaccccacatggcaggttccaacagggcccgtccaaacgcgcactgcacccactccaactctctgactctctctccccccctttattggcgtcatatgactctctccctagtccctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggac

SEQ ID NO: 6025 - DNA, 809 bp, Zea mays
catgtgctaattatagagaatatttcgaattcaagtaaggtcccaaatctgaggcatactgttgctgccctgctggaataaatgtgctactttcccctgccttgttaagggaaagggttttgttcacgatgttaccttgtaaccttgtacttatgtttcatacttggaatgaaggttcatggaacaaaaatattctgctgcattgcatgcaagagctgttgatcattcagagcaatgtattggttgtgagtttttgacggcgctcacagtgatagatttgttatctatatgccagccccagcatattcatccttgtgctgtgggcgtctagaggaccgacaatatatatatttttaaaacaaattcgtgaagaacatcacaagttatgcatgcaaactgctcaagtcatgtggatccaaggcatcctaacaactagcacagcattacaacaaaatattggtgtatatgtgcctacaatgaagtgaaaggtgatgagtcatggtgatgtgtaaagaggcattacaaagttagcttcacaagcgtatgaattcattgacaacccttgacatgtaaagttgattcatatgtataagaaagcttaatgatctatctgtaaatccaaatccatgtactatgtttccacgtcatgcaacgcaacattccaaaaccatgggttgcaagatgctgcagaatgcaagccatggatcatctataaatggctagctcccacatatgaactagtctctatcatcatccaatccagatcagcaaagcggcagtgcgtagagaggatcgtcgaacagaacagc

SEQ ID NO: 6026 - DNA, 626 bp, Zea mays
catgtgctaattatagagaatatttcgaattcaagtaaggtcccaaatctgaggcatactgttgctgccctgctggaataaatgtgctactttcccctgccttgttaagggaaagggttttgttcacgatgttaccttgtaaccttgtacttatgtttcatacttggaatgaaggttcatggaacaaaaatattctgctgcattgcatgcaagagctgttgatcattcagagcaatgtattggttgtgagtttttgacggcgctcacagtgatagatttgttatctatatgccagccccagcatattcatccttgtgctgtgggcgtctagaggaccgacaatatatatatttttaaaacaaattcgtgaagaacatcacaagttatgcatgcaaactgctcaagtcatgtggatccaaggcatcctaacaactagcacagcattacaacaaaatattggtgtatatgtgcctacaatgaagtgaaaggtgatgagtcatggtgatgtgtaaagaggcattacaaagttagcttcacaagcgtatgaattcattgacaacccttgacatgtaaagttgattcatatgtataagaaagcttaatgatctatctgtaaatccaaatcc

SEQ ID NO: 6027 - DNA, 84 bp, Zea mays
gcgctgaccgagcgcgacggcgttacctggcaggacgattgagcgcttcggcgccctgcctcaattcatgtgagtgagagtaaa

SEQ ID NO: 6028 - DNA, 1500 bp, Zea mays
caatgtcttttttctacacaatatcaaatacaaaagtagcgctggtcaacacgacttgtgaaaacatcaaccattaattctgatatagcactttgctttcttgatcctttatcttgtcttatttgtccaatttaaatggctatttgacatgctaattacaaaaacaaaagaattgaataatctatgctagagtttgtatgagtacttattctacttttacccttgggtaaattttatagtgttttcattttacatgaaagattatctatgataatccttgctcatgatatttcatactatgtgatcgcctaaaatttgatttgttatgtatacttcaactgatgcactggttcttgctttaaaaaatagtgatagcaaacatgatatggtagttagatagcagggagtcaggttgcttagcatggctaagatttgatgaatgggatgagatgcatttctgtgttgagtagtggaatccagttactttagtacctaacaaacactacaagttgctaattttcaaacatatattcctacctagctagtgaaaataaaagaagaaattgtagccaaaagcttttcatgccatctatattagcccacacacatttgaggaatagtccatgagtacaccgagatgcctagaaagtaacaaatgaagcaccgcagaacatatccgcgaagcaaactctcgccttgcattttgcatttccaatttccatgaacattatcacaataaaaatatcaagcaataaaaagacgagagcacattgcgctattgaaatcaacattccacatcaacatgtcacggagacggaccaacggagaattttatagctatacaaatgacctctgagacaaattaagcaactgaacaaaatttcagtgacactatagtggatggatagaagaataccatattggagagcctcttcttgcgcctggtgttcctcttggcgaggaagtgctacttcccagcgcaccaccgcacgatcttgcccatccccatcaccgtaaccgcttcaccaatgcctatggaggtagggcaacaagaaacatacctggacagagtgcaggacacacgctccattgtgcggaagggggaggagtcagaagaacaagaggctgggagaggaggaatcgacactgagaagcagagattggtggagcacgccattcttgctacttccacctcctcccctcctcttctctctcttttgctggacaccgttgtcctccaccctctagtttttcgtttttcgtttttctttctttataaaatcaaccatgtcgactttatcttgtttcctcaccgttagatgggcttcttcatggtattgggtcggcccacgggccaagcggaacaatgagatcacggtatcacacatcacactgcttgcctgcttggggcgtgtggaggtggagcggtgaactggtttatgctaccgccatctctctagcgttagcttctgcgtgtggccgtgggtgcccgcgcgcggc

SEQ ID NO: 6029 - DNA, 1149 bp, Zea mays
tggcggccagcagctacgcagcgacgcgtctgggggggcgcggagtggaggaggccggaccggaggcggagacgaatgccctggccctggccggagatgatgatgcacgacggcaggcaggagcaaggatgagtttaaggcggaggagaaaagtagatgaggagcaagtggttgtggagggaaaccgttccacccatctcaattccggccgttccatcacattatattactactcttttctgtgctccatgttcctcctgccacaggacccacttgctctccatccttttttcttcttctcccatttctctcttctttatttttccgttttcagattaaagaggccgttaatattaaggacattgctggrgagctccagctttacaaagaaattactccaagctagccagggacggagcagaaaaaagtttaggagggactgaactaaattgctgcagtataaaatcccattctacattatattgtatatattttagattaggggaggctgtagtggggctccatgggatcagaagcggtagaggtgctcgagccccgcccgccccaccgctggatccgtccctgaagctagcaacaaacaaggaacgaagaaacaaaaatatagcacggatgatagaaacctcctgagggaaaagtgatggtgaacgtcgatgcatcttttgatgagaaaaaatatgagatgcggaagcgtggacacggccataaaagaagctatccagggcttcgtgtcttagccagtggtatagatgtccaaacgggccacccggtacggacctgacccgaacccgtttcggcccggtacgaatagggtcgggccaggcacggcccgttgatgcttcgggccggatcgggctggcccacgtgtctagggacatgcccaaacccggcacgcacagggaaaaatcgtgccgggccggcccattggcccggtgggcctcaacggaccgggccagacactggcccgaaccaacagtagaacggtatataaatacatatatttaacaaaattaatcatatataataacatattatttatatatattaagacaacaaaatatttatgtatgcattttatatttatgtatgcattttatatatgtttggtcgtgtatttagtatttacatact

SEQ ID NO: 6030 - DNA, 108 bp, Zea mays
tctgatgaatcccctaatgatttttatcaaaatcattaagttaaggtagatacacatcttgtcatatgatcaaatggtttcgccaaaaatcaataatcagacaacaaa

SEQ ID NO: 6031 - DNA, 1276 bp, Zea mays
ctgtgacccacccgtgagtgtccggcctacgtgttctaaaacatttatattatatcaaaagtggtatactctctactcccttcgtcccaaaatataattcgtttaaagctaaatacacattcattaatcaatatataaatatagtttctatgtatgtctatatttattatcattgattcgattgtagatgaaaaaaggagcctataaataactatattttggaacggatgaagtatttgtttagctcttagtttttatgtataatatactcaaataaatgacgatgaatctagacacatatatatatatatataacacatatatcaagtattataaatctattaataattatctaaagtgaattttaatttgggacacagagattatacagtatacaatactatcatcatctcccagcacaacttacgattccccagagcagagcgtatatcatcaggtgtcatggctacgtatgatttcgcccaaccaaaaaccaaaaaacaaaaaacaaaacaaaactgcgcttccaaaagatactcctgctttgcgaagctggatatgaaccaaacgtcctcaaagcagtgtacttgccagttgccacagcttttctcaactctcaagtatacatgtgctcagtggattctcgaaatttgatcgttcggccccttcgctcctccttccgttcctgttctaatccaacaaaggtatagatatatatatatatacaccctgatgtaatgtaatagtgcccgcatatatcctaatccaaagaatgcagaccgcctaaatgcaccgccgatctgattattcacctgctcgcagagagagagaaaagagaagaaaagcgtagtggcaactggaaagctaccagctgcatcgatctatatataaacaatctctagccactacagtctacagtacgtacgtcagtgcattattacttctgtttgatctaacagtctacccgttcttcattctatgcaaaaaaaaaaaaacagtctaccccatgttcaacacggccagccgaacttcattcctgcgcgtgcaaaacgagtcgtaaaaaacctcggcgcttcttcctcttggaccggccggccggtatatataggagcgcctggagctggcgctgtgtgcgtcgccacttgcaactcgaccgaccaccagagcagcagtagactcacagctcactcaccgtgtctcacactctcacacgtaccgatcgagcggaagcaaacaaagcacacgtacggggtcgtcgagagaggatcggaatcgg

SEQ ID NO: 6032 - DNA, 1500 bp, Zea mays
aaaaaaaacacgcgtttgcctttgcttagcgcaacaagcgggtgacatctgacatcacgagacgagcgtgcgagaggcgccagccagcggtgggaggcgtgaagtcgcgcgcgcgcgcgcctgacgggaggcgctgcgtcacggccactgcggtggcgctcgctgacgcagtcctccctccctcccccgtcaggccgtcaccgtataccccattgattccggcaccaaatcgaaatcacgatggcgttgtcacccaggccagcgatcccctgcgccaggagggaccgtgccgcccggtgtgcccaccaacacacagacaccagcaacgatagccaatcgtatggtcccctctctctgacgagaaagaggcgtcacggtcatacctggtggcggtactagtagtggaaattgggattcccatcttccgaatccagtgtaatcgtgcagtactatattttatctatatattgtgccagtggtcacgaagagtttgaccgacgttttcagaccgtgctagtggagtcgttgaagactaatggtggtgaccgacacagcagggcttcactgcaaatctcttaaaagcttcaaatgccgacatcccactctacctatccaggctatcctcagttttaatcgaacataaacgaagctagtattcataacatctgataagtgtagccagattactcatggaatatgtacttataagtttattcagagatataaatattactattattttaaatctttcttggacggagggattgcctctcctgctattttcttttgtctagagggctccagcgaaggaatcagaaatggacggtgatctgaaccggctagtccgccggcaccgcacgccgcaaaaaatacacctaatcctgctccggtctgaaatcgacaggatttatagcaataaggacaagcattaaagccggtcgtcatcccgccagacgtgcaacgcgataaccgtgccagagcacgcacccgactgcctgacgacgaaaccactctcggctctgacacgtgcgtccacgaacaattttttagcgtaccgtctcgtcaacctttcatctccaggcccctgttaaacgctcgatattgaattacgaagacatacttgttctaacctagttcatccacctagctcatccaactttaaaacaagggaaaattattcctctagcattgaaagttcgtcatattcggaaaataccatcaaaatttcgccgttacagaaaataacaccaaaaaggtccttccgttccatactgcaacactacgttcgtttcttacgccgttacaggaaataacaccaaaaagctctcatttccagtggactgccctcgattcctctccagaccgtgaccgagtactgctgttcatgagtactactcagttagaattgaagactatgtccatgagtactactcagttgaacgtttcaaagctacttatcagtttgatattaacccgatggttgataaggcttagtggccc

SEQ ID NO: 6033 - DNA, 1021 bp, Zea mays
ttttattaaatttatgtaacaatctatcatctgcaagtaatttatggttaaaaatactaaggtgagtaaaaaaattatacataccagggtcaccagatgaaaaactaatcatagattacctcatcacctagatatgcgcccgattgaaatagacattccatccatttcatttccacacaggcatcatctaggaacaaaacagttgtgagatgaaaggaaaatcgcttacaatataaaacaaactgatccctacaatatttatagaatatatataatacctttcggttagtcatagagtcgaagacacctttgtctgtggtcctacgtactggttagccgagaaaggaaaaaccttcgccatacgatgacagtcacgttcggcctctgcccaacacatacgacataccataccatacggtgccgtgccgtatatttaaacggcaaaaagttcgaaactatcacatgtccttataaaggcagttaatgggaccataacggtatatgaggtcaggctgtctccaataacaggagacccatacgccgtatgcgtcttaatgggtctgctgaaatggrgacccaaattgttggttctccaacagaccatctaaaatgggcctccatcaaccgttttagcaagaaaaggcgggaagcaatcatcycaatcttcagttcccgcttcttgctgcccagaaccaagacctcccrcttyctgttgcccacgtcgccggtcagcctgctcggccactyrtccagcagagctggaaggcatcttcattttctcccattcgcttcaaggcaagtttcattttcttctctccctgacaggaatcctattccttttttcgtttttacagtccgtaggtaaatattgcccccaagctgcttcttttcttcgtttttacaccatggtgaaactatttctatttactactaatttgagttcgattcttggtgtgaatctgctgcaactattgcctgattgaccaaactactcaaattaatctgattttttcatgcagcc

SEQ ID NO: 6034 - DNA, 1500 bp, Zea mays
cctgttcttctaaagaaacaattaaggagaaaccatgtcggatctttaaaagactagtttctgactatacttaagtagttaattcaaattcgacagaatttgagatcggagagacaaattttggttctgataggtggctggatcgagcaccgagcagggtgtttggacacgggcctacccagtgcagcctataaagttttcacgtgtcctttataatttcgaaaacgcaatcctacgctacgcttagtcgacgcaacacgcaaggaaacaaaacacacgcgacaagctccatgcctcccagcctagaccaacgaggcctgccctgggggtaccagtgcgcacagcccgaggccacatcctcgagagggcaagagcccagctaatttttaatcccggaacccgaagcccagaaggcccacgagagcgtcgaaacgcgacgccggcgactcggcgaccgcgcgccgcctttaattcgaacgttggaggagtcctgactagtagcagtagtccaccctgtccattcccggcacaccgcgacagcatttaactagcgtgcgtcacctcccgtcctactgcttcctctcgaggctccgagccgcccgttagtagtgtagacctgcctccgccttctcctcgccaacgcgccaccgcagtaaagagcgcggattaattccagggcgaggggggagactcacctccattacgctccgtcccccttccccggcgtgcaccgtgcagtaggtgagccctcaaccatcgctctcctggtccggcccgcgtcccttccgatcggccggtgggtttcgattgcgctctcggtaccgccgtaccggtacgatccagactcttgattgcttcccgctggttgctgcggttgggactgagacccgcgcgggcctttggttggtgagcgccgccgtggtggccctggttggtacttggtagtgttctcccggcttccgcttccctgggggtagggtaccagtgtactgctactgcggcgcacgccggcacgcgcagccgggtttccttgctggcgcgcgcgcccgttcatgcgcggcgctttggtggcttggatgttcctcgaggaaacaggaagggttgccgcgtacaccccagttcttgccagccgtatctttctaggtcggggttctgttgctgcatgcgtttgctgggtattgatttgccgtctcatgctctcgctagctgccctgcacgtgacacgaagtgtaattttgtctcagtgtgctctggaatggttttgggggctttgggcttcaagggatttatggttcagaagcaaattttgcggatttgggtttccgacatcccatttcttgtttcgatcttgtggtgtttgttccactcatcctgacaccgtagtccccgatgcggcgcttatgttatggtaaatttggtgctgcaggtatctgtgcattcctgccctgctgtggttggctaggtaggggtggtaactggtaagaacagcaagaaccaacc

SEQ ID NO: 6035 - DNA, 1500 bp, Zea mays
gttcaggtatcccttttttgcattccattctattgttttgtcttcttatttgttgctcttaatttgtttatcaagacttttagtactgaaaaatggtgtgacccttagcatgaaaaaaaatatctacaacatccacatgagaaagttacaagtgcttcacactctatgatggtatcatttccgatcatctagcagtgatgctggtcaggataatcgagcagctttgaaagagcgatttgctttttactacatcaagagatctttggaggtagttcactcgtcatctttttccataatatattgatttcggaatgtaatgtgacttattttctgaccttgatatttaaaataggcttatccttgtatttacatacatgcatgtacgtccatttaaaatacagccacacgaacttgatggatgtttttttgcaaagtgacatcaggtctctaggtacttgtcgagattgtctctcgctctcgcgtcagagacgctcgcagctactgacatacttctatgctatccttttatttcccattgatccctatatagttgagacttctagaactaatcattttttctagattggtagactttggatgagtacaaaaaaaagaattagattcttctgcatttgatggtggacgtgaggtcagagcacccattgaaagaggaagaaccgaaatataagttgtcatctaagcaccatatcaaatttgtagagagggacaatgtacatgtcctgagagaaatccacaagagaacatcttcatctgatgttgtatcaaatccactacctgcggcactaacaactatttcttatcttcatactgcttctttactcccagtaaccaaggcagcatcttccaagattagtgtgaaaaaactatgtatcgtgagtcataattagtctaaaattgtttcgtaatatgtgaaatgaggccagaacgtaccaaaaaggaaggcatccaatcttttgtttggtaaatattcatacatcagtaacttctcatctttgtgaatgcaacaaccaagaagtctaactaagtttctatgctgcagtttggcaatcagaactagagtacttcatttccaaattcctcgacccatgtgtagaactttttagtgagccttttgacagctacttgccttccatagcatatttaggagacatgtaaccactgtttgaaccatttcagagaactacttcctctgttttaggcgcgtgcttcagcaactcatctcttgttctctattccctcttctcctttctgttttccatattattcttttttctcatggttcgcagaactagattaatatgtgagttggtttaagtcattcgcatggaggttaattgctattggtgaaggctgactaggtcaaacatcctacatgacccacagcaatgcagaaacattctttggtatgaagcaatatgaattacagattttgtgtcatcattctagatacctgactatcatggcattataaagcatcca

SEQ ID NO: 6036 - DNA, 1500 bp, Zea mays
gtaacatgatttatatctatattaaaaatattcgatttgacatatgaatgttttaggaacatccccacaattgtttgaaatagagattaatttctgctgcattttattctgtgtcagccgacaaaatgtactgtggtgcagagggaacaccgcgagctgtgacagcaggggtggtgaggaagattttaaaatccgcccgcgtgctacttcgaatctccgtctcctccgacattcactgcccgatggcgatggatgtaggttccacctccaaaggcgcctcctttttcgacgccttgatgcctttctaggactaggaccagtccgaactgctcgtgctccctctttcccgtgcgcgctgcaggttggtcgatcccacctggcggcctccgtgattgccggtgagtccttcttccttttttttttcttcgaagcacgttttggatcttggtggcggaatgctgctgtagtgctttgtgctccagctcctggtggttcctgggattgattcttgcatggttagcggctgcactgcaaatttggtttgcactgcgttcgtcggccatttctcaaaaagtatttcagattccctttcatccaacattcatttcatcccgtctctcttcctggtgtcgtttttctttcttcctagaatctgcgtattgattttctccttccctttccagattgtggaataaactatatacgaaatcatttcttctctcttttgcatcaaatccatcccaaaaaaatctggttgcaaccacttcggtttcatgttttgcccgtagcattttttcatgatctttggttatgatttttatttaccacggatacccatcagcatatcacacacatatcgctcttttatttgggttttcagtgctttctatgcttttgaaatgatgatgaccattcaatttagcatcagataaaatggcatactggtatgatatttctttcgccatttttttataatttcttcttaaaagacccaaaatattttctctatattacctgagaacttattgtaacataatgtaaataaccttcggtaaggtgaaatggggaataactgaacaaggtctgactcagcaatctacctatagatggttagaacagtgttatacattttgtggaatgaattaagacagataatttttcaatctagttgtttcctcttggtactagactgtagtttctttgtccctccccaatcatgtgcgccttcctgttcttgatatgcattccttcccaagttgcagattgagcatgctgcttcggaagctgaaattgtgttcactgctttatactgaattttcacgttcttaagataagatgtatcagctatgcatctttgtaatctgcacctactttaaattgtagaacactttaaaattgtttgcagtgaacatatctcagttattttccagcatggtgatgtcacttaatatttactgttttgctctctgtcagacaagtcagtgtctttccagactggag

SEQ ID NO: 6037 - DNA, 133 bp, Zea mays
ggtgagtttgttagctatgtcttcatggatgtttggatctactgtttttaaaaaggtatataatgttcttttatgataactcgatgtgcatagggcatacgacatactaaacttgtcaatttttctaggtgta

SEQ ID NO: 6038 - DNA, 928 bp, Zea mays
gctagctaatttcactaatgatttttagccaactagctattagttttaaggggtggttgaatgcactagaactaatagttaattgactaaaaattattagtgaaattagctagctaactattaactaatttaccaaaaataattaataattgaactattagatagggtgtttggatgtcttagctaattttagctactaactattagctctagtgcattcaaacacctttaaatattagaatatctaaataaggtctatagagtttttatctatatgcatgcgagtaaattatgtgagtgtctaaatgtactataaacctaatagttagttgtctaaaaattattagtgaaattagatagataataaataattatctaaatattaactaatttactaaaaatagctaataactaaattattagctagagtgtttccttgtctcaactaattttagtaacggactcttatatgcattcaaacacagtaccgttggcatctcgagtggcatcaccatcgccaagatgatgccgttgcgaggaatcgctttccgtgccgtcatctcgtccgttcgttgtgttgcgtggacccacgtcgtcgcccaagccggcgcgggcctatatgctggcagccaagggcagaatcggcatttcgcatcgccagatattttcgatggcctggcttgcgggctgctgcagcggccaaagatcagccatgctgggccccacccccacgcttcccatcggcctcgtcgcagtcggggccacctgctccgggtcccaacaagccgtccacagctggatccccagcctctattaaaggcgcggcggggggaggcatcgtcctctccgtgctttctcagaggtgggttggcttctcctcccccaccggttcgtgttcaggttctggttcgtgggcgagagggaagag

SEQ ID NO: 6039 - DNA, 188 bp, Zea mays
ggtctgtgcaccactttgcsctgaatttcaacatgttgacatcgagaattaagcagtgcatgctaattattgttcaactttgcatgcttaatatagagcagctggatggcgttataacagagcttctagatagatatcatggaaaatggccacttgtcatactacacaataaatgaatttccaagctt

SEQ ID NO: 6040 - DNA, 345 bp, Zea mays
cttttctctacttgctagtctatgttttgatcatgctgcataatttatttattgttaaaaaaaagatatagccaccactgtttttctgctgtgtaatatgagttcaccagcttcttcttggctcttaaaattgcgacgttcatacttctgcctactataatcaacatatttcttaactgcatgatcgaattctatctgcatgagtttggatctaaaaattcccgattctgctcgaagattgattgattttgtgtgttttcctctaccacacacttcctatttttctttttctgattgtaatattttgcttgttgattaccatttgaacagctacaggaagaaaga

SEQ ID NO: 6041 - DNA, 510 bp, Zea mays
tgtagcatccgcacagcgggattgcggtgtggggggcgggtggtagggcggttcgtggcgttcgcggatggagttgcgggtgggcggtatggcggggtgtttcgacggcgagatttccggcgtgaggcaggcgaaggcgggcgcagtgtttttggaggtcaggggcgggggcggtctacactctgcgcttaattgttagtagagatagagattgctgctgttgctgattttatcgtcgtgtcatcgtcattttcgttattttattgggtccctgatttgtgttattgttatgacgttttctagaaggccaatcgggccaattttacggcgaacgacggtaagcaaccggtcaacccatttgggtcggaggcccattcgtctccgaaatccagagtgggacctgagcgtaaatagaacccgagcccctctccgcctccctccccgccgcacagcctccacagcccgaaaccctcgccgccgatcggtttcggagaagagaagcaaatcaag

SEQ ID NO: 6042 - DNA, 684 bp, Zea mays
tatatataaagtgtgtgtgagaccttatcttaatagaaaacggctctaatgcgtgtttttgtaagttgatcatattaaataactgatttgaaaacgaaatagttaatttagaattccggtaaactcggccgggcagagtccgatcccggcgctgtgggaaggacgataacaagaagcatgcatgcatggtgtgggcagctttgagtgacggcaagattgactttagtaaagttaaatgctaagttattttttgcgtgttaacccaagtatttttcctggtctactaaggttagtagcggttgaccttgccacgcatgcactaccaagacgagctagcgtgactttcgcctgaatgtttccggtagcaggggtggtacgtacatgcattaatgtttagtacagctggagatgaacaattaatggaaacaaacaaaacacatatatacgtaacatagtgtgtcactttgtcccctcctacgcgacttcccctccaattcaggcgctctctctctcgatccatgcatctcaactcaaaggcattcaattaattaattatactagctagctaggaggaggagtactccggccggccggccggcgcccataagaacctctcgtgttgtgtatgcatcgatcgatcgatcgatcgatctccgactccgacgacctcgctatccgcgcgcc

SEQ ID NO: 6043 - DNA, 1394 bp, Zea mays
actaagtacatatcaaatgctgcacctgcttcaggagaaaatatttatttaggtacaccgcacacatgacatgatacagcagacctgactttcccttgaaaaaaaaaagagagagaggcaaatttcattagcactttagcattaagagatttacaaaaaaaaaatggacctttaatgtaaatgcaacgagcaaagtgaatttcctgtcccggcatgcatgcagcagcatagcaaccatacttgctactagctagccagtggtgataaagaaaggcaggatgaagctggccaagtaatcccagctcaagaataacagatctacattttcttcagttttgtggtgcgtttttatcaacatagtaccgacgatgatgggttcgttgcactgttgaaaaagctttggaattaaatggaaagattgtggtgacagggatcagagggatgaaattggccgcatatttcacccggagcaacagctactgtacatgaagtcaggtttaagcaatactgtttaggccaagaaggggttcttgaaactgccaaaaagcagagtgatcatgtgatgaagataacttggacaaaactgaccacagaatttggagttcaatraaaccaacctgaaagccgatcaatgacagagaaaacccggatgaaattggccatgtaatctgragctgcaaacgtaccatgtcgtctatgtttaaaccaccgcctgtttctagtccctaaaataagttaccagccgttgcgagaggtttggacttggctcaggatttctcagccaagtattaccaccggaaaggtgaaactgaaaatgaaaagcaggattggagctatccacatttcgtcaatgtagctagctgtcggagttgtcattagcctgttgtgaactgctggtagcgtagcatagtactgaaattttaaataacacgaaaaactttcatatacaacctacgttaataattaagctatttgctttcttgtgtgtgtagtatagttattaaatacccagctatcccctttcagttaccagaaaggtaattactgacaaggagtagcaggaagagatgagccaagggaactcatgcatgaaccatgtatgtagtgtgctgaaaccaccagcaatttccactcactcactaaactagaaaactaacaccatcgcccatttttttctcaataagatcaagtggaagctttcaagcagctaccttgaagcccatatgctaccaaaccatgccaggacgtaacaccttctgaagctggaagcctttataatagacccacaaccacacaataccaaacctcattccaagctctcttcattggttcatagctagctagttcgcctcccaaaaacacctgccctcgtgcgtggcaggagcacgggcacg

SEQ ID NO: 6044 - DNA, 455 bp, Zea mays
gtgtggacgtctacaaaccgtgcttgtagagtagtagggatttaaggctttactgttggagcgaagtgttttattggtgtcctaaattgtacaaaatatattcatattaaattatatgatgttttttataggtcacatcgttggagatactgttagctcatttaaaggttaaagtgataaaattagtcgagatgaatcttttctttccggactcaccaataaaatcgcgacggacgagatttaccaacagccaaccagggaagatgtttatgccacgtcatgtcgcgccaaagcttgtcaaatacagcggtcccacatcagtacgtcaccaatcgaactgaatggaccagtcgacgtcatcgcctccctcgcctatccgctcggccgttggcgctcaccaaaaccacccagaagcctccgcttgaccgcttcactcgctttccgcccgccgcgcc

SEQ ID NO: 6045 - DNA, 1500 bp, Zea mays
aatgaatattagtaattgtaggcccaatcaatgtctttctggccgaggtgaagggaggttccagggatttatttggttttgcttaactattgttaagaagctttagaagcatttctatcagtggcactgaaagaccagaagtttagtctttgcatctaggctagagttttttaaacgatagggtaaagctattgcttgtagtacaacactgctcgtatttcagtgtgcaggtctgctagaaggcggagatgcattttatcggtctctatatttttatccacttatcttcattttttgattttttgttttaggctctcttcttcttggacctaaagcagttagaggtgccctttctagaataacttttggtctttccgttagtgaggtcagtcatcctttagttttatcttattgtatggtttattaatccatcatcattgaatatttgaatgtcctatttatattaatttgatttgtcgtatccttcacataaataggtgttataacctaaattttgcattgtgatgtctctactaccaacacctattttcttagaaggctacttggtagtaatttttgtactagctacaagaaacccactttatgcaataaatatccattatttgagtgtgaatgtttgtcactgaacaatcaataacgccttcatatgaaactaacctttctctaatgtgaacagtgcaatgttgagggcggggtctcgcttccacgggacctttagggctggtttggtgcacatggaattggaggggatccatgggggagtaattcccttcttatttaaatttgaatagggaggggattcctcccacatggatccccttcaattccctgtccaccaaatcagctcttagggaggatatgcgtgcgttctcgaacgttctggtggcctagaaatacacgtttcccaggccggcaacgtcgacgccgacgcggtcacgccttttttttcagccgactagttcacgtgctcgacgacggcgagcgtctgtctaggtgcgtacaggacggcaggcgctcaatacgtccacccacagtttcaatttgctcagttaaagtatttaaatcgattcagcgactgtttctgttgtatcgatccgatgctgtacaaacacatttatttctgtatttattaatagactaatatacacttcattgtataatagagtctcttaattgtattttgtagttagagaactatttcgatgtctctcccactatgcatacccccactatacatacccttaatcacagcacaaatcagcacaaatgtacacctataaatatgacgcacggacggcctcgtttctctcccgcgcagcaatcctcggcctctcactcccatcctcccgcgcttagaaaaccagggccaccaagggctgtggcgtgccattcagtccggccacgcactcaagcaatcatcgttctttcgaaacgcaacagcaagaagaacaaccacgcacatcgccgttccatcgattc

SEQ ID NO: 6046 - DNA, 1500 bp, Zea mays
cagcaatggctctgccccctctgcgcccgctgccgcctcttctcttgcgcgcgtgacgcgttgcacttgcacggtaacagctcccacggccggccggtcagccggtgcagtcgacgcacggcacggcgtgctcgtgagaggaggcccatggcgcggggccgccgcgtctctctttgggcaattttttagagatgggtagtggtgtacgctatcatcatcggtgccgaatgccgatcggggggtcatgcatgcatgcaagctagctgtgcccgatatgagccgtctaatccgtcgtgtcccgagagtggagacgagacgaacgacgaatctgttcttgcaacagtagccgttaaaagtgcacgacggagaatctgttctagccagctacacctacaccccgtcgccgccggtagctactgtagcttaattaggccggcgcgatcatatccgcgtattgtttcaaccatcggtagatgatccatagttaatagtattgggagacaagctgttggaggtgctctgatacactacaccgaaggaaaatgcacacggagtcggagacttcatatacatcctgccgtcgccgctctcggcgttcagacgagaagagccgacacaagttgaaatgaagaatgccctcggaaacttcagatacggacgtacggtggaggaggaaagacgagcggcggccaaaacgcaaaaccttttttttccattaacaaaagcagcaagaagcagccttggtttggttcgccgagttggctgttggccccctgttctcttctcccgatcctttcgcgcgcaccaatcagtaatcacactgttattgcagcacagcagcaagcagggttggttcactggttgcgttttgctcgatcactcgctcactgcaccgccaccgcggcgccggcgatcgccgggccgtcttccccaccggcgtcgtcggcggtacgggcgatcagcgactcctcgcggtggaaccaggtctgctgcttcgcgatgaacgcctcgaccgccagccggaacgcctctccgtcgtccacccccagctccgccaccgccgccgccgccgccgacgacgacgaccgccgttgccgccgcctgccgttctccgacttggctcgccgcagctccggcgacgccgcactgcccgctgcgccgccgccgccgccgccgcccgtcttctccgacatgctccgccgcgggggctgggcgcgcaacgtcctcacgtgcaccgcctccttgtcctcgaacaccacctccggcggcgcctcctgcccggagggctcctccgcctcggtgatcggcggcagcgccgggccaaggaacgcgaggaacgggtgctgcgcgtcgccgccgctggagccgggagggtccgcggacggcggcgaggatgaggccgcgtcgcggcggaagagcgtggcgagggcgaccacgatgacgttggcggcgaggaagtagaggcgcggtggggcgaggaaggaagcggcggcgcggagg

SEQ ID NO: 6047 - DNA, 411 bp, Zea mays
ggtatttgagctgaagggtggcatacaagtggtttttctcccctagtattaggtttctttcttgcttcattttatgtcctgaaccagctgctacttgtgctagtttttcctactgttattccttgcacttaccgttaccatttactttgtgtctaggcgtcagtggagaagaacgcgtgggaactgaaacagtacattgaggagctctactgggggtctggtaagcaggttctgctccttggtcatagcaaaggtggagttgatgcagctgcagctctttccttgtactggtctgagctcaagggtaaggttgctggcctggcgttggttcagagcccatatggtggcaccccggtcgcctccgatatccttcgagaaggccagatcgctgataaggagacaaggaggatc

SEQ ID NO: 6048 - DNA, 117 bp, Zea mays
gttcacagtccccactccacctccttctacaaatacacctcagtctcagtcccccaccacatccgctccccgccttccgcttccctaccccccgcatcacctaccaacgccgacacc

SEQ ID NO: 6049 - DNA, 434 bp, Zea mays
tactaatttccttttaaaaaaaataaaaaacactcgaaaaatagggttttctaaactagccctaaagcgctgttcattcgaaaatattccttttgtgtccaacgcgcctcgtccgtaataccaaaaaagcgaagccgtcgtgcggaataccagcatggcgacgaacatgctcccaaataattcttaccaagcaagcaycaccctccaggcgtccctccctcttcactgcttctagcatcgctgctaaaaatagtagtgaagggacacccaaacaaacgcaaccagcagcgttcacgacgacgatgcagggatatgccgagaccggggattctaccaatttgatcccctccgtctcgcgaccgccgtcctgcggtggtgctgccgctgcgtcgcgggtttgatgtcgccgctgtcaatctgattcttccgtcgca

SEQ ID NO: 6050 - DNA, 1500 bp, Zea mays
tttaccgtagacccgttgggaatggaagacacagcgtttactaccgctaccgctaccttttttttatatgcaatgattgtttgtcttaacagtctccgtacagaatttagagacgggcagagccacaagcaaagccggcagcgtccaagtttcgtgaggattttcggccggcgggctgccccacgccacggaaccgcgcgccggccggatctggatttaacagacgctaatccgcccggccgacacacacacacttgcgcctaaagaaatcgcgaccaaccagcggcgcggaggaccgtgcgggcccaggcgaagcagtggcatggttggcggatcacgcaacggatccggccgcggaatcattcgtgcgctgccgcccgcgccgtggaaaaaaaaaagaaaataaaggggacgggggtcagtgtggcgtgggggacctctggagtggagaaagagagggacagcgacggcctgcgcctgcggcgtacgtgccgcccgcccgaccccgtcaaagcaatcagcgacggggccccgtaaacgtgcgtgccggcgcggcgcccgcctatctgctgctggatggtggtatggtagtacaggtgggcggagtcagtgggcgtctctgtctctctctcgtgcgcgactcgcgaggttagtgggtcgtcgccaccgtgtctggcaccaggtcgccgccggccggggtcgttaacatctcgaacgcgtacgcgggtcgtgcctgcctgcgcacgcggcaggccggcgggcgggcgggcgtctgaactgcggacgccagctactgactcggtcgtgtcatcgtgtgattcgctggatcaccagcgggaatccactggtatcacatcacgagttcagaacagaacacggcccagcctcggaaggccatgagcaccacatgtgagagcaattgaaatgaaaggtacattcaggcttcaagacacagttgaaattggctaacccataaggagaacctgctaagaacatcgaagaccacggtgctcagctttccacagttcagccgcaaggctgacaaaacaaactggagctatcctacttatcccctctgaagctatagaggtggaacaagtcttgattgtcaaaatccccatcctctccaatattttttttttgacaaagcaaactggacatggcacatctccatatcgttcatgtcaggcagttcccaagcacccagaaagtgggacagatagtcctgcaatgcctgcaatggaactagtcgctggagcagttagtcctaaactggctgcagctaacttagttgctggacctgatgactggggcttgggggtggcactgtaatctcatcctcttcatcagttggatctacattcatgtcaatgtttcttagggaaaagccctggcactgctcattggtgtagtaacctcttttgcttcagttgcaccggagacctcatcagctatctccacttctaggccggctagcttgctagattggttctcgacgaa

SEQ ID NO: 6051 - DNA, 613 bp, Zea mays
ctctacaaaaccgatcatataatgctatttctctatgcatggttaattggttattacaaaggaagcctcgttctagaagcttagaatacttaaagtgtattttttattctaaattctacatacatatgtttttcagtcaacacaactctatctcatatgttggcaagtcaatcaactttctgagagtatgctgtgacgatagtggctaggctgatgctgctgccgaggctgctgcatatgttggcaccacaacatctcggggtggccttggttatggggagactgatgctttggaggcattggtggttgaggcagccaagaggattgatcgacatttgaggaatctgtttgaatgccttcgccaatcctgattttgtgtgtgttgagatcatgaattcatgatgtttgaagtttgattttgattggtctgtactctgtacatctagctgcaagagaaacccgtgtgtcacctgtagtcctgttttaattgtcgtatgttttccattctgactcactttggatttcattttccttgagtgcagatttgactcttggctcaggtgtcactgtgccagcgcgatcaatattagtagttcctcttcatctcgtgcaa

SEQ ID NO: 6052 - DNA, 1500 bp, Zea mays
ggcgccgcctttttatagccgtccggtggggagacgcggcacgtcgcgcgcgaggccagggcaaagccggcaagccgggccagggacgtgtgcaccgacgcggacgaattgcaaggtccctcggcgcccgtgcggcgcgacgcgtgtgcgaggaggcctcgcgggggcgacacgtacgtgcgtgtcgagcgatggcctgcgcgcattccccgggcagagatgcccctcggcgcaccatgcgtgcgcgtgcaccgtagaccccgtatttatttatccgctctggaggcggagggaaggagttgaagcacgcacgaccgcgcctggaagatggtagtgttaagaaacctttcttgggccaggaaggcctatgtggcccatatgcctgaaaccctagttttgtctataaatagagagaagatccccatatcatgtaacctttggagagcagcaccatatagtaacaaagaatcagttcctctctacactcttgtctccttgtgttctactattattcagttaagcagcccttggactacactcggtagcaaggggttcttaacacgttatcacgcacgtggctctactaaggagatcgagcaaaaggtattaagaaagatgttgaactcatattttatgtaatattattctttcctctctattcaagcacatacatgaaaagcacaaatccctagcagatttatcgccgacacgaagtcgatggggatgcacatgtgattgttactgatttgaaatcgccgacacacgtcgatcaatcacatgagatacacacgtttattttactgcatcatcgcaagcacagagaaaacaaaaacaaaagtagcaacgctagcatcagcgtcgacgtcgtcgccgtgctagcacgcgcgcaggcaagcagccaccgccgtagcttcaacctcgtcgctgccacacgcaggcacgcaagcaagcaagccttgccatcacggtgggcaggcagccaggcacgtgggcacgtagagctgctgctgcctcgtcactgccgtacacgaagcacgggcgcgcagagctgctgaggaatacaaagcgcctccgtgcattaaaaaaaaattactcgtgcagtgaatacgaagcgttgcactcgtacatctctaggcccttaatgcaaaagcagcggctcattttttcatgtaataaagaacacgcatgcaaggtggagtggcctagtgagcaacaactcatatctctatatataaaaaaaatggagcagcgcgcattctaatggtccttaatgggctgtttttttttcttaaggaaaaatagaatagaattttaatttaggcattattatgactctagaaattgatttctatgaaactaaacaatgtaatcttacataattgtgtaattaaatttgtatattgcatcattcatttaaaatatttgctttcttgcgatttttttttcatcctctgaaatgattacaagaagtaatctaactataaaatttatcacatgtag

SEQ ID NO: 6053 - DNA, 1500 bp, Zea mays
gtttagtttcatagaaatcaatttctagagtcataataatgcctaaattaaaattctattctatttttccttaagaaaaaaaaacagcccattaaggaccattagaatgcgcgctgctccattttttttatatatagagatatgagttgttgctcactaggccactccaccttgcatgcgtgttctttattacatgaaaaaatgagccgctgcttttgcattaagggcctagagatgtacgagtgcaacgcttcgtattcactgcacgagtaatttttttttaatgcacggaggcgctttgtattcctcagcagctctgcgcgcccgtgcttcgtgtacggcagtgacgaggcagcagcagctctacgtgcccacgtgcctggctgcctgcccaccgtgatggcaaggcttgcttgcttgcgtgcctgcgtgtggcagcgacgaggttgaagctacggcggtggctgcttgcctgcgcgcgtgctagcacggcgacgacgtcgacgctgatgctagcgttgctacttttgtttttgttttctctgtgcttgcgatgatgcagtaaaataaacgtgtgtatctcatgtgattgatcgacgtgtgtcggcgatttcaaatcagtaacaatcacatgtgcatccccatcgacttcgtgtcggcgataaatctgctagggatttgtgcttttcatgtatgtgcttgaatagagaggaaagaataatattacataaaatatgagttcaacatctttcttaataccttttgctcgatctccttagtagagccacgtgcgtgataacgtgttaagaaccccttgctaccgagtgtagtccaagggctgcttaactgaataatagtagaacacaaggagacaagagtgtagagaggaactgattctttgttactatatggtgctgctctccaaaggttacatgatatggggatcttctctctatttatagacaaaactagggtttcaggcatatgggccacataggccttcctggcccaagaaaggtttcttaacactaccatcttccaggcgcggtcgtgcgtgcttcaactccttccctccgcctccagagcggataaataaatacggggtctacggtgcacgcgcacgcatggtgcgccgaggggcatctctgcccggggaatgcgcgcaggccatcgctcgacacgcacgtacgtgtcgcccccgcgaggcctcctcgcacacgcgtcgcgccgcacgggcgccgagggaccttgcaattcgtccgcgtcggtgcacacgtccctggcccggcttgccggctttgccctggcctcgcgcgcgacgtgccgcgtctccccaccggacggctataaaaaggcggcgccacctgatcctccatctcacacaagcaaagcagcagcaacagccaacacctaaactaaagaacagtagtagtccctgtgtacgtctagcaacgatccgcaccgagctcgccagttttgctcgttagtttggggacggcg

SEQ ID NO: 6054 - DNA, 1280 bp, Zea mays
tttgctatgcatgagtttatctctcttcgacatcaactgcattgtaccaaaacaggcatcaatgcactactttgcctttgcatgattaattatctcggttagtggcacaaaagtaaccatcttaaaccttagtttttcctctccagagcttgttcggttagaggtggatttgggagaggggaattgaaggggattaaatccccttttatacaaatttgtataggagatgatttaatcacctccaaatctcctcgattcacctcaaaccaaacaagcccttatagcacgactacttattataaagctgattacacaatctatcgtgtcttaatcaataaaataaaataccttagcttatacatttatcttgagctttgcattttgtttttctcctttcatgccgagcacttgttcatcttgtggctatatcatcatctttttgtatgtgcatgctcaacctttgacttaaaactatcttgttgtgtcgttcatcatcaataagtaaaatatagtttattggttgtctcaattattagaactatacatagaactttcatccatccttggacaaaatgatttgagttcacttataaattatcacatattaattataatgtttataattcaggtgaatagtgtcatagattcacaagaaaaacgttccaggttcaaataagcgttccggaatgaagtgaaaaaggtctctagctacagacctaaagcgctacaaaaaaatgttctgccacattataatattaaaaatatatatttttttttattttcagtgctgtagtgaataatactatcgttccacttatttgtcggtagtgcctcgtggagaggataaataagaaatcagaaagaataaaaaaacagaagagaggaacaaagaaacaaccccggattggtaaaacgggttggcaaaagaaacgggtgatgataaagaacagcccaggaaaacggtccaggggttcctggcttgggccgaacaaccccgtattgggctaccgctgcagcggttcattttcaccacgcgtgcgctctctctgtctgcgacgactgggctacgccgccgccgccgtcctccgtctggtgccgaggtcttcgttggacccttcgcccgcgactagcgtccgccaggtgccaggttttcccgctcgcaccatctctcttccattcctgatgtgcgaaactgagcacccaaaaccttaattaaccggctgtacatgtgtatacccatgtcctttaccgatcctatccctgaccataggctgaaggcg

SEQ ID NO: 6055 - DNA, 1500 bp, Zea mays
atttgctgccgtgaatgtcgccttcgccctcgctcttctccctaaccccgacaagaggaagtcagtccatgtcggatatgaatgatggagctgcggcaaggcgaagggcggagagctcacatggctcctactgctattggaagcgagttgttgctggtgcaccatgcgcgcaagatgttcgatcaaatgcctaaataaatatttggaatacatattttagtataatatactcgagtttccagtaatgtgctggaatgcagattttagtataagcttcatttttcaataatgtgctacacatgtacacatgattgctccttcttcacactgacaccattattatatattttccttgatgcataacctactggaagtttgcaactgatttagtgccggagtgcatattttagtacatgctccagtttccaataatgtgctatagatttacacatgactactcctcacattgagagatagagaggagatagggttttttttgtcaaccataccatcattgttcaatgcctctgattaaaatgtgcctagcaattgaaactttcgatacattggagctcagagctactggtagtgcctgttgtataatatgctactgaatgagtggatgtacaatcagtaatttcgtttgacataccacatgctttgctttgtagatcatgatgcagatgtagtgtatataaacaaagttggttgtttaacagatcttgtatttacggtctatgcccacaaagttacagtttcaggttatggcagtgcatatgtcaaatatcagaacacaatggtgacttgctctcgcgtaaaggctcctgagagcgagcgatcaacgagtcgtcctgctgtcgctgctcgctcgagggaaagaagatcacacagatgtaaaatgagagctcgaaaagaagccgacgtctagcagtgaaagaagcagtagccactcccaccattctccttacgttattccgtatttctctttgtttatgatcgttcacacaaatacttactatatatatatatacacaattcgtataacaaataacatkgacacagtctaattctctgaaatcactccattctacacactatcatttactccatgtgcacaattcatatgtaacagataatattagtacgatgagattgaagaaaattacaacaacatattgttccataacagattgtaacataaattattcttatcataaatgataacattcgttgttattaaatctaaactatcttctgcactatgttaaaattcgattgcccaacaaaatctattgcttccttttctagctatccatctttcgatacatataactaatagacacagttatagataatactacttcacactttcatttacatttaacaattaccattatcttcttgccagttctttatgaataatttttacatatacaacatgatgcaatacttgacgacaagggaaaaggttcaacaactacaattgattctccacccaaa

SEQ ID NO: 6056 - DNA, 1500 bp, Zea mays
caagctaggccaacatgccctaaaactttgcagtgccttctagtctaggccagcacgaggcttcgtcaggcaaaggacgtcgccacgtcggaaacgtagtgtgctgccctaacctgccttgtaggtaacgaagacccaaacctgctagttggaattagtagctatcgcaggtcgctcttgatgtaatctgctggaccgtactaaggttttctcgacagaatatatgggcggagaatatttttttcccacacacaacggtacgtgtagtataaattgtcggctacgcgtgataggaaaatggcaggtctcagttaatgaatccattagcaaattgatggcgacgtttgttttgttggcaggggacccgaccttgaccttgttaatgattttagccagactttagaatttgcaacccctcctcaccccgtttccagctagctagctagatcgcaggcgaaaagtccgcacctgaacacacatcggtggcaaagcatggtaacgctggcacgtacgcggcgctggagtcggcgatgcggcggggcaaggaagcaactcccgcgagtagtagcaattacactggcaaacaactacgccagctaaacgtattagcggcggctaggctagtaggcaggctagggcgctaggccaggccagccgccgacgccaccaactcggcgacgacgacgacgacggctccagcgtggtctaccgatgcggtgcgcgcggacgacgtactcacgtaccaccagaccacgccgtctccgttcgttacgttttcgcccgagccgagagcgacagggaggacgcccacccaagtgggggaaggtggcagcacaacacagcgctgatctctcgccctcataccaaaaaaaaaaaaacacacagagatggtatggagaacaaggaaggctggcgttgattattattatagtccattggcaacgagactagaaagggtcatgcagcagctgtcatcccattcccacacccggaaccctctcttccagcgcagcgcgcggccacggccgtcgtcggccccccatctcttttgcttgcctgccgtctcctccctccctagtccctcctaccatatcctgctccacctctcccgagtggagtccttcctgactcctgagacctgaggtggaggaacatggaagtggagaagccgcatactaggaaacccaaggggagggagttgtgaggtagagggacatggaagtggtggtgacaagtatactaggaacgccaaggggagggagctaggaggaaccgcaggaggtccggactttctacgacacaagcagacggctaggccggaaccgccagcaaggatccaggagtccgggtccgcttttctcgtcccgcccgcaaagatcgatcggaacaactagcctagccctaggccctagcccagagccctgccctgcgcaccaaagcggaggggagagacgggagactagagagagcaaatacggtacggtgcttgcgttgcggcgg

SEQ ID NO: 6057 - DNA, 1282 bp, Zea mays
cctgcagagaaatcgggggtggcaatgcccacgttgaacacaacacgcaccaaacaaataaatgaacgaacgctacaccgcgatcagtacagaacagtgcagagcagagcaggcgtatgcatgcatgcatatattacggagaggggagcactgcttgcgagaacagttgttctgcctgtgcaaggaggtctcaccatgtgccctccgctgggctgtggttttgactgaccagacgggctctcgttttctttcagcataggatggcttagtaaaccattatcttttctatgttttaataaaaaaaaattccattccttaaaaaaaaggaaaaacaatctgtcctgcactgtatttggtctgctaggaataacagataaagaggttcctttaagtgagcattgtgtagattagcacagtgccagatgattcaaagctgtcctggctagccagcgcttgaacctactccatttggtgtgttgcattattgtgtgcgcgctgtaatgcactaaacagttgtgcagaaaatagcatgcatattgttctcctgtgtgtgtgtgagagagagaagaccaataccatcatataagctggcttatttgaaaaagcaacctaatgatatatgattatcacataatgaaaaagaggaaaggctccaattgaaaaataagagtctagctagctaggagatccggtaaatacatattgggacttgggagtcaatattgaaacaacgaacgaatgtaagaaactctactactctgaaacgaatcgatcggatatgggggacgagctagagaaggaaaagctgcatcagcacaaagctttccatgcatgccgcggaatcaagcatctattcctccagcggttgacagtcgacgggtcaaagtctaaaaaagactacagggagagtagcagtattgggtagtatatgccgcccaacattttgtaaagccatgcatcggttttcactagaaaagaaaggcgtctggattcccgatcgattctccagcgatgtaatctccacccctttacacctcgctgtcgctggagcgatgcagcataccaccaccaatggcgtgctcccggtcaatgcaacttgatcttcctcagcaagcaaattaaaggggggaaatgggcagcagcagccccactccacgcatgcatcttgtatagttgtatcattgtatgggagatggttataccggcacttcaccgagatgctaagtaaagaaatcgccagccagatttcattgctatcctcgacttttgcgaggtggtgggg

SEQ ID NO: 6058 - DNA, 1080 bp, Zea mays
ctttacagatacattcttaatattatctaacaacctatgctgtcaaatttgtgaaactgcatgatgttgtaagcgaatctgcgctgatagaattagtccttggctaaatgctctctatgttctgtttagttatccaccgtctctatgattcttctttccactgatgacacgactaatgactatttgttcttgtgatgacatcttgtaactgkcatcacagtgtagttgaaatcacctttctgactatgcagtgtagggttacctttctgattggaagacaaagaaggcttgcagctattttttctttgttcccatttgtgaagctgtcgctggaggcgagatgarctcatgttactggtattttaactgctccagaacagttccaacctgtgatctacttaacctgyatgccttgaagagttttggagaccaagcaaacaagcacagatccaagatattcaacaacaggtaagcattatttttccatcaaaggtgcaatgtttacactgctcacaggtcacgtcacaagctacaaagaatttttagcgactaagaaattgcatgctaaagctggagtatctaacatcaagccaatatacacaggctgacaaacatttattattaagcattccccttcgtaaacatatagctaataaacacgcgtagcagttctccacaccgtcactacatatgcttgtggtcctatctacctgctggacatggctgctgcaacctagatcgttgcacaaggtaaggttgaaggtgctcgcatacgatgatatcttcatcatgtactcactccataagcaagcagtacaagtagcactgcatatttttttcttctctgatgcgctattgccctgctcaaaacttgcatgaagtgcccagccgctgcttcatcctttgacctgctgctgcccttgcgctctcgtgcagtgcctctttcagcagctcctggaatttttcgaggaatacatcccactcatctgcactcatatccgacagcctgacaaaacacatacttgatggaagttgttcatcggcactcctgttcattgcactttttgaggcattgccact

SEQ ID NO: 6059 - DNA, 1207 bp, Zea mays
tttcttgacttgtcggtcggcggtcaccagcacagacacaatcgactcacggggacctgtgctatctattgactggcaaaggttcgctcgcgcctctcgaccacacacgcctacacagaactgcgagctcggtgaaccgtggctacttatacacgcggggcgtcggcggagctcctgataaacaatggtggggctgggccggtggagtgaagttgacacgaggaaggagcccggaagcaaaggcactcgtagttaaattaaaaaagaattcagatggatgcacagcagacctgatcgattgcctcggccggtaccgtggctggggatccgtgatcgacgaggctggatttatgacaaatcatgaaagacaaagcaagtgctgcctgcagatcatcctgtcggcgctggccgtactgcccattagctgtttctcccggtcccagctcgcccgagcgtgtgtgtacgtgctacctgcttgctggtctggtacacgagcatatttctcgccgtcgttactcgttacgacgcctggcgtgcctggtgaagaaccggctctatttttaatcgcttccatgccggctcgaaatgcaataggttaagagataaacaaacaacatggattactcagcattatactatatctgttttcgtatattttatcgatcgttagtttatttttaaaataaaacgcgataaataaaaaagaacggtgagagtataatctaggtgtctaaattataataattcataagctgatcattagatgcttatataattcgtaatctagattatataatcatagaagtaaacgtagtttacaacggcagttagcaatgatgtttgtttgtttgttcacacgtccaagctctgccggcgggcgacagtcagtagtggcattgtcgttctaaacaaccggtgctcggagagcaaaggctcgtactgcaggatcctttctgcatatgattgattagtccgtatcgtcctagctgggatggatgccccgatccaccaattctgttgcggatttgttcgctctgtggttccggtggtagcagatgtagttttttccctcaaattttgttcgagttgttaatcctgcacctgattcttgcacgtgctggggcggggtggcggcggatcgatgatagattcgtgcgatccttttggctcatgttgaggtgtatatgtcgtgcaggaacatccgggg

SEQ ID NO: 6060 - DNA, 966 bp, Zea mays
ctccaagagcggattttcagaaaaaacttgatcgactccaaatagggccttaattggcacgatttaagtgtatggattcttgaataaaacatatactgcattccgcagatgctcacgtaataaaatgtatgtcattgctgacagcaaattcatgcactcgacgggaagcttaagtcatcgatgacgtgcgagacgaagaaaacgatcaagccaagtgacaatcgggcaccgcaggtgtagagaaatcgacaaaaacaaggagaagtgtctctcgtgggtgtggtgccgtagttttttcaacttgttgtgcagataccgacagggccagatattggcccatgaccacccgggccatgatccggatatagcctttttttttaaaaaaaaatctccttgaaaatattgaaaagctatataattaatctatctcgttctaacaatatttatatagtgtttattctaaaactcgatttacattatcatggttacatgtttcaaaatatgtctttattattttttattaggctctatctctagattttaaaatgatkgatgtaaataaataaagatattgctttacaatgatatttttttatgtatgttatctatcttacatkgttatataactgttaaactatatttttagtgtttttttatcccaagttgatctagggctttagtgttccgctactagatgtctacaactctagatcccagccggagctcattttttttggaccgaatttaatagaaatagttggccacttgggctttgcttcagcatctgacgaggattatgtcgttgagacgctgaagcatgaggacggtctcaccctctatataaagagagagacctgcactctcgtacttcccaagaagaacatcgccattgcagcaagtctgtatgatctgtgacagctgtcgatagaattatcacacacattcgttattcgttgaactacaacc

SEQ ID NO: 6061 - DNA, 1500 bp, Zea mays
ttggagcacactatatgatgtggaattttaatccgctgtgcttttacatttgcgtacatatatgatctgtgcttctcctgtctgtagaataactgtatacatgctaggagcaaacttgttagaatctctgtttgttttgtcatttaatcaccaaaacccttagttaggggttgattgcacttacaactcggctaaagctccgtctccgttaccggccgctgtgacggcgacttttctttgacgagtgcccgataaaaattaatcggcaaagaagccgttgtcgatgtatagttctccgagacttcttcgccgagtatcggcaaaaccttcgtcaagtgttttctaggctttaccgagtgctttagacactcggcaaagagtctgtttccgatagtgatcgatgctatccaatccatcaaacgggagattcatcgtatttaccaatccagtcaaagcagcatgatgagctccctgctcccacacgtgtcgacggatgagctgatcatccatggtgagaactgagaacacatgttgttgatcagtcttttttttccctcacaaatgttcttgcatgcctatgggtggtggagcactggagcttgagccttcatcttgaggctcgttcgagatagcaacgatgtagctacttcctcaagtacaccaagttgctgcaatgccgatagtatcactggggatgactgtgaccgcgagccaatgaagatgacaagcggcgagaggacatcatatacggcatggcgtgaagcacagcagctactacgtacgatcgattgatgaaggactgtcgtcaatggagtcgacgccgatcggtggcaagcgacgggcgcatcatagcctggtgttcacttttcttttctcttgtcggaactgttgctcgaattccaagtcatgcgtcatgtctagttcagagcaacagcaacctactattgtcagatcaacaacagtttctctgttctgatcaactggagtactagctagtattttgctgtgatctgaatcctttgacagctctgcgttcctctgcgactgtgtttatgcttcgattatcatctagctgttcagtgtaacttcagatcgacaacagcagcggctcgtgtccatctcctctgcctcaagtaagcagtgcaacagcagattgggcggctagtagccacattatcagttgtcacatagtgacataactacgtaagtgatcggactgatctacagatggtttaccaattgcattacccaacgtctttgtgcagttgtgctttatacctgcgtatcataagctaggagaacatgttgcacatagtcaatataaaccagaaccgataatcgacttagctcatgtttagatactctcgtattcacttcaatacatgttacatgtgtattaaggtggtgcacctctttatctccctatatatctgacattccatgagccaatagctactgcaacaaacgacctcatcaagtcagtttctaggggcgaccgga

SEQ ID NO: 6062 - DNA, 253 bp, Zea mays
tcaataaaaaaatcttgagatcttttttgtggatagtttacatgggtattattgcgagccataacaacgcatggacaactgattagtaactaataattgcttacatattagtcattgcccatataaatataaatggagttctttgtgtcaaatgaacgctagctgaaccctagccggcggatctccgcgggcggcagtcaggagtggaggcgtggtcgcacgggcgaggtcgcaataggagaggctcagagag

SEQ ID NO: 6063 - DNA, 443 bp, Zea mays
tttccacctcaatccactccaatcacaaaggggatttgaggttcccaaagtagccttaagagacgtatcttggtgaaaaaacgtctctagcacggttctctaagtctagatacggttccacccatacaacctatctctactaactattaagggggcagtgtagactgcccccgctcccgcaacgcccgcgcgccagctcccgcacgcgccgccagcccgcacgcgcgcgccgcggattcggtacgaccgccgcggatttcgctcccacgcagccagccatggcgcggctcggccgcctccctacgcccgcggaacaaccgcgccaacaaccgcaacgctcgcgctccagcacgaccgccgcggattccgcagatccacctccatccgcgtcactcaccagtctcctcacctaatcccactccgccgccgccagcttgcccacc

SEQ ID NO: 6064 - DNA, 1500 bp, Zea mays
gcgctcctcgtcgtcgtcgtcgtggtgtaataaacgagtgaacgactcgctctcagtcctcccccctcgtactagtacgttactgtccaaggacgaacgctctgctcatcacaacacacgtgtgtgccgcttgcgagccgcgtggatggcaaaacaaaagtgtgttaattgcgtacgtcacatatactacacacacacagtactccacgataagatgcgcgtgtggggggtcgtttacaagttttaaattttaaacctgcgtttgcacgcgaaagctgtggatgagattggattggattggatcaccaacacgaattgaggtgtgacgaagtcccttttgcgataaaccgagctcctttttttttatatatggttcttttttaaatatctttttctatatggttggcgtaagagagagccctagccacacacaagaaacgtggtggccgtggccccctatgattgttgagtggtttggttcaagcatgcacgcaacgtttccaaccatggtaaacaccgacaatgaaaaagatgggtcaaacaagaatcgagacaactcctgcgctgcgctaggactgtgtattgagcaacgtaaaactatagacgacactaactgtttgcaaaataaagtttaaaataaaagatgaaataggaaatgagataggtgatctgctctagataaagtcctgtctagatccaactaacatcatatctaaacgttccaaataatattcctcaaaacaaatgaactatctatattataaaaaatggttttctccgtgcttaaaatctcacttttaatataaataaaaaaatcaaatgatccttgtatcattattgcagccaacatccagccacacccacaggccacagcctcccccagcaaggccgtggccgcaccgtccgcactagagatggcaacgggtacaaacccgccgggttttgctatcccaaactcgtacccgtgaaaaatatttacacccattaaaaaacccgtacccatgacgggtttgaaattttgcccaaacccgtacccatcgggtttgcgggtacccacgggttacccgcgggtttttatctccaatatgcttattctttttataatcaataagtatcgtaatgattaatgagatcatggtccaaaatttatgtaatgaacaacgagttcatgatttggtataaaaaatattagtagagagaattaaatacaaataataagttgtataatcaagttaccttgcactaagttatacatccaccacatatataacgctagtaataactataatagcaagcaagcaacactatcaccaactacttatacattcactatttgataaaaattaggaagtaaataggtagataacaagtttgttgttcgtttataaaataaaatgacaatatgcactaggtttggtcgggtttaaaaaactcacaggttcacgggtttgggtactataggaacaaacccgtacccataaacccgtcgggtatagattt

SEQ ID NO: 6065 - DNA, 1500 bp, Zea mays
gaagagagtaaatactcgatacatagatcctctagcaaacaacctttagagacttgggagtctcctccctctcttgcctgcttgtaacccctactacgagcatggagcacaaaaggtgacggtagcgtgagacaccgaagactagatgtagggacgttctgctcgaaccagtataaaccttgcgctcactgagcacaccatccgaaccccagaacacgtacaaacaaatttacttgttgaagatggttcaaaacaccgacacataataaacaaaatatccaaataatattttttaaaagaaattacttgagaactttaggttctcttgatttacagtagtttattagggcatgtacaacatagagcctttggatcgattttctaggtacaagtgacaactaagagactgtatgataatacgttgagcctctagattattaatacatttaagagacaattgtatagaaaattgtgatgatactgactactctcgaagagcttcacttatccccatagaaattcctcaagaaacacctcaatcaatagggttatacatgcccttaggtcatgtacaaccacattaattgagacatatcttggtaggtcttcaaggctattcactatggtggttttatgatgatttaatgcatatttaatagtgtgcacatcagattctttgatgacatgatataatatttaagagaattgagttttatggggtggaatcatgtcaactcgtttctaaggtcttgtaaaccatgtgaaacctctattaagagtgatttgttccatcttcacatattttactaacttatatcagtcattgaattacaatatttaattagtatgtttgcctataaaatagtgaagtgaaatattgtattaagagacattattccatacataattttatagcatttttgatgatgtggtagcgttgaaaagagtgatacaaaattactattgaaaataatctaggaagttaagtgtaaaaaaatcaaaagagatggtgctttattttacgactttttataattatgtattttaactgtatttatgattaagggctcaagtttgtatcacgctttgtctctggaaatatgttttcctgagccacgtacagttattatatataagtgtgcgtagtttgaggctgggtggcagtagaatttatgaccaaaacgagtggtaaattttgatctggctcctatagggaaggaccaggaccgggtttgatccgatcagacggaccccgtgttggaaggcggaagcatataggaataggaacgcgagctggactcgagactcgagcggggcaaacggatcctatcgcctgtcgcgtccttgtcatcgtcgtgtgggcggtataaataccctgcaacacccaccaggccacacycaaccccaccttcattgattgattacagcccgttcatccttccttcccccgtcgaatcccaccttccttccccygcccgttaagcagccgagtcagcagca

SEQ ID NO: 6066 - DNA, 148 bp, Zea mays
tggcgaagggacctgatcagaaaacaggcagacattctaagcccggtgaccgcctgaagcccactctataaaccctgacccaggtcaccatggcctataactgtttcagcgattctcgcggctttttgcctgcccccctgcaacggag

SEQ ID NO: 6067 - DNA, 930 bp, Zea mays
gtttgaaacaactaagaattcagcttcagcaaataaagaaacaaagaaactagtctgaaaatgagtattagtcccgtttggatcctctaataatcgtaatttagacacagatcaattaaactaatatgattttatgtggaatatatttagatactattattggccataaaagggagatatttatgttgttagccatatgtggagatatttatatgctattttttactataggaaagcgagtcaaagaacatgttataaattacaaattctagagtacaaacgtagtctatagaatcaatttccatctctcatcccataaatctgaaatttggaaatttggaatgttaaatttcaaaycaaatagcctaccctattaaattaaatagattcttattactccaaaatgaacggatccaaacggccccttagtgttttgctcttcataggctctacttgatactctgttctgaaatgaaaagattataaaaatattttgttttaacttttaaactataaacaatatatacgagataaagcatatgacatacaaggcactggagaatgtagttgctgaagttgtgatttgggtttgttctcagcttatctcagtgccggtgactgataattgatgcattgctgttctaagcatggtattgttgagtttgatgcttctcgctggtacattttactttcatgctgttgctgctttgatgtttccttttaataaaatttatttttatggttcatgtgaacatgaagtgttttttgtttccaatagtgaaggagatagagaagtgaattcttgatccagacaattacttgccctttaacttgaaatatgaaatattctgaagaaactacgtgcatcctcagatgctgaagcaagcctattgatctcaaataacaacgtgttttcagtttgcctatgaa

SEQ ID NO: 6068 - DNA, 488 bp, Zea mays
ggtttgatcagtttcactaggaactgttcactaattgactgtctcagtaatacaattgaatagcctgcaactcagttagccatgactttcttcgtcatagtttctttagctgaattattttgcacatattacatggatgtgcactacccatgttgttcaatatcccacatcaatatcgaattgagtatgatgactgatgacaactaccagttattgtttcttgaattggcaacaacttggtctgtgagtcattcccactttgcccctacccttgctgagtagtgtcattcttttaggcataccttatagatgaatgattttttacattactgccttccccagtccccatcccaccccatttttttgtatcttggaaaatgtgacttggacaataagatgttgcttcagttacttacatttcttaaaagtattgactagtctttcatctggatgcaggagctctgcagtaaaggaagtgtgtagtcacc

SEQ ID NO: 6069 - DNA, 221 bp, Zea mays
ctgatcatggctgattggtcgtcctcgtccccggcttgtcgttgagcagaccactcgtgactcgtggcctcgtggtgttgcagaaaccagccctttttttcctgtcagcaactacccactggccactgcactagccgactgcggagccgagtgttcctttctagccttcacttctcagcacggcagccttcgatcccccgactgcagccgccagccgcgcc

SEQ ID NO: 6070 - DNA, 667 bp, Zea mays
tgactggatgtaggaacgttcctggacaaacaaatataaatcttgcgccttccgcgcacactctccgaagcccggaacgtgcaaaataaatttatttgtcggagcgaggtatgaaacaccgacacatatatctaaaaattgttagatctgatagttagttgctaaaatcagaaagatatattcatagtcaagttaatagttgaggtgcttttagccaaagacatccaaatacccaccgctaatagtctagctaacctataactgcctcatgtttggaaccacccagtttttaaggaactggtttatagaaactgaggtgattctaaatgtatcagtttatagaaattgaattcatagtttcttaaaaacaaagaagctagtctcacatagtaaaaaataaaaactggtttttaaaaactgagttacttccaaacaagactttattagctgatttaatcaagctaaaaccatcaggtatagttagcgagctaatttgatttttaagacatctaaatattagctctactgcgttcaaatatttgtttgctaatagcaagggaactgctccgaaatccgaattcaagagtccccgagtcgacaggccacaaatcccaattccaaaaccttttctccgtcccatcgccggcgatcttctccttcgccgcca

SEQ ID NO: 6071 - DNA, 577 bp, Zea mays
agggtgatttgtgtttcatttgttgttcttgttgtttggttgctttcttcatccctctctaaactctctaagtgttttgtaaagcaagcaatagacacctaaattgtgtggtgatccctgcggggtctaactgacctgagagattaagaagaagcattcaaccagtctaagtgaccatcgattgagagagggaaatggttgaaatagacccatcctttgtgtcctcctcaacggggagtaggttcttggaaaccgaaccatgggaaataaatcacagtgtccatttgtgttgatccaccattcgatttgttccttccctctcccgtctctctaaaagttctcttactcacattgttttgagtttgctttcaaagttattctcattgattgagcaactcatagcaagaagaactatcttccgcactccgaattcattgttatttatttctaccctaaccctgggtgaagtgtatgttcaaagtttataatttttaggttttgcctattcacccccttttaggcgactttcaattgttataaaaggcaatacttcattagagtctaacaactcaaagtg

SEQ ID NO: 6072 - DNA, 1050 bp, Zea mays
gggaatgcagatatagtttctaatcacctagtaaaaggtgaaaaatatcagaaatcgtttctaagggaatgcagagctagtaaaggtaaaaatctttgaagttgtttctaaaggaatacaaagcatgactacgaagagtatcgcctttgtaacgcgtaaaaaggaagaggatgcgtttttcgccttcggctcaaaaaacacgcaagactcaagtttcacacaccataaaggcaaaaaaatcagtaaaccaaagcgaggatactttactttacaatacagaccaaaaggcttcgagtgttcatgctctttgcattacaaaaatattacaatgcaagaagtttttcaaatgatcactgtcgttcgttaaaatatcatcgtcgttcttgtctgccatcttattacgtctttccattttagccaaagttttatactctaaaggctagtttaggagtcaaaaaaccgaaggaaattggagggtccctctattattcaaaatttaataatgagagaattttattctcttcaatgctccgattttatgactcccaaattagctctaaactcactcttcctatgggtccaccacgcactgctataacaatttcttttagtggtaggcgggcctgtacggaatggaaattccttgagccaatgaagagtccggacaccggataatccaatgatatcggcgtacacgtgttaccctagcagaaactcaacaggaaaaaaaagttgcatctgcaggagccaggacggtgcgttctctgcacgggcagcacggcccaactgcttatccagacatgtccaagtgtagcgctcccataggcgcctcggcgagcggcgaatctgtttcatccgctgcaagtgatccacaccaggcgcgcccccacaacaatccgcggcgtctctctccgcgcctccgctccacagaaccagctggggctagcccgccgcgcagcgcagccacaaattaaacggagcccggcctgggcatccattattcgttgcagtagtcgcagctgacggacgactgaaccaccgacagacaac

SEQ ID NO: 6073 - DNA, 277 bp, Zea mays
gaggattaaatatggagaaaggggaaggaaatgtagatgatagattttttttttcagaggagagtgtagagtactcaaaaccggaagcgactccggtagtcggtctcggtcagtccactccactccactccactccaccacgcctgacccgcccactctaccttcttccctcttcagtctcctcgcgccaacgaccacatcccaccgaacaccgatcaaggtaaacctgttcgctgctccgccagaagccgaggtcgagctgttcacggcagcgagc

SEQ ID NO: 6074 - DNA, 925 bp, Zea mays
ctgtcgggcattgaggtcacaagctgcaaccaacctcaggaattctctgtttttttcttttgacccgcgacccccagtctgctgaggtcctcgttgacatgcgagaattgtttttcttgttttctctttgttttccctgatggaaagtttctctgcattttttcgcattaaaggctagttttgcaaccttttcaattttccaagagaaagtcaactaatttcccttaataaaaaaatcctttgaaaaaaaatgaaaaacccttagcaagagtgtctaaaaagaaaggtaatctatacattattgagttgtgtcctataaaattaagattctagtgacgtcttgaatgtctagctttaggtatacgtatacgaatatagatcgatgatatccaaaaccatttcggattttagttgccatggatcgaattcgaagaaaccgacgagtaataaccgtatcatctacgagacgaggtacaactctcgtcgaaaccggaacaaaaacacacaaaatgactagttatattttatattgtagttaaaaaaatataaaacaaatacatgggcgtttttacgtaaatggataatgagaatttaagaacctttttcataaaaaacacaaaaaaaattttaaaaaatggagacagaaaaaaagagaaaccgaacgcccgataatacccttctcccctagtaccaaataccaacgcattcactcatcactcacctttgcacacctcactgctgaggagctcgtcttccttcccgttcttttataaggccccggccccgggctgcggcgccgctcgcctctcctcccttcccttcccgtaccgtgtcactctcctcccaggttcgtcgtgcggagggccaaagcttcgaggaagcaaaccctagcgctgttggagtagtagcctacgccctacggccg

SEQ ID NO: 6075 - DNA, 684 bp, Zea mays
ttactaccgattgcaaccgaaccggatcgcgcgctacgaagccttcagaacaaggaaccaaaaccacgcgagccaggcacttcctctactcctccctgcagcacggcgtgcatctacacgagccggcggggcggcgggcggatctatctccaaaccctagccgtacgtgcaacagggcgacggcaaactagcggacgcagcagcgggaacgggaatgctccggccgcgcggtgaccgggcgaacaggaactgctcccctccttccccctctactacctgttgactcgccggtctccgctgctgagtacggcggtggaggcaactggagctcactcgcggagggtatgcgaaggcggagcgtgccgcttgcctagttcgccacgcctggaactggaagtctggacggaggcgcggcggtcacccacctctctcgctcttcttcagtcccttcccactcgttcccctcccctgcgagcgattccattgccactccgctttattattgctctttccgtcaggctcactgggcctttgggccaacgaggcccatgtggtaactccacaaatgctcatttcgctaaaaccattggttcgtcgtatcgaaggagtggaccagcggagtgtttgcccaattgccccgcgccgccgcccccgcagcagagtagcagaccagcggtggatgtg

SEQ ID NO: 6076 - DNA, 333 bp, Zea mays
gagtatagggcaaaaagagaacatactcacacccaccatacttgatggatataccaaccacccaaataaaatacctttggctatcaaaaattgtcatatccatctaatagggcttttatttatccatcggatatccgggttttggcccgttgccagcccttgtcagtccactactagtgtcttacaggccgttcaatcttgcggcccattcaatttatgggccttgtggctgtgttggcgtcttggcgaccggctcattcaaatcccctgggcttcggtggagttggccaccgggcagagcagaggggtgccggtgtccggactccggagaga

SEQ ID NO: 6077 - DNA, 429 bp, Zea mays
ctccgggtccacttggatagatgtgaacgtgtcagtatgtactctccagaaaatcgagcttccattgctttagagaggcagatgcatatataattcttgaaacgccgcgctgtttctcaacgtaggtagcctctgtcaacgcgatacagcagtaaacatgagtacaacgtgagctcagagccgtccatggcgtacgagggcacgtcggtaaaatctcaacgtcccgtcccgtgcctgcctgccatttcgattagttagaggagctgcgcctgcgtctgcctgcccccttgaactccccaagagccaagaaccagcgcagcagcgcgccccctccccgccccacaataaaacagccacacgctcgccacccatggccaccaccaccaccaccaccacagcacaggcccactgccaccgctaccgctaacc

SEQ ID NO: 6078 - DNA, 1500 bp, Zea mays
ggaacgggggacaaagccacaaaggcaaaggctgcgcatgtcgcgagggggtgccgggtgggactttgggagagtgggtggacgcgcgaaatactacgccccccgagccagcagcgggcgcgagcactggaacgcacagaccagcagtgcaagtagactgatgatgatgcagatgagctctgctctgcaccggttcgcagtgcgcgcggggggccgcgaacagaacgacacggagatgccgagcgagacgaaagaaagctggtccacgctcgttatcacaaaacgtgaagtcacctaccacgtcgtcggtgatggtgaggccatgctcgttatcacaagcgtgaacgcacctgcctgcacgcgcgcagctgcagcgcgtcacgagtgcattcattccaaaccattggactcactcccatggggtgggacttgtgacatcccacccgtatatattcttgttaataattgaacaatgatatcacgatccagcggcactcggtgtggtactgttttccgcccctctccctttccgagcaaaggatccttcttcattctgttggaccgtcgactgtactagtgtaaaagtgtactacgtttgattggtgtttaaagaactgtcgtttaaagaccaaaaaaatgtatttaattctctctttcttattcgtatcgatgtacatgtgtctagagagaatatgtcttatattgtggggataagaacaataggtggttacgtcttatattataggacggatggagtaatatctaaatgataggtgacggactgtttgtcgtttaacgcttaattagaagaagacaaaacatggctactgagtatatgtttgtttggtaaggtttctcttcgatttcatctttaacttttttacagaagccctactaaatattttgtagtgggggggggggggggaatagtttttcaacaaaaaaaagaaagaaagagtccatggaatgccaaatatccccttatcacgagagtggctgggtcaaaagccagaaagaaaaataaaaaacaaacacaaagagccctaaaaaaccatgtcataaaagctctaaaaagtagagcgcctcatcaaagtacaggctagaaaagaaaaactgaacgaaagtgagcaaccatttttctaatcacaccctcatccttccttcccttcccgctaccctacccggcccctgtctcaggtttcgcgtactaatcgcgtcctagtcacttctttccgaaaatgcccctgcctgttctgcacgccggttcatacaaaaagggcctcacggcacacagcatatttgctcttgctcactcgcccggtcgcccctcctcttccactcctcgctcgcagtcgcagcaagccgggaacaacacgagcagggggaggggaagaagaggagacctaccataccatagattcggagccagatactcaatcagtatcctgtaccattaccaccaggcgcgcaccaggttaccaaaatctcgtgtggagggaa

SEQ ID NO: 6079 - DNA, 1500 bp, Zea mays
aagataacatacgaatagaggatcatgaatcgttaccaccgatgtttagcgcggcagaagaagatagcacaacgatatagtggaagcagtcggcacttcctcgtgtaccagcagcagcgacacatttacccatgctctcatgttcattgttgatcaacactgcaacaatattagtagcatatctatggtatccatccgtaaacgctacccgctggtgtgttagcatcgcgtagaaaaagagtagaaaaagaggcgatgacagctaggagtctctctcttgtagcatgtcggtctccttcgtatataaacccttgctaatggactatttagtccattgacattctcatgatcattattgcttcttacacctatatagtcaacaatcgtcaaagtatttcttacaattttcaccagctgcgaccatctcttagtgtgtataattcattttttccctccttttctccacacattggcatctatctttgcttaaacaaatgtgtgaatcacacatacggttcttgctactaccaggtgccttactttgtgagacagacttgcagtagttggctggcatacacatacaaataaaaacatcttcagtcatccagtgagcttcctcaaaacaaaacaaaaatggggaggatggtgaatgttgggaggtagggcaaattggtctcatttgtccgtctgcaaatctcagatgaccaagcaaagcaatcccaacgacacatgtgcaaggatgaataaagagcacatatatgactcggagaagaagggctgcccaaaacgctagctgtggggggcctggaatggcatgggtccctcagggcagcaggagacagaagagaaagggacatggtgagtgagagggtggcttgtctcatcctgtggctgtggccatcctccatgcccaggccctctaaaaccccaccctgtaccgccttcgcttgaaccctttcttccttctcatccggcaagccccaaccagatccaattcccccccatacaatatcttttctctctcatcctccaaaggaccaagaagtaccatttctgctatctccattcgtctccaatcccaacacagcttctcaattcagttcagggaattctcccttttcttttgttttgctctagtgctcttggctgtttactccgcttcttatcctcttctctccacagaagaggagtgcatgtgcagcagctgtaaagacagtatttttttttcacctcatcttctcccaaggtgttgttggtgccccaggtggaggcaactgccaaagtgtttgggtttcttgaatgttaggcttttttggggaggaggaaagggcttgatcgattaggttgttcagccattcttgccccagtgttcttggattcatggtcgtggaattaatccaagggtagctggaggctggagctgctccatttcccttccgagaaaacgaaggcgaaggcgatcgtttgaacggttacagctgttgccgttgagccggtgca

SEQ ID NO: 6080 - DNA, 1143 bp, Zea mays
gttaggcaacatagactcaatctttgtaaacaaagaaggacatgtcggaggctgaagcggcgagctcgaggcggtgtatgtatgtggcaaaactgttggtactgttggaatacaagtggaattgcccacctcttcctatcattttaagcttttgggttgaactgtttggtgcatgcaacttaggctctgtttgtttgagctacaacttttgtagcttttctgaagaactgttgctgggtttttgatcttgagaagccaatgatagctttttgatgatgttattagtttcctaaactcagaaagctacagaaacccataaaaccaggcttttgagcttcacatataaattcagttttttttgagcttctagcttttcagaagctaaaacaaaaagctagttgtttgtttcaacttctggcttttcacgctgagaagctacctagaagctcaaacgaacaaacaaacagggccttaatatggtatcaaagtcagaggactcaagtttaaatctttgttagcttaattaaataaatctttacttgcttctatttcatgtctgagacttgagagagcctcgatgttagtgggagtgttgggatataagtgagttgcccacctcttcctattagtttaagcttttgggttgaattggttgttgcatgcaacttaatatgatacatgaaccaaatgttacgagttcgaaccctggttagcacaattaaaattaaataattgttgcttgctcctattctacatctgagactaatagaggctcggcgtgagggagagtattgtaatataagtgaattgctgatagcgcaattaaaataaaatattcgttgctcgcttctattccgcgtctgagacctaatagaggctcgacgtgagggggagtgttgtaatataagtgaattgctcacctctttttatcagctttagcttttgggttgaactaattagtacatgcaacttaataatctgtagataactttgaccacactgctatatgatatgaccatatatctagtatttggcttcaattctacaagttatttgatcttctgcatttgtaacgcttccaacgtttctgttttaattgttgtttatataccaaattatttcctttcatttccttagtacaaa

SEQ ID NO: 6081 - DNA, 61 bp, Zea mays
tcgctgccggcggggattagcttgggagtgagcggcgaggggggttcggatggtttgagag

SEQ ID NO: 6082 - DNA, 232 bp, Zea mays
acatttgtctaacaaaaatggctacatcatagcgcttagttgcaaaaagattctcaaaatttaagcactggtattttccaaaacaggagtcgacaggtgattcaaatgtcaggaatccaaagttctttgagacattgcttgtgatggattaggcaagaatttaatagctacatcattccaatttctaacaaaccagcatctgttgatgcagtgaaatctcagaagcaaacat

SEQ ID NO: 6083 - DNA, 1500 bp, Zea mays
aggtcgcaggagaaaaacgaacaccgccaccaacacttactccggtgccggtcggccgggtcgtgcgtgcccctgcccccctccggcctccggctcccagctttctcttcataaaatacgccggccgtgcgtcccccgaacccccgcaccttcctatccgctccccactcggcgtctgctgctgcattgccgtgccgccagtggagaggagatcaagtgatcgttggccactgcactagctgcacgaaggtactcgatacttgttgagaagaagaaaagagagagagtgctgatcaccggccgccgccacttctactgggagttttttgtccggtaaatgactggaggccttgccggcgtcgtcgtcgcggtacaggtactgggtccgctctcgttcttgacgtgcctactactatcgtccccgtcgccggagttgctgcgtggtcgcaccggagggtttatcaacgaaggtacgcgtgtacgtacgtacgtacgtacatgcttattatattaatccgtcagagttaattagaggtaccgacgatgatctcacagttgccatcaagttatctgtccgtcgtgcttaatctgcgatacgactaggaacggaagtgtaggaatcgctggtctgtgtaagagtacgctccctgtccctgcactgccgcgctactataccatttgccgagcctactactatgcctataccactgtatgcgcgtgcatggtttacacgatgctttggcctgacgcacaggtagctgcttcgtttccggaagcagtgtgttgtctggtattgatacgtgcagagacagagagcagcagatcatgccaagagagccagctgacgacgacggcatacgatggccggccgtctctgcttgtgttttcccgctagtgctagtgcacttgattcaggggcagaaaaaaaagacatcgtcttttgcattgctcagcttcgttatactttaatacaattaatcaatagctgtatgtcgatctaaatcagagttaggaagcgttatatgcttatgagtgtgggaagcctactgcactgagtaatctattgctacttggtcgtccctaacgacatgagacatggcatatcacattcacaggttaaacaaatcttgccggctcaacgcttcgttaggagaagacggaagactgcagaaactcctgaggaggaggacgcggggaataaaatcgagcgataaaaaaagtatcctgttagagatatgtagtgtgtactacgcatttcagagttcacatgcagtcgtaattaacaggttcattttggtcggaacagttgctgagtttccacatcatgcatggaactgaaatatacatatgcaggaccaggactgctgtggaacagtatcctgaactaaacagctaaaatacacagtagaaactaataaactyactggacactggacagggctgatggatgctaccactgttgattccaaatggatctctcccgccactgaagatgggtcc

SEQ ID NO: 6084 - DNA, 534 bp, Zea mays
ggttggtgccggccggcggcggcctgcttgcccgcgcgtctccctagctctctccatcatcgtcttccttccacatgcatgcacatctatgcatcaagcgtgtgtgcttcaggccgtggcaaccactagctagtccgatagtgcaccggcacccgatcgagcaaagttggtggtggccaggcaccaactccacctccaacccaacccaacccaacccaaccgcgtgcgtgtgtgtgcggctgacggctgctaacatgtgccggcgtcgtcgtcgctcaccaaccatccggcaggcaggaccaggaagtaacacgcgttccacgaaaacgactagccacgcgcgtagaattctccatgtttttgcctacctggagcgtgcgtccatgcatggccaatcatatcatttccagggtcgcccgcgtgcttgacgcgtaactgtcgtctaactgtgatggaaagtacagtactgtacgtaacaacaactgctctggatggaaacacaagcaggagctgctggaggagctgggcgtgtac

SEQ ID NO: 6085 - DNA, 783 bp, Zea mays
gagtaaataataaaaagacttagtactagttatttctggtagtctggtccatgcacctcgggcctcggcggcaataatactcgtagaatgtttaggcacgtaacagtggggttgctcagttcggcgcggcccgcgcactcgcaaccgcgctgggagtctgggctgggatgcagcagagatgttaaccgaggtcgagacgagacgagagacgggacggacggccatggcgcggctcttccaacgggagcagacgatccgagggcgcgcactgccccacccagatcttcacggggattctcgcttccccaccgctgcatcgcccaagtcccaaccgcgccgccgcgcacctataaagccccgcccccctccgcaggacccgttcaccgctccttcccgttcatccatcacaccattcccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagcgcaaccgaaaacccctcgatccggctctcctcgcgctgcagcttttataacgccgtagacgacaacgaaagagaacggaaagaaataaaacccaacacacctaccgtcgtccgtaaaggaaggaaggaaggactcgagag

SEQ ID NO: 6086 - DNA, 717 bp, Zea mays
atacagtggttcatctatcgactatcgatgccattgctgtcattttataactgtttctttcgcatttctatttaaaataaactcaattgaggagggaaagactgccctcccggtattttattaagaagggatttttttaaccaagccagaaagtttgccttcgaggggaatcgaacccaggactcggatgtgctactcagaagcctttaaccactaggttagatgcccttttgcctacatttctatttatgtatgtctcttctgtatgaactatgaagtagcgaaagggcttctagcgtaatggttaaggcttctgagtagcacctccaggtcccaggttcgatccccctcggtggagaatttctggcttggttaaaaaaatgccctcgttgtgcctcgcccgctcctgggttacgtcctgtgcgccaccctccggctgggcctttgcagagtgggcggtgacggcccgctagtgatgggggccatggttcggggattttcccggccgggaccatgtttcggtctcttcttaatataatatcaggagagcggtctttccctccccggtcgagttttcttctgtaggaagtatgtttgctatcagaaacctcatgccggttcttgcgtatgtttatgtacttccgtgatttatcttgctaaacattggtgacccgttcttctactattattgcttttctaataacaacatatgaacag

SEQ ID NO: 6087 - DNA, 504 bp, Zea mays
ggtcaaaattgcatttaagttttctgggggtctaattggaaatttttaacacaaaaaggactcaaaaacaaaaaattccggccaacacaacagccagacttgtatgctcccagtcccagcgcacacggcattgtctcaagcctttgccccacttccattcacagaacagggaataaaatagtcagagggagggaagttacatcgacatgcttaatctgtctccatctccaaatcgcaaataataaataagcacgtgtttgctttctgtacatgaaaaccactccagtctgagatttgcatgacctgatggtacatcaatgctgcgcttgcacattcaccttgttgtgctaaaaccaaccaaacatgtaatatactgactacagcaatacaggtcattgctgcagccttgtagcacacgtaggaaacagccagctggccgtgcttccaagttgcccatttttctggcggtcctgataagcattccgcttttatgatacttcattc

SEQ ID NO: 6088 - DNA, 437 bp, Zea mays
tgtctgatgcggcggcggcggcggcgctagtgctggggcctcctgcgcttctcttcgatctccgcgagtgcgagcaagagagagatacggacgggaggagaggagagatggggcggcgcaggagctccgctttgtgcctgctcccccgctgttctccgccgtccgttccgccaggagccccacaggccgttgcacggatctcaaagcacgtgacgatccgcaggccccgcgcccgcgccaccgccccgggtgcgctggacctctgggccccatccctcttctcggtgcgccgtgggcccggttcggctcagtccagccctgcctcggttcttcctccccgtcccatcgtgctgtagaagttgcccgctgccgtctcctgtcctgactcctccatgtctctcacttccctcacttctcggctttgacctcggctcgca

SEQ ID NO: 6089 - DNA, 214 bp, Zea mays
cgtaagtcttttgtcctttttgtccctactgcagtgttatagtttgaaaataagaataataacttaatttctattttctcctgaatcatctatttgtgtaagtaataaaaatgcattgtgaacatttatcagattttaggtaaatccgacactaatgtggtgcagagaataaaaaaagcactgccaaatctcccaccaatgaaagttgctagag

SEQ ID NO: 6090 - DNA, 1500 bp, Zea mays
aggaggaaagggagctatagattagctccttttttttctttctttctggagctgttattttatccggggaaggatctggttttgtcccccgtattgggaggatttattatctttctccttcttccccctcccctcgaccctctcagcctcaccaggatcagctttgttgctgcggaggcaatccctgtcgcctgctccctccccatgagagtaccacgccacgcacacccttcaggtccagctcgcctcccctcccattttctcagtacaatctgcaccatgctgctgcatgagcagacggaattcttctatctggttcgcccgatgagaagaaaaaaaaaagtagtctgaattctgctttctcacgcttgctgttcatcgcttcccgagccgattagcagagagtcggtagggtgctgctgtttcttctctctgaatttggatggagagactgagctccgaattcagtttcgacacggacgcgggacgatgaatcagttggtcttttttttttctttttcttgtgctgctgttgggttttctgagattgaggtggtggcacgcgcacgcgctcaccaaagttcttccttccctcgctctgccgtacgcaccgacgaccaaagttactgatgatgctgccgaaccacgtagtatcccggttccttcgaattctctctttgtttctagcgttggggccctcggggttggggatggatgaattctccgaattcccccttcctctttggatgtttctaccattggaagaaagccaagctctgttccctttactcctgccctttttttatgtggttctatttgtgctgtgttgcaattacttattactgcaccccaagtgcgtttttcgaccaaggaaatcttacgtcttttcatcttcttctctgttatctagtattatacagccgcatctgttgttgcagctgttcggattggtatagctgcaatccgtagaaatactgtgccagtcacaactgaattaaagctgcgggtgtttttttttttttgcctcctaattctctcctgctttcagccacttttacgtcgtgaatatatagtttctactagaattttttttgttgtttttgttgtgtgtgcctcaagaccgtggacgaggaggctaagcagttttatctcttctcccagattgaacagaaaaagggcttattagttcgaattatttgatttttggtttcttgaggcgtgtgattgtttgtcttggtatagcagatcgaattttgtttcgtactaaaccgttttttgcgaacaaagtttctgtttttttttgggtactaaatcggcgtgtcatttatactgctgcagagaagagagaacttataatcgatcttggatttcttgtgactcgatttcaggaacgccgtaagctgaagctttcagtcggctgctgaaacctcgttcatcagtcagtctccaaggcggttcgatcgtggtggccatcatcagccgagcggccagagctgcacg

SEQ ID NO: 6091 - DNA, 1500 bp, Zea mays
agacacagacgcgcgcagacaacaacggctcgtgctcgaatccgtcgtgcaaatgcgtgtgccgctgcgcgccagcgcttacctgcgtgcattgtacgctctttgcgcggcacggcactgcacagctcgaccagcctagtcagctcagctcagctgtgtgcgtgccttgtgcccttgcccgccttttgaagcacctgcccccatgcatgcctgccaggccaacgctatcgcctatgggtctcgttcgcggcccgcggccgagagcaaaagcgcccaagctccagcgtaggccgagccccgcgcaccggacacgaaagcgataaagcagccccgcgccaggcttgccggttccaattccaaacaggcgggccgagcaaggttgggggccccgcgctgttcagctgtcaacgccggccgccgtgtagaaaagcaggcgcgcgtacgtaccgtgagacgtcagtacgtgccgcgtcgtaccgacgggaatcattcaactgatgaaggaggagatcaggagacgcgcgcccacgtgtattgtactatagtcggagctagcagtaggcccttccttccgcccttgtgtgcgcctgggtagtcgccattcgcgtcgcggatgaaggggacaccgtacgcgcggcggccggcgctttgtctgccgccggccggggtggtggtgatctgcgggccgcgaagccacactcggcggcgtccggcgtggcgtgcacgtacggtgcgggccgggcgtgggcgcctatcgctggtcgtaagcttgtgtttttttttcttcgctccacaataaatattgtgttgacacttgacaatcttttgccatcgatcgttcgtttacaatctacgctacttaactgtcacctttatagcgaattattcttacaacgatgcactgtgatggctcaactctaacgatcttaaaaatgtatatataccttctgctattgtgaatctggtgtgtcaaggagcacggaagctatgtaagtacgcatacgtgtcagtgtctgcttatgaaccaatcaatcatcagtgtattattacctgatttttttcgatggtgcagttcaaccacggcaacatctgatctgactttaggcgtgtaggccgtgctaggacgtggggttgtgtgcgcgtgcgctttccgccgcccgccggccgaccagacggacccatccagcatccagccgagccacagtcccaagaacaagaaggctccaaccgcgacatggacatggacgcacgcactccagtctccaccaccccacgccccacaactgctacgtttccccgacgcccagcccaactggccagctcactgtccactgtttctgcgtccgcgcaacttctccaggtcccgcgccatacagtatataggaccacgcacccgcacgaacacgccgcaccagctcccgcacgcgccgcaaccccacgtccccccaccccgcgccattccttggaccttgctcgtgcacgcgtgtccgatcgccaacc

SEQ ID NO: 6092 - DNA, 113 bp, Zea mays
tggcatccttcccgaccagcttcaccgccgtggcgacgggcagcgcgaggagggagaagaggaagtccaccacctccttgctcgcctccgcgaacagcactgttttttaatca

SEQ ID NO: 6093 - DNA, 349 bp, Zea mays
aagaagagggaggagggagggaaagggacaagataccagaataaattgacgaggacacaaggaacgaacggagcgcgcatcgtgtggccgcctgagggacggtacagtacgtgcaatagacttcacccctgcctgctgccccgtgccaaaagcaacgcagcccctgatagtgatggctacccgctctgctctgctctcggctgccgcctatttcccttccctctccgggcgctttgcataggagtcggagccgccgcccgtcctccatcctcctgcacggcaggggcagccacacttgttggttcctctccctctaccctctcccgtgtggcggcgggggatatcatct

SEQ ID NO: 6094 - DNA, 559 bp, Zea mays
attttagtgtctacataaaatagacaaagatgatttttgttgatgtttggtcgatgataatatatatgttcttaacttttttatgatatttatattgtagtataattttatttgtatcagtttaatgcagtattggtttgtttttagttaatcgttgcactttaatattttaccaaataatttgtatgccgtcgcaacgcacgggcatcgtactataacacacatatgtacataagttatcgtgttattatacggttccgttgcaacgcacgggcactcacctagttcatttatacgtatgtacacaaatggctagaggcatcatagtcggccctgaataacaccacaccaatctgcagaattaactgacaaatcgttatggtagtacatggagaagccagaaagatttttgctccaaaattcgacccatccattctggaacaaattagccagaaaagaaaagcaaacatgaccacgaggagttccagcgctccgatgcaacagatttttctagcatgcttaatccggtggattctgcgactatccttttacagcgaga

SEQ ID NO: 6095 - DNA, 927 bp, Zea mays
gcgacagagatttggatataaatgaaaatcgggcggatatgaacgatattagggtcatcctgtatcataccctattatattccaattgtattcaagatcggatttgggtagttagaaacgagacggatataaatacaaggaccagatatttaatcgggtgaataagtgacgaatacagatattgtgtggtcggatattggataatgcatgtattacttatcgttcgctattgtctagaacatagatagacataacaatataacaataatttatggtcatacaatagttcaatacaatattttaaacataatggcaagattcgaatcacaatagtctaatataataaaatatagttttaaaatagcatatgtggattttatagtctaaccatttttaggattatacgcgtacatatgtcgcgtctccgtaattttttatgatttttgtggctatttgtgtattattaatttctttctataaaaatcattgaaacacaaataaattggtacaatattctaatttcaaccaaagattgcaaataagttaccaatactagtaaacattctatatcaagataacctcaagttcgcacatgaaaataataaatagaagtattgattacgttaaaacttggatacttagatcaatttcacgtctaactcacaaagtgaaatagaagaaacacaaccatctattgaattttatcttacaaactttagttaaaattgtatatggacatatgttttaactttagttaaaattgtatatggacatatgttttccatccgtaaaatttcattatttttaagactatttttgtattattaatttcttttttagaaaattattaaaatacaattaaattcaaaaaatattccagttttgaccaaaattgcaagtggagccccttacgaaacctgtgtgtga

SEQ ID NO: 6096 - DNA, 757 bp, Zea mays
tatttgattgtgttgcattattgtatttctttaaacggaatatcgtatgtggatcaaaagccaaaataggaaaggctaaatcgatcgagaaaataagtataccattttcgttccattttatattggggcaattgtgattctaccatctctaaccttgaaattatgattttatcccttgtttttcaactttatgattttatccatcagttttgaaaataaagatgtcgttttccccttcccttaacaccgttagtgaaaatcagaatttgtgattaaaacataaaaaacgatgggtaaaactacaattgcaaagtgagagacgggtataatcacaattacttctaaaaatttcaatattattttcatgattaattatgattataccattttcttaccttgtaattgtgattttaccctattttttattttttaatcacaaattccgatttgcccttacgcttttaaaattgaggggcaaacaacaacttcgtttttaaaatagagaggtaaaattacaaagttgaaaaatgaggagtaaaaccataattgcaaactagagaagggtataatcacaattgctcattttatatttattaaaaataaaaaaatcgaagatagatagaataaccggcgctacgaatttgagcgggtgtagtatagaaatcgggacggacaggattattccgacctttttcatcccacgcccaaacgccaaactccatctccatcacctcgcacttatcggtgaaaccgcgcg

SEQ ID NO: 6097 - DNA, 459 bp, Zea mays
ctcagatatgctagtatatatagacagatcaagcagaacaactgacctaaaacacccgacgtattcctatttaggttcaaattagaaaacggtggacagtggtattctagtgcatatcggtacgaattcgatgtgaatctgaatccatcgctagcgaagtgcgcaggggggagtagttcggttcggcagcaaatgtgttcgttttctttttgaacgtaactgacagaagctatctgcctagctacggcgtgtcggttgcttgtctcaccaaagcagcgacatggaagcctgacagctcgtcgcgtcgcgccatttccacccaacaaagcggcggcgccagcacgcactgcttctgcttgtgcgtgctcctccgttccgggcacgcctctaaagtctatacagcctcgaatccatcccggccgccgctcctgggggatactacagcgagccgaagcgggg

SEQ ID NO: 6098 - DNA, 937 bp, Zea mays
tgtaagttcaaccttttgcatctttggctgaaacatgcttttaggaatatttgcaaataactgaagcttaaatcactcgtgtttctctactgtatgaagtctctgaactttaattgcatcttttttctcaaacatgaaggagagctgtgcatcatacagcagtgttacattcatcctctcaccattgaacacacacattccgatgtttccaaatttcccaggtcactagaatgatgactgatgagagaattgagactcttttctaattttcttgggaaccaacttgacatgacaccagaagctgggcaccatccttttgttgttcggctgtggcgagatgacaatcggactcgaagtttggagaattgtgaaccatacctgctgcacgaaaacataagaaactagtatgcattggattgaatgctcagcttgatcacaaagtgagcatgcagcaggatgtgaaagccctctcttggcaagttgattggcagtccaacaccagttttaacagcaagccacatgaagaacttgcagtgtagtggagcccaagtaaaattttcttccaaggtgcaaaacgaaatctacccacaaaaggagcattataggcaggcttgctggaacaatttctagaccttgtgagtttccaacaatgctgatcagctgctccttgctgcaactccaaaccatccaccaaatcctaaatgagaatagactctcttaggacctgtacacaacgcttgagacactacacgacacttgatggccctttcgggaactattttgtggagattaggagccaaatcaaggttcgtcttcccatctagtcatctatcaaggtagtctgtgtctgtctattgccaaaatcgattctatagtcatacactcatactaaacagaacttggccattgtgaggaacttgagacagcaacccaaccc

SEQ ID NO: 6099 - DNA, 1500 bp, Zea mays
acggcctctgatttcatgatccaacgcgttgtttttcctgatgctggtttttggcagagtattccgttgatcttcttggctatggcgttcacatacatggaactgtacatccattagcgctcctagtaaactgatgagagagggaccagcggaagatcgaggcggccatgtcgttttccagacactaggcgtcgccctcgcccacccagggacccccaaaaactgcgggacaggatcattgcacccgcgaaatgaaaatttacaataaaaaaccgatagtagaaaacgaaagcgaactgacgggccgccgggccggggagcagaaagggaggccattaatactcgacacctccccgtcttcttcctcctcccccctccgccattgctccacgagtccacaagacatctcccgcgcgcccagagctctagagagaaactggacaggagcgcgggcttcggactcccatctccgcgggggcacaaaagatgcaggtcctcatgactcccagcctccgcgcagcgcaatcgggtgagatttctgctgcgccacatctcccctccggttctgttttccctggttcctgattcggctgccttccgttatttatatataaataaatgtgcttcggccttcggtcctgttactcctatagatctgtcgcgcctgctgggttccagagctgttcggtttggctcatctctgccgttctgcatttcgcagaaagacgagaaaagcccgtccctacttcctgctttcctcacctttccgcagccaacaccagaagaagaaattggcaaaaaaaaaaaggagcattttggtttcgttgaaatgcggccccgatttcgactcgccagctttgcgcgcctctaactgctaggcagtagtgtgtgttttctctctctctgtgtgtgtgcgcgcgcgcgcgaggaaaggccttcgttctggggcgggcggctctcttttgcaagcggcaatgatgcgcctttggcgagcactctctgctgatcagacgcttgtttattgctaaagaggacgctagatctgtagcgttgcatgattgaggtcagtggggggcggggctggacatagttgatggttttaacaggacctttcctagctctaggccgacaacagatgaacgaacccccccaagtgcggcgggcgcacattgagcacccaatgatgaggcgtccatggcggatgctgaatgtggccgtcattttctcgccttatttatttctttttggcaaagtcttggtttactgtctacttgaatattatgtcgcagcccctcctgcgttttataatcgctatttttgccactcacagttttgccgatttcatcgaagttcttcccccccacaccatttgcagattgtcaatgaatctacaatgcaaatagtccattgcaatgccaaggttgcttcctgactgaccagatcgagcgtgttgaactctctggtcatctcgtctgaaaaaacagacaggtgtttgcagct

SEQ ID NO: 6100 - DNA, 1048 bp, Zea mays
acttttgtacacataccgcttattagcaacattattgtcctacataccctgactaaacgcttgataatagtataaaaacatataagttagacatggtccatagttaagatggtaaaagtattttactgtaaagtttatgcggtgacacggtacacaatataatatatatcaatatcgtacattatcaattttagcggtgatatatgttagtatatataaggccttattctgttaatcccgttatccatggattggatgagatttgaaaaaaaattaagaaagagtttgacttacttgagatttaatctcaccaaatctcactcaatccacatggattgagaccgaacaagccttaaataggtttaagttgtaatttttaatctgtttttgtggtcctccaagtgatagatgtgagggactgtaaaaaagaatatttacatccggtatgtacataatgttttttccatagctagtagccaaggaccaggaaaatccacctctcataggcacaaggaaatgtatgtatgagctagcgctagccacagcactgcagttaacaagtggcccggagaacgcggcacacacaagcgataaccctaccacgtaccacgtgccacgttagttgagcatgttaccacgataaaacatacaatttgcatacaacagcaccgctggcgcctggcgcggcgtccattctccacacggttagggacgatgctgagaccttgtttgcaaaaagaattgcttggaatcattgctatttgactcagatctgttagaaaaaaatccaactgttttgaattgtttgttgacagcagggacaaattgctcaaggtcaacgaatgtccggtcgagctgtgagctccggccggcgacgtgcgctccagccggcgataacacggagggcgagcggccagccagccggctataaatagaattgcaagacggcaacctttcttgttcagcccatcgctgtcctcgagcttttacttgtacactggctagagctagctcgtacagcaatcaggtcaggaggtgttaagcgacg

SEQ ID NO: 6101 - DNA, 230 bp, Zea mays
ggggacgaaacacagtcacattcaaccctcgattgaaaagaagccaatgtctgcctacacatcggagatcagacggttccccacttcccctcgatgccccggatcatgagtcaacagcgctccagcctccaggctcgtcttgcggctacttcctttggcacttccctccgttcctactttcctaggcaaacggtcgaacacctcagcggcaaggcgcggcgccaccaccc

SEQ ID NO: 6102 - DNA, 1340 bp, Zea mays
caatgctactgtgttaacatgtctgctgctattccttttcaaccaagatgggcgccctcttccccctccctatatttgagtcgaatcttacccaattatgtcggtctcgggtgggatttggctaatttgggcgccatggcctaggtcagcgtacaaatctggttagaaactttttgtactgtaaccatacaacgtagatccttatgtttcaatacattgttcacattgacacatggttagttgatgttgttatgtagtgcttatatcctgctttggaatatagttccaagaagagcgccaaggggaacaaacctagaaaagaaagaaacataatttttgaaggtttcagaacgcctagagaagctattgaaggtcagtatttcttttcttgtccaaccaattagtagtaggttctgttagcttattagtccatatgaatttatgaaaatccacaacatacatgtgcagctgtttgtcactatctatattagtttcatcgttgtgattaagaataaggaccacatggtttctagactgaataaaaatatagacaagttgttgtgatatgtttgttgtgtgcatatattgtaaaatagttatgaaactctgcgcatatttacagcacacatacaaaacaaatctgttttggaatgataaaactacttcaattacttctaaggctgtttagttcgaattgaaaattattgttttccccttttctctctgcaacatggccattttattactccatttgtcattctatttgatctaaagaaaggaggtcagtrcaagatacatatgtgtttcaaacttgcttctgaaactatgttcatttcttcatttagtcatttttagaaattgtatacatttttcattctaatttacaaagcttagacatatcttcaatgaattctgtatttttatttctgtgcatgtattacctacaccttgtgctatttgtgaccaatcatattccaatcttctgtcatgcctcgccactttggagtctctatccagtctggtatggcccttctggaacctgtgcttaatgatgtacaaaaaaggttggccaacatgtgggcgtcactactgttattacgtggctaggtccgctctctctccatataatggttgtcatgaatgaaattggaagacaggttctaccttctaccgctcttgctagatggcccattgtattataatttgatttgtatcagtttagttcatttatgagataatatgacttgttcgcactgcatttttacagtttctcatgcagtgaaaaagctattgttgcaccacgagtgtaagtaaaatgaaatatccctccgtaatggatc

SEQ ID NO: 6103 - DNA, 200 bp, Zea mays
ctttttgccaaccttaacatggaacaaaaggaaaaactaaatgagctaattagtgccatccatgaaaaggatgacctcttggactcccaagaggacttcctaatcaaggaaaataaaaagcatgttaaggttaaaatgcttatgctctagaaattgagaaatgtgaaaaattatctagtgagctaagcacttgtcgtgag

SEQ ID NO: 6104 - DNA, 679 bp, Zea mays
tcggtaccctggttgcacgagaggggagaggagaggggcaggcagaggcagaccatgcgtcctgcgctgccgctataattccctgcgcgcggaaactatagcccacatgccctctgactgattccacagccgacaccatcattccgcaggcctgtagtagtagctttcattcctccgtttgtttgtcgtccctgcgtcgtccacccccaggcttttgccgtaccgtctccttccagtcccaacagccatggcttggcgctgcacactgcattttattttaatttctagagcgctgaaacccatacacactgctgcatgctacgcattcagtatgtactccattgtagtagactagtatatcctcctcttccctctccttggagttggagcactcgctgttggctgttgccctggccggcggttccactccactattttttaaaaaaattgcgggcagagcaggcttgtatcgaatgatgtgggcactcttgccgtttttctttctttatttatttcttttagttagtactgtactagtgcatgcatgtatgccactcgcgagctatatcatttcggggctgaggcgcctcagcgcctgagcagcaggcggggcgtcgctcctcgcgcgcgcgctgaatctgatgcatgcacatacaactacgcaggtgcaggtgatcat

SEQ ID NO: 6105 - DNA, 222 bp, Zea mays
ccgcaggagcattgagcgatggttgccgtgtaggatgcagctggactccgccggccgccgcctagctgctgctgttgttgctgaagttccgatgcttcagcaaccgcgatcttaataggagcggagggtggagtaccggtggagtgggccggacggctggttgatctccgtgagctccagcgcctacgcactgggaggtggggaggtgattgccggaggcgt

SEQ ID NO: 6106 - DNA, 888 bp, Zea mays
aaaaagaaacacctcagttgcccctaaaaaatggaacgaagcactattacacatctactaaataataaatgcgaacaaaattaagtcacaatgaaaaagctacgtacgtcaaaactgccacaaaggtagaagcagcgagcagccgtgtctggatgtttggattgacatacccaagccagtctgccacagtcacagttaggcacagggagttcaggaggaataggagcatccttactagatacgtttggatataactcccgaggacgatgtctcttctgccacgcctcccggcacatgtctttcatctaataaacgattataattatcacttgtacctaataggctttataataggtttacacaagctatcaaataaaatatactcatcatactaatgatactatatatattatgagcaactttggaaactaataatcgaaaaaatacaacctaatatataaaacgaatcagttggacaccataccttggtctacgaagtgaaccaactcgaatctttgaatccagcaaattttgacgaagttttgaaatgagaggcgatgagctcttctcggccagcagcgcgaccggttttataggcctccgtagctcggcgccaagatctgtggcgccgagctatgaggccgcgtcagcgccgcgtcagtgccatgtcagccctaggcgcagggagccgttactgccatgtcacagctcggcgccataggctatggcgtcgaggtaagtatcgggtccaaaattacatataaaatttctcgggtctaaataaatatttttcgaaaatagtgttaaaaacaaaaaattcaggtttatgtaccggtgacagcgaccgcgacaggtcctctcccccggaccgcacccgctgtagccgcc

SEQ ID NO: 6107 - DNA, 1346 bp, Zea mays
gggcctgggatttcgtggtctgcctttttcttcagcctgttggcgaaaaaaaaggctccatcgtcatttgcttactctagataggatacaaagctacaagaaggtagtataaataatgggcagatgctctcttgttattctcgtgtttgcggcctcgtgggggatttggttggctatagcgtcgtcgtccgttccttgcggcggagtcctgggtcctggaccatccaatcctcgccatagcaagcagatgctctcacggggatcgcattgcttggcacgaaacagacagcagcagttcgggaactagagcttcggaccggctattatgtagtagtagtacaacatggatgtcattcgcgcgctactagcggtaactgcggcggccgtcgttctcagccaggagcaagcaggtcactctcgtctcatggccatggtcatggggggttttcagctctccaggaccgtcagtcatggggatgaaacggcgcctagcttttacatggctgcggtggtggcacgcgcgtgtcctcaaaagtgggatcacatgcatttgtccgtagtttcacgtggcgtgctcctcctcgactctgctccccaccccaccccaaacgtatttgcatgccattccccccctccgactccgattgcatcgacaccacaccttgcttgaatctgcacatcaccttccgtggatataaacgagatgtcaatttcgatgtgaccgagggagatgtgtttgtgtgtgtgtgtgtttttcttttcattttggttcttggccggctcttcatcgcccttttccacttggtttttgttggctctgttgtgtttgtgcttccctttcctcgcgaccgcgactcggatcggatctctctcctgtgtagagccatgctgtgctgtgctggtagtagcagcagcagtagcaatgagtagtccagtccacagctccaagaacacgtggccgtcctttccttgcctctccctatcggtattcggtaacgcagggggagggcgccaccggctttaaccatggcctgtcgcttttgcctcgtctggtcggctggtccctctgctctatcccatcccccttgagcaggctgttgagcaagctgaactcatacgaacctcgatttcttccgtccggcgtttttttttctctcagtttctgaggtatttctccccctttctttcttccctccctcccagtagattcttcactgctcggggatttggaacaaaggccgtggttcgaagctggtgtgttcgttcaattgtgcggaaagaaaggccagtgttatgtgtgaagtagtgaaggctagcaggtaggctggctctcgcctcgccgagcg

SEQ ID NO: 6108 - DNA, 806 bp, Zea mays
agttgtattaataaagtcatacagacttagtattggatggtttttattttgtatagcaaagcacgggcacatacttatatatcttttaatgtatgtaaatcttcttaacctttaaaagatactaacaaaaaggtataacgataattaatgtttctgcttcttaatatattttaccattatatgttgactccgtagacgcacgggcatacacctagtatatatacgcgatgatcgtgaactacgtttaaaattaaactttagcagtttatcacaccttgaagagctaaattactgttgggtgttaaaatttaaacactttatttttagcaattctgtttgatcttcatgtgctataatttagtcagaattatagtcctaaactttagatccaaacagacccgaattcatgtttctctttatttatgatgatataggtgtgtgcctgccctagtgctctgtgaccctgtccccgcaccgccagtccgccatcggccaccgcaacagtgcagaaacagagctaaccctgatcctcccctcgcagcctgcctgccaccatcagcggcgctacacctcgccgctgccgccgctggggataaacaaacggaacgaacgcaggttcacctcggatctgcggctcgccggactccgaacgaacgtcacgtcactgaacggacgccacagatttggcctgctccgccccacgggacgcctagccggatttgacagctccacgcgcgcgcgcgcgcgcacccaacccgcgtcttctccggcctgccagtgccgcggccggggctccatccccatcc

SEQ ID NO: 6109 - DNA, 440 bp, Zea mays
agtgtgtctatgtatgtatctcaggcccggagcagtgagctgcgtctgcgcatgaacgcaaagtaaagctgtgactgtgactgtgactgtcaggaacaggaagtactactacactactggtggcctgtgtgcgctgtcccctgtggagggaaaccaacaaggccaaacacacacgcacgttgggccgagaaaaaagaaatagaaatacgggcccatctcatctatgttctagttaatggaaaatccggcctgtgtcactgatggtagatcaggcccaatgaacacgatcacagccacaccaacgcaccacgctcggctgcgagcttgcgaccccaccgacacacacagcagggaagcgaggggaaggagaggcaaggcggcgcggccagcggcccaggatatctgcgcgtgcgatcccgaggaggcgtcggcgaggtggg

SEQ ID NO: 6110 - DNA, 340 bp, Zea mays
tgcattcggtttgaggaatggcgggtgcgacataccaaaggtgcatgaaccacgtgtttggagagcacattggtcgaacggtcgaggcttacgtcgatgacatcgtagtcaagacgaggaaagcctccgacctcctttccgaccttgaaacgacattccggtgtctcaaggcgaaaggcgtaaaactcaatcccgagaagtgtgtcttcggagtcccccgaggcatgctcctggggttcatcgtctccgagtggggcatcgaggccaacccggagaaaatcgtggccatcaccaacatgggccccatcaaggacttgaaaggagtacacagggtcatgcg

SEQ ID NO: 6111 - DNA, 352 bp, Zea mays
ggtggggcttcttgttcagggcacataaatgtttgcttgctcttttcctatgtgggggtggtagtctgttggggtgagctaatactgtttactttaacttgtacaattatccctgcatattgtggtgtctgtgtgtgggtttgtcactgtgtgactgtttgtgtctgtctgcatgactgtatgcatgccatgcactagctaaaatactatatgcctgatttttgttgatgtatgccctggtccattaacttctgtttgcatcagtagaaactaatcaatgtgcatgttgctttagttaatttgctgtgctttttttatgcaggttgaaagtatagttctgagcatcatttca

SEQ ID NO: 6112 - DNA, 1500 bp, Zea mays
gcacggcacgcgagggataattccagtggcgggaagggaatattcggatcggacagcttcgccgccccgtcggctcggccatgagttccgatcctcctccccatttccgaccctacccctgccatgtcgccgaatacccgcgcgctgcaaaggcacaccaaagcgaaggggccagttccgtccaagggcagcaccgtaaaatctacccggcacagcttccaataaatgccctcgctcggtgacttcccactcgcactcgcaccacccaaaccgagctcgaggacaccaccacgaacaagaaagaaccgcacggtccccgttgcgtggttccgccgcgtcgcgtgtgcatttgcgcggccgcccaatccgatccggcgaagatcggccgcccgtccgacccggcgaagatcggccgctgctccgggagcacccccaccccaccaggtccgtgctctgtcctgttcttgatctccgcggcggttctgagccgaatccgcagcttgtgctattgcttctccgatgctatttttcttttcacggtggtgtgtgtgcagtgggtttgtgccgctgcaatgggttcgttcaggggaggggtttcgggtggggaaatttttggtgacggcctgacgggtcgatagggagtttctggggcaaaaggttgtgttttcccagccctggacttggggtcgtgcgttgcgtcaggtgtgagatcatacgtgttgactgttgagagctggaaatagggtggggtcacagcacggctcccgtgattggacttgtgaaatatttgcagggacgttgggcgtccgagtgtcaagatcacctttttacctgcgtccacttggaaaacttcctccctgtccctgtgcaggtttcagagaatatgctgcttgagggagtcagagttgagacttcgggggaataatccttagtttatcggctggtatagatgcggctgggctaatattaggagttatgagcatgaattcgatgaaattttgatccgtggggcgtttagggacatgcaaatttgatcgctgtattgtctctgatccagggtcagggttgctaatgaacaagatcaacaaatgtcttgcacagttgcacctgtcaccattgaatttggctaataataaataagcagatcaatttgtctcccgaaatatgctgagatgctttggatcatttcggtgcatctttgtggtgtaatgtaaatgaaacggctgcacgaggcggcattgagattgagatcactgttttccaaccttctagagcatgattgttggttgcatactgttattacgaattaagagtagcaaccatatcatcttgtgtctccttgcgccgggcttgttatcctgatcacatctcccttggttgctttctttcaggtggtaggtaatcgttgctggttccagaagcgtccctgcagccggcgctagctgcacggcggtgacctttctcagcgaaacttgtgtcctcatggctcagtctcaacag

SEQ ID NO: 6113 - DNA, 741 bp, Zea mays
catggtttttttagaactacaaakgtaattacatccagacacctggtttttgttgacaacaaaaatgtaccgtggtatatctatttggattgggtggcttctacccttgtgctgttcgttcatcgcccgtttccttcttttgaaatggttcatcatttccatgttgttgaatgagaactcgcatgacatgaccagagctagcaaactcaaaaggctgaaccggtgccgcgctgcgtgttcctttgccttatgagctggacagctaaattttctctttgcagatgatgctaaccatgtatgttctgtttgcggtaacgtggcagttaaattctcttttgcagatgatgctgaccatgtatattctgtttgtggtaacgtggagaggatcttactccacactagtatcaagatcgaaacaaacagctagatttcatcaacttgttccgtcttctgactacgtacgtactctcgccctgcgttcttccccggcatgacaagcatggaatcgtttcatgtgatccaggtgaacagttgacttgccgagacttgatccatgaaaaagccatgcttggttccaacgacactgtcgttagtcagagacgatgttcgcatagcacaccccctcaccgccgactatttaaaggaggcctactacacacagtgccagccagtcacatcagcgcgtccgccttcacctactatcatcatcgtctccatctccggccgggcacccaaactgag

SEQ ID NO: 6114 - DNA, 316 bp, Zea mays
tcattctcatctgcctgccccccactgccgccgactgcgctgcgccgtccggatcgaccggtccccgcgcgcaacccaccccgcatgcgcgccggccactgcacgtatatatatacccatcgtcgtcatcaatctatcgctgtgctctactactgctctccctcccatccgttgtgccttccaagtcttatctcacgctagctggatcgctttgtcagtgtcagctgcgcggtgaccacgcggcatatgatatgagcgcggcgcgcgcggagctagcgctgccgctgaagctgaccaagtaaggagaagtgaccgg

SEQ ID NO: 6115 - DNA, 1500 bp, Zea mays
acatgacatctagggcaaacaagaaatggggaaaaaaaaacacaagcaaattcataaagagaagcgcaatttaaaattatatataaaataatgtccgttcttttcttttccttgtttcattcagagaacttattaaccaaatctttctatacgggttcgctgaacttctaaacaaaactgtgtgaggtttctcctttttttcccttctctgcattcaagttaatttgtaagtccagttttgtggggtcatggactgcatcatggcttttcttttaaagaaaataaaatacattactggttttctgtagctgaagaggaaaccagcaaacccttgccacagcaaactaagttttctggcactttcttaaaaaaaacagccacatcagagttatggcttgtttgacgtttgggcatcaccgagagcagcctaattcctacagcattcaggtgaattccaaatgggggcaccaagatgccgcgccgtgagaagaacaggcagcggttgttggccattgaagcaactgcagcagagctgtagcatggtatcaagcgttaaatttcccctggttagctgtttggttggtgtcgcaagaatcggtacgaccaaaagccatcaaatttcagccatattttccacgcacagatcctgcgctcgaatccgccaccagaattttcttgtccgagcctttatggccggcctgtacaacggaacgcgtatgagttccgctatcacggcgggcggcgggcgccggggatacgaataaagcccatcaaggataatgctggtacacgcagccactaaaccaaggatatttttttccgtttctttctttcttagtcaaatctctctctctctctctctctctctctctctgagtctgtgcagtgcgttgtgtgtgcttggctcccaccactttctctctctctctgcactttgaaaacttcgaaagcctctggcaagctaagcacggacagccctccgttttcgttgtcggcatgtcaaccctctcctcctcctctttctcccgtgcactccatcagcagtgcttcctcgctctaaaaatgggagccgggcactgaggcggaagagcaaggcgcccttcatccattagccagccaaagtaaggagggaaccacccatcctcctcttccacttcaagcatcatcagtgtcgatccgacgttcccagtcaagaatcaatttcgacgatcactattttggtccactgcaaaattgtaaattctcccatgtcatcagttcttgcttcgttcccttcacgttctgactttattgttcaaatgctcatccatgcaatgggtttacaaccagcattcgcaaacttgaactttcctttttttacataaaaaaataataaaaaagaggttctcttttatgttccggtcacatttcatttactggcacgatgaatttctctgacaacattcttcgcccaccgtgcaggtgatttctgagccagccaggagcttgacagtcacaggg

SEQ ID NO: 6116 - DNA, 163 bp, Zea mays
ggtaagttttcactgagattggaccgatgttgtatggtcatattttgagtaaagagggtcgaccaaagagttttgaaaaataaaaactgtagttcattgaagatgatggttggtatgtaagtattacagttattgattctccacttactgatgttacatttgg

SEQ ID NO: 6117 - DNA, 286 bp, Zea mays
ggtcgagatcaggtgaggtgagggtctcgccacctaacaatctcaatcccaatgtcatcctcgctcactgccatgccgataatttctagccacaattccatgccttgcccgtccagtagctcccatctcatcccatcccgacgaatcaaatctccatcaccacttcaccagtcaccaccttgcctagcctccgtctgctgcggacgccagacatcagtcagcacgagggaagcccaaactctgccgcctcttcctctgcgctgcgctaacaacgattcccgattcc

SEQ ID NO: 6118 - DNA, 484 bp, Zea mays
tggctcgccgtcgccgccgcggagaccccgcctttgctctaaaaccctaggcaaccctgcttctctctgtaattgttgcgggaccccacccagacacgcagtgagagagctagtagagttggcatggtggcttgtccccacgtcgcagcgactgagctcgctctcccctatttcctgtggggccaatacagcctcgtgtcactggagtagcggtggcgagtgcagaccccactagtcagcgtacctgacagtgtggatccactctcctcgatgacgcggaatccgtttcagcttctggtaggtatcctggtatccagttcctttctttgcccctcctccgctttcttcggttcttcctctcccccactccccacgctgcctgagaggctgagactaggaaggggaaggaaaataatagtttggcgcgcaaatatccgcctccattcgtacgccgctattctcgtctgcgatccgcagcgcgatg

SEQ ID NO: 6119 - DNA, 481 bp, Zea mays
tcgcgctgcggatcgcagacgagaatagcggcgtacgaatggaggcggatatttgcgcgccaaactattattttccttccccttcctagtctcagcctctcaggcagcgtggggagtgggggagaggaagaaccgaagaaagcggaggaggggcaaagaaaggaactggataccaggatacctaccagaagctgaaacggattccgcgtcatcgaggagagtggatccacactgtcaggtacgctgactagtggggtctgcactcgccaccgctactccagtgacacgaggctgtattggccccacaggaaataggggagagcgagctcagtcgctgcgacgtggggacaagccaccatgccaactctactagctctctcactgcgtgtctgggtggggtcccgcaacaattacagagagaagcagggttgcctagggttttagagcaaaggcggggtctccgcggcggcgacggcgagcc

SEQ ID NO: 6120 - DNA, 567 bp, Zea mays
ggatccatcataaaggttgagtgcccaaaataaacaatgtatcagtaaataatatttttatttatatatatatatatatatatatatatatatatttatttacttatttttatcctcaccatatttatttccttctcttttttagattcaagaatttcttttaggtctcaatttccattctagatttaacatattcatttttatattattttttttttatattgtcacaagtaatgcacacacaataaaatcccagcatgatgcatgtgtcattttgggtgtcttttgttgtttattgtttaagtgagatgttcacatgtgatggtaaaatagaagtaacacacatatagataagggaatacaagtaatttccactttttatatctccttacaaactgggtattacacacagccttgtgggggtcgttccattccatgtggcctagctagctactgttcctcccgtccccccctccgtgatctgttgtgtgtcagtccatgtaccctcctcgatcgtagtgtctatatctcctgccttgcagctttctgcagggagctgcgccaacg

SEQ ID NO: 6121 - DNA, 1500 bp, Zea mays
ggtaaaacaccgcaacaaccactgcaagggatgattttgtttgatggagtctgctcccaccatgcgactctatctccgatcgagctagcagcgagtgccagagcaagatctgatcgggccacaagcccgatgaaagaaaccaccaatcgaggtgggatggaaaggagtgcagtggagattcattacctgctgctgtctggagctggtgagattgccacttgcctctagcgatctgggtggcaattccccacctcggtggaggaagcgaacgatcgagagaggagaaaagacatcatcgaaatggatgagccygacggaagaaatcgccaatcggggtgggacagagaggaagtgcggtggtgattcgttacctgctgctgctcggagctggtgagatcgccgctcgcctccgacgatctgggctrcgcttcctcgcctcggtggaggaagcgatcaatcgagagaagagaaaagatagcagcgaaacggatgagcatggagcatgcgacagatctgcgtccaattccgaaaaatactacgctaatttttcggttttggtttcacgcacgcggtagatccacgtttagtctcgaaatttgaaaacacagcagcgaaatggataagcacggagcacgcggcacatctgcgttcagttccagaaaatttggaaaaaaaaactacatgtgttcggtcttggtttgacatgatggctgatgctttacatggtgggttgatttggaacaaatgtaaggatctttttataaaaaatgacggtcctatagattttgtatttaaatttttttataatataatataatatttatatgtaatagtctagtccagaaaaatgttgataattatactataatacttatattagtctagataataatgagacagaactacaactttctcctctcatcctttcctcctagttagtccttgaaactactattaatatttctcccgaaccttccttatcttttacgacaggtttaagtaaacggtgaaaatgattttacccagaagccaagctacattgtagctagtgggtgcacatgcaccctaaaaattcaaaaaacagttatagtgtttaaattttcaccatataaaaattagtttagaaactctatttttgaagagatttttatttttctaagaaaaaaatttaatttatcttgagaaaataaaaatcacttggaaaattggattcctaaactaagtatcactacatctcatctctatgcatctataagagaggttatctatgcatccacaagagaggttatatttgatgtagtagcttcgtcactgattttaccgaaaatgatccacgccacggacgttgcagtttacgcagcctaacaccgaccggaatcccaaccaaccctttggccacggtaatcggtaaccaccacgacgacatctagcgacgaacccggcagaaacaaagcgtcgtgccagcaggaaaaccaaggaccaagccaagccgccggcccc

SEQ ID NO: 6122 - DNA, 145 bp, Zea mays
cgcgcgacgacagagctgaacacaaacacccacatcgatccaacccaagctcgcctcggcgacaggccgacagcccacgagcgagatccaacccaagttccgacgccgcgggcgagaccgatcagatccacctcagccgtctcgg

SEQ ID NO: 6123 - DNA, 418 bp, Zea mays
ctgcagctaatcgctgtggctcaccttgcatgtactactcactagtggtgaaactacagcagcctactgaacaacttgctagcctttgcctacaagaccatctctctctctctctctccttcccatgcttctcgccggaacatatagcataagaatctcccgtgtccgggcatctttccttttcctgccataggccgtgacgggagcttcttgcttgcgtgcttgttccgggccggctatcatattgcctgcctatgaaactctctgtctctggccaatggaggagctacttcttctcctctagcctttctcgtctctgattcgtccattgaccttgggtgacgtcggcgccacttctgcgccccgcgactcctcgcgtcttgtgtgagtgagtggctgagtgctacaagcaaaagcg

SEQ ID NO: 6124 - DNA, 637 bp, Zea mays
cttggatactgggtgaagatgtaaagtttgataaggagtcccacattggtttttgcttcttctcttcctactgctgtttcagaaacctagacctttgagacaatcagacttggagagagccttatcaacatctagaaagtgcaagaaggctgcaagttcaggactgcagtcacccttgtgggttcggccgacagattcagaagacgatcaggtacagaacgcgatcyttgagatatctaagctgatgtctcgaatagttgagagcagccagtcagaaccccaagagccttcttcaccttaatctaatccttttgctagatcgcgtgaaaattctacagcggagtaaacgcaggcattacgtcgatacccttaggttttcttacgcagcttgcagagaggttcagcgtatatatatatatgcattaattcgttttgcttggcgagggcgcaccgggttttttgaagctaactgcagctgggagtatgccctggtgtttaagtttattattcaagattgatgcccctgtgggctgtaagctcagaactccatagttgtccggcctacaattggccttagtttccttgcattttatcttcagtttaactagtctagggtagcgaattatacattcatata

SEQ ID NO: 6125 - DNA, 523 bp, Zea mays
ctaacatcatcgttaaattataattaagatatacattctttgtttttatgttaaacattgtcacttatacacattatcagatgtaagaaataattatgcatacatcaaaataaacatatttgtacaattagtagtctcttgataagctaattatttattttttgtcgttaactagtacacaaaatatagtcacgtgcaagtttaataaatcctcgcggagaacgggtataaggaatatgtccccatctccttttacccgtcggaagataattttttctcgtttatattcccgtagtgaaaatttcttttccatcaccgtctcctaacagagaaattttcagtgataaatcgaagatcgggtccacgttgccatggatctctaccgtacgtggaccatggcgtgacgcgacctgtcctctcgtcccggcaccctactataaattgcggtccaacacgcacgctaattgcacacagagctacctactgtaaacattcaacactcaagagccaagagggagagacg

SEQ ID NO: 6126 - DNA, 475 bp, Zea mays
atggtagttgttgctgtgctgccaaaatgaaaaggaaatcgaacaacaaattgccatttcctcattgtttcctatcgaagtgcagatcgatcaggcggacacaatctttctactgctctctgccatgcatggttttgcatcgtccatcgtgtttatttcccacctatatgtttatgacagcgaaactcaccatctttattctattgacattcatttccatgcaaattacatatataataacgtatgctggaaccaaatgcgaattactactacaataaacatcctacaagtaatggtcggtcggagcgttatgtttctctcctctcttcccaccgtacacggatcatatatatatatatatatatacacacacatgctctggaacggcttcttcgatagttccaccaccacggttacttccatatatttcccttggattggatcggcgctcaaacgaataacaatccggtaacta

SEQ ID NO: 6127 - DNA, 1298 bp, Zea mays
ggttagttgcttccgtgaaaagaggttaactgttttggcaaaataattctactggttagtaactcttctgcctaaaatggaactgacaaaaaattcatcatttgacataggaactgaggatgtattagragttcgrcagacgattatactcaattatcatcataataaaaaacactcttctaattgttgatgatgttatgttacttgcatcagatarcaaaccaccctattgtacaatctgttggtggaaacatgtttgtgttgtgygttccaggttgtctgtttcttggtagccttttttggctgaattggtgatatacacaaaatctatttacttgttagastatactttgtattgcacccctgatatccaggccattgcttgtgttttctatgattcrttttaactgaagttttcacgctgtgaaaattttctaccgtgcagtggttaaaatttctcaccacgcactggaatgtgttccattatggtttctgaagctctccaaaatttctatgatgactgatttattggaatgctacctcagatggaacatttcagtgctatttatagaagatggaacattgaccacgaaaaaaatgtaatccatgatgtatctgaaagtgaaaaaacaaaattctgcaatggtgtagacacttgagtagtcattttattccgcatcataaaaaatattgaattgtgctatggagtttttacggaacaactggagcattggttccggttcctctctgcctaaggttgatcaggctgatggaaatggatggtcctgatatccagggcgccagccactcgggcacaaaaactgctctcttatctaaaatattcatgcccagaagtagtttctctcccttttatgcacatttgagatctaacgtttgtacatgatggtctgaaactataaaatgctattttagttttcttgaatttattctttcatgacttagcattcatattttttttatttccaagttttgaccatgtgaggaaatctgaatgaatattcaggttctttctttctttaagaaattccctttagatacttaatggtgagatgttgttcttggactcttccttccaaacgaaacttcgttttttcccatcaaagttttggtattccattcatgtatacattaccagaatggatcttgttccacctgagaagtaattttggctgtattggtttgcatttcaggctgaccaccctagattaaacttcaaagaccggtaccctgagctatacagagattctcatccaactgcccctgttgttgtgccatgg

SEQ ID NO: 6128 - DNA, 491 bp, Zea mays
attttatttgtgttattttggtgtgtgggagaagccacacaagagtttaacatactaaatctggataaggaaaggtttattgtaaactagctcttggatccaaatacatagagggctagagctagtttgggttagagttagagctagcgggcttgaaggatccaaacaggctcactgctgctcagccggcggacacccaccaatcatttgtgccgcaagaatagcccaaactaatcgccggcccatttagctttttcgacacgtcagtcagtgcgaagcccatcaatcgcggggacaacgggtaacgggcccataggaacaagaagcccaaaaaccacttgtctttgtctctctcggggtctctctctctctccgttccgttccgtcgtctcggcctttcgggtctttcgctccccggctcttcgtctccctctcttgccgaatccaagccctaaaccatagggcttgcctggtgcccgggtgggctcccc

SEQ ID NO: 6129 - DNA, 229 bp, Zea mays
ggctgctgagatttttgccttgcttaatcttctttctccaactccatttgagagtggaggcggataagaattttttgaatgctcttttcttccatcattcttgctgagggagcatatgtaatgttttaatttaacatgaggcaaactaggtcatatcccataattctttcctttggtgtcccagcctcataatggattctcgtgtatccctccttgccataacacaacc

SEQ ID NO: 6130 - DNA, 1001 bp, Zea mays
ggatttgggcgagaaccacatatcattgcaacgaccattttgacaccgtgagtgtatacagtattgattatggggtatttaagtattttttaagaacttgtttgacacagctttttagcactagctgccgactgtttaaaagggttcttcctctaaatactctctttgttccggaaaaaatgcaaatctcactaatacagaagtcatactttttaatttgtcacaatatatatttaaaaaactgataaaattaataatatgtaataaacatggttacatacattacagaatgtatttttaaaataaataagtactgctagtcagcttaaaatattccagcccagcacacacgcgcagcccaaggccttgactcccgttggcccaacattggcgcgacatcttctgaaacccgactacccgagcgagccaggcccagtcgagcttgagcagaagcagaggccttattgcatcgagcacgcaccgcgccggaccggaccgggaccaggcacaccacgcacgcagagccctagaggcattcccaagttcgagcaatcgagccccagaggaacgactcctgccggacgccgccacaccatctgaaactgacggcggcgggcggccgctgcttcctctcccttctccgttcagatccggctactggcgtccctcctccgccatcttccctacccccgacgtggcgacgagctgtgagccgtgagctgttccaacattcctggtataccttgaggtttcgggttattttcgtgcgttttcttttctagaaacccgagtttctaattgctcagcccgaaatttgggtgaacccgaacgcgcagtcctagttcaagctgaaaggagaacataaaagaggagaggctagggttttggcgtccgagaccaaaccaagctctctccggcgacggtgagggctcgatatcggagtccagtaggcggctcctgctgcttcggcggtccctaatccctctctcggcagtgtacag

SEQ ID NO: 6131 - DNA, 573 bp, Zea mays
ggtatcattgtacatgctacgtgcactcgtctagatgtatatttttttcctgtatagaaggaaacaaacgacaagtcggtggccgcggggacctcttttcagataaaccacgaggtaaagaaagatcaccaagaggacaggatggctgggccgccggctggggtcgaacagcagcaagcggcttgaatgaatgaatgaatgtgagccagcaggatgatcggactgccacgtggcttccctttctgccgtccagcgcctaccgcccggattgcaggttgcaaggcccaaagaaattgccccacatgtaccctgcgagcatatgctttgttaatactactacttgttgttaggggtaagtacagtggtgcttagtatcgttagcattcttatctgtaccacctgcaggatcagttattttaggttagggcttgtgctttgcacttggcatcagccaagtatatttccgagctcaacacacagtcgcagataagtacccagagcccgagcaccatcctgtatcgtatcacacgcacgcccatctgcgccaagcttgggtaaaagaaggatcggaga

SEQ ID NO: 6132 - DNA, 1500 bp, Zea mays
gtgtcatactttacaacgttcaagtgcaagtgtttcattcttaaaatagcccgaaccttctaagtttgcacctaaaattaataaacatttcttattggttacaatccaaacaaacacgcctatcagatctcaacaacttctttagaagggttgacaccatggtggatgtgacatttgatgaatctaatgagttcaagtggagcatattggtgtaaatgtggtaagaaatgagcacatgtgatgttagaccaatcgaagcgatagaagtaccataaatccaagcttcaacactactctaaaaaccaatttcggtctcaaaacatatgctgatatagaggctggaggctctatgctggcacaaagactccacacaagcacgaggagccttccaagtctgtggccaaaattagcaagaagatgaactaactttgcatatttttttagtattgtgatattgtattcttatttgtcgtgtttcatgaagtttcttaacatgacaaacaagagtacatgccttaagcatgaggtgtttgctctacaaatcccgtgatgtgtggaaaataatccgttgtggcctgttggctgacagcctgtgccaacctaaataggaaaacaccctctctcactcggacacttggtcttgtcgctcggtaaacaacgatgagcctttgggtccagccacaccattccacatttgtcaccctagagatggattcagatacttattctgatgctaaacttttagtattctttcttcgattgtgaacaaataacctatagaatttgctatgtaaatttaaaaaatccggctaggaagggaatgaccgtcctcccaatattatattaaaaacaaaccgaaacatagtctcgaccgaaaaaacccccgaaccttgaccccgtcactaatgggtcaatcaactgtccactctgcaatgcctagcctgaggtggcatacaagattctgttctccgagagcgtacaaggcgtaggatgaatatttttttaagtaaacccgaaaatcgtattgagcagattgaagtcgaacctaaaacctataggtgctactcaaaagtcttaaccatcatgctaaagaccatttcactttgctatgtaaatttatattcctgtttttttacattgagcgcattaatattcgtaaaaagtaaaccacaaattcattctatatttttttaaataattaatataaaattaagataccgaattcatacgaattcaatttttttattatagagagaaaataacacacaaaatatataaaatttaattcttatatgttatattattcttaataatatcataaaatttagcttcaaattctatatatatcaatattaaaatattggaacaattggatctataccattaaaagatccaaactttagatatataccatggaccccacatgtcattgactcatgtggacccacatgtaagtgagataataatggtatggatccaaattggtgatcttttaatggt

SEQ ID NO: 6133 - DNA, 432 bp, Zea mays
ctcctatacaacttctaaggagtatctgaatagccgatgccgagctccgtctgtgaggtcaccgcggcggcactggcacgggatccatcttcctcgatggtcgagcacgttcaaaccgacgcccggattccagttccatcgatagcattgaggtggcagatacgaacgcattaatgcgttcgtcataaaatatactagtgaccacccctatctcgtctatggtcgccatcaacgaccggttgcactgcgcctgccgctcccttgctcgggagcagtccgcccgccagcgggtgaattctggggggctacatagcccgcccagtccggccctgccaccgcggaatgtcacctgcatccaccacccgctgacggccaaggaaaaggaaaaggaaaagaaaggagcgttggaagcggggcactggagcagggacc

SEQ ID NO: 6134 - DNA, 1500 bp, Zea mays
attgtacatttttgtataaatataaatcaatgccacgattccaacctataggacttactatatgccccatttgttttcttttattttgaggaattggtatcttactaatggaatgtgttatttttttagaatgtgacattctaccacttttcaaagttatcatataaacttatctcaaattcatgaggtgagagatgaaaattgattttataaatttacatgttattttaacgatgtacaacttataacacactcttttacttattccgctataacataaatgtagtatataattatctctctcatatgatttaatataatttagtataatatacaaatatattatatatataaatatatgaacttaattagttttgtctaaattataattattaaaatggaattcaattccaacgaaacaaacgggcccttattttaaatttgatcttgtgattctgtgaacaatacaatatatgtgcaaaacgtgttttaaacgatcataggtataactaaagacagtcttcaaatgacaaaagctattcattcgatgattttgagtttttaaaaatggtcgatccccgtccttcgtccgcataccggactaccggagcgatagccagtgagccaccactgccactgaccacccatgcagcgggacccacagcggcgagagataccagtgacagcgacaggcgtcgtactctcatgcgcggtatccgatgcactccacagtccccctcacaagccacagtccacatgctctctgtgcttccatctttgacctcccgctaatcacaaccaccgccattaaccacagcctaaagcaggcggttgctccccccgcttaaaccctcgaaagattggattgcactatttgcagggactggctggattccagcatccagctcccgcacggccacaccgacgaggcgaacgggccagagtcggcgatcggcgtgtctccactctacaggcgacgacgaaaccagcagcctcagcgccgaccactccgggagcggggcctcacaccctcaggatcaacgggagatgccggtcgccgccgcctcaccctcgcactcgtgaactggcttcctctgcgacgagccggggcgggctcggattcggcggatcttgtgggtgcgtggcgtcgggctggtccggtgctagattgatcccgcattcgagctgcggcaagcgtctgggtagtcgcttctcccgaggtatttcggccgccgagcacggcacggcgcggcgcgagtccgcgatttcttagggtttgttttagatgtccatttcaggggcgtcacctccggcgcgctccccgtcttttatccgtccgctccctgatacctgtgctgtttgcagggaaaggaaaacaaagttgcttggccgactttgggatcaaggatcggcgaaaagaaagagaaaggagggatctttttgggaggttctgtttgagctttcagggtttatatcgtagccttgggcaactccgtgctg

SEQ ID NO: 6135 - DNA, 1111 bp, Zea mays
gaaaaaatgagagacattttcgaacttaagaaatgcttgcaaatagaaaaggctttcaaaatatttcaaaactttgcgaaataaaaaataccaagtgatacaaatgtggtcaaatatgttaaaattacaaacaacgcatattcagcttagaactgagaaggcgtgaacggagaacggcggcaccggcacgcagggtctacgaattaggttaattggcgatttggtgaagcgtatatggtacacggacgtgaagtcgtgatggccgtaggctcgtagcacgactgcgtgagttgtggcctgtacgagaggctgggctgtccatgttttgagccgatcaactaatgaaacatttgagctgattaaattaatcaatactatacttaactacatacttgagggaggcccaacaatttgggggccagagcggccgcccagctcatcccaaataaaataggttctattgttgcctggagaaatgaagaataggaaaatcacggagagggagggaaatagtgcgagaagcgtgcggctagaatggttgattgggctccctctcagacccccacacagtcacacatggcgcgcggcgattagaagccccggattacacctcatcgccattcgccactttttttatctatcctataccaactaccacatattatatcatttttctcacacttttttatccaaaaaaaatccatcatcggcgggtcgctgtcgcgcacagtggatagaccattcacccagtacgcacgctcgtgcatgcatgcatattctatcggtttagcgttccgccgtacgcacgctcgaagtagctttcactcgtacgctacagtgcatagagtatctcattcggtcgctcgctgcagcaaaaatttctacgctatgctttagcgttcgcgtgtccggtagcaagtgcggctagccttatctagttatctgtcaccgctcgcaatccccgctgccatgtcaccaccgcccagctcgtcgccatcccgcagcatgacttcatgagcgcaccgcatatacgcctactccccgaacagctcgctccggctgcccagtcctcgccagtcaccaccgcccagctcgtcgccagtcgccacca

SEQ ID NO: 6136 - DNA, 673 bp, Zea mays
gataaaaaaattataaaatagaatattgttgaaatagtttttcctaagttgatccctatattttgcaatatgacactgttgtacatgttctgactctgagaacctttatacaacaatttttccttatctttgtcatccggaagccaacaccggactcgttacaaaacttgtttgcaaagtgcccgaagagcaggtgcacctaacatttttttttcctttttggatttggagggggatgccaaattgccaatgccagtcaacaccaccaccccacgtcagccccagggtccaccgcgcagccaccgtccggcgcgcatccgacgggccggatcgccccggcgcctcctgaaaaccctcacccactaaggtcactgcctgactgcctccccttcttcccttcgtctcccttccccgtcgttcgagaggtgggcgaccaagctggtggcgcgccgatctcccgatctggtggcccgcgtcctccccgatccgccgcggaccgacgcgcccggcccggatttggcgctgtgggaggatcaggtgcggattccccccaatttttttgaggctttttttttttggtccagtggcacggaacggaactggcctaagcgtgctgctgtcttccgcgcagcgtccgtcgccgcccggggaggctccgattcgcgggcggtcc

SEQ ID NO: 6137 - DNA, 216 bp, Zea mays
cccctgtcccaaacagggcctaagtagatagtggccgttattactcttggtttagccgcagttactcgcagtcatccgatacgccgatcccgttatataaatagatgaccccttggccccgtcgcctcatcacgaatcaccaacaccaacaccctctccagtctcctccaccttccatcccgatcaccgccgccaccgctttcgttccacgtcccg

SEQ ID NO: 6138 - DNA, 1078 bp, Zea mays
tttaattatgaatgtgtggaaatttaatactttcttcttccgaagttttttctgacgaagcaggcttcaaactggagcttcgtttgattccgacagacaagcttcggcgatgattaaaaattttggcagcagaacagtgcaaatagcaatgaatgctgtggtaacttcacaccaactcatctgtttatatagtactgcaggaaagaaggcgaagcgccaggatttttacaccaggcggaaacccgcttgcactcgctgtgcggtggaccgcagagaccaaacagtaactctgcaaggtgggaccgctacgcgctgggaaattgaatcgtttctcgacaacgagctcagggaaggtgttttttggaccttcggctccccgaagcctaagagacttttttcacggatcaagctcgttacgaaaaacgatctagcaccgcgaaaggggctactgttgggcctatgcttcgtcgccgaaggtcttacaggaagaagcggtcttcggctgaagttgtttgtataagatggccgaaggttcctcttcgtggagcttcggtattacaaaccgacttaaagatagaatgaccttttagtccataaaggtctgagtcaatgttgtaagcttttataaggggcatacttgtaatttctcacaggctgcgtcctgtgcctataaatagtgaacagtattcctttactgttcacgcattctggtaattaccatcgcatcttctggaatccaacctttgccaaggcagaggtattattgtattcaatgattcaatatattaagtaaatataatataattcgtttatgatttatttacccctttttatacctttaattttatgttgtctcacaatatgtattgaaattttattacgaagacttaagcttcgtaattttaatctcatcaaccttcgtccaaggcccattatcctcaagggaataatgtttcatggacgaaggatgttaacatttaacactttatgttgccttgttcttaattcatagcacttgagaacaagtccccaacattggcgcccacctccggtgaactcacttccactttttgagctg

SEQ ID NO: 6139 - DNA, 107 bp, Zea mays
ggcataaccattaagtaacactatttcatcgccaatttataccgcagacgaagaagaacaggagctgcagatccttcctgtgccttctgacatacacgtctgcatac

SEQ ID NO: 6140 - DNA, 404 bp, Zea mays
agtttgggttccaagtcttcatattatttctggcttctttcttcagattttagagatctatgcattttgttctgttgttacatttcctttcgttatacatcgattttctatataaatgcatgtaatgattttctgggttccttaaagtgtcgtcaagctgtggattcggtactctgaacatcttcagtaccattcctacttcagtataggtgctgttagagtgatacagaaagcataaaattgattccttttggtttcttacttcattcatgaaagcattgcagttagggcataattaatctctggctggcttttctggtgtgcagcttcttgaaatccacagtctggtcaaatgctgtgaagaaaattcctctagtgctgaataagttcagcatagaaccact

SEQ ID NO: 6141 - DNA, 109 bp, Zea mays
ggtaattacttgacatcgttcgtcgctcgcctgttactccacagccgctgggaagaacttgctaactaacgccggcgtcgtccgtgtctgaattatttatcgctaggct

SEQ ID NO: 6142 - DNA, 1500 bp, Zea mays
tctgggcccacataacggggttcagtatctttgtgcatgcccccttcagctataaaaggggaggcatgcggcgttacaagacagatccaatcttaggctcactcagacactcacaagttcatacaagctctcaagcaatacatcacacagtggagtagggtgttacgctctggcggcccgaaccactctaaatccttgtgtgttcttgtgtttcctcccagtttccaactaacaagcaaaacgcttaggcctctcctcatcttaggatttagggcgggtgcactccgccacccggctggagatttcctctccgacatgatctttgtacactttttatattataaatttgtgatccttgtgaactttttatattgtgaacttgttatatcatgaattgtgaacttgtggtctttgtgatcttttgtcaactttgttgtattatgaagtttgatatatttaccgattgtattttagattccgaccgttacctatgtattttccgcaccaaactttcgtttccgatgtttccgaaataccgatatcgtttccgtttccggagttaccgttttcgattttgtttccgataaaaaatatgaaaacggtaatggttttagtgtttaccgattgtttccgaccgttttcatccctacccgcaagtgcctttcatcatcgaatacattggtgtgatgttgaactgcttcgacagtggcagtgacatggggactgtttggttcagcttttttctgaccagctttttcgagaatctagctgttgggagaatctggctgtgtagagaatctaagtatcattaggattacgtgcggaggaagataaagttgtccatgtggctcagaatctataaagtgacggattactaatattgcgatgactcaacctattatatgtttatgttgattttgaatagattttactcaaacgaattttatagaagctagctgaaaagctgagtgtttggcaacccacagcagcttttggtggccagaagctgcgaaaagccgcttaaaggacatcatccaaccatcacactaatgcccctgttgagacccacacatcaaactgtttgcaacttgcgagcttcgtttcagcaagtgagagcagttgcagagccaaccaatgcacaggcgagcttttagttggtgttattaacgattaattgtcaaagccacctaaatcaccaccacctttgctcagcatggttgactaaacaagctgttggttttgttgaggcacaagctgctgctcatcccagtggaaggaaacctcagcctcagcgctcgcgatccatgcgtataaagaaggtctgagaagcggcggtagcagcagtcatctcagtctcacattgtcacatctccaagcagcagccagccaacctcaccacctcactcacatctggaaccgcaagcaagaatccttctccaagctcgtcgattatcctagctagatagaagctcaattggcagggccggggcacgccacgcc

SEQ ID NO: 6143 - DNA, 687 bp, Zea mays
gggtgtgtttgtttcctcgtagattatataagttgaattatggtggaaagataaaaagctaaaatatcactttaagctcagcttatttgtagtcccaaagtgatatttttacccttctatcataatctaatttatataatttaagagtgaaacaaacatggttttattggccaccttatgtggtattataatttagatatctagattacataatccatctaataatatatattgtttgtttatctcttaatttatttaagtatataatctaaaggggtaaataaaccggacctaaataaatagtgttgtttaacggataaaaaccgtgtttttgcgtccgtaccccacgtgctcctcggttcggcacttcatccaaaacctcagcactcagcagtaccctgcttcaaaatttgaatctcggagcccttcttctaactcgtgcatgcacctagtgcatacaccaagtgatcctggcgacagtacccgtcaaccgcatctactagtggactagaacgcgaccaattcatagaccgggtccacagatagaagaatccctctccccatattccttttctctgcgccggcaccgccgtctcgtctggtctgctcttccattccgttcgcctttgaaaactacccacaccacaaagaaatcgaagaggggaacagagaggagagagaagggag

SEQ ID NO: 6144 - DNA, 719 bp, Zea mays
tgtactagtgtgatactatcaggccgcatgcagattcctttcgattgtttatagggtttttttttttataaagactgctggttttcaagccttgaatcttgtagctaggtagccagaccggtcccggccgggtcgaggaagacgcaaaactcagcaagcacagttgtgctagcctgctaggcacggtgtgtagcaagagacagaaacgagcgtataaccatggcgattaactgatagctgtggaattttgagcacatagtcctccaaacatttgcatttgtattgtactattgtttatgtagcgaagtttaaaatgcagtttggtaggcctaacccgcatgcgagggcaccgcacagtgaggctgaggaacggaaccactccagctaagattccgcaccgcagcaaccctgggatcctgctgtcagcgcgggccgcgggaggggagattcactggcagcagggccccacaccccttcccaggcttcccatctcagaaaacagaagccgatctgttttgttctgccgaatcaaaagtgcgatatgatcgtcatctcttcgacagcacccgcccaaccatctcctataaatccgatcgccgccactggccgttcgtcccccatccacccatatcccacgccacaccctcacaaccccctcacgccgccatacctttccaacgctacgccggccggagggacagagagccagccaagggaag

SEQ ID NO: 6145 - DNA, 581 bp, Zea mays
ggtacgaattactctcttcaaattattctcaggactgtatttttggttgaagtaaatacaagccctgaacaatcctagtcgttcatttgcttggtgagatagagtattgtgagaatgaagttcttttatcaagacaagattcaatttgttaatttcctgaagagaagagggtttgaccgtgtcttccatgggaatatataatgaagacaagttggtctcaagaacttttcatgagttttcaaactcgaagaaattgaagcaaatcactttacgaagatgtatacaagaaattttggatctaagggctcctaatcactttttgaggcttgctactatttgatgaacatgtttgtaagttattagctatgctctatggagaactataaatgattcaccataataatatgaaagcctggtagtaactcgtgaggcacatactatttttgattgttatgtgccatcttatttgtttaccagtgccatattacttacgaaggcttttgtgatcattcagggagccaagaggatttgggttcgtggagttcgttgatgcttatgacgcttctgaggcacagtaccac

SEQ ID NO: 6146 - DNA, 508 bp, Zea mays
ataatcttcctcccgcacatcccgatccttctctcggcggcccgttggtcacgtgactcatccccctgtgctctcctctcgtggccttgtttcctggcggcgacggctggtcgagcggcgccgcccttggctaggtcttcgctgggtccttccccggcgacgagcgtccatctggtacgcctcttcctttctgtccgcttccattgagttcccatcccttcactctctgcgaaaccgagcacgccaagccctagagtgagctatttgagttccgatctgaaccaatctacatgtacataatatgtactgtacccaccaacttcgattttttttgcgaagaaaaatatcgcgtgtacgcatgttctatagcggatccgtgcgcacctgtcgtctagttgagcgaacgagggggagcagacttgtgcccctgtcctgaatttgggtgctaatttgtttgtgctgattttcaggggtcgactgaactgagcaggcagtaggaagagacact

SEQ ID NO: 6147 - DNA, 158 bp, Zea mays
ggtagagagacaggccgagctgcaaacatagcacagtcgagtcgccgcgttcttatgtaatgctgtaaccttttcccagaattctggagggccattatcataacaagaaggtttttagctgcagggccaccaacgccgaattgcaaaactcagcaaaa

SEQ ID NO: 6148 - DNA, 492 bp, Zea mays
attattctgtcctgtgctctaatgatgctcggaatgatgatggaactccccgtcagtgcgcctggttaatcacaagtaaattcatctcttttaatttgttctctctcttctccgattccctttgcacttttcttttctgcggagagagacgaggaggaatctgaatgtgtgggcgagtgttgaaagaggacgaaaataaatatctgacgagcagaggaatgctcgtatatatatgatgcttgtagaaaaagatcccggtgcagcaactcgctttcggccccgatcgtcttttcccctgctgccaaggtccaaccaaacacgatcggaggatagggctcccctcccggcttttctatccctccctctcctctgctcctgtgctatcctccgttcatcactcccccaggatcccctgcagctaccattgctacaacacgggtacagtacaggtgaggagggagaaaacaaacgaacgaaataaagagagtacgc

SEQ ID NO: 6149 - DNA, 913 bp, Zea mays
cattttctatgttgccttgttcttaactcttagcacttgagaacaagtccccaacatgcagctactagctaagcagggtaataagtagcttccggaaaatgacatgacggcatcatgtgaacacgacccggaaaaaacggattttcctcctagaaaatgaatagcaatttgtcaattcatgtgaacgctgacgaaaagataaatatctctcccaccagcttttgagtaaccccctcggttactgcaaatttctcactaccgaaaacaaaatgcaggaaaatgggcaaaagatagtaaccgcagcaaattttgcgtatatccgggggcctcgcgaaaaaggatcgctctccttactctgtattaacttctggcctttagacattttctcctccgtagattgcagaagtttttttttcgcttatcagtatttcggtcgagaaattcgcgaagggattaggggaattcgaggcagggatttgcaagaatcagggcagtttgatgttgcttcctgtgcgcgtcgctaatttctctgttttattcgcgtgatttttagggttttattttgagtttttcgttttctccaccgtatttcgttggcttcgttccgtgctactgtaaattcagaatcttgtcagagaaaagagaaggaaaaggaaaaacaaacaaaatagtaaggggaatttggtacctgggtgtttgctgttccttgagtaagtatactctcctgtcttcagtacgcttattaatctcgcagaattcatcgccgggacgctgcggcttgtaattttcgagctgatggcatcttgcttgctgtctaggttggtgaatctttggagtgcctggctccgacgagatcgaaaggagggacctttccttggttcctctgctggagctgtgattgcagaggtgaacc

SEQ ID NO: 6150 - DNA, 667 bp, Zea mays
tctagaaagatagtagctagctaatggacaacgtactactgatgataacagtacttgtcggcatgggaccatccattgcccatgttcaagaaactagagcactgaagagcatgcattctctatccattcacacgccatatgcatgattaacttgctcgagattattctttgaactggtggttagagtaccaacttgttgcaacattttatagcgaaaaccgccagctgaggtgatttggcatatcctacggtagggaaacaaatttttatatatatacatctctgaactgtccactccatagtacttcaaaataactccaacgaccatgtaaatctctcttacgtatgagctgcactgcaacctacgcgtgcttgacttgcttggtagtcgaccagcaattattgtaagggattggccctcatcgcactgctgtctccggcccaatgatttaggcttctcatcaatggattctctgtatgaccattgacaaattccaaaccgtggcatgtatagcctccgccaaagaacccttctccttctgcttgtataaagctacctatagcagaagaggctgatcggctgagctcatcgcacaaaagatatataagaaccaccaattggtaaccacaagcaagcaatatatagagagtcaaccttgcagcggcg

SEQ ID NO: 6151 - DNA, 536 bp, Zea mays
tggttttattgtttttagaatatatttagacataatgtgtaccaagtatatctagaaaaaaatataagttagaataaagagaaaatacttgaataaaaaatcttgtttaaatctcatttttttaaacctaattcacattttttaaagatccacctgcatgaccttattgatgttcaaatgtcaagctagctagaattgccatgtacgttgtggcagcgagttcgaaaatgattagcaggacgccacgaatcacgctaaatttatttatcttctactgttccttggccggagatcgactcatcgcgtgctgccacgaatccaacacgcaaacccccaacgtgtcagccggctagatgcgacggctgactatttaaagcggtagatcgcgcggtcgcatcacggcatcgttgtccacgccgagtcgccgactgatcacttctcttccagcgagtacacacatcacacagcgaagggcagcgcatcgtgctgcggcggccggaggtgatcgacaagcacctctctaggaataataaata

SEQ ID NO: 6152 - DNA, 58 bp, Zea mays
ataatcgttagttaggggtaagaggggaatcttatgtccatattatctaaaaaaatat

SEQ ID NO: 6153 - DNA, 355 bp, Zea mays
cccgcccggatgtcgccgtacgcgcctgcgttgcatcggttcgtgcacggatgaggcccaacatcgcacggcacgagagaacccctcctaggctcctactctctccctagtccccgcgacggcacaagcgaccgtccccacgacggtccagactccagagcctgcagaccccgacgccgctcgcgttcgggaccgtaccgccctcccctgccgtatccgcccacacaccctccctccccgccgcttccgcccggtatcccccactcgcgcggccgtaggacacggccacgtgcgccgcctcaaactgttggtgctgtggctggggcgagaggagcggcggcgttagggtttcccc

SEQ ID NO: 6154 - DNA, 140 bp, Zea mays
cttgcatgcctgcagccgggcgacctgatctataccggcacgcccgaaggcgtcggcgcggtcgtgaagggtgacgtgatgcgcggcggcgtggacggcatcggcgaattcgcggtgcgcgtggtctgacgcctgcccga

SEQ ID NO: 6155 - DNA, 74 bp, Zea mays
tagttcgtgcgagttgttaatctacagtatcgagaaggggaagggggttcctttaggccgtaggttttgaggag

SEQ ID NO: 6156 - DNA, 1500 bp, Zea mays
ggtttgatgagtatctctagacgtacgtggcggcctatgcatgcagaaatccattggcaaggaggttgcccactttcaagtttcaatggttgcatccttgagaaagatgtagcatgcgtactacacgcaatttgcatcatttgatgtcttgatgatgaggtgtcctctgggttataaaactagccactgtcagggtcaaggttcatggctagcatgactctacgtgttcctcttctagggttcgcaaaaggctaaggccatgtttatagatgagctaaaacaactgtgcatgcatgcactgcccattattattggtagcatactatattcttcacatccttttgagccatgaaaaggtgtgcgaattgaagcaaacaagactctcctgcacatgctcaccaattacactgatgacggtgcacgtacactgcattgtcacatgcatcgatgcatatgcttaatttgctgcagtatcgatcatatatacgtacatgtatctgcttgcatgccattgccatctcctctaccaaaaatcaagcgctaataacggctctatcaagcaaatagaggctaggagatcctaacctcgatcagctcgatcagttaatcaccctgtgtgtacagtgtacaccgcattttggtacgttgtggtcgatcatgatcatgcattgggacctctctcagtgaaaattaagcattatctttatgttattcaagttcatgaactaacacatatctaaaccatgaccactcaacgaaggtattaagctcacgtctagtgaccagtagagcttatgagcatttgtgttgtatgtagaatatatatttttaatatatagatgaataatctaaaaattctaaaaaatataattgtaacaggatgggtcagcactgcaggccgagaagacgacctcaacacagaacggttatcggccggcatggcatattcatgttttaattgaatcgtatcgggccaggtcgtggcactattaaataggtcatgtctcgggccggcccgctagataacccatttggccatctatagtccagtacctcttccctcactgtctctgatctcgcgagcgtggaaaaaagcgagagaaaaaactccatcttgtctaaccctacaccacatacctcgccattcgtactcacctaatctatagatttggatcatatttgaataactatcatatttaggcaatgtctacctatatgatatatagaaattgtagcgatgcacgtgcaactaactagtgtataattatgtgtcttttgattatgtcttctataagcagtgcatatggtgtatgctacaaagttaactatgcactcagatgattcaaaatagtgatagggttatgtgccctctgccagtgtcttatgagattgtacagtgctatgaaggcaaagccatcacagttttcccctcaacaacattttgagatactgacttgtttttttcttatgatctactagccagttcaagacccacaaaag

SEQ ID NO: 6157 - DNA, 391 bp, Zea mays
tgtttggagcccttgttttatgaaccgctcgtggtgacaaaaaaaccctggcccagattacgtacgcggtgtcaggtgtcagtacaagatcgaggaaagcatgcattaacgaggtgcgtaatcaggagtcacgtcggtacagcttgggcgacgagcgaggcgcggtgccccggcctgggcctgccccgccttaaatcgcacgcgcgcacatacacacatgacacccaaccgcgagctctcatcgacgttgacgcgtggtacacaccaccatgtacacgcactgtgcaacggtcgtatataagtatgtcaccgatgcgtcgagcggccacacagcccggtacgtacgtgcaagagacgagcgtagtaacaactgtgagcagctagcacatgc

SEQ ID NO: 6158 - DNA, 94 bp, Zea mays
ggtcagtgatcagctgcatctgcatctgcatgctgcactcgcagtcacaatgcgcttgaattgaacgtgtcactgactctgtcgtgagcatgcc

SEQ ID NO: 6159 - DNA, 1500 bp, Zea mays
ttctttactttaaagtatatatactacaaaagatgttgtatctacattctcttgtatgagccctgccaaacaaacgttaaaaaacgacttcttacaaacaaaaaaattaaaaaaaagagtccagaggacccggagctgttttctatatagaggtatcagcctaatacaaatcattacaaaacttcactaaaactaattttgtcaaacattttttaaccggctctaccacctctaccatagaagatgctatctacatttaaaaaccaccttatatatatgtggagctatgtaaaaggaaaaaaaaaacaggtgtgatgttgacgacatgcgcatggcattatatgcacatgcatgcgcggaacgaaggtacggtcacagcagtggggcctgccgctcaaggaaattaaagccgtcgatcaccatcaatgagaatgaaaaaggcatccaacttttgtgcaaccacccgcatcaacacaaactaattaattaacgtttgcagcttagatttaattgctgccatgcatgaaacgatgatgatgatcctaagggcaagtttaataacagagccaactgctggctatttggcccatccggtatagcgcagttagttcttcagtattaaatctatctatttcataaaatttcttagttcatgtgtcaaagtcggatgtacgtttacaacgtatttcttctctttcctctcctcttctctctcctccacctcagcatttagctagcttatagcatcttattatacttgttttcatgaccaagtagtatatatctgaatttcttcattcgaaaccactaactatgtattgtacgagctgaagtagttgcatgtacttttttttgtttgtttgaatggtgtctcctgccacgcaggtacaaactacgtacatgcatgggaatgcatgcaattaactgatcatgaacatacatgtgtatgtgtatccattctcttccacaccccatatcatatcatacataattcatatatacctagcttctagtcagtagaccgtctagtcagtcgatcgtctacgccgtaccccagatggagacagcaaataataaagctgatcgattgctgatacaatcatacaaacaaacaaaaatatcagttaattactgaccaatctcgagttgaaaaaaaggggcaaagactttgataactgcatgctttgcttgctagtccacacagtaggtactgacagttgggattggttgtagtttcacctttcccctgcttaatttgtttccccaaccttctttctgccctatatatatatattacacacatatattctgctactactagataacgatagaatgatccatgacgacgacctcagctcaccaacctttgttttgctacccccatttcttctttaatttgatcgagcttgctagatagatctcggtgacgtccgtccgtccgcgggagacggtggcggcatcagtaaagacttcgacgatgagggctctgcagaccagctg

SEQ ID NO: 6160 - DNA, 546 bp, Zea mays
aagcaatagggagcaagcctagactagccgaaagagcagagcgaagcgagggagggagggacagctccgagatccagctccaggtccagcgcgaaggagaacgcgacggagatggaagagaatgcgacggggatggaggagatctagcgatggagaactgacggcgacggcgctggggacggaacccggtttcaacgagactaatactgctctaaatctgttaatagagtagtcatattcattttagagtgttggctacgcctagttttttcataacggagaaaccctcttctgagtctctatttcgtcgaagccgcactcgtcgtgtttcataatgtcaaatttctctttccttggcgttgccgccccaccaacaggacaagacagcagccgctgccgttgccgctgccgctgccggctgccgctacctatgctcaagtgctcagtgctcaccgctctgcccctgcctcatcacacgcgcgcacggcgcacagataccttttctctcctctcccgtcccactctcctgggcaatcccggcccggc

SEQ ID NO: 6161 - DNA, 1500 bp, Zea mays
tgcagtcattggttggttctagcaccacttgaaatcggaatctgatcttggcagacagattggtgtgcagaccttatcggaattaccgtcttcagctgcataatttacgcacggcagacaaatggcatcgcaagatcacagctatgaggacaggtcaatttctgtcccagaatactcacgcaaagacttgatggtgcgcattacaaaggtatagatcattcgtgtatgcaagttagtggtcatattctgatatccaaaacgcccactgattggtgcttgctctagagcgacggtgatgaagaaaaggctgaatgttttttttttcttcttttcattgcaccaggtagctttatctactgtaccctccattggttttccttgaagttgatcagatctgcggtaagatttttggctttcagaaagaagaatatacgttgtaaacgggcaaaaacgacgtcaagcgccccttctcattgagacaatgaaacagcatgcatggggaaaaaaagagagaggtctgcccacgctccatgattgttgaggtatatatagatctgacgaattcctctctcttttcagtggtgtgctgactttcacatgctttgttccttgtctgttttggaagcctcctcattacctcatctagataacattgacattggccttattatcctttttccataaacatatggagttcatgattatatacataagtattttctgtgatgtgtatttttgtttcttttgttcttataaactctccttttttatatatataaatattcatcagtaggggcctgttacatgagaaggaagcattctcagtgacgaaggcctgtccggagaaaatcatcactgttaataggctttagcaccacttgaaatcagaatcaagttttggcaaacagattggtatcggaatttccgtcctgggtttatattataatttgctcagtcgatcgcaaaagctactgcaaaagatcgccgtcaccgctataagggcaggtcaacttctgttacggaatcagaacactgaggcaattaatcactcgtgcaaagtacattctcgagttgaaagactaccctccacttgttaaaactgaagccatatatgtatgtagattccaattccaccagccacagaaagccctgcatatttctccaccgctccttttttttctctctctctctctcctagtagtatatatatacacacacataaatacatgtttctctcaggctcacaaagtcactcagttgagagaaatacaaacatctgagtctagctcctgacagtcacagacctcaaaactgttctgcacatccttcagctcctttcttttgcagttgcagacttgcaggtaagcaagcagaacagagtggcatggcacatctctcaagtcccaactgactgcctgccatggtagtgtagtgtctgagttctgaacagagcaggcgcaggagaagtgaaacatttgttcacttgtgcagcccaggtgc

SEQ ID NO: 6162 - DNA, 756 bp, Zea mays
accaatttttagaagtgagtttttcttacacccgactacccgatcgagtgtagctactcatattttcattgagccgccgtgcgtacgagtgcatacttatttatcactttgagtattttttatatacttattgtaagataatacttaccaggaggtgggagaaatttaagggagccaatgatttttagcatattattgttataatactaaagtacaatagtatagaaaataaatacaaagactctatatatacattttgtcaatctacacacactaaattttagatactacacacgataatatcattaataatatatattccattagttctaaaatagtgttcgttttatctctatatttttatgtctatattaactaaatgataataaatatagatatatttatagaatacatacgtcaagtattatattgtatgaactcaatataatattaaaatgaattttattttgtgacagaggagagagtatcaaacaaaactccttacacgatctcttcctttgctaccggccggcggccagaagcggccgatctgtccaacaagtccaagccgcgttgtcgctcctcatcacgctctctttgctggccttcgtctttaatttgccgccaccgcctttggcttccttgctcccaaagcatggtatttaccgggccccttattgactccccaaaccgacgtgagcaaagcatagtcacacagcgaaggtgtgagcgagcgagacggagacagagagagag

SEQ ID NO: 6163 - DNA, 1500 bp, Zea mays
agtggtggaatgtcaaattccaagccaaataatctactttattaagtaaattccaatttctccaaaatgaatagatccaaacggccctaagaggaaaaagatgacatcgctccctatgaaatacaaaccgttggctatatgatcttaaatagtggcataactgatgcatgaagtagcataaggaaacatgatcattcaaaatttaggggaggactgacatatatgcaatcaacgtgctaatgaagcaattgcgaactcacctgcatcttcttggttctctactaaagagttatgaccccaggtctgatttaggcaaaggcattactgaaatgctggcaaaataaaaaaaccaatacttaagttagaaagattcagtaatatagacaaaatgaattacagtgagcttttcacggacaacaaaataccaaaccaagataaacatcatggaactagattcagatagttattggcaataataatacaaaaaattcatgaactaaccactcagcaacaagttctcataaaatgggaaaaagactggcacaacaaaagaatggtcccctgacaacatagtcaaacacatagaatgtttattgatcataaatattttctcctaccatcatacctagtgaaggtagattaaatgtgttctcctaactgtagagccagtatcgtacaaactcatctgcaatgtatgaatcacactttcaagatattaattaaatcatgccaaggtgaagcatccacaacagtgtgtactaatgaagaaaccaagccaatctaccccagctcctcttcaacttaaacgccggtgccaccgatctgggtatttgcctgcccaatcatcagatcgaccatcgttcggcgggcagcagtggactcaggatgccagccaaataccaaaaaaacgcgcaccggaaaccagtcaggaacttcaattcccctaacccgacgacatgagccgctacttccctcaacgcccttaaatattatctcaaccataaccgtatacgtattgaagtaaagatacggatgaaatagagcgtaccaaacgaatcttgggcttatggtgccggctggtccattccggcgtgggaaacacccgtcgggaaatgtttctacggagagaagggaggaccggaggagcttctgctgtgacggtgggcagtggccgtcggagaagggagttgggggaaccgtgcaaggcggaagaggcggcggtgggtcaggcccagcccaggtgcaacctatatttggtcaccaactcagatagccagccccaagtacaacttggactccagcccaaaacgtttcttcttgagaaacactccgctctctctttcctcctgcgattctccatctctttccctgctccgtctcgtcgttgtcttcccctttttttcctcagccacctctctccctcgctagagcaaaaaccttgccacgaatcgccgacactccaacccggaagaggcaacgaggtgactccgcgcctcggtc

SEQ ID NO: 6164 - DNA, 110 bp, Zea mays
actacatgtcataatatttcacagctactgtgacttattcgctacagcaactacatgagactcactactgctttggaacctatctgcgactgcagatcattttattataa

SEQ ID NO: 6165 - DNA, 1500 bp, Zea mays
tttcaataatagaaagtaaaaaagattgaactatcaaaatgttttatcttctatcatccagaaactgaaagaatcacatcaaacaaggcttagcatatgtaccgacgcagagttttataatacaaatgaacacaaaacaatcacgaggaaaaaatattgactgactgaataaatgacaccaagaacattttcagaaaaaggagcaggaaagagaccaattttggattgtttgtcgccatttccacaagcgtctcatccaaaaaaaattacagaatacacccaaatagttcaatcagtaaaactgaggtatttatggtttccattatttagttggactggaaactagtaaagtcgcacagccaaatagccctaaactttagcagctttttttagctacttttagtcatttataatctaaacaggagagttaatggtggtaattgaaactaaactttagcaattcaatttatatagctaaagtttagcaggaagttaaagtttatcccgtgagattgaagcggggcctaactctttcgttgcaaacgcattggctggctatagccggatcccttgaccagtgtgaagtgacgcatgcaagtcagaaatgtccacaccgcgctccacagattatttcaactggacaaaaaaaaatcaaggggagttgatgtgcttcggattaaaaacaattattcaaattgctgcagatataatatatagagataaaatattgtaaaagtagtagaaatcggtgacaagcaacgggctgtaagactttccctgcagctgcaaggatccaaattaaccactcagcgtcatgctattaattatcaaacgcatttgtttggttggtggtggcgtgatgccgtgatgggatggcgttgtatggttctgaccaggccaaaagcagcactgcccattgccgttacgagttactatcgtcactttcttccacgcactgcaacaatcacatggaatgcatgtttgtactgttttcagtttctcatatgatcatcgtgatctttaactagaatatttaacagcggtgaaggatttttccatgtacttatttttttttcatattttagagtacacatgtgcccgttcagcattattacgtattctcacgcatgagaggtctagcatctcaaactatttctgtgtgttatagacgctcacgcttgtgtgggtgtgatgtagtatatgtcgtggtgtaggttcgtggcctcttgtacgccgataacaaagaaaaattacgcaactactcggcagcgtctgctgcgtcctctcctgcccgatgcgcacccgtcactgcttttacgtccccgtggcccaggccacaggcggcagcggcacatttccgccaccagctaccctgccttctctctcctcttctttacacctcacctccggatcgctcagagagtcagagattcgagttgagctataggcgtagccgactggtcgccgcgtcccctctcggctccacccggcgagcgaaca

SEQ ID NO: 6166 - DNA, 947 bp, Zea mays
tattgtttatattaaaatgaatagcgtatgttcatgccctaaaattacacctagaagtttatgcaaaaataataattttatacatatgtttactgctatagtgtaaaccttttagaccgcctaggcgaccgtctaaatagagggcgactgatcctttaacgtttaggataacagtgtgaatcttctcctgctattgaacactaatcttggtagctattgaactctgctttctctcctttcgctgctgctgctgctgcttttttagtacaatattgcattcttcttcttctgtcgactgttgggtactctgttcactcggttttttttttttttttttttgcatgcatgactggttaggtttcgattctggctggttcaactatagtctgttggcagtagatcattcttgcaagcatgatccaagcacatctccagaagattatattactgataagcattctttgatgtgaaagtggatagctgaagatctcgttcatgagaagccaggaacttggttgtttgaggttggggacggccggacgggtacttcaattcaatgaccttgtcaacagaagcatgatctaggcagtggtgtctaacgtccctagaggatctacagctgctggtacaatgtgacgtcgacgagcttgacgactgcctgttcaacatggatgaactgggcaagttgagttgagtgagctcagggtgctcgtggtcagggccattgagatgaaccagactaccagagcacgatgtcagaccttctgcagtccgtagcgaacctccacaagatccagagcctaaaactggagaaccagagctttaggcatagaacagatcttctgcacgtccaatcatgaacagattttctgttcgttgggatgtcccttgttttgcttggtatatagtccatacatgatacgtgctgcatactttgtggagcatag

SEQ ID NO: 6167 - DNA, 163 bp, Zea mays
cagcccaacgatcccacggcccagattccgttcgtcgatctcacctcacagttgcacggcagtgtgccccagccgggctgctttctcgcgctcttcaaccgctgaggctgagccgcgcgcccgcgccgcccttcgtcgccttaccaacgaccgaagccacacg

SEQ ID NO: 6168 - DNA, 451 bp, Zea mays
ctggctcgtgggtcccagcgaagcggctggaaaggttgctgctcctttcggcgccgctagcttgcacgctatgcagcagagctggcgtcacgattgacgcgagagttcactcacatgggggatggagacggggtgtgcaccgtgcacagcacagcgttacgggtggtcccggcgacacgtcaattgtcgcggcggatgtgccgtgtctcctccctcggccacccgctccggatcccaatcccaacccgatatgctgtctctctacggttacgaacgacccgctccattttctcgtgtccggatcacaaaagcccgacgtaactgctccccacagtggtctccattttcttcagccttcagtccctgaccttgcggaaagaccaccacaccacacgcacgttgctgtacctgtagcccaacaagccctacacctctcagctctcggtcacag

SEQ ID NO: 6169 - DNA, 1500 bp, Zea mays
gagcacctctatgccctccaagcctccatgatggaggccggggactcgacaatcatggcccgattcaccacccgcgtgactggggacgatgacgcccttgagtgcccttctgttgcctcctcattcatcacagtaagcctctgcaacatcgtgcttgcgtccctcgctcgccagcggaggtccatgccccactcacagagttcaacctccttcaacaggccaccatatcacagcgatgaggatgccctcttccccgaccaccagatcgcagcgatggagccggatccggtcgccgctggggcatcctcctcgccagccaggttggctccgcatctgatttattcttcgtctttttttttctctgctggcttcctgctctgcaagaagaagcaagtgacacaggtgcatgcttttgcttgctgtcgcagatgtccttgatggcaagattcagcaatcgtcaagtacaaagacatcctcccatgcgaaattcaatttgcccaatcctaatctcttctatatagcctcacagatcgcagcgatggagccggatccagtcgccgccttcaccagcgccggccatgtccccgccgtggaaaacgcgaggtaytgtttcttagtacttcgcatgggagcatatttctttaatgcatttcttctatatagcctcacagatcagcatggttattgtaatgcatttctttgatgcggggtgcatatgctaagcttgtatttaaacattccctaaaccatctttcatcaaggtactttgtcactaatgcagcctataacgcttctgatctttcatcaaggtgcttataatgctttgtttgtcttttccttgcaggagcatatttttttgccgataatctgatggcaaaagcaaaatcatgaaattatgatggtcataatgttctatttctgaagtttattgttagacagtaagtttccggtgcaatcaaacaatttattgttactattatccttattagttctacaatcttaagcatcctccaccagctcgtcagctctgtgactccgtcgccggtcgccgtcgccccgagcagagacgtgcgccagtgccctatggagaatagaaatgcttctgtttcaacctatcaacgcggaaatggttgtgtaagtgtgctattttactgtcaggtttaggtgcttgattcggcagaaaattgtttaggcatccgacgctacggtttggggctgagatataaaataaggtccagcacttgtagatcaagactgcaatccagcttatttctgaatccaaattgtaggttgatacgtcagtgtcatgaaattgaaaactgatagttgtttttccaaaactgatagttgtagatcaaaactgatagttgtagcataggcgcaggccaagaatcattttctgacttttctgcttctatatgtcacttggttattcctgcacaacattatctggacacgtatatttatttatttgttccattttttcatggaggcagattg

SEQ ID NO: 6170 - DNA, 625 bp, Zea mays
attcatgggtccaacattcaccacattatcttacacttagttgtaggccactttaggaacatattttttatgccgcttatctaaagcatggagttcccatttatgatttatgtcacttacgtatgatactatcgttatctctcctgttacttgtttcaggtatcagaattcctggattccaaatctgagacggatgttgatgttgactataacagcttgtactcaaagcaggactttctacagggtgaggtgctcgtttcgatgtggctagagtaacttgtgtactctatctcatcgtttttaatttattcgtttatatatatatatatagtgtgatttaatatggtgtaatgtttctcatcctaatgacaccccaaacatacattcttcttccacggctgggtagccaaacaatcccacaacagtaaaattcttctaccaagtgaagaaccatggagaaaatgccttcctaatcattgttcccgctttgcaactaacatttccatttcccgccacactctcccgcgcagcacccattcttctttccctccacttgccgctccagttgcagttggtcgaaaaaagtggaaaggaaaggggcaaaatatcctagggttctgcctcc

SEQ ID NO: 6171 - DNA, 630 bp, Zea mays
ctttgggaagtgctgatcggaactcctgtagctcaagtgtttcctagacagaaacagcattacagaagttccagattggtgtaacaggagaaacaaaataatgatagtctcagtagattgttatcaccccgtgggtgtgaccttatagctgttttatgttgttgcatattgatacatcatatatatgtgtatttatattctgaaagggtttattcaacagtctttcatttgacagtaacattttcaagcgaactaggtacattattatggtgagattatgtaaacttcatattcatatatttatcgccgttcttattgcgtccatgtacctcatctaatgatatggttgtgttcagatttttcttcttctgtttctttgtatctggctgactgtttcttcgctcggggtgctatctgagaggccatcgccctcgtcaaatctcagcagccaatgagcaccacccagagtgccaggtcgtcagcaacgaccagataaagaagtggatgagatgccacttcacttcactccacccctgcttgtattgtatcctcgtcttttcccttctctccgtctatttccaagctttctccagatcaaatcagaaaggggaagggaagaacggcccagca

SEQ ID NO: 6172 - DNA, 1023 bp, Zea mays
actctaattcatatgtgttaagattcatatgtgttaaggtagatttagatataaattattataccttaatttatctcaacacatgggaattgagatcaatactaaaataacaaaactaggtctaaggcttatttgggagcacaacaaagccatgggaccgagtttctgctccctatcgtgtcgtacatgttctcccgcctgagcaaaataaaccgaatcaaatcaatcaaaatcgaaaccaaattagttaggctatccgcactcgtggaaccctaaatttctactctaaaaggaatatttcatcctagtcagcgagattctctactctataccacaatcatccgcggtcacaattactctatatatctaccctataccaactaccatatattatattatatttttcccacactattctatcccaccgcgcctgccactgtctatccctccgaactcccaacagcgctgtcagccaggaacagtacgtagagtagaaacgagcgtacgctgtatatagcgttcctctctccttactgcgtgatagagtagtacgaagagtttgccgttgcagttcgtcgcgttactccatattcgacgctacctttgtagcgtacgtgatcgagtagatcactgcggacagccttagaaccaaattaatcgttggtttcgtatctttaaaaatcgaacaaccaacgtaattttggttctaaacattagaggatcgaattaatcgtatttagcccttgcctaatacagtattcttaaaccctacgtatataagcacaagtacaaacccctccaaaatccaactcctgcgacgggtatttgtgccacacctgcacccgttcccggcgcctcccgttctcggtggcccgtcccccccccccccctaatcctccaactccaactgtcgcccgccggtagccgcgctcgcggcagtggacctcgcctcctgcgcggctgtgcccagactgctgtgctgtttcggtctcttcggttggcagcagccacgccgggaacaag

SEQ ID NO: 6173 - DNA, 106 bp, Zea mays
ctttcgtcgtcgcagtggtgtgccatcttatcttattgttcgagattaattagcatggataggatgctacgtcgagattatttttttgttttttcagtgtgatttg

SEQ ID NO: 6174 - DNA, 150 bp, Zea mays
tgtttaggctggtgccaatgcaggctatagtgagggcgatagcgcccagcaggaggcgagagcggggctggaggcgggcgagagcgacccggcgggcgctactgctaccgcccggcgataggcaggcgagagcggggcgacgcgttggcg

SEQ ID NO: 6175 - DNA, 1248 bp, Zea mays
taggattattagaatggaattcaattccaaggatccaaacggggctaagatgaaattaaaaattgaatgtatttctactttgtagtagggcaaaatgggaagaacatgtcatatagtggtcccacaaatcctttgttcctctcatttccctcccttataacccttcccctgtgatataatgtggtggccatgcacattataattgtgatcccagtggcacaacggttaacagtgccttggttggatgcacaccatggaatacatgatttgctcaaatgacactgggtcatgcacaaagtcaatggttacgttactaaaggcaccattgcgtgattttggtaatacagctagtgaataccagtgcacacgatagatatgccaaaaggaaggcataggatgccaaagtatttgtgaagagatatgttaacatagcctaaggatatttatttttgactacgcaatagcggcggacaggttggcgagcgagagaaacatgtgaggtccaaggttaaaggggtaggagagaagatctaacggctaggaatcaatcgatctagagaaaggaaagaaaatacatttcatagttccttcgaagttacgcaatctatatcttccaattctacccttggcatatcttcaattcctattttacttttaatcaaatacttttgcatgtttccatttgaacacctagagtcatcggacttatatacatggttctactaaaaaacatgtaaaatatatgtgtatatatggttgtactaaaaaacatgaaaaaagacctaaaaattaattcacataaattttctatatcatatctcactctaaactccaataaagtttgccaaaaaatgccttctttatctttttttcatgatcgagaagaacggagcacatatgtgtcaaacttcatacacacctgaatagcaatagcaataaaaaacaataatacgtaagaaaaaaaatcaccgccaaaaaacattcctccttttgataggggcaaagcgggaagaataagtcaaaacatcgacccacagacacctcgtccccctcgtttccctcttcggctcctcccttatatctctcgccctgctttcgctctcacaccacttcgccacaaaacccaaacccgttccacccgcaaggactctcttctgggaagagtgggacggatcgagctcgaccccacagaggtccgtccagaccctcctctccggcatagaaaggagacgaacgctctttggggta

SEQ ID NO: 6176 - DNA, 274 bp, Zea mays
cactgtagatttttccgataagtagaaaccaaatatttcaccgccacaaaaggcttcatcccatcagttacccatgtagcaaaaccaaaatacttgtgtgcgagaggccaagagcccaaaccaccgccaaggaaacccccagcccaccaggcgccttcctctataaataccctaactccggtggccgaagttcctcacccattcactcactcatctcaaggcctaggtagcaccgtagcagctactagaagcagctagccagaacaactcgtcc

SEQ ID NO: 6177 - DNA, 1500 bp, Zea mays
tatatttcccgctcgaacgaaagcaccaaaacataatagtggtctagtggaacatttaatcagctgagaacgggttttgcctgattcacacacgttaagttttgaagcaaaagaagcactacatgctacgtgcaaataacgttataggattagagattagacacccagataacgagtaagacgtgtatatttaacgtcgttaccagctagcagattaggtgtatgcacaaatttgcgaattttgcactacaggattaactttccatataacacatgaaacgttgattacgtgtccacacggatgaagacaatataggtgcaaatttgcgtcacacggtccaaacatcacatgattttgtaaattatttacgttacgttgttaaatttccatgcaatatacgtacgtgcaattttacgttataggattaggtgccgacgtcgacacggataaagacaatatttgcgttacgagatctaatcattacacggatttgcatgttaacgttacagattatacatgtgcccatatggataaaaacaaaacatattgtgtgaattaaccgatcgacttatgactgattccaaattaattgtgcaagaatctgagacattctacacccgccactttatataaaacaagtcgtcaactatttataagaatttgtttttgaaaaatagaatacgaatacgaatttatcattcattcagccgtggagaggtctgcgggtggagtgggactgggagggggggaatgggaatcagacgaggaaatgcagcatgcagacccgacccgtttggccttaaatggctccagctgttcccatccaaacccaacagagggactgtagagtgtagagagagaaagagagagcagtcatggcctcgccgggcgccctgccctgcttaaaaacctcggcccttaattcgctcgcaccggttactactgcagctcctgcttcctcacaccactctccctcgcctgccagagcaggaggaagaaagattggcaggaaccaacagttcatagaccaaggagcgcggtcggggaggaccgaagagagacagagagacggcgagggagcttgcaggtgtaactgttgccgtggaaacgggagagcgatagagagagagagacgggccgggacggaggagggtcgcaaggaaggaaaccaggtggaagctagcggagggggagaaatggcgtgaagcatggctggatccaaggtttcgcctttcgcgatatcctgcctattctgcagcgttcgtctcgagttggaaagcggctaccacgcaccccggcgctgtcttgcccggcctgctcatcgtcgtcgtgtataaataggagcagagggggggccagggcctcagaagtcactgcagcgtcacagctaagagatctctcctcctccacctacagctgtagagcgagggagcgagcaagagggagaagagaaggttggtggcagtaggtgggtgtggctagccttcagccagccggca

SEQ ID NO: 6178 - DNA, 455 bp, Zea mays
gtccttcgtctctccatagaaaacacaccagctgcttctcgttcttccgcgtcgtacgtaccagtaccaccctcctggattaccacctccatagctttgatatctctcatccatcgattccctcctagaatccaatccgatgcggcggccaccacccccgccccaagtggcgtcctcgtgagaggttggcagcgagctacatcagcgagaagcctagggcgcgcagtatatctcggaatgtgctggctcccaacagccgcgaagcgattctcccctcaccctcgaccacgagccgcctatataaccatctccatggctccccctcccaacccccaccagagctagcggcatcactgtcatcgagctcgaccgacgaccgtcgatcggtacccgtcgtcgtcgcggcgtcgtcgacgacggcataataatataataaccaggccagggcagggaag

SEQ ID NO: 6179 - DNA, 481 bp, Zea mays
ctcacccccgccaccctccgccgccacagtgactgacgagagttggtcggcccgttgaatgctcgcattcatggagcccacctgccgctgctcccgcgaagctggcgcaactctctcgctctccatcaacctatccaccaccaccaccaccaccataacagccttttttcccattagatgcagtgtcgttttcctttgctgcttaaaattcgcaggattcgccgaggttttcttcttcttttcttccttccttaggcattcgttcgtgcgccaaagatccatcgaaggctttacgagactgagggagtcaagaacgcaccatgctaccttgtccctttcctctcgctgctgccatttttcgcccctcgttcttccttttccctggcatggtcatccttgtcatgtcgtcattgtcgttggtgccgcagcagaggatgaatggttcgggtattgacttctgtccattaatgtaaagccttca

SEQ ID NO: 6180 - DNA, 1500 bp, Zea mays
gatagctcacgagagataggtatatatatatccttgcaagacacgtctaaatataaatctttatgatgaccctattttcactactactcgtgccacatgtcttgcatctaccaaaatagataattctaagagaacaagtctctttgccttatagaataaactaagcattttaaattaatgtgaacatataacctatattaacaaacaaactaaaactaaaactaaatctaaaactaaatattattactaacaaactaaaacctaaaaaccaaagatactaaccaagattaacctaaacataaatatgccaactttccaactaaataactaatctaaatatagagcacatatacaactacattcaaccaaagtttttatcgtgtttgacctacctaaaatccctaacatctctatcaaaatatattttccctttaaaccctagcaatcaatgacaggtcagtcgcaccatacggtatggtatagtatagcgcctggttagttttgaaaaataatttttaaataattagaaatgtttttttaaaaaaactcttttagaattggaaccggggccaagaacatacatatggtgcgcagcgcagcgttgcatgttacggccacgaaccacgatcatcaacaccatgctcccaaagacctaccaggtctcgcgcctccagcctacccatcattccctcatctgcagccagccatccttgcgacgccacgtggtggaaaccatatctatattcatgaaacctcaaccaagctttccctcgagcgtccttggccatcactagtcaggcatcagctaatcagcaatgggataaaaaaaagcacaagtgaggtccaggccaaaaaatacagacaagtacggaaatctcaaatacgtacttccactgtacgccgcatttaactcgctatatgaaacctcgccatggcatgttagaagcatcaacaggaagaatggtcgtgaaaatcttaaagctttctcacaagaaaaatttagtgtccagaggaggattggaggaatactgacaaaatacgcttgctgcgtatgaatgaaaggaggaattcaatactgacaagatacaatctatatgcgaatgaatgaaaggaagaactcaatactgacaaaatacactcgctgctaatgaatgaaaggaagaactcaatactgacaaaatacattcgcggagttgcggtgaatgaatgaaaggagaaactcaatactgacaaaatacactcgctgcaaatgaatggagaactcattttcagctcactacaagctgcccttgatattatcagaagaaaaaaaagaatgtgaaaaatagggacaccacatcattgccatccgcatttcgtcctcatgttcttgttatcttgtagctccacatccaccatcccactctccctattcttcttctcttcaagtgccactcccatccaccacaaggcttggcttggtgggaagaagacaaacgccggcacgcgcacgcagacacg

SEQ ID NO: 6181 - DNA, 144 bp, Zea mays
actggaacaaatgagattatcttataaataatagttcaaaaataagtttggatttgatgtgttagggggtcatctttcttcctcaaagattctcataaagagcatcactgctaacctttctttacgtacaacttctgtgatgtt

SEQ ID NO: 6182 - DNA, 1500 bp, Zea mays
taatcggaggaaacttggagaaaaagggacaccgagggaagctagaaggatagtcagggtcacgggtagcctgagatcgagcgcgagatgccggagatcgatcgagacgccggagtccgacaaagcttgggcgggctcgggcagcgcatgtagatcctcggcgaggctgtccgacgtggttgcactctagcacaacgtcgaatcatgggcgtggcggggtgcggtggtacgacgaggttgcttacttragcttgtgtgcttgtgccttgagcggtggcggccaaagcactaatggcgtgtttggtttgtggagtcactctatgcttcatgaggtgatgcaccataaattcattccatcaattttggtggaatcaacccactcctcatgtatatactaattattagctcatgtaaaatattatacctgtaccctacccgatgtatttcgggtatccgacccgacaggacccgcgggtgattttttttctacccatatccatatccattgggtacgaaacctatggatatccatacgcacgggtctaactgccatccctagattaagtgacagcatgggatcactcaatccctggtggaaaaattcatcttggggattatatcccaagaaccgaacataatctaaatggtaaagtgtctctgctttactcaacggataaccatgacaaactcgagtgcgaaaacatcttgatatggtcaggctgaacttgttggaagataacaccactatggaaaatcctrcgggagaagcgaaaaaaaggcttgtgagctttatataggagaagttggttgagcctcaaataaaaatccatttgtttccattatcaaacagagtaaactgatctataatagcccggagttcagtgagttgctgaaaataaagctacccctgacagtggtagatgaaaaagtgtatgagactagcatatagattcctttgctatcttgaaagttaaagtctgcttttttgctaaaagagaagagttccggaaagaccatttaaaggtacctgctgtccccaaagataaaccagaaattgctcatctatcttaatatttttatttatagatacgtgtgtgtcgtcgtacctacattattactcgtatacataaatagatagacattaatactcgtatacataaatagatagatacaggttagtagttaatatatagataagttaatgaaaaatataaaaaaaacattatattccatttagaacggacacatcagaccagctaggtttgaaatgtatgggcccaagaatcggacgcggcgcgagcgcattgccatcgatttggcacgaagagataaacggcgacccacctggccacttttgataggctcgtgcaccatttcccctggttcccctcaatccaaatagtgccgtcccggcgtcccccccatcggctacctttcctcatcccacgcgacgcccatgccagccacacctgttcgaccacctgacccgcgcgcgccctg

SEQ ID NO: 6183 - DNA, 1500 bp, Zea mays
ttcgactcttttctcccaacggctgtcagcttttgggggatcctttaaataccccccacactctctcttcattacttctgctctctccatgatttctcagctgaccaaactccaaacaagggcattcaattctcatctcacacccgaaatcgcatctccttcaatcgcttgaaggatccttggtgtgaggtgaagtcgatctaacgcgctgtcaatttcatcttgattctcccattctctttgttcttgagctcattgcaaacttaaccttgtgcagatttgttactcttggagccttgtgttccttgacggttagaggttgcttgggagtctccaaatttgtggacgaccccaagaagtttgtattacccgctctttgagcaaatttgagaaaagattgccttgaccttggtggtcggcttgtggaggattagggttggaaaagacccggccctttgtgggctcctcaacggggagtaggacacctttgtggtggttgccgaaccttgggataaatagcgtgttcttgtgtgttcttgttgagtgctttaatttgttggttggttcatattcatctattcgagtggattttctctagggcaagactttagcataatctctaaatactttgtcacatttgtttaattgtttatctaatctaagttgagcaggttcaaacttgttcagttgtaaacaaaatcaactgaaccggtttgcaccagtgcaacttgtatttgacactatctcgaagtttttagtggaaaatttcaggtgtagcctattcacacctctaggctacttccatatgtataagttatttatttttttatattttattgatatttggattaaaaattagatcatatatggctcttgctctaattttcttggaaaaataaaaatctattggaaaaataggttcccaaattagttctaaatgttaaaaaaaatctcctttcttttttctcgcctagtcgcctccctttctcttttctctcttcgtcttcctgctctcgctgagcctgcaggatctgaatccgagctcgctcgcatccactatctgcaggccccacgcgccctgttccttcctcccgctaacaatcgccctgttcccggtttgatccgttgaattctgcccggcgcgcgggggcttgcgggtgcgcaccggaggctgcatcttttcccggccaagattcggtccggtggggccgttcttggcacgatttcacgggccgtttggccttccctcgccggatttgttccggctccaggcaccaaattccaatcttttcctgctgctgctgcctctgcgacactttattcttctcccccaattagcggcggttagtgtggattctgatttgtaggttcatttcctggtttcctccgtgagcttctgcggttggcgtggttacgccagtccctcgcgatttacatctgtgattcgtttgaaaatctgggagtgtggagatttgggaggtcttctcgctcctgtgctct

SEQ ID NO: 6184 - DNA, 335 bp, Zea mays
atgacaaccatgcgactgattatattagtgaggaccaatatttttgcggttggagtgtccatgtttggctacattatgcacctgtaacgatttttttcttcgctagaaaaaaatattttacttcttttaatgtccagttgggttaccttaaggaaaatatatcccgtacgatttggacgttgcaacaacgagagaatacaagggataatgtccagttggtgagctcaacttataatgcttcattacgtgaaccaatactacgtagctgcctgtgcctctttctggctccctgctgtctgcctggccggtgctcagtgctcacagacacgcgcaag

SEQ ID NO: 6185 - DNA, 577 bp, Zea mays
tgatgtgggattcctgcttaatttagtgtttgcatgggcttgaggcttatcattttgttgactttacacaacatttctgttttctttatcaatgcgccgagagcatcaataatgttagataattttagtttattgcatgtctaatgatttgtttagtagttagcaaggctttttgtttccagttgcaatatgcaatttgtatcctgcatctagccctgtgtttacttcttgcattaaaaagggaagaaataatggtgtatggtttcattccccatgtcagcagagttgggatgcaaattaaacggtttcatattttttgacacctaaaaacaggttcataatttgagggtgtaaattaaactgcactttcaggtgacagggcagatggttttttgtttcaatttagaaaggtgcatggaagcttcaatattatagaagaatatgcattcttactgtttttttattacatcttgataacatatgctttcatttgaagcattcacctttgtaaatatttatcattggccatctctgttccttggtactaattctttactttgtcaactaacatactgtc

SEQ ID NO: 6186 - DNA, 470 bp, Zea mays
ggtaattacttgattttaactatgtgcattgctaatcctgcaaacttcactgagggtttgttttgtttggaggtttccatctattctaaatgttaagtcctttcggacagtcacagtctcaactctccaatgtgaagctttaaatagtgcaaactatgtatcatgaaagcaatttccatgataaataatcgcaaccatgcaccaagttagactttccatatatagatgggccaaattaaaaaaatgtcctttatagaatcctaaagtaacctacatttgaaattggagggaggatatttgttagggttaatacaaataattttgggcttgataggttaggccaccatgttccatgttgatccagtatatccatccctaaatttcatttgaatgttagttttgaaaaatctttttatctattcattcgtgatttgcagggatataactcacttaaggattatttccctgca

SEQ ID NO: 6187 - DNA, 792 bp, Zea mays
ttatctctttaaatcaaagaaaaaaactaaaaaattgatatccaaatagttattcgtttgaatgcactagaattaataaacactagttgctaaaattactcggagatatcaaacagttcagttgttgtagccagagacatccgatcatctttaactaagatccactcattagtttattagttagtttattagttggttcaatacaactaaaatcagatgatagccattgcaatttttcaccaacagttttttagtaactctggcgcattcaagtatacccttactggtgaagcgcattattttttaaaaaaatctgaaaggttttccgtttagacacaaacggaagccaaaaagcggatgaagcgttatctggtttctcaccgactcaccctgcagattttgttcgtctccctctcctttgccttgcccaccgagaaagaagagagagagagagaaaattcaagcaggcaacccaaaaagaagaggaaaggattggaaaagctagggttttcgccatggccgtcgcccacctcgaactcccctccctcgaatccacccatcccacgctctcctagctcccgcatctcgcatctccacaaaaagccgccgccttcgattcccctccccgctgcctcgcccccattcgagggtttcccctccccccccccctaaatcgaaacgcagcattaccgaccgagcaagcaacccccgccacccgtcttcaagggtccgagccgagcgacggcgctggcgatccagcagggcgtgagggcggcggagggcggataatca

SEQ ID NO: 6188 - DNA, 698 bp, Zea mays
ggtactaaagttctgaaaaggtgttagcttcgtgcctttttttcccttttcctgtgctgggcatagatccagttccattcttcgtgtaaatactgcagtgggccagtgcccacaggacacaaccacccacccttctcaactaggtctatgaaccctcaaaccctggaccgtttgtccttgcttccttcaccacgaaccattatttcgcctatctcatttytgttctgctgcaatctagtgcaaaaataatcctctttgggcaaggaccaattggcagtctcacctccttatgttctcctatcctttctgccttcaccatggaccattatttcacctactctcatttttctggtttgctgcaatctagtgcaaaatattactctttaggccgactccagaagtttatccattaacattgttttgcactatagactgcacagtttgcagagcgaagtttgaatttgggtatgagtaagctgctgtagatagtcttagatgacccatcaacgttggcatgagccttggtcctggggacaccagctgacatacagtaattgatgtacttgtgtacagtcggatttagtaactagtaatgtgcttgccgtcacatctgcatccaggcatgcattattgtttacccatgtgaagaatttatcggttgttgagcaataaatctggcacatttcagtttttagtat

SEQ ID NO: 6189 - DNA, 979 bp, Zea mays
cgactatagataaactatgcatattaattctaggcacaattacaattgtgatacttatatagcctatcaattgtggcacaattaggggtggtaatggatcacaacctgaaagactcttcacaataagttagggtccttaactaattttagttaaaaaatgattataaatagagcttgatcctaatccaattcgattcttaaattttatagtgtaaaatctagagcccattaccactcctgggcatagtactttataaaaattaatcatgtaactttgtaatttgcgggtaaaatacgataacggggaacatacgtagtgttcgaatggtagcacattcagttcttcttgctccacattctcttttatcgtaacaagatagctctatatttcgaaaatgtattggttcaaggaactagaaaagttatatgtttttgtgacagtctgatctgagttgtctctcatagctacaataactttattaggatcagcatctctgatgagtgataaaatgtgtcagttgtcagtggtcattggtgcttaactgagttaccgcctaacattttatctatgtatatgctttgtgatagcattggactttttttttccttattggcacaatcgtttttgacttgttctgattttctttttttctgccggcttgcagtgcctcaagattctgaaggtttccgtcaacctgacatgcaccacggaatggaggttcgccttggtttgtccaagggacctatctgccctagcttcagttgaggcagtgaatgtagttctgctgcaagttcacctctcagtccagtacttcagtcaatagaccatattaagatggtgaaatatgaaaactggtagcttgcatctgttcaatgttatgttttaatcaacgctgaatttaatatttgtcaagtttgaacttttctggtttccttgccactgcgaggccatggaagcgaccaaatttatatatgtttg

SEQ ID NO: 6190 - DNA, 120 bp, Zea mays
ggtacctaaaacaaagaactaaacttgttttgtaggtttatgcatccgggggctcaagttggatactcgacagcgggtgcacaaaccatatgacaggggagaaaaggatgttctcctcct

SEQ ID NO: 6191 - DNA, 840 bp, Zea mays
atgacttactcaaacggaagaagatagcggtggcttggtatttatctgccattgatggaatgaaagaagcgccaactgttaaattgttcagggaagcaagggaattggctgggttctgattccctgttttcttcagttcgacaggcttagtcccccccggcctgtacgcatgctaatttgtatggccataccgctggttatttatgcattccatcagacgccgatgattcattgcttgtagatgtaaatcaacaatcataccaccatagtcaatagcagttgttttaatgccaatagcaacgttcatgtttaaaatggtagcatttttgttccttgttttctagaccggacattttatgttcctgaagatggtgattgtgttacaaacgagttgagttgacatgagctgtgtactgatgcgttaaggtagccgtcgaaacgggcaggaatgcgcgagtcgaaagaacagtggtatgtatggtggggtcagcgggaactttgtttctgccgcacaagagtcagaaccgaccactgccagggaaataccgcgggcaccggacagcgacgcggcttcctagtccgggactccgtgtgcgccgcccaccgtggcgccgcagcgccctggccccggcgtgtcccccaagcagagggccgcagcccacaggacgagacgacgttgacgcgcaaccacctcctgtattcttatcgccaacaaatcgaaaaagcccatccgcgctagaaaatcagctataagacgcgcgggcggccagccggacacggacgccaacgcctcatccacctgtgctgtgacctcatatttgtcctccgttccttcgtctc

SEQ ID NO: 6192 - DNA, 835 bp, Zea mays
ctgcagtttgaaatgaaaaacagcacatcctaaaaaaggataaagaaaaggaaagtttcggtggatcaaccaaatttcttcattcatactctattctggcaagtaattttgtaccaaaggataaaggtatgtacaccagagaatattccaagtaaattcaaatttgtcaatgtgtgaaatgttctctctattattggaaactgttagccgttttccctcttctagatacggaatttttactatgcacctagacgcagtttacatatatatactttgttcaccaaaacagctccattcatactgtcgtttatgtctaatttggcaagtaattttgcatcgaggataaacgcatccataccagggtgtatttcaagcaaattcaaaatcgataacatagaatattttctctattttaacttataagttgttttgcattttttagaaataaattttttattatatatttattgtatatatatatatacatagttccatagcaaagctatgcacctatttttttattattatagatttattttagatatatatatgctcgtattgtatatccatttcgaaattttgaggtgttcacatatgcatgaatcttgccaaaaaaaaaaatgagtcatttaataagtagaaccaaaaagattcttcctccggatatggcagttaccgtagaattagctgtgtcatgtgaatccagcaccagagatccggtttataagcctcataggacgctttggtccagtagtgaacggtgcaaactagatatctctagatcccgtacctgatcgttgcattgcattgcatccatccagcgctcacagagaaa

SEQ ID NO: 6193 - DNA, 806 bp, Zea mays
agttgacgtgtgggcaccggccgttggccccacgcttcggtggacgcgcggtagcttttcttgttttttttatttctcgttctactcaccccacgcacgctgcgacccaacgctaggaaagaccgcgcaccgagtgtctgacaggtggggtttagtctttttagcgatctgtatctcaactgtactgatacagtacacatgtactgatgtacgtatgggtcgggacggaataggtgcgcaagagcaaagccagcgccaccgcctcgtggcctcatgcgggcccgagatcgtgtttaagccgttggatgcctgatatgcgcagcgtgatccgtgctgcctgccaccggctaagcgcggtgcttccgaagagggagcctttcactgacatgtggagaaaataaaaattgggcccacctgccagtggcgagtatgaggccggaggacggaggtcactgccggtttcgcccccgccgcccccgccttgcttttgtacaaaacaccctccttttctgtattctcgtatttataaccccaagttgccttcacacctgtgtctctgcctccactcctctcccttcccttcgcgtctcttcttcccccttccacttcttggccgagcccctcttggtctcggcatcctgctcgatcgaagaatgctggatcaggcatattggaggttgcagtaaaggcggtaggtgcttttcttcttccccgttggtggctagagggactggccggggagaactacaacatattggaggctgcaagttctcgggaggagccgggcttctcttgcggcggcaaac

SEQ ID NO: 6194 - DNA, 272 bp, Zea mays
ggtctggtctacttccacggcggcgccttcgcagtccactcggccttctccggcgcgcgctcccgctttctgacttctgagcgcgctcgtggcggctgcccgcgtggtggccgtgtccgcggactaccgcctcgcgccttcatcaatcctctggctttgccggcggaggagtgggcgaccaccccttcatcaatcctctggctttgccggcggaggagtgggcgaggctcggctgccggcgtgctctggtgaccgtggccgagctcgacacg

SEQ ID NO: 6195 - DNA, 127 bp, Zea mays
ggtagtactgtagtaggataggatccatctgtgtcgtgtcgttctcgttcatcaagccaagggtttcgtgcttggattacgcattcccatttctccaaagtgttgtggacaactaaataatgattac

SEQ ID NO: 6196 - DNA, 767 bp, Zea mays
acagatattctagtattacttaagcataaatggaaatcgtagcaacgtacgagcactttggtagttaatgtttagtagtgtccaagaaattgcaacaagatggcaaattacctagcaaaacatgggatgagcgtggttagcttagaatccgttgttttcatgagcgaaattcgtatctttgttatcagtctagtctctggagatatgttttgaaggatatatgttttcttgcaagtacgaatagatcatacttttgtttctccacactcttcctacccttctttttgagcgcacgagtgcacgacgcatgattaacttgctccgttctcgtcattttgcatatatccacgcatgctaccgtaccaacaagaggaaatctttgcttccttccaatggaccaccatctttatgcctcgcaattgtgaactcgcgaaaagaaacaaatctgtcccatatgcacgacggcgccacgacaaacgagctagcgtcgtcgctggctggcttcgatatgtacgtacgtactcctccgcgcgccacgctcttggcgcgccacggctacccgtcccgtcatcggacaccgtcgcgccgccagcccgccaccgcgcacgcccgcatcgcctataaattcttgcaccgatccgcacacacacgcacaagccaaacgtgcagctgaggaatcgcaacggcagtgacgtgtgcgcgttgccaaataaagctactatactagtcaccgctcgattgccgtcgcagccgcccgccggccggag

SEQ ID NO: 6197 - DNA, 243 bp, Zea mays
ataaactcactcatttcatttcctaatattaatcaaattagcatatttcttttcttcctttagaaatagaaagaaagcccttttcctttttaacaaaattctttctatttctacctgctcaaggtattcatcattctagtacaactattgcagtagaatgacaacagactcgtgtatagggaactagattagcttagctacctatctaatttattgtagaaattccgggatccgcgattggac

SEQ ID NO: 6198 - DNA, 1333 bp, Zea mays
ataagacgtatcttgttcaagctaataaatagagctggggttatagttaaagcagccagtagaaaaccgaaataactagttatagtaagcatgaaggggttcaattccattttttttactacactacatatgttggtaaagcacttacctaagtttaagttatggaaaattcataattcatcggttattttagataatactaaaaaacaagatagagtgagatacagaagtgtaaaaaaaagagaaaatcgattcatcagacggaacatgagtccctaattccgaatcaagagatttgttgtggaatctgtcagttaagtaaactaataatattaagaactagatcatctaaccccattgaaaaatgaaattggattttcgggagaattttggaataaaagataaataaagaattgaatttgaaaaaaaaaaaaaaaattctttctatttcggattcggattatttcttttttaataggatggatttcatcctctttttggagcaaattttaactcattgtattccatatggaataagaggagaagaaaagcattccacgacccccgaggggccccctcaaaaagggaactattcctaaaatttacttttttttatttatttttattcgttttttgaaccccaacaaaagtggattcaaagttacttcaattatccttttcttttaagttcttcttgtaaagttccatgcttgctgtttggtcaagaaaattagacctaatccaacaaacaagacaaggattgattacgaatcttgattcttcaaagaatgtattccgtttctttcataacggattatccgctattcgattttctatttattagatattattttatgctaaccaattaaattcctttaactaaaaagggatcgattttgcatatacttatctttgtattgcgtcaatatgagaatatccttcctaaattctttatcttattaatcattaacttagattttcccaagatcttggccgctattccaaattaaattattctactattccgaagacaatgaaaataagtaggacccaaaaaattgtggggttctattgatgccttgaataacatgtaattttcctatagacaaggaacaaaaaagagaaaaaaggaattctgtttcgggaccaagcaaaactggattgctgtgccataggaaggatagctatactaattcggtatactcaaaatacacctttggtacaaaattgacaatctcacaaggatgaaatatcagtaattttctatttactggtggatcccatcttttacggaatcaattccttttttgaataaaaattttgggagctcagc

SEQ ID NO: 6199 - DNA, 63 bp, Zea mays
tgcaggttaagccagcgctggctatagtagaaatcaattactgatatctcaggtatagatagc

SEQ ID NO: 6200 - DNA, 170 bp, Zea mays
ggtcacgagggatatacaaggagatatcccttggtgtatgcttttcgctgacgatgtagttctagtagatgaaagctaggaaggagtaaatataaagctagagttatagcgtcagaccctagaacctagagtcaaaaggatttagaattagcagaaccaaaaccgagtat

SEQ ID NO: 6201 - DNA, 1110 bp, Zea mays
gatggtgtgacttggcctaccaccctgccaccgggttggacggtcgagtgggatgttgctccggcaagagaggagtatgaggagtagtgggctaggccttgcccatttcctcactaccgatgacatcgattatccgctgcactttaatttatgaactttatttgctactcgaaaactccgatttatgtgataactcagtacttaatttgaggtttcttgttttattgtatttcttctgtgactcaccttcgagtgagattgtggaatttgatcctggttaagtggcttcataagactagatctgagggactgacgggttattccgatttaagtgtgttacggcccctgaggcgtgacttaggcacttaagctggaataattcgggcggttccgccacaaaagcgagccaggctgcggcctctgcccctccctcagcctcaaggattttcatcaccagtgctggggaggggagagtgtcgagttggggtcggcccctgcgtgggcggtggcccgctccttccctccgtgatcggggggaagggtggttgctgtccgtggcgctggcagctgccgcgtgcctggctctcggacccgagtggcttcggagccgctctcggtgccggcttccgccacggcagctggaagaggttcttccgccgacgagatagccagggccgcccacggaccgacctccaactctacggccttctgcccgtccttgcctcacgagttttgggcatgggcgggggcctcctggcagcagcatccgccctgaggtcatcgctgccgctgttcggccccccggagcagaagtcgtcgtcgtcgccgctgctggggcgggcgacggcgcgccgttcgtcggtcttctgttgctccgcaggccccccccccattgagtggggttgttcgtacctgcggaggtggaaccggagttccgtttgtaatggcactttgaatgccagtgtttttgttcattgtggctgtcgaggcctgaacatgtatgtaattttgggcacggagccgtgttttttcctcattttcgagcactaagactcgtctgttggttgtctgaaccgcttcaccaagcgtgagtcgccccgtgtaaaggtg

SEQ ID NO: 6202 - DNA, 1500 bp, Zea mays
gtccagaggattagaaaatcagagaaattaattgagaaatagatttttagtacatatttaattgcagaaacttgtttaatttgtagaaaattcatataaactccaaattggtccattctagttcctatttttttgtaaaattattttctaaccatcagtgccactgttttgacatgaaagacaatttaaattttatctattacctaatcttgtattaagcacataaaatattagaaaattcataacataaaatctataactacaaatttaatgagtccagttcctatgatcttattttattgtctagattattactgtgtattttgtttacatgtttggtgtgatgttaattttctctatatactgtgcttgtttgtattgtggcgagtagaagaacccgtgactgaggatcctggtgagcagcagatagaagtagctgagcaggagctcattgaaggcaagttgtgcccttgaccactttttacccaataatattctttaataccatttattcatgcataggttaattttgatgggacccgataggtcaccctagattgtttatctcattaccttgtttacccctgaatcacttgggtagttttgctattgctttacatggttttgggataatcatttattatatctatgttccaattcttttgttattctatttatgttcatgccaagatcattaatgttaattggaacatagagcttaacttgagtaacacgtgccaccacaagggattaatgggacgcccttggctaactaattaggaaagctagtggaagactaccttacccgaaaggggcaagggcagtaggggagttgcatgcaaggaggttctcgggttgatttagctgcgatggcggtcagacaggggattcttgcaagtgctcttcccataaactgtagcgggttttcggaagctagtggaactttgtaaaggcctcgtagtgttgccctgcctcgcctcctaggtataggtgtatgggagtcgcgaccccttggcagataggtaacatgacttgtgggttaagggtacaacctctgcagagtgtaaaactggtatactagccgtgctcacggtcatgagaagctcaggattcttgcatgattaatttatggaacttaaattcaatttgtcatttgcaatgcatgggattatgtgttggggacttgttctcaaatgcttcggcttaagaacaaggcaacacagaaaatgttaaacggtaaagtccttcgtccttcgaagcattatttccctcgggatataatgattttcggacgaaggttatgaagggtgaaccttcataaacataacatacgaggatgaagaatgaatcatatgaaatataaagaataacataggcaattatatgttattatcaacttatttttgcattattattatgaagaaatagaaatgacatccaattacaaatgtaccttcggcttggaaggggatgaaaatacgaatgtgacgcaaaagcaaa

SEQ ID NO: 6203 - DNA, 1124 bp, Zea mays
atctagttagatttagtaagtacgaggtcttgtttgaggttctgtttgggaataaagtttttaaaaaccatagtttttgaaatactacaacatgctttagtaatgataaaaccacaacttaaaatgctatagttttgaaaactgaggtccaaatctaagtttaaaataccttaaaataactacaatatttaatatttacagtactttagttttgaaaacagagattttagctaacctaccaaacatcattttgtatataataatgcaatatttaagaatacatcggtatttttctaaaacacgagaatactacattatttttctaaaattgtgaaaaagcacactgatccctgatctgcacaaaaccttaggtgacataaaaacccgatggagtagtcagagtgtgtaggtctgtattatccatacattttttttattattaaataccgtatactatactggtgaagagagtaataatcctctagactctagtgggcaaactttatgtatttggactcccaatacaagcacatggtgcaattcatycatccatgcaacatgcatgtagtatacagtggtctcacactctcaccaaccaggtccactgttccgggcgcagtcgacagtcgtcccagcagaccagagcacccgcaagggccgcaaccggcattgcgccggcaattgaaaactgcttgaatccggcgaaccggacacgggacatcggaccggaccggaccggaccggaccggaccggaacctcctccactcgaagcgaattccccaccggctcaccttgcacggtactacgtggcgaagaccccttgaagtcgtggctccgcagacattttcgcccgtccctgctataagtggcacgccgggcgggtaagcggcggcgcgcggcgacccccgcagcagctccgaaccttctcccagccggcgcaggaagctcaccgggaagccggtgcaaaacccccaagatcacacacacacacaccccagctacaaatccgtccgccagcccccgtcgacatccctcactcccccatgcgcaccggcagctcaccgatccccggagccgctactgctataaatacaaagcttccccggcggtggtctagccggcc

SEQ ID NO: 6204 - DNA, 92 bp, Zea mays
cctgcaaacaaaaaccaactctgtggcggaactgcccgaattattccaacttaagtgcctaagccccgccttagaggctagaccacacttaa

SEQ ID NO: 6205 - DNA, 73 bp, Zea mays
ctggccaacccaacccgaataaatttgaagcgcggaccaagccctagatccgacaccagcaccaccctcagcc

SEQ ID NO: 6206 - DNA, 669 bp, Zea mays
gttgggttcgataaacttgtcatactgacatattatattattttagcatcttttaatactgatgaggtatagrgtttcaacattttatatttagtacttacttttgcgattcaaatgatcatgtctacttataacgttaatggatatgagtaaccgctacctgtggtgggtatggcataattttgtaccatgatggatagtgaatgcggatataggacaattttttctttggtgggtgtgtatgtaggtgtatatagctttggtactttacccgtcgccatcctagttcgttgtgatgcaagaacagcatatcctgcattcctgcattacatgaggctctgagctgtggtgatttaaaatggtctacgggccacattgtaatctctgtctggcccaatttaaagatctacggtccgcacttgcaagcctccgagccggcccataaacacgcaaggcttatcagtatcgcctagcggggccctcttcctatcaaaacctcatccaaattccaaagaccaaacagagagggagggagatagagccccacaataccgaaccgaaatacccagccaacagccacaacccacgcgccacgcgcccacgcccactggccaccgccccacccccacccgtgcccgtcccgtgctagcttagctctcggctctcgcc

SEQ ID NO: 6207 - DNA, 625 bp, Zea mays
tggcggtaatttttgtattttggtgccttttccactttatagtaaagatatattaacatagttcatgtatcgaacgtcggtgatgtacaacatggcagatagtcagctagagattaaacaattatcaatgtgaagccgcacgtgcacatgtcggaagtaaagatatattaacatagttcaatacaatctgtcattgttgatggtcccacttaaaccggtgatatgctaaattttaatatatttagaaagtaatatatagaggactgtcggaagagatgagtttttttattttctatattatttgaggactggctaaatctaggatttaggtagtaaaattatatataactactgtagttgctcttatgtccgattttgcagatgagctaaccgatttagcagatgagctaacttttgcagtagtctccggcttcttttcttgggttacaagacgacgaggcttcctttcttggacccgaggtaagaccgcccatagaattttcatttcgccgcattattttttccccttctcactccctgcttcggtccttcgccttcctcatgtccccgactctccgatactagtcgagtagtccggtacatcccaccgcctcgcaccgcggcc

SEQ ID NO: 6208 - DNA, 797 bp, Zea mays
cttaagtttataattttcagattccgtctattcaccccctctagacgactttcaattctctactttgaagaatatgtcatacagataaggtttcacccccacttctatgacttctggaatcatatcaatgcttctgacatgaactttaaacctgaccatatctttagtttcaagggaattcaaatctatttcctcaacagcaccaattgctgagctaagttcacatatagcctgataattgagcaattcttctgaaacattttcagcaacaacccaagtagtgtgaagtctggacttggccttagcttgagaaaaccaaggtataacactgattttaactctggatattttcatttttaactcaggaaagttaacaacctcattcaatctttcttgagaagaaaaatgcatcaaaaaaactagatgggcatttggtagctttccaagttctaccccatgaaaagtggaagctaaaattatgttccagatcctcacatctaacctcaccttcaatgactttcaccaagcccaaaaaactttttctaggtttttttgctgcatttttagcaaacagagaagcatactcttgattcccttctcttccttgtccttcgcctcttgtccgactcagatctccccgacctgccaccacccgcgagccctgcacaacatcactgctaccttctctgtcgatccctcgatctccagacaaccccgctcgcctctctccctgctccggtccccgcccgcctctcgctcgcgacaactccgccgcagcacgcggcggccgcggcgag

SEQ ID NO: 6209 - DNA, 308 bp, Zea mays
ggtaagatgctttacatggggtattaacaagatagtactgtaacactagagacaactgttgctaacttgatatacagaagagttccactgttggagcagcaagagtgcagtaattcagattctgtgatttgactcaataattgacatgattgcattattgagattataacttggagctgattatattcgttatctatgatagaaacctccaaatatgataagtttccctgtgaaaccatgctattttagccacgctggagttggttaaagcaccagttaacaacttccttttatgcataaaacaggag

SEQ ID NO: 6210 - DNA, 789 bp, Zea mays
actgtccatttatcaccttcaatttcttttatattttctttggattttgacactctcctttcttttgcttgcttttctcgtcggatctgacttaaggatgtgatgacaaaaaatacctacctatttttagatccctgacaagagaaaccaatgaatacttctgagcctttctaagatttgtcttctttgtttggtttatgttctctatgcttaaaaaaggaaaggaaggtaggatttcagccatgctcttatagagtgactggtgctcaaatctagaaattgatatcacctcaggtttcggttttgagtgctcacttctctaaatctgtagtatggcagtttgattaaagtcttagtataaaatgtcttccaaatttcacgcactaaataaagcagcattgggagggccatttcttgaattttttgtctgcacttcattcaggtgaaccaaaattttctcctaggtctttgaactaaaatacagtagtactttagaaccacaacactacaacaaagttgccactgcatgtaaattagacaaacagagtgtgcacacaaccactgaaagacacatttataaccaaaattcataagttggcaccggggaccctaggtcgccgtcgaaggcagtgagcccccacgacccgcacatgaacgtcaaccctcaaactacttcgtcaaggaggtggtcaagggcatcgacgagagcgacctccaaggctccactagacgtggatcaaagtcttcgccacgcacaacgcccacgagcgcatcaccaagctcgagaac

SEQ ID NO: 6211 - DNA, 682 bp, Zea mays
gctaacaaactcagatagaggcctttcacaatcctcctctttcacaaacccttaccaggaattaaccaaaatctggcctggaccctggaggcaactcctgttcatccagttgactaaaaagtggacactgtttaatatggttattagctagtacacggaactacagtttgtcagttggtaagctaacaatctgttttttgtgaccttgatatcataggtggtctagagagtaatacacagatcatagatggtaatggctcagtggttcacatagtgaaggcgtggaattcaacagtcaaaggcttggaatccaacgtgtagcaagttcaaagaaaaataaaatgtcaatcatgataacaatgtgagggcaaaaacagtcccaaaggtcatacatgtgcagggactattgactctttgtatgtcttttcttcttgagcaaataaaaataaaaagtcaatcagaataattatgtgaaggcaaaagcagtcccaaaggtcatacacatgtacagggactattgactctttgtatgtcttttcttcttgaacctgacgtcctttctctcctggcagctttgatgtgaagcatagcatacatagtatatcagaaacatcaaaactcaccttgtgttttcttacccatcctgctgtgttctcttcctgagaagaaagagaggactcac

SEQ ID NO: 6212 - DNA, 825 bp, Zea mays
ttagggggagatttgtcaaacaattaagcycagctccagttagttcagttactgcatattgcatattcagttaagttayatgtctgcatttgagttagttagttcagttagtctatattatcagtcaagggtcgagccccgatttgtggaggccgatgtcctgtagaataggtccagtttgttatccacaacggagaactcgcgcagcgtgcggcgtggggatggacgcgcactcgagcacgtcgcgcggcttactcggtcagcttattttactgcatgtacgttccacttctactgtaataaatagaagaaacagaaaacgtcgtgaagctctcgcggcacaaaaactctgtctctcttagttccagttttacaactgtgtgtgagctgatagtgagtagagagcttcgttctcaactccgatagttgtccaggtcagatccgacactattgcccaccgccgtaactttccagcctgcgtgtacgcttcctactccatttttttctgtttcattcacacatgaaaatgttggaccttgaaaaagggagaaaaaaatcaatccgccacctgttctaacacgcgaggagaagaacatggcgactgctgtttcgttaccgtccgcgtgctctgacccctagcgagcccacggcgtcgccctataattggggtcccaaccgaaacctctcctcgccgcaacgaattcccggtctccaaccagccgggcagccaccgcagacgatccctagttccgcgtccccgacccgaaccctcgagttcgcacgggctccggccagattcgcgcggtctaagcttcgaatcggcgc

SEQ ID NO: 6213 - DNA, 1500 bp, Zea mays
tgatttactcatttcttctgatcaactagttgtaccgtttattgcttttccttgcaggctaacatttcgctaggccacgtcatgatggcgccctgtcaaaacaaagtacgtgacaatggtgacgtgcatcccatcgctgatcagtgattactctagatctcatatcttttttttaaatgaaacgaaggtgactgatttactctagaattgtcgtagctttctgcaatagtgggtgcaacaactctactcagctcattgggtcatgccttccctaataaaatgtcaaagtggtcgcaagcaagtgcgaggaagcgaccacggcacaaagaaacacccggtccggccgtgacacggagcgaaagtgtatcctataccccccctgatcccaggaagatttgaatcgtcacctaaccggtcgctctcattgtgcctgcgtgaaggagcgtgtccggacctccaagctcacctgaattggtccagaagatttcaaactccgacgaagtgataagctctagtgttcgcttcaggtaaagatgatctgccacctgatctggcatctggcctccgttggtgtcgaattggatcacgtatcagtaagggctagatcgtccaagtcgcctcggaccacagttggagacagagaatgactagttttttcacgaactagcaaagtaacaatagaagccttggaacgacgtcgattttttttattttttattagatgttcaataccttaattgaccgtgatcttctcatatatggagaggatggtcttatggcagaagactactcgaaaacacgttgggaaagtttccaattttagaaaccgatacgaaaacaaatcaattcaaaaagaaatcctacaaaagtcggtataacggaacaccgaaatcggctcgaccgggtttcagaggccattatagccaacccgacaggttctaggggtcacctagcagcattagagacccgacctagccgattataggtctgcgggttaaattgccacgcacatgtgcctcgygcgcatcctgttctagtgttctctactactcctccctcagttctaaaatataaaatrtatttcctccgtttcgttttagttgtcgctggatagtccaaaattaaactatatagcgacaactaaaaagaaacggaaggagtacgtactagtaatctgcatcttaaattcttagtaatttccgagtttggtgtctgaaaacagccatgctaaaagtagcagcaacacccagctgggccatttccgcaatagagcagtactacagggtgtgaaaccaaaagaccaccactgcctagtgcctactaataccagtggccccccttccctgttttcctcaacgctttcactttcttctccgttccatcgcctcctcccacttctctctgccgccccccacaccccagccgcgccattgcccactgcattgcagactgtaagccgggaatccacttggattgcatcgatccatcggaaggcgccag

SEQ ID NO: 6214 - DNA, 276 bp, Zea mays
cgcaccgctgtggacacgcgccgctacacctcgacgccaccgcggccctgagccgctgcacctcgctgtcaccgccgccaccgcgaagcaccccagcagtcgtcaccccttcagcaccctagcagtcacacggggaaggaccccaccaccgccttccttgaggtcatgccctgcagcaccctagcagccacacggggaaggaccctgccgccgccttccttgaggtccgcacgacgcccggcctccccctccagcgatggcgaggggtagggagaa

SEQ ID NO: 6215 - DNA, 933 bp, Zea mays
gcagaagctcgtcggctgggtggcaactacagcctacatgttcttttagaatagtgtgcgcaagagcagataccatatgtgcataaagaaaaaatactagtcaatgtaccatccgatactcatttgggggcacatcgacacactttgaatcttttcttgacagcttcttttgttttgactgtccccatcttgccagaaatcaattgatgaacagaatccattgttgtaaaaagggctattgaggtcagcgtgcagagaattatttcttgtcgaaaattggaggaataatcgagagaagtggccatatatctgaaataaagaagggaatcatagttggaaagatacttttatctacttattatagattattaggcaactggtgtttctatgtcagttacattaaggcccaatggtttcgttgtctcagctatatatttctctctctctcttgtcttttattagctactaactgggcagctgcaagaaaggtgcaaggaaggtgataatatgctgaggcattgatacatgcattgtaacaaagttcaaagagttgcagatggatcatgaggtcattggttttggtctttttgaaatgtcatctccataacgtgatgatggttgtcagcattaggattatcgggtgacctgtggagggtcaggtcagccttcctgcctgttccgtcgtatgttttggagcctcttctctgaattgaagacgtatgtttggaacctcttctaattgggcccgtttgttccgccggtcgagaagggagggccagcccacaggacgcaggcccagctcagtgaggcggcctaactcgatgcctgtatgcaggtgcatgatccttgcccgcagctccactccaaaccacgtgctgcactgtactgtactgtactgctggagagagacgcctccgccgctggaatcaggcg

SEQ ID NO: 6216 - DNA, 1160 bp, Zea mays
cgtgtaaacaaagactgtattgtctatctgatagaatttagaacagtagatggaacgaacaagaccgctggaaatacctttgaggctgatatgattgtgtgtagtagcactcttttttatgtaaataacagagtacctatgaattacgattatactaatgacagtatagatatttggtaaagtgcaaaggtgtaaaaagctaccaaatgtgtgttttttttgtgaaatttaggtttacacgtgttttggatttatcccattgtggaaatttttgtaactttggcttcgtctcacggggtgtgtgaattaaaaggctaaattttagtccctatcacatcagatgtttaggtaaaaataggagtataaatatagtctaattataaaactaattacacagataagaagtaaacgataagacataattattaaacttaattagtttatgatctgcatacgtgatactagggttgaaaacagttggaatttcggaaaccgttttcggttttttcggtcggatttatcggtatcggtatttttcgaaaacaatatcggttgtcagaattttgattcagaatcggcatcggaatcaatgcggcgttttaccaatcgttttcatttctatatatgaaaggcggacgcaaagctcgccaaccatgctgccacgtcactcctccctctccatcgccgccctcccccacctcgtcctcatcgcgtgtcatgcttccgggctccggccctccgcgaccctactccacctcccccggccggctttcgccgccgctgcagacgcttcgccaccaccgtcacacgctccgcctctcttccatgcacgtctccctcctgcttccactcctccggctacacccccgccttatggccttgctgctcgccgtagccccgcacctcaacctcgggaagatacggaccagagcgacgacattgaggaggaaaagtaggagcgtcggcggcggcagtgcagcacggcgcaagccctaataattaccgtcgtgacgccgtgattggaccatgtttcgcggccaaatggcgtgcctcagcgaagctgcaagttggcaccgcggcgacgacgctggtgaggtggtccgtcgtagggatcgaaacaagagtatggcgtgttggaggtgaaggcaaccgcgtcagcc

SEQ ID NO: 6217 - DNA, 1500 bp, Zea mays
gtgcaccatctacaatactccattgagagtattgactgactatcgattgcattgaaagaatttttcctatctcacacagtatcatatgcatttggatacagaccatttcattattttacgatagctagggtaggaattctttagttctagctaaatcttgatcatgactggagttttggaatgattgtgtgaaatattacacggtatatatataatgattgtagtacttgtgttagatggtgagataatggagctaggaagggcgaacctaggattttgtgaaaaacccatatcagatacatgttcagcttctgcatgtgactgtgaatgcgttagggttaatataattaaggagaggcctagaccataccaggagtaattgctcatatgcttatttcagcaggcttgaacagtgttttggctcgtagctggggcagcttgatgctgtaatatacagttgaagaagcgtatacatgcatgcatatgtcaactggatgtgcataaatgtccaggcactggtgtactgtacccgtgtgcgtgcatgtgcatctatcatacaattgaaaaaaaaaatcctaccagaacatctgcttactaattgagattctagacaaatagaacaaaacttagatctcgtgtcatttcttttttttccttcttccaagatgggttcgatttcttaatcgttcttgacagcaacctgccagtcaaatggccgtgacaacgtatactattatcgagtaaaaggtcgccactttagtagtacatgtacatgcatgcgcagatacatcatcaggtactcatatatgggcacacatatagacatgttttgaggaaaatgagacaaagtatagtggagacttccctagaaagcagaagaaaaagaagtggtttatgttccgttaaatcatactacaacttttttttattatactctccattttgtcatcattaggtactcatatatgggcacacatatagtactgccaatttttcttgctaaaaaaagttccactatatatatgtatgtatgcacaaataaactaattttcttagaaaagaaaaccggtgtaatacatactaagggctagtttgggaacyctggttttctaaggaattttatttttccaaaaaaaatagtttatttttccttcggaaattaggaatctcttataaaattcgagttcccaaactattcctaatatatatatcatactctccatcagtctatatatagattacatatagtaagtatagagtatctcgctatcacatagtgccactaatcttctggagtgtaccagttgtataaatatctatcagtatcagcactactgtttgctgaataccccaaaactctctgcttgacttctcttccctaacctttgcactgtccaaaatggcttcctgatcccctcacttcctcgaatcattctaagaagaaactcaagccgctaccattaggggcagattaattgctgcactttcagataatctacc

SEQ ID NO: 6218 - DNA, 1500 bp, Zea mays
agatcgtagctttagctacgcttgattttaaatgaaagcattattgactataaagttgtataattttttgagatctacattttttgttttggttatttctctatatgaagtcgtttaaaagtctaaattttaaatatgagaaattcaaatgtaactttttttgaatatatgattttaaatgaaaaaggttatcaactataaaactgtataaattttttagacctacaacttgtgttttggttgttttttaaccaagattatttgaaaattttgaatttcaaatgtgagaaattcaaatggaattttctttagataagctattacaaatgaaaagttagccaactatgaagtctaatttttgagatctgtagatcatgttttgaccaccttttcttctaaggccgtgtaaaaaaaatcaatatgtgaggatttttttcaatagacggcgtctatttttttagagttggtattgtctctagtcgcatctacaaatttatttgcaaagatggcttagttgtccctaaagaaataggagtatttgtgaaaacgacaaaaaattaacaatcccttctaccatttcatttatggaggcggctggtttcagaaattatttttgatgaatttagattcagcaaatttttttggggtagcagtgaagttttttctccatgctagatcgagttaagattgggggtaggtgacgtgcaaatcatcattctacactgacggcttggtcaattttgatgcatttatgtcaaaatgacagtgataccagattcctcaagaaagtttgatgagaaccaaagagcatgtacggttcctggagtccacatccatgcaaatgcaaataatgactgaaataaactcgacttggacttgttcaatgaatcgttcaaccatttcacccatgtttcaactatcgatttactgccgtctgcagtaaaaaatgtcaattttttttacacgcacctgcaggcttcacactgactgcaacagggtgtcagcagtctctgcgccacacctcgcggctatatttgtcatgaaagacaccatgtttttactgccgtctatatgtcagtttttcttatttgcaagctatatttgtcatgagagatcacactgagtttgtaaaacatgtgattttcctgtgagtaattaagacaattactttttacgattccttcgtgcattttactagtgcggagaacattgtttttctaaaatcaagatttatttatggtacatcgtctagagttgtttgaaacttttatcaattgatcataagaaacattgttttacatttttttaaaaaagacacctagatttacaattttagaatagcatcggtgctttcctcatcatccacctggctctcactctctaaccgtcgcacttgcaagatacaagtacacgtctatttaaaccaccgaacaaccgtcaacactcaccggctgctgcctgctgctcagcaccacacgcttgagagcttgttacgaggca

SEQ ID NO: 6219 - DNA, 1500 bp, Zea mays
agcttcttggacgcgtgatgcagtagatgctcatagagtcataggcgtttgttactctgtgcctaatacgatcgaggagttaatcggatacatgattcagtcataagatcaattaatatatgtatgctatggtaataaggggttattcctcgctcgtccaacggatcaacatgcaacctacatagatcaaagactaagctaagctatcaacgattcttccagccatctatgtacttttacatgataatcagagccataacgagttcatcaccatctgcctccgtgaatcctgtccgtagtctatcaatcatcaagaagctaacaaagcccaactatacgctttggcatgcgcaggttaggacccgcgctattcacagaacaaagctgctcagctttctttacatgtgtcaccaaggcgccactaaccaaaatcacccagaaagggcgctgatagaaaagggttcaatgtagataatctggactttctgtagtatgaagattgcaaaggcagagatcaacgagtggcgagccatatctccgttcgtcgctatcaaaagacatgttgattcaagtttactccttcaaaaccgcagccgaagcctggacaaagatccaaggcgcatttgcctcgaaaacaagaggaagaaacttcaatgtacggttggctctaacaaatactaaaaaatagaatctatttgttcggcctctaaaaaaactgaaaattcggtagagtacattttcacatgccacggtgacaattatctccgactagtttctgttatttgcgctgtgaaggagctggtcacagtcagcgagctgttcgatcagyttctgaattttaagatccatgtcggcctcttctgcgactgcacctctatttgcgttgcgtcctttggtgtagccacatccacgattgattttatccaaacctgctggtggggggaattcgatcggcttgttgtgtatgaccttgcggcacatgcgctaccttcacaacgtagtttgaagaacattgcgaaaaggtatcttttttcacatcaactttccttcacatctgcaggaccacaagaagagatatttcagccaagcgtgtgtggtaatgtacatgagtactagtttgttttgccaacgtcggtcggggtgtagcgaaatcgcccccatcactcgttcctatattgctgggccaggaaatccaactcggcccaagaaaagtccaccggaacaaaccgctcgtttgaccgtctactccgtctccctcgacttgtgaaacaagtcaaaatactgcctccgtcgcccagaaaaacattcctccaagtcactgacactgggcccccacagaaaagaagcacctcccgcaagaaacgcgcaaaaatccagagaaccaaaagttgaagcggaactgcagttctgtctgagtctgggtcctgatcctgactcccgaggctctcctccaaaaccccctccttaaaccctagcttccgtacgcctccgcgctccccc

SEQ ID NO: 6220 - DNA, 1352 bp, Zea mays
tgtctgatctcatttcactaccctaccacactgccaggtgccgtactgtccattgtgtttgtggtggtcgacctggctgatttcgattcccttcgattctgtgtgtctgaataattaggtgacaaaggtgaaactgctatctgaagcaagatcatagggaaggctgtccggtctgctgatcaggcagcacgtcaccttcggtcttttaactgaatgttgctgggttctcaaggaatgttgggcaaaattgcgactgcccctgtgatgtgagtgcggtgacctagaggaagagggtggtgcggtagataggggttatgaaatgaggtcaacatcgagacctgcacttagttgggacgtcacgagctgaaatgctaactgacggcagttcagaaatgtatctcaggaaaaaggttgcctgttgggtctggtgctacgttcctaaatgccacaaacactgggagagatggtgggagattgtatttattttttgtaagaaaaatcgtgctgttaaaaaaaacccatgaaattttgcgcagctccaggtgggtgagattgcgctgcacctcactatctcagtgactcagtaggaatttgaaattcaaatctggtcctgtttttaaccacgggttaaaaaaaaatcttcggtaaggtgtcgtgagtcgtgactgactggttggtgaggtcaacgaaaggggaggggaaggtggaaaaaaacattatggcgtgccatgatctaccaaactggctggagaagacgacgaaaacgaccacctaacactggcggatcagacgatccaagtcaaatatagtaggtaacgaggagaaaaatatatattaaaaagatttttgttttcgaaacgaaaataaaaataaaaaataaagatgacatgaagtgtgaccaaagcaaagcgaaacgcgttgcagaaaaagggaggcggcagtaccagcaatagcctagtactaccactttccaggaatttaagaattttatttatttattgtttccaggacgcaaccactgccggagtgctggtatgtttctggtaggagtccgtgggaacgaaaaaaagtcatcttgaaaacaaacgcagggaacgggaacctggcatggcagatggcacccaccaggccaccacctccgccgacagcgagcacggccaccagcatcacccctgccctgccatactcactttgaccccggccccgggcgcctagtctattctctgatttctctctgcctgccaagaatcccgccagttgccttccacttccgccagactccgcgttcctcctgactcctgagcagctgccgcctgcccgagcagtggagggggaggcaggcgcccaggcca

SEQ ID NO: 6221 - DNA, 904 bp, Zea mays
actttacccctatgggtccgccctgcttaaaaattacgtatgttgtaaacatagaaatattttagaaaatagtttaagaaaataggtagaattgtactatggtaaatctgatagatagaatttaatgttaatatgttagcacttaattcttttacattatatatatactaccgatatttgatatggaatttatgacttaaactaacgttaaattgccaaaatttcaagaacaccacctactaatttagtgccaccaacgaccctttgcattttccggcacagatttttttgatatgaaaacgtagtcgaaacaaaaaaaaaacattgtgaaaacgaaaaaaaatccacggtcttattcgtcgtagtgagtgtgagtctcgactctcgagttacttctacgcatctccaagccgcaaacggacaaaaccaaagcaatccgtgcacaccgaactcctctcctccactcgcctcttccacgccacgcggatggcgtgcgcgcacgcaaggtccaaagaagcaggccatccgggacggcgcgagcgcgtcctgcgttccattccaccctcctccgtctccgatcctcgccttcaactccactccctcgctctctcgggccttcttccctagcggcgacgacggggtgatcactgattcactgccgcccgcgccaggtcggccaggtatgcgcgctcgttcccttgatcccttcccttccttcttctagcttcgatttttggccaaaaaaatatctggtatatatgtcttaccgcgcctgctttatagctgtatgatacaaattgccatatgacgaacggtcggattattggttccacttcggtctggcgaagtcatttacttccctttttgtctgcagaactagtgggcgccaaacatcatagcgatc

SEQ ID NO: 6222 - DNA, 1283 bp, Zea mays
gatgacatgtagtaaagcataaatgcttaaagaaatggatgagctaaccattttcctttgcacttgatttgttaagaattttatttttgcactgtcaaattctttttgacttggtctctgcatttaatatttcaagctaaacaatcgggtaacatgagcctgcttattttgatacgtaaattgttctgcctgctggtgaagttttgttatagaggagttgccataaaatccatagcgcaggtacttttctgtgtgtttccagcacaaaatctgatgccagttttggtaagaaagtaatgttaattgataaatttccaacaataaatgtgtcactcctaaaattattctgaaaggtggtctaagtgaataattttttttctttctcaaaccagttttggctaattgtgtgtttctgaacataatttgcttggttcatttggttactggtagttataccaatgcagaataacaaagttttatggtgactaacaaaaacaaaggatgtccaacatatactttcttgtagataggaatagtagataatctccggtatatttggtagtggtttaaactagtgtttgttgttgtcttgtctaatgttctgcttgtaactgtctgtcaagaacatgacttgaccttatgaaacatatttgactgggtatctttagggctgatattgttgttgatagcattatctaatgtcatgcttgtaactttctgtcaagaacatgacttgaccttatgaaacatatttgactgggtatctttagggctgagattgttgttgatagcattatagcaagtatgtttgctgtctccattcttctgtggtgccattcacttactcagacttgctcttctgttgaagcctgaaggcagttcattgtttgaaatattttgaatgcattatcataaccaagtttttgatggaaaatcaatgttggtgtagcacacagagttgtcattagaagacctcttttggattatgatgatgctttcctgctatgccataaaggaaaataaacatattattttttataaaagaaattatgcggacttggtaatatggaattatttgtctcacatatgtgcatctattacctgttgtacatcgcaaattatctgatcaccatcttgattcatgaatatgaactaatcatggagttgagctttgctcttgcagcacaagtttactatgtctgggatggcatttgatgattcacctgcccaagtgaatgttgaaggagatgtttcagagaaaaaagtagaagttcaagaccaga

SEQ ID NO: 6223 - DNA, 256 bp, Zea mays
cacgctcttggctctcgtggtcgtgggccttggacgtgcgcccccgccgcctgcctcagcgcagtggtcatcggtcagcgcgcgttctcgctacgcgttctccacttctccccacggcccacgcctttcccagccaaaagaaatatccaattcctcaccctaccccctcgctgctttctcctccccgtcgacctcgccaatcttcctcccgctaaccctagtccagcaccccgagatctgctccgcgcgagcagcc

SEQ ID NO: 6224 - DNA, 737 bp, Zea mays
acccctgacgtcgctatggccgccgccgccgcgtccatgaaccccggggttagctccgccacagccgccacggcgccaaccgtcccctcctcgttcatgtactggggcaacggcggtattggcggcgctgccgcggcgtggccagacctcaccaactgcggatcctccattgccacgttcttctagccgtctggctgtcccgcactcccgctggcctcgcgttaacttcgttttttttaccttaattttctggttaattttttcttgactaaaataacatgtaatttgtggggaaagctgagatgagagagagagagagagagagagagagagagagagagagagcgcactgtggaagaagagagctagatcatctcaccacctcatagggcagaaaattggacaaatcaaacaatgatccaatatttcaagaggatttcttcaccgacgactctgagcttcatcggatctatggtcttcgccgtcgagcgatgatcaaggccgtcgacgactagagcatgcatggatttgggaggaggaggaggacaacatgagaccatggggaagctaaagagagctagcaaagaagccaagaagtgtaagtgcagcgctgccatgacactacttgatttcctacttcgttcttggctagctagcttctccttgggtgttttgtacatagagcatatggtgtgtgtggggatacaatagtcaaggtggcccatgagagatcatgc

SEQ ID NO: 6225 - DNA, 126 bp, Zea mays
ggtatagtgtaccatgattgagagcacatgaattgatattcagtaagcaaattcacctattggctgctattaaaactgtaggttagagttcctattggaaaattcctgttggagctgcctgctggg

SEQ ID NO: 6226 - DNA, 698 bp, Zea mays
ggggtcgagcagatcaggaacatgcgccartgattagtggctaggaaggaaactaagattggtcaggtcctataatcaaggtgagcttctccatttgctctggctgctggccttataaatggattgtaaccggacctttgaaggcaagcaataatcagttgtctctcacctttctacctctgttaagcccgcggttgggaggcataatccccaccggagaagacagccgacggctacgagctgtgtagccgcggtccggcgagtcaagggtacaccgtccttgacatatagaccgccgtatgtcgccttactgccgttacaatcatggtgtaaacgacctctaaggaaactatcagggcaaccagttggcagctacatcaagctgtgccctagcatctgctagacacctgaactgcccatcctccaaaatctttcggtaatttgctatggcaatatgaaaagaagcacagatggtaattgtattaagtggaatagttattttagatcatattccttctatagtatctctggtactaagttacagttttgtttggagggttccaatctattttacataattgtcaatcatgtagttttctctttcgacataagcaatcatgtatttgtagttgctttaccactatactgaaaattcattaaaatattttgttcagggaatacttgtttttgcttctgtt

SEQ ID NO: 6227 - DNA, 203 bp, Zea mays
ggtaacttccagaatcatgtgcttgttgacaccgttatttggttaaggtagattgctaccataattttagaatttagttcaaagttaagttgcatgaattcagacaaattagacctaaatgattatgccttttgcatatatactgctggtatgaagtttgataataatcattattcgatatctagtttcttgctagggtgacc

SEQ ID NO: 6228 - DNA, 210 bp, Zea mays
tgcatgcctgcagacaatcttgtttccttctctcccctccccaaaccccagcgccgcctccgccaccgcgttccgggacgagtcaccgctccgtcggcacggcagcttgctccagtccacgccacgcgctacgtcgtcgcggtcgatcctcccgtgaggcagccgtgtcgctaggcaccgcctatttctcgaacaaagtcgctcgctacc

SEQ ID NO: 6229 - DNA, 50 bp, Zea mays
tgcagctcctatgctgtagtgagtcattaacgtgcggatatgaggtatgc

SEQ ID NO: 6230 - DNA, 475 bp, Zea mays
gagatatatagggaaaatatagggaactacggaaaagagaaaagtatgagtaaatttttttgcgacgtggctgtatagtgcattatataaagaaaaatttagattgcagatagtctttacgctacccgaagctaccacgaccaaattatacaatcctgtaccatggaatttccagcacacaagcttgttttcaagcgtaagcctatccgcgtggctacagctactggctcccggttctacccctgcgtcgagaccatttcaaagtcaacgggccaatcaccgcgcgcagaactccaagtccgcgcaccaaaaccatcactgacccgggcccactacactccccctagtttcttttcccccggttttttccgtcctctcctcactcgtgtccgatggctcgcccccgccgcctcctctgacgacggtctgactgacccccgcctccccggagagcggctccgctgtctcgccggat

SEQ ID NO: 6231 - DNA, 184 bp, Zea mays
cgcaaacagtcgcgcaggcgttcgatctgatttcaactcttaagagttggctcatttatgatttgagtcgatagaaagtttagttttcgagtagtctcgaaaaggacgatagcttgggtggatcagatttgggggaatttcctggatcccactgaatggcatgtgaccaaattgggtagtagac

SEQ ID NO: 6232 - DNA, 87 bp, Zea mays
ggtacctaaaacccaagcttaattaccttgcaggtttatgcatccgggggctcaagctggattattgatagcggaagcacaaaccac

SEQ ID NO: 6233 - DNA, 884 bp, Zea mays
taaggcgggagctaagcatcttgacagtctggggcttaccgtcacctttaatagggtctagtcgggcctgccagccatctcctttgttttgtttcgccttatatgctgttggagaggaggcatgggtgttaggatcttgatgatcaggtccagtgtttgtttttctgccctccagggctttgtatttcggtccattttggacctttcctttcttaatataatgatgcgcagttcttctgtgcgttcgagaaaaaaaaagatacatgggtctaattatgtatctagacatgacaaaaactgttgtgtagtcaagtttcccgtgcaatcaaactactaaaagtcatacaaaaaaaatcaaaatttatagatgtgctttattatttactctaccgatttaaaattttcattcaccttatgttaagagagataaaaaggagaaaattctatctaatagtagtttgattgcacatcgattgtacaggaagtttgattgcgcaatgactttcgtcgataggcataatgtatatctagttgtataacaatagttatctatctagaaaagccaaaacattttataatttagaatggagggagcacttttctattttaaaaactctccctgagctttcataacttaattactaattttaatttcaaatgctttacagggtggcggccttgctgacaagaaaagcatctctgagacgctaagagatgcatgccgaaaaagattgttggatgctcttggacaagcaaagttgcgactcgggaatattccgtgagtctgcttccagtttggcactgtttggttttgaccattggccactttgcccaaactgctaattaaagcatgagataccttgtgttccgaacttgttttgatc

SEQ ID NO: 6234 - DNA, 425 bp, Zea mays
aacccaaaacgactgaggggaccgagcttgtgctgagcagcagagatggcgggaaatgctgcgtctcccgcctcagtttcggatgccccgcctttcccaaaccggccaccgccgccgcccgtgtctccccaccgacaggtgggtccaatccttaaccacggaccagggcccccacctgtcaggtggaccttccgaagcaaggatcggccaggcgggaaaacatttcgcggcaggtggcggttgcgccaaatttctccctcccttttccgttcggcgtccccaaacgcctccctattaatctccccgcgttccccttccctcgcgccgccgctcccccctcccaaagctcgccccgctcccagctagggtttcctcttcccatccacagccgccggggcgccgccgacgaggacagcgccgccacg

SEQ ID NO: 6235 - DNA, 140 bp, Zea mays
ttccgtaacctcggattccggcttcgggctgccttggaagccacaaagcaaaaagatggaaaggggcattggcatggttctcacagggccattttctttctcactccccaattcccaatactacctttcgtctcaaagcc

SEQ ID NO: 6236 - DNA, 535 bp, Zea mays
ctctttatatttataggggagaatgtcttgcctgtttctaggcgataaccaacagatatcacgtgattagatagataaccatgcacgagataaggataatcaaccgagttaatctgatcgcggggtgcgcgaactgtccgaatacaaggaccggaccgtcaaccatttttagtgctcaagatgcaactaaaataatgtgtctttaataggtgttgtattaggttgatgtaaatattccttgggtacgccacattcggtacaaaggttatgtagatttttttctaaagaaaaggaatggccaagaaaataaaagacaagcgcataaataaacgcacgcagcagcactgattactgactgcggacccggtaccgccacctatttgggagatcaccagtggcctaagctaaggcagcttccatgacactccacgccgcggtgccccttcccaactctctcccacccggcccgggcgcaacacaataactagccgggcaccaacactcggaggcacagcccgtggctcccgcgccagcc

SEQ ID NO: 6237 - DNA, 930 bp, Zea mays
ggcgggacgcggggtggggtgcgggcgcgggcgagatgcggggtgtgtgcagtagaatggtgtggacgcctatgttacttacataattagtagtagagataagccttgaatgaattgcattcatatgagcgaaggttatagatagaaaacccaaccgatttacaagatactgaaattctgaacactatgtccgacaataccgagattttgaaagcagaagcatttccaccaataaacgattgaagaataaatccaacagattctggagacaatttgatactgcagcgtccaaaagaaaccaccaagaataattcccgagaaaagaaactcgggtgccagttgatcaggcagttgaaagaccatgaaatccaatcttgaaagtgaagaccagaatggaaaccaagtaccttaccaagatgatgtgggattacccccatatatggaaccattcctttccctcctggctttcgtctgcccctcaagcgttgacaacaactagctaaccatcgttctgtaccctctagagcaaaactaaaccataatttaggaaaactttataacaaatcgttgttgtaacaagaaatgttcaaagatgtatccgggaaccggagtgaggaaccttcaatagcagattgagaaaatttaccgtaaggtgtgtaaaataatttctgcatactgatctgacccctctatcaggtaaggaaaaaatgttggttgattgttgatatggttaagcaacatattggtatgatatcctaaattctggttgttaacttacaagctcatggaaggttgatctcgagacggtttgccatcttatcccttatgttacagctcaaattcatagcttttgttctttgtgatggcttcaccaacaaactgatctgttcttgatgcctgcaggctgcaaggccgtgctagtttgaaccc

SEQ ID NO: 6238 - DNA, 56 bp, Zea mays
acataggaataccgatgtctgttaataatacgatgtcttgaactgacagaaagcat

SEQ ID NO: 6239 - DNA, 304 bp, Zea mays
agtcgacacgcgcgcacataaacaagtcaaaacagaagtcaacccgcccctccgccacctcgccgtcgtgccgtactgtcgtgtatcctagccccgcgcctccttcctatatagagagagcgagccgcgcgaggtctctgcagccagaaacagagctgggcgcacggagagaccaggttccaagcgaaggcagtgcaggcaggacgagtggagctagcgtgaccttgcgttgccttcgccgctttgcttgtgtcgagaggagaagcagagcagcgggacacgagcagcgggttggaggttgaca

SEQ ID NO: 6240 - DNA, 1359 bp, Zea mays
tggtggtggcactgcacgagaaccgtaggagcctggaggaataagagcttctacagtgacctggctaagtagacaacactagaatgagaacaagtccaaattaatcaattaatcaatgtggcgagcttgaactgaaaaggaagcacagcaagtgtgacgcttctgacagcaaatcycaatctgctgataatccaaatctagtgcctctgactcgttaatttgaaacaaattaaaaaatcaaatgagtgcaagtaactgacaccgtaagagaaaacaagtccaaattgagcataactaaccaaactggaagcataacaagttcaatgtccctgacagataatcccaatcagctgatgtaatccaaatctagtgcactcgccagtcattagtaatttcataaagcaatgctggtgacgaacctaacaatttattcatccagaagaagcgcacttatcctcgttgatgcgaacggggtggagagggtgagccccaatacagagcaagtctataaacccaaccttatccaacatccaaaccccaagcgccccctctaaaaatccacggaaactgaaccactgtccctaacagaaactaacgccgcccggaccaccaaaccctaaaccccgaaccgcgcgtcgcactcacacccagaccgacactaaaatcccctgtttctccgcggcgaacggaggcggtcggagcagcgggctcggggaggaaggagaagtggaagcaaactcaccagagcgcagggtgcgggagaggagcgggaggcggaggcgcgtgggggtaggcgccgccactgcagttgctgctgccgcgagagctcgcatcctcggcccgccgtctgttaaatacccccttccctctcacggtcacgcgtgggaggctgggagctgccacttcgactcgggagagccaccgcagccggtagcgtagcgtactagcgtgcgcgacacgcagacacagtcgcacacacaccgcgcgagggttcttggccggaaagagaaatttgctattttgccactctcaattttggctgtctgttattatgccatcccgtgtctatgactggtgggaccgtctgtgtctatgatttgtgggtccgataacatattggcgaaacccacaaatgataatggcaaaattgccaatggctccttatccgacatgggcaccaaacgggcgggcacacgacacgcccgcccacaccacagagagagcagcgcgacctcacctcccccttccacctttcccgcaccttgttgcacataaaaattcccacgccccgcacccaacgacctccgcgtccgcccccaaaacccccgcaaaccctagccgccgccagctaggcaagga

SEQ ID NO: 6241 - DNA, 1359 bp, Zea mays
ttccttgcctagctggcggcggctagggtttgcgggggttttgggggcggacgcggaggtcgttgggtgcggggcgtgggaatttttatgtgcaacaaggtgcgggaaaggtggaagggggaggtgaggtcgcgctgctctctctgtggtgtgggcgggcgtgtcgtgtgcccgcccgtttggtgcccatgtcggataaggagccattggcaattttgccattatcatttgtgggtttcgccaatatgttatcggacccacaaatcatagacacagacggtcccaccagtcatagacacgggatggcataataacagacagccaaaattgagagtggcaaaatagcaaatttctctttccggccaagaaccctcgcgcggtgtgtgtgcgactgtgtctgcgtgtcgcgcacgctagtacgctacgctaccggctgcggtggctctcccgagtcgaagtggcagctcccagcctcccacgcgtgaccgtgagagggaagggggtatttaacagacggcgggccgaggatgcgagctctcgcggcagcagcaactgcagtggcggcgcctacccccacgcgcctccgcctcccgctcctctcccgcaccctgcgctctggtgagtttgcttccacttctccttcctccccgagcccgctgctccgaccgcctccgttcgccgcggagaaacaggggattttagtgtcggtctgggtgtgagtgcgacgcgcggttcggggtttagggtttggtggtccgggcggcgttagtttctgttagggacagtggttcagtttccgtggatttttagagggggcgcttggggtttggatgttggataaggttgggtttatagacttgctctgtattggggctcaccctctccaccccgttcgcatcaacgaggataagtgcgcttcttctggatgaataaattgttaggttcgtcaccagcattgctttatgaaattactaatgactggcgagtgcactagatttggattacatcagctgattgggattatctgtcagggacattgaacttgttatgcttccagtttggttagttatgctcaatttggacttgttttctcttacggtgtcagttacttgcactcatttgattttttaatttgtttcaaattaacgagtcagaggcactagatttggattatcagcagattgrgatttgctgtcagaagcgtcacacttgctgtgcttccttttcagttcaagctcgccacattgattaattgattaatttggacttgttctcattctagtgttgtctacttagccaggtcactgtagaagctcttattcctccaggctcctacggttctcgtgcagtgccaccacc

SEQ ID NO: 6242 - DNA, 573 bp, Zea mays
ctgaccaatccaaagtatgtccagaggaccctttagccataagggatgcatgtgtgccttctccacaacaattctttttcaagcacagtgatctggtcacagttctggattgtgctgagcctgtgtgccaccacaatgcttgtcctgccaaccatcactcggtccaatgcctcttgtaccaccttctctgactggctgtccagtgcacttgtagcttcatccagtagcaggattgcagggttcttcaggatggcacgggcaattgcaatgcgttgtttttggcctcctgagagctgcacacccctctcaccacaccatgtgtcatatccatccttgaggttgctaatgaagtcatgtgcattcgcagaccttgcagcattctcaatttctgcttcggttgctgtttctgtaccatacacaatattttctcttattgtacctgcaaatagtgttggttcttggctgactaatccaatatgtcgacgcagggctctgagattgtatgttttgatgtctttgccatcgatcttcactacccccctaagtgggtcgtagaacctctctataagacct

SEQ ID NO: 6243 - DNA, 669 bp, Zea mays
ggtaatctgaacaactcaaaggctcaagaaagaatggaaaaaggattctgcaattatgctttcgagcaaaggtcttaacatcgcaacatgatttgaaacatccaaaatcaaataaagaatgccaagttatttatgatgttcataatggtctggatggaggattggtttattcaagataattataatttagtaaataatgatctgttgaaataaaagaaggattttgagataatcgatctatttgtttcatgttattatgtttcacagtgacttcctctagatatggactgtagttttcattagatacggtgatctttcatctttgtaacaactgtgaggcatagaatttagtcttaactactgaacttagttccaccagctacatgttttgctgatgtacctgcaaggcatacggttaatctcaactagtaattatttgacatgcttagttgtatttcacagtttgtttgtcttgtctctgtcttggaatttaaagtcaatcccactgccccacattactcatttacactcaacattctgcttaacaaaccattggcgtatcttggttcagtgggaagcctaattggttttgtaccgcacctgcatgtgattctgccgattttttaaaactcttatcatagtgattgctgagcatacatactttttgat

SEQ ID NO: 6244 - DNA, 210 bp, Zea mays
attctttttaacattgggtttataaagattcataaaaaagtaaatataaaatatattctatgtgctctcaaataattcagtatggattcagaaataaattcagtaaaattttcaaactttttattataaagggcaaataatatataaagcaatttatacaatattttattatttttgtaataatattttataacataaaattgtatacat

SEQ ID NO: 6245 - DNA, 181 bp, Zea mays
cgaccacacaaactggcggaactgctctcagctctcctcacgccttgcagaagcgcagaggctaaacccccgtctaaccctgctgccgcttgccactactccgcttcgttctccgccgcctccccggacgtccggaaacttctagattgaagggggatagccattggcgtcagcgtgtgtg

SEQ ID NO: 6246 - DNA, 877 bp, Zea mays
ctataatggttgatttggtggcaaaaatatcacggcaggcccatcaccttacaaagcatagacttccactttgtgtatgcctaactctaaggagaaagcggaaggaccgaaatttccactgaagtcggtcagtaccgtggcctgattcatgtgatggtttctctgattcgaagcaaagtaggagcagaaaacgcccgcaaaatgtccctctcctcctttccgtcccgtaccgtcgcatttccacgttccaataacgaaaaagttttttttttaaaaaaccaacaaaattttcaaaaattccagatttggaagcactgctacgttagcaggaaatgaatagaacattcttttttaaaaaaatgcgcgtacgtttgcacgtcaaattcctcgtcgggcttcttcccgtcgtccacgtccccgtaccttccgttccctttctcccgttcgcacgccgcctcgtgcactcctcctcctcctcctcctcccagatctcgtgaccattgccattccctccctccgctacacgccgagcgcccccgtccggaccaggcgtctccgcggctcctagtcctcgccccctccctctcccgtggaggactgccgcggggcggcgagggagaggagatccgtcggtgctggctgctggttggtcggctggtcaatccctttccatcgtttgctggtgcgtgagctcagggtttggacagtttggccccgtctgttgcggattggacccggactggattgggttcgtgtggctgccgcgtcggcgggtgctgattccagcttgtcccctccccctagattgcgcgagacggtgcttcaggactgccccctggcgcggaggccgcacaggctcggcggcgccggcggcgag

SEQ ID NO: 6247 - DNA, 1362 bp, Zea mays
gagggagccgagccgtgcgggcgttaaagagagtcgagcgggtgcgtgaagagagccagagggggaaaggagccgagccgcacgggaagagcatgagctcgatcgtactggcacgccgtcggtccaggtcacggatccaacgatccatcaccttagttgatgaatatatatatatatatatatatatatatatatatatatatatatatatatatatatatatattagatttgtcctaataatatacaatatttcatctttattcaaaagttgagccaaacacgattatagtctagctttattctgaactgttcaatcggccagcttattagaaaaactgttagctagtttttatgatgatgattagtagacacgtataccagagacagcatagatacggccagtttcacaacgacgacctctactccgtttgcgtttcatgattaatggaggccggcagttagaaacaatatccaaatacatgtgctcgaaaaaaagggagaaataaaaaaaaaaccaatgatagatgcggataaggcgacagcacagctgacagggccccacgcgtcggcgggcgcgcgccgccgaacgaaaccatcccggcaaggcaagcaagcaaccgtggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcattcgcatccggtagctcgatcacttcttcctctggattttgggaaggaggcatcggacgtcggatgcatggtgagacactcgacgtcatgctccaattctgcttcgcggaacgtattcctgtcttcagttgccgattctttgtggagtttgggttggtggttggtgcgggcgagtagtttgatggaacgcccaacagggcctccgtttctctcttttgcgaaacaaaacaggcaccctgctctaactgaaacacgatcccatgcgcttctgtctgatgagataatctcaaaagaccttctttgcctgtttgtaatgcttgaccaaatcagtttcatctctctctcttttttaaattttttttccctatgtacagccgatatgcaccactattatggagtatttgacttttcgttgttcatatctgatgcctctccagttctgtctgaaatggagatgccatgcttgtagtagcttctgtttccacctaactcaactgacctgccaattatgccctgtttctccaacagacacactcattgcattagcgcctacgcctaccgcaagtggaagcct

SEQ ID NO: 6248 - DNA, 460 bp, Zea mays
ctacacgcttaaggctagtttagaaacttaatccctagaattaaaaaggactaagggagaaattagtttttttctcaaaatccctccaatttttaaggggtttgagtttcgaaactagttcggaaacttattccagtttagaagccacaaaatagagaggattgaacgagctaaaatcatttttcatatttaggctcccatactaacccataaataaaaaaaataccgctactgctaatcaactcgacgcggactacagtctctctccatcttctcccccatgccggaagctcaacaaaaacaggcaatgggcaacgcataggcatagcttggctcgcacggtgtcgctggctcccctccccttccctccccactgttacatccagcgagctgttcacggccgtgccgagctcagtgaggcagcgtttgcgagtccgggacgaggggagcggcgggcgac

SEQ ID NO: 6249 - DNA, 1500 bp, Zea mays
gggaagccgatcgaaccaggcaatcccgtcgtcgtcagtcgtcaccacgtccacatgctactcaggattccaagcttaaggatcaagctacagaggagaggatgccacggcgcaggtctccgttggcgcctttttctttttttgtttgtttgtttccaagtcagaaatgcatcgtgcctcgtgccaccatcacttggtttcggcggttgaagtaatgaagtccttccgtcttcagattacgctagcagttggactttgagaagattatattgaagtaaaatgcaggactgataaaacatagggatatcaccggcatggcggcattccataggaaacttttcaagagattagacctcgtgttaaaatcctccaaaatctcattataataatctattctataagaattttatataatatgtaggaactcaatcctttattttaataaatgatcatatagaaaaattttctatagaatttcaatcctccataattccttcacttttgttttgggaggcctaagtgtataaccgccgaattgtctatgtttttttttccaattggctatggatttttagtggagtccgcagtccaatctatatccatacatgatattagagagctaatttttctctaatagagacccaaacaaagatcctttggaacgcgtgaatttaagacatacatgaatttgacaggagtcggttcattttcatagaaaaaaacacagaaaacgagggggaaaatcgcgtaatccaaaggagcttaaaagtttatgaatccaattaagagagacatttaaggaacagaaatgtattttactcgctttatccccgcgaaccttccaacacaagggtctgtttgtttcccttctatattatataagttggtggaaaggtataaagataaaatatcactttgtaatcataaataaattaaaataagatacctaacatcactttgagactacaaataagttgaaataaggtagtattaggtagattactttaacttatttgtcattctaaagtaacattttaccctttcactctttcatcaaaatatgcttatactctattcattcaaatctataattcgtttgacttttttatcctatgctttattgacttgtcttatttaaaaaattttataattattataaaaattttaaattattactatggtattgtttagcatacaaatatactttagttttgattttgaaatttttatttttttataaaatttttaaataagacgaatcgataaaatttgggaaaaaattaaatgaattatgaagtatgatagatggagtatttaacttacgaaaagtcaaacgaattataaattgtgaccgatgaaacaaacggggcctaaaccggtcgcgtcatcggacggtccacaggcctcccgtgcgccccgcagccgtctccaacggccgatccatgcccgtctggcgtcttcctcagtcgcatcccctcgttgaggtcgacagcgacggcc

SEQ ID NO: 6250 - DNA, 1500 bp, Zea mays
caaagtcgttggagcaattcattgaggcgtgagggggagttgcagatcgatataaatttgtgacatataaagtccatgctcaatggacaagttaaagtgctaagtcaatggaacctgttacactattttagggtctgttgtatccaggagctaaaacaaactgactaaagtttagttcctctttagaagctaaaagtgactaaaattgtgctttttattattctagttatttttagctcttcatgtctagatttttagtctctaaagtgacaaaactttagtcgtttttgttttagctcatgagatcaaaacatgtccttagtcgtgtgacaaaccgctcgcctatgtacaagaattattctgtgatagtcaaggcaatttaatgtgtgaaaaatacatacaatgcgaatttatggtcagttattgtgatgttttttaaaactagttattatgataaaaccattctcaataggagttttatgtgagttttattctcattaaatgacatgtcacctaagcaaacaagatgatatgacatgtaatttaataaaaagagatatataaagagtttaataagagataaaaaaatttcattgggataaaactcttgatacactgttttgtagataaatgttaacctaatagctttaggccgtgtttggtttctagggataatgaaaatctggctagcagaacatagttgattttccatcttggataacgtgatgcgagagactatccacaattattcaagcttaggttggaattttttggataatgtgtatggtgcagattctaataatcggcttcaactaaacggcgcatagaaatagtatgataaaagtatccattgaaaatagcctaatgtttgcgatactagatatggctaagagtgaagtagtcaatgtgtctcctctcccctaaaaatggtaatgagctctaaattttaaactataaaatttaagaatcaaatcaaattaggattttaaaaactattttttccatttttaaactaaaattaactaagggtttaaagataaattataaagaaatatttggatcaccagtaccacccctgcctctctcgggctcgctttcgtttcgtgatgccctatagacaaacggcccgaaaacctaaccttgatgagctggtgtcccacggcagcttttcgtttttcgtgagctgggccttccatcatccgcctttcctctctcttcctcgttatactggcccacaaaagcccatagccccttactcattcacctgcctcttcatctcagcctcacgccacgcacgcaatggctggcgttcgtctcgtcggcgtgcgtccgtcccctggccgtctggagaggtgggtggggagtctaccggacgcgggtagccggggcggtcgccccaccttgccgatacgaggtgtccgctcctatttcattcggtccattccgcctctcggaagagttgagagaggagtaaggaaggcgaggacctcgcgccccgcg

SEQ ID NO: 6251 - DNA, 98 bp, Zea mays
cgtatgtacatattctttgctttgttctttcgaaacttgaatatagatcttgatgcataatttttcttctgcgagaaagctggatttctgcttatttt

SEQ ID NO: 6252 - DNA, 460 bp, Zea mays
tgggcggtttcacgatggccgaggccactcacttcatggtcctgcattgcattcgggccgtctatggttgatccagcggcctctaatctaacgctgccggaggatatgaatggaacaaattggctgtcgcgcgcgcgcgctccatcccattccccgccttctctcctccattccattgatccattccatagtcgaaagtggcaatggcacgagcacgacctccccatattgggctggccagccggctcgcttccacccttcctcctctcccattccaaatttagctcgtcaccttcggcatcgccgttctcgtgttccccgccttcccgccgmtgctggacgacagccggccgtcgggccggccgcgacgccgagggctcctcctcgttcttccttgcacgcggcattgatcaaccgacgaatcccttccactgagcgagaacggcaggggcacrcgcgg

SEQ ID NO: 6253 - DNA, 178 bp, Zea mays
ctttccagtgacggtcgacgaactgatccgccaaagcggcatcgcccccgcgatcctccagaccgtgttgctcgaactggaactcgccggccggctggaacgccacgccggcggccgcgtcagccttgccctttgaatcgagacgaaccatattcggtccgtatttggtttggaggca

SEQ ID NO: 6254 - DNA, 999 bp, Zea mays
cacaaacgcttgcagggtgcatttcttccccatcttctacgggataaatccacgacggagatttaagtggggattgggatcccgcttaaattataattaggatatagattctttgttattaacgcaaaacatcattacttctatatattgtgagatgtaagaaattattatgtgtacataaaaaataacacatttgtacaatgagtaatctcttgataagataattaattaattttattattaagtagtatacgaaaacatcgtcatgtgcatgtttaacgggtctccgcgaggaacgagatggggaatccgtctttgtttaccgagtttccgcgtttacatctccatgaggtctagtttgctagtcaaagtttattcaatccccttcgattttgtagcccctctaatcccttttaattttgtgactcctaaattatccctaaaggaaaactccatcttctaatgtaaaggaaaactccatcttctaatgtaggaatttcgaccaatcggcgtttggcgtgtctaatccaaaacgagcgaaatgatagaggcgctgtaaccaggcaaccagctgtgagctgtctctctgcggctctgtgcttgccccggcaggtgacccctgctggcagccgcagccaccagcgaggccggtcagtccggcacagaggatctcctgactgctgggtccgatctgtcagcataacatcccatggtcaccaacccacccttcgcgccgcacccggaccaaaccctagggttaaatacattttgatccctgcctctctcccgcacgcccccgccccgaagacctcgcgacgccaaaaaggaggagagaccgccacccccacgcccgcacggcccactcagcgctctccacccccgtcccctcgcggcggcggcggagcccgagcctgagtcctgcccccccgggctaggttggtctccgcctccgccctccagtctctttggcacaacctgcagccgctggcgcaggtggac

SEQ ID NO: 6255 - DNA, 753 bp, Zea mays
tgtttaaaggtggaataatatatagtttgatttccattatccttggaatccatcatatctcatgctgttattgagtcaagtcaaaagccttacatttataatcttatcactagcctttgtcctgctgtcttcctcacaaagtcctatactcaaaagttctatgagacatgcctcacattgattaatatcctgtagtcgaaatgtttaatgatgtgcaacctgtacaactaacaacatttgctggtggtaaagaaattatattttgctggcgcgcacttttgtaagaactatcaattaaagcttatctagagccaggcatacattcttagtggaagaaacatgagatgcacattgtgtagtgttctcggtggttcatgacgctgatgttgaactagttacttcgactggatttattgtttgttgcttggtcaggcatgtccttcatctgccacaagtgggaactcttttggccaatcttaaggttgtaactgacattctagtctgaatgttggatagcacaatcgagattgccatttgttcctgcttgttgctcctataacacttttgtggctgtagcatgcaggatgtttacatagtgtaagacccatgaggtcaatgattatctttttctagaagggtctggtatctcgatgaacacatgtggtgccaatgaaggcagcatttactcttttttcccctcctcttgtacttagtgctgcatcatgatgaaacagtgtccagtgcttgaccttg

SEQ ID NO: 6256 - DNA, 410 bp, Zea mays
agcagggtgtgtgacacacgcgcttactgccgaacgccaaagcccccctggccgaaaaggatagagatgtccaaagccatatagacagggacagctgctatactgctatagggtaggccaggccggtgacgtcaccacggcatagctatccattcctcctttaaaaagctagtagtcccacacaagctgcactgcgatgtggtcctctcctcctatcacctgacctccacacacacacagcacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgc

SEQ ID NO: 6257 - DNA, 1168 bp, Zea mays
ttagccgaaccagacctaatctgaaatgaatggtggcaaaagtaaagagttacaagggctcagctcactgaacgttcagacagtaaaaaaaaacaagcagaagctagtaacaacaggagaagaggatcgctgcacgggcatctcactagtttggataatattgcagatccctagtgcatcacattagttcttgcatctatgtactaattgaatgaattggtttggttacactcttttactctggtcgttgtcacctagtcgaccgagaggttcgtagggttattaagtggcttggtgattgttgttggcttccatcatcggagatccacaaaactaactctagtatagttttgtttttattttatagtgtgtttggtttctttggtcactctcttaaactttagagactaaattttagtctctaaaaacctatttgaaatacttattttaatcacccccgtttggtattttagagactaatgtttagaaagttggaactaacacccccttagttggagtgcctctctagtttagttgttctaatgctcaaatattcaacttgtgtatcttacgatgctcaactattgaacttgatgtatgatgtcaattaatatattaaccactttttttaactcactacaacaaagatatatgttgttggcgattaatcgaatagagatagactagctagtcatatgtcatatttctacggttttatataatatagaataaattttattttaaaaaagtacaaaatatatgttttctatttattaggtagatgtgaatgtggtcaacaatcaacgttcaaacactcacttatacataatttcactttattttttatataaactctactattatattaatagagaagagattatatgagtcagagttgattttaaaaaaaacgtagtgattttttaaaaaatattgatgtgatagaccgttgaaactagtattttaatatagaaaaagattattgtatttatttaattgtttcaaaaaatctttatagaagagggatatatggtgtcggtgtcggcgttggcgagtggcgactggcgacttctctgcctcgtcctccccgttttcccctccgcgtccagcccggcgcgacgccgccacgcacctagccgcggatccgaggcgcagatccaatccagcg

SEQ ID NO: 6258 - DNA, 1500 bp, Zea mays
ttacaggacacacatgacctgacctactctttttctactactactgtgctgcagcaagctacatgacccttctcagcacattgccgtcgtgtattgcaaaatttcggaggctttgactaaaaaagcttcgttttttcgagcttgctcctgccccgaaataaaattcggggccccaaaaattcgcaattctgggggctggccccccgaattagcgcgcctcccggagatccggcgccggtgagtccccagtcgatccctctctctgtcagcttctggttgaggtgcgtctcgccgccggccgcggcctggcgcggcggcagatctggcgggcgcctagggttaggcccgtctcgccgggagtccccgatccatcagtagggggcggccgccgcgtcttcttcccccgcagccgagatcgcccctccgcccgccgcctgaacccttctcctccctccgctcgctgcgccgcagcccggagaggaaaccgcgctctgtcgaccaccgcctggggcccagcgtcctcgcgacctgctccggcgtggcgtccgctctctgcagccccagcgtccccgcgaccggccccgcgcggccgccacacagctccgctgctaggtctccgtccccacatgactcagatccaaacaccatggtctccgttccccatgagcccatgaaccaaacacatagtcagttccttctcttcttaaggctgtggatcacgcggatcgaggcgtttcttcgattctagctggggtttgggggaggtgttcgtgaactggattcaaggtgcctcctactcctaggggcctggtttgtttgtttcgctttggttttttttacatgctattgtcggtgaggttcgatatttgtgggcgtgtgtagaaagtttggatcttttgttccacttgttgctatgaaagacaccattttttgtcgtgggaattgttggaggagttgcttgatctgcttagtttagcagctgtagatcaaggatggaatcggagtaaggatgctcgggagcccgaatttagcgaagtgaatctcagtgttgcatagtggtttgatggaagtacatgctctttccgagctgaaatgtcagttctccatgaaatagagctatcgataagtatggtttaactgtagccctcacttctaatttcctttggatctgaaatgaattggttgaaatgtggtagtttacttttctgggacctcttaagtgcttatttacatgcgtttttgtaatatatactgttacgtcatgagttcttccgttttgatgtttgttgagatttctaatctggatgtacttaactgcaggcccaggcagtgaagatttctaatctggatgtacttaactgcaggctaaggcaatgaagatttctaatctggatgcacacttaatcttgtccagttcttgatcttgggctttgctgcttcctctcaagttagtttgttggccaatcgagtccagaggcgcagatgagtgaggagtacaat

SEQ ID NO: 6259 - DNA, 1500 bp, Zea mays
aataatttatttccctttttacaggacacacatgacctgacctactctttttctactactactgtgctgcagcaagctacatgacccttctcagcacattgccgtcgtgtattgcaaaatttcggaggctttgactaaaaaagcttcgttttttcgagcttgctcctgccccgaaataaaattcggggccccaaaaattcgcaattctgggggctggccccccgaattagcgcgcctcccggagatccggcgccggtgagtccccagtcgatccctctctctgtcagcttctggttgaggtgcgtctcgccgccggccgcggcctggcgcggcggcagatctggcgggcgcctagggttaggcccgtctcgccgggagtccccgatccatcagtagggggcggccgccgcgtcttcttcccccgcagccgagatcgcccctccgcccgccgcctgaacccttctcctccctccgctcgctgcgccgcagcccggagaggaaaccgcgctctgtcgaccaccgcctggggcccagcgtcctcgcgacctgctccggcgtggcgtccgctctctgcagccccagcgtccccgcgaccggccccgcgcggccgccacacagctccgctgctaggtctccgtccccacatgactcagatccaaacaccatggtctccgttccccatgagcccatgaaccaaacacatagtcagttccttctcttcttaaggctgtggatcacgcggatcgaggcgtttcttcgattctagctggggtttgggggaggtgttcgtgaactggattcaaggtgcctcctactcctaggggcctggtttgtttgtttcgctttggttttttttacatgctattgtcggtgaggttcgatatttgtgggcgtgtgtagaaagtttggatcttttgttccacttgttgctatgaaagacaccattttttgtcgtgggaattgttggaggagttgcttgatctgcttagtttagcagctgtagatcaaggatggaatcggagtaaggatgctcgggagcccgaatttagcgaagtgaatctcagtgttgcatagtggtttgatggaagtacatgctctttccgagctgaaatgtcagttctccatgaaatagagctatcgataagtatggtttaactgtagccctcacttctaatttcctttggatctgaaatgaattggttgaaatgtggtagtttacttttctgggacctcttaagtgcttatttacatgcgtttttgtaatatatactgttacgtcatgagttcttccgttttgatgtttgttgagatttctaatctggatgtacttaactgcaggcccaggcagtgaagatttctaatctggatgtacttaactgcaggctaaggcaatgaagatttctaatctggatgcacacttaatcttgtccagttcttgatcttgggctttgctgcttcctctcaagttagtttgttggccaatcgagtccagaggcgcag

SEQ ID NO: 6260 - DNA, 754 bp, Zea mays
tgttctctatttttcaatgttatgattttcaccctctcgttttgaaaacgaaggtactgtttatgatatataaaaattgtatcaatgtacggaaagctaactaaccacaatagaatcttacacgagcattttgtcttcacctctgtccaatcagtattacttagaccatctaaccaatttaactagaagttctttcacgaaatttaatattatcaactacacctaacgacaagcggtatgatagagatttgtttttaaaacagagcgataaaataaaacaaactagagataaaattacaattgtaagccagatagggtatagtactatagtcacagatacccccaaatttttaacgcggcgtaaaagcgtgatgacactgcactggcaaagtggcaagccgcttccgggaaaccgacacgttcctgtcctccctctttctgtgatgcacaggaacaggaaaggccgaatcacccagaagccatgcctccggacgagaaaggaaaagaggacccctgcctcttccaaaaataaaccaaaccccacgcgaagatggccctcccaggcctccctggctggctctcctctcgtcttcgccgcccctccatacttcccgctccgtccctctcccccgctttgaccacctcctccgccatatctctcctccccctcccttccgcccaccacacgcagcatcacaaatagagagagagagagagaaaaacaaagaggggtcgacaagcactgacacgaccc

SEQ ID NO: 6261 - DNA, 526 bp, Zea mays
agagatcaaatcctctcccagtctggaatcactccaaacaaattagtgacgagagagagagacttttgtgttcatttgagctcttgcgcttggattgcttttcttcttccttctttcttgtgttcaactcacttgtaatcaaaacaagagacaccaagttgtggtggtccttgtagtggacttagtgtcccattttattgaagagaaaggctcactcggtctaggtgactgtttgagagagggaaagggttgaaagagacccggtctttgtgaccacctcaacggggagtaggtttgcaagaaccgaacctcagtaaaacaaatcatcgtgtcatccgctcttattcgcttgtgatttgttttcgccctctctttcggactcgcatttaattctaatgctaacccgacttgtagtgtgtgcttaagtttgtaaatttcagatttgcctattcacccccccccctctaggcgactttcaattggtatcggagctcagtacttcattagagcctaactgctcgaagtg

SEQ ID NO: 6262 - DNA, 104 bp, Zea mays
cgtgcaaatctctaatcccctgctcacccctacttgcatttttaattcttctcttgatttggtctgacggtgacacctaattgcagatctagaaggtgctcttg

SEQ ID NO: 6263 - DNA, 151 bp, Zea mays
gaaaaatataataaatcattatattccagctaagcatatcttttacaattattaagcttagagtatattgtgctatatatagttgctttgtccttgttttctaatggtgcttattttcacttgactagagaaatataaccatccttacaaa

SEQ ID NO: 6264 - DNA, 372 bp, Zea mays
aattaagaaagctcatacaaattaattgtattacaggagctcaagtgtatgggcaagctaacacttttaaactctgtattaccaatttattaaagttattttatgataacgctgaaaatccgaaactgtaatttttgtaatttttgaaacgaagtactaccaaacaaggcaaaattgactaaagttccactctaaatcaaacagggcctcaaaatggcccaggttggatgactggtcctagaaccctagtgccctcatctgtctaaaaccctagttcggtgaagcactagcctgagcggcggcgcggaccggcgagacgactgaccgaacgagtgcgccagagagctccctgcaaaccttgccgcgcagtaa

SEQ ID NO: 6265 - DNA, 1144 bp, Zea mays
taccttataagcgttcgctccatcgaaaaattttcatcgcgagaattaaaatccggggaattccccgccaagcagtgtcttggctaggcacgtgaggccgatccgtgtgtccgacgcgaacacaacctttccgtcccccctgcacgtcacgggagtccatggaggccgcccgttctagatcgcacggctcgcgccccgcgacgccatccaaccccgcgcggccccacctacagcgagcggctcgcgccgtgccccagttgccagctccgcctcccttaaaacccaccgctgttcgcgtcctcgtttctctcaatctctctcttctcctcgcctcgccttggtgttcacgccgtcgctagcgcctgccgcggcgaagcttctgccctccccggcgccgggctcgggtcgtcgtcggccaggtaaatctgcccgctctttccccttaccacttcctcccggtgtggatctgggctgtctacgggtttcagatttacgggggcgtaagcaagattgctgagatccatggcggtttctggtgggtacgaggatgacgtcgacgtttaggggctgtatttgcgctttatttttagggacggatggtttcacgcggtggatcgaacaagaccgatgcaacagaggtggcagatggtttttagtcacgctaaggatcagataaattgtttggatccgagctaattggatctgactcatctgatataattgcttagtaatgatcgcgtatttgccacggcatgttgatccattcgtgcagtttgttaggtaggcacggaaattattatatatatttgcagatcgtctgcatccttttctaagcttatgtggcttggcttgggtttagccagcacttgtaagctttcagacaaatcttgatgcacatgacaaacattgttttgctttctgagcattctgttcgactgcaaactgcacacatgtcctatgtgtgccttctcaagaaggaaatatctctatgtagaaggttgttgtataaactcgataggctcatttatattacggtaaagccagtgcatcttattaaacttgtcagccatattagactgtatggtcatactaatcattgtatcatgagaacttaccaatttctctttttccttattacaggaag

SEQ ID NO: 6266 - DNA, 347 bp, Zea mays
ggtaagatttgcaactccytgtctgtctgggtctgtgagctaacggacttgtgccaaattgttagtttatatgttcaaagtagatagaagtactactttcctatgagttagtttcagcaacaaggatgtggaagtaaaccaactgctgctctaacggttacatgcagaattgcagaccatgagttcaaccccatcttttcacatggcactcatcagactctttatggaatagttaacattagtgttattaagaacaaaagttagattcataattaagtgagtctataattttcatggccatataaaggagcactcatgtactagcgttgaatagatatttagctgaa

SEQ ID NO: 6267 - DNA, 1500 bp, Zea mays
caactattaattctggctagaatccttatctcttgtgtgattatcctaacaaaaccattggaaaccgcttaagaatgggtctagatccccctatatatatgaaggggtacgatcgattaaaacacacaataatyaatgtatcaaccaaattttaccatatatattgggagtatgagtaatttagctttagacctaaatattcacctctcttcggttctatatcatctagagacatcttgggtgacccgacgatctcaaggcaactctaggatctttcctccctgcggggtccaaccgggaggcaagatctagggtctgcaggagattcacgaagccctctacaccctcacggacggaccacgacctccacgctaacggtacgcgcgcctgcagagaagagcggagctccttacacagagtcgcgcgcccgtagagaagagcgaaactccctacacagagtcgcggatgatctggtaacctatcgtggatagtccatgatcccacagaaggtctcgtccccagcacgcggggtttagggatcgttggtgtttrgtccaaaaagacgctaacacccgctatttaaaactttgctttctaaaccgtagagtatacaatataaaatactctctctccatttraatttataatttatttgacttttttaccttaactatgaccggctcgttttattaaaaaaaattcataattattgttaatttttgatgtgatattatttagcatataatatactttaaatgtgaatatgaacttatcattttttcgcaaaaaataaataaatagaacgagccggtcaaacgtggcacaaaaagtcaaacggattctatggccccctttggcagagctctgactcataaaaaaacagtttcratttaggctccttggtttctctagagaagccgatagaagccatatttttggtgctctggattacagtaataaaacggctctggctctcgaaggactctcaacaagaaacccttttttgtgatagtttggtaaggacgtaaggctttgcaataagctcgaccctcaaaagagacatgccaaaagagccctaattttaggctgaaggagcagtgttttgtacgaccatccgttgaggacgtacattacgtggacaagagaggcggccagatataaataagataacatatctggtgcacatagaatattggtgcacatggtgtacatattaaatcatcaccactcattttaaatctaacgtctctagttgtttgctatattttgctaaggacaccctccaacgtggtggtgtgtagtggtggaagatgttatttgtaaattgaataatcaactagagacattaaatctaaaatgagtggtgatgatttaatatatgcaccagtcttttatgtgcaccagatatatcctctataaataaatgttgtagacctgcacgctgcacctgcaatacctgctcccccttgagtctgcaggttttttggtcggcgtacagca

SEQ ID NO: 6268 - DNA, 1500 bp, Zea mays
cagcataaaaacaaaaggatcacgtcgtttgggctctgggctctcgtcgcctgatctccctgctggtggctgatgctctgatggcctgatgactgacagggccacagacagggccacagagggactggagagcgcagcacgatagtagtgcagcacgcgtggtgcgccaccgccagcaccgcaccagaccaactgcacgtttatttttatgtatttgaatttgatgtttggattattttattttatatttgtttctaatatatgtacttatagacttaaatattaaatctatagttttataagttattcttgtctttatattttgaattgtatactaaatcattatagattatgctaaattatttatgaacaatttctaatggcataccttatgaaaaaaatcctagctaggccactgccggcgctgctcctccggggtcgtggcccttttcgccgctcggaccccttccttaggagcatataatcctacccatgcgaccttccctaatcatcgacatcacgcccaccaggaactcatcacagacgaagcaaaatagccgccactggagtaccataaacagcaggggaggtcgagttccagtcccactcgtgggtggcgctctcctccatccccgccttccttgacgccactgttgagcaggcatcgatgctcacgccctgggtgcctccttcttgaccacctcgccgtgagacctagaggagcggacgtgggaagatttggccgtcgtggaacttgcccacgctaccgctcgaattccaaccagtgggtctgagggcttcgcctggtggcgtggacggcataccgggtgttaggggtatgcttcgtagccgaagatcctgaagaaagaaacaccttcggcagatcctctcaaaagcagtgccgaagctatcactcataaagcttcggcatagtgacatgactcaagacgaaggagtgaaccgacttaaagatgaaatgaccaataaacccatgataagtttgtgtcatgattgtaatcgattgtgaagggcataaatgtaatttcacacaggctgcgccctgtgcctataaatagatgaacagtacccctgtactgttcacgcaatcttgtaatcgcttgcacgcgacacttggattattgtcttctgtcaagacgaaggtataaatgtaataaaatgttatgctttaatatctgaatttatataatgaaatatataaataagttcatgtgttttgatatattattcttttatatcttatatcttatatttcatctttcattgtttcacaattctaatcacgaaggtatgaccttcgtgatttttgctcatgaccttcgtccgaagttcattatatccttggggagataatgcttcaatggacgaaggtcattaacatttaacattttgtgttgccttgttcttaattcgaagcatttaagaacaagtccccaacattggcgcccacctccggtgaactcacttccactttttgagctg

SEQ ID NO: 6269 - DNA, 869 bp, Zea mays
aattatagcggcctcgcggaccgtacggggtgcacgaccggaccgtccgcgactgggtctgtctgacatctgacgacgcattaaatgcaatatagccgttgatatagccgttactactgaccgttgcattttcagccgttgatctacaggggcggaccgtccggacctggcgggcggaccgtccgcgctcagcagaatggagtaacggctaggaagtggttggtggctataaatacaaccccaaccacctccattcacttcatccaagcattccaaccttcaacattcaatacaagagctagcaatccattccaagacacattcaaagcctccatctctccaagtttcacaattgagaaaagagatcattagtgattagtgacttgagagagaaagtgatccgtgtgttatttgtcgctcttgtcgcttggcttttgcaatcgtgctttctttcaatctttcttacgttcaactcaattgtaaccaaggcaagagacaccaattgtgtggtggtccttgcggggaagtttgttcccgttcgattgagaagagaaagctcactcggtccgagggaccgtttgagagagggaaggggttgaaaaagacccggcctttgtggcctcctcaacggggactaggtttgcgagaaccgaacctcggtaaaacaaatccgcgtgtcacactctttaattgcttgtgatttgttttgcaccgtctctcgcggactcgattatatttctaacgctaacccggcttgtagttgtgattaagtttgtaaatttcagattcgccctattcaccccccctctaggcgactttcaattggtatcagagcccggtgcttcattagagcctaaccgctcgaagtg

SEQ ID NO: 6270 - DNA, 197 bp, Zea mays
agctcggtacttgtgtggatttgctagcatggagtcagaaaagggaggatgttgtatgtctgaaagctcggaaaaaggagaagcgagtgaagaaagaaaatagaacacaacctcctgtagaagcaccatatgttgcaccaaaaacgaagatatctatcaaacctgtaccagataaaactgttgagatttttgacggg

SEQ ID NO: 6271 - DNA, 921 bp, Zea mays
ggacagtccggtgcacaccggacactgtccggtgcccgatttccttccttaatcagcgcagccgaccgttgtcgaccgttgcagatctggcgcaccggacatgtccggtgcacaccggacagtccggtgcctctttccgaccgttggccagaccacgtgtcgcgcgcagattccgcggccgaccgttggctcggccgaccgttggctcaccggacagtccggtgcacaccggacagtccggtgaattttagccgtacgccgtcggcaaattcccgagagcggcctctccgcccgaggcagcctggcgcaccggacagtgtccggtgcaccaccggacagtccggtgccccagaccgaaacagccttttggctgtacacagccaactcttctttttcttttcttctttctgtttctaacacttagacaagtatattagtacacaaaaccaatgtactaaggcttagaaacatacctttactcatgatttgcactttgttcatccatggacatagattcacatttaagcacttgtgtttgcactcaatcaccaaaatacttagaaatggcccaagggcacatttccctttcaacaccgctacctccggcttcggctcatcaaagagcggccgtgggttcctttaactaggcaagagaagcctcggacagcaaggccgaccgagccgagggactcctacgcctccgggatacggatacctcactcgtcacctttgcacgaggcgactcacgcttggtgaagcggtttagatagccgacaggcgagtcttagtgctcgaaatgaggaaaaaacacggctccgcgccgaaaatacatacatgttcaggccccgacagccacaatgaacaagacaccggcattcaaggtgccatcgcaaactgaacttcggttccacctccgcaggt

SEQ ID NO: 6272 - DNA, 1500 bp, Zea mays
ggtttccatttatctgcatcatttgtgcgcgcgtgctagagatcaaggaggagaagagctgacgaagtggaggtcgtgaagatgggggatgcgggcgtggaccgaagacgtcgcagcggttgcgaggacgaaggcgccgccgcatctcagcctctcgagagacgatgcgagggagagctggagggggccacagggcagtgagagcgttggcgggggactgaaacggtaagctgggccagtgccagataagtgcggcgtgctaggcatactagtgggccgcaccaaataacatagcccacgcggactaccgtcgttgtcaccgctgcgcaaatattgtaccataccggccagccaaacattgtgataccagcttataagccttcctactttgaaggaagcaatcgtgttcatgtgtacttgctagtgtcaactcgtggagtttttttgcgcgagctgagtctggcacgtggaccctgcgtgtggggtgtgcaaaactgaggctatcacatggtccgggcgtatggcgtgtggagtttgcacgatgggaatggaggtcgtagattgaacaacagtgatggacgatccagattgaatgaaggtagaacggcaggctacccttaccgccttaataagtagtagagattatgaactataattataattcttttagttaaagtaaacatgacaaattctttaaaaagtgagaacgtcaactattttaagggggaggaggaatatcttgtttcaggtcatggcgccctgggaactttacatggttcgaaaaacccaaatagtcagatacataactcatagtttttcttctcttttttaagatcagaattcaggccatctgattgatttagcgtttcacaagaaagcagttaattggatgaggtggggttaaatcaactgtacccaggcgttcgccacaagaaagcagttaattggatgaggtcattcgtttcatcttcgtcttctcgaaaatactattcgtacttccacgcacatgttcggacaccaataagcatcaccctcttctcaacagcatgtgcattttaagtcaacttttcttgccgccgacatagaccctgtttactttggggtaactaaaatttagtgactacagtttagtcacttttagtccctaaagaagcaaatatggtgactacattttagttttttagtcatcaagaagtgactaaaaaaagactaaaatatgatttttaccttatttgtcctctccaatttctttttcagcaaacactaataagtaactaatacagtcattattcacatcaattaatattttttagtctggtttagtcactagaaccaaacgggatactttagcgactaaaatttagtctagtgactaaagaaaccaaacagagtcttaagcctatttatatttactacagctagtagaggttgcactagctcaagcagcctatgccacatttgcactcaagcaagtgagcagctcgcccgccctccagcaac

SEQ ID NO: 6273 - DNA, 460 bp, Zea mays
cacaattttggctcgatttagactttttgaggtccattttgcgagcatttatttcgttggacttgtatttgtcctaggttatttccacgtttcttatatgttatttgaacttttggaggttagaacgtaacattgagaacaagagttatatgtgcttttgcagaaagtagtagtcaatgatgtattagagatagctcatatccagtgacatatataatttgactccaaagtatattataacagacaatacaagcgatatgttgtcctacaacgcacgagcacatttattggtagagatagatagatcctctgttattgaaagtgggattaacatagccctacgtataacgatagcaagggaacagcatggaaacatttgatgatgatgctcatcaactttcttcagtgggcagagtatgtagattattagggcgctcacagcttctgaaggacatcaagc

SEQ ID NO: 6274 - DNA, 364 bp, Zea mays
cttagcccgagtccgagccctgggtcgggcggagcggagttcgccgtcttccggggctgagcccgagtccgagccctcgacccccggcacggagagatacgtctatctgccgtagggtttctagcaccgcgtcgccgacgacgccagggtcaggccgccacccgcatctagtggcgtcggccagaacctagctgcagcagcgatgctcctccgcgcgatgccagagccgcccaccaccgagggtcggtgaatccagggggagctcaagaatctcctggaaggcgccgcggtccgacgggccgagagctctgcctcccgaaggcaaggatacccctcggaacctcatgccgcgacttcccaattc

SEQ ID NO: 6275 - DNA, 238 bp, Zea mays
aagctgtgtttagagtacaccgggccaacactctaagcttgttgactcatttatctcatcgcttcgatatcgtctacttactgctggtgcatcaacaaatgatatattgcaccaatatgtgtccactataaaggcattgcggacaattgaccccaccggggtgttcttggaagcagttggtgaaccaattagggattatctgagaggtagaaaagacactatcaaatgcatagtgaca

SEQ ID NO: 6276 - DNA, 770 bp, Zea mays
ctttgcttcaaacacctgtatgtattcatattgtggtcctctaaaactatagtattttaaactatgctattgtcatgactaaaatatactgtagtatttcaaaaatcgtggtcttcaaaactttgttcctaaacagggccttatcagcccttagcgttcgyyggataaacattcgcttaaaacaagacacacccgcgtaattcagatccgcagcaaaggaaggtggagacggagacgcatccaaaagagggcggtcccagctgaaagcggcagcggagcggcgtcgtgttgtgtgtgccgatccccatcccatccaaccccgaccagtgcggcgcctccgtttgtacaccgcgcacctactctactcgtccgtttattgttcactgccccagcggccggccagcgcgcacgcacggcagtgcaagtccacctgggtccaccggacacctcacctttagagcaccgcaaccgcaagtcggcagcggcccaaaaagctgcgccgccgccgcagcaaactaggtggggcccacccgcccatccgcttgcttttccgtttctttccgagcgagcgggtgaaccgccgcgccgcggatcggttccgtccgggcgggaatatataaagcggggccgccgcgtacggcgtacctagcctgcgctgcgcgttccgtaaacggaagggtgaggggagtaattacattccagtcctccggcgccggccgatccgaggccaaagggagggaggagacccctttccctctcgccgccgcacg

SEQ ID NO: 6277 - DNA, 164 bp, Zea mays
tgagaatatgctgagccaacttcttctggtagttcttcactgcgacagtttctcgctttatcaaatcacttgaccgataccatcctttgggttttgctgctacctttctttatgagccgagctcttattgtgatgttatccttcatcaggaatggcagcatgca

SEQ ID NO: 6278 - DNA, 159 bp, Zea mays
catgaaactgtgaaggtcatatgtaagccctgcaaaccagggcagatccagtaatatgcaaacgagatagcccgactgagcggtggcatccctgtcaacgtcattrgagatgacaccatagtcttctatcgaggaaagagctatgttcagccagaagtt

SEQ ID NO: 6279 - DNA, 1154 bp, Zea mays
gtctccctctatctgcacatacaaagtcaagtctattatgtcgtccaagagaacacattcggtcatctggaacgataaacagacgatggactgcattcaatcaaattcccatgccaagggctaatttgggaacctattttttaaggcatttctatttttccaattaaaaatgaattaatttctcttgaaaaatagaaataccttgagaaaatggggtttctaaactacacccaaagagatttactagtcacaagtaggaccggaaaccggaaacgagctgatctcggcttggtaacccagctagttagtcttggctcggtgagttgagagacctagcttgattcgggcttgtttaggctcgtgagtccacttgagagccaccacattaagtcttaatttagagtataaattatatatttttattatataaaataaaaatataagttaaaaatttagtaacatattttaaactatatctagtattgagttcgttgcggcgacggtggataaggaggcaggggcacgtcgtgtagtttacactatgtgtttaataggtagtagagatattttataacatacgtatagctaacaaaaaatgatcaattattgactagtttgttacgatgtgacatggtcgtctttgatttatttattgcatgatctaatacatgatattatatgactaaaactgagatatctcgattaaaacgggaaaaatcgaaaacgttcaaattgtttctgtccagtttttatatttgtctaaaacaaaaaaaaacgatcgaaatatctaaatatgaatttgaataggttaatatagaaattggtgtgaaactaaacggtatatatctctatcattgtcacctctagtcacgccatggagggagtttcaggaggtcaccatgtccatgtggttctccgtcggtcttaaaatggtggtgttttgtcacgtacaaaataagggagttatttgtagttcaatagacaaacgttcatgacttggtccccaatcccattttaattaaagcgtcgtgttacacaagtcaaccaaagtcaatcgccgcgcttaatttgctctcgcccgcccgcccgctacgtctcccatttccttattaaaaagaaccaaatctatccatgcatgaaagcatctcgtctcc

SEQ ID NO: 6280 - DNA, 1500 bp, Zea mays
actttagaaccaaacatgtgctagatttatagaatactttagttttagtgagctgatggaaaaccatatatgaatagtgtaaccagttgtataccatggtattataataccatatagtttcaaaaaaactttcctgtcaaacactcaaaaactttggatacgagtggatgtaaaaatcctgtgttttttgagtgaatgaaacctttccaacaggacggcaagcttcaatccttccttgaaatccggtatatgacatcaggattttcaatcctttgaagctcctttggaaaaactacgtcccaaacaagctctaaaaatcaagagagttcttctccggcatgaaaagaacacaaatattccagcaatggagctccatttaaccgtgaacacttacggttcaccttgctagcaacatcagatgagtaagcataaacaaatatatactaacaagtaacawatgtggagtacgtacactatcactggaatctattattaatgcataaggattgagctgatccatttatttctgttgtaactcgtcggaggattggacaagaaaaagaaacaccgcatcatctagaagctggtggagggtggagctcaagcatccttggttgcggcaaggtgagtctcgtaggccagctgcgccgccaagagatccaccacggcggtgccaacggacttaaacacggtgatctcgtcgtctctccgtgggcccaccacagtcccggcggccagctccgacagcgtcccggccacgtcctccctccgaagcacgcctcgctggaccgcacccaccaattccccggcctcctccatcgccgcctcaaagtcgatgaacacccgcccgcggcgcagcgcgtcgtcgtcgcactcccgcatcgccggcgtgaacgaccccaccaggtccaggtgcgcgccggggcgcagcagctccccgcgcacgatgggctcccgcgaccccgtggcgcagctaacgacgtccgccgcggcgacggcctcgtccatgctgcccacctcctcgacggtgaggcccgggtgcgattcgcggagcttggcgacgagcgccgcggacttggccctggtgcggttccagacgaggacccgggagacggaggggagcgccgcgaggtgcgcctccgcgaggtagggcgcgagcgcgccggcccccgcgagcgcgaggaccgagggcgggcgggacggggaggcgaggagcgaggcggcgagtgccgagacggcggccgtgcggagcagcgtgagcgcggagccgtcgatggacgcgagcggcgcgcccgtggcggcgctgaagagggagacggcggcgtggacggacgggaggcgcggcgagttggacgggaacgaggtgacggccttaagcgcgaggtagggcagcgacgggtgcgcgcaccaggagggcatgaggaggagcgcggcggacggcgccgtggggagcgggatggagacgcgctgcgggcactggatgccggcggagagctccgg

SEQ ID NO: 6281 - DNA, 58 bp, Zea mays
gatcctcgagtcctgcatggtgaaacccagcgacgacatagggacgccgccgccgccc

SEQ ID NO: 6282 - DNA, 626 bp, Zea mays
catcaatctatatggttagagttgaaataaatatgtccttagatgaaaattgaaagtaagacacggttgattttttcttgtgctctggctactatcaacgtctttttaaacagtaccaactgctgcgaatcccaggatgtgccgactcccggagctgatccaccaacatcaattagcttatctcttgtgcggctgtacctacaggctacagtactgcagccggcacggtatagtagcgaaatagtacgagtttattgagaatgacgtatttattatttgcatagggtgcgccgtgcaagcgacgctaacrggtccgcgggcggagccactcagccacccaccaattcgcagcaccccgtcccctaccctacgtcctaccaatagtagccaccattggtgtctcggactctcggctcggtggaacgcaacgcattgcgaccgacccgcccactctctccacgactcaatcgctagactagagagagaaacccttgtacccgtgttccttttcatcccccattttctccgagtttccggcccatcgccgagcatcgagtccaaggaagcggagccggcggagaaggggagatttgactttcccgtcgggtgcctagggagcaggaggg

SEQ ID NO: 6283 - DNA, 410 bp, Zea mays
tgcagaaattgtctttctgactgtgtttaaatttgtgaacaagttgaaaataaaaataaactgtgtcaaacaggacctatatttttagaacttagcttgtgtcatataaatgcaaccaaacaggcccattgtatctcagcccatgagttttttttcatgtcgacccggcccatgattcccgacctggctcgtcgcgcaagttgcttcgcgtgtctcccctccacccctctcctctccttccgcttccgcagtacctcgccgccacggccgacgttgataaagccccaaacggctaaacccacgtctccctcttctgccctccctccctacttcccagccaccccatggctcgcttaacccccacgaagtccaaatcctccaggaagcccaagccctcctcctcctccgcc

SEQ ID NO: 6284 - DNA, 432 bp, Zea mays
tgcagaaattgtctttctgactgtgtttaaatttgtgaacaagttgaaaataaaaataaactgtgtcaaacaggacctatatttttagaacttagcttgtgtcatataaatgcaaccaaacaggcccattgtatctcagcccatgagttttttttcatgtcgacccggcccatgattcccgacctggctcgtcgcgcaagttgcttcgcgtgtctcccctccacccctctcctctccttccgcttccgcagtacctcgccgccacggccgacgttgataaagccccaaacggctaaacccacgtctccctcttctgccctccctccctacttcccagccaccccatggctcgcttaacccccacgaagtccaaatcctccaggaagcccaagccctcctcctcctccgccatgggcgccggagcggagccgg

SEQ ID NO: 6285 - DNA, 410 bp, Zea mays; identical to SEQ ID NO: 6283

SEQ ID NO: 6286 - DNA, 389 bp, Zea mays
gactgaacactgaagtttcgatttattcgtttttgttaacccctctgttacgacgacaagtgatcttcagtttgacatttatagcaacattatttgcccttactaagatctagtatcatccttttaatgggaatatttcctattaattggaactctctgaacacttaatgtaaaaaacgtgtcattgttaactatcttaaaaactgctaccagtaaaccctaagttgtctggcatttatttctttccttcctttaactaaactattgtattttttcttccaaagttgattaatgtgatgttgaattttttgttttttagctatcacaaattctctaattagcttgctctatggcatattttataggttctgtaattgctgatcggcgtg

SEQ ID NO: 6287 - DNA, 476 bp, Zea mays
ttacataaaaaatatattaattgaattagtgttgtctaatttataattattagaatgtaattcaattccaacgaaacaacggggccttaggtttaatatcttccttacactgcgaaaatgttgttacacttgccaaaaaaaatcaatcgcatatttaccttacaaggacatattttagcaaaatgctatagacatgaatccaacgtaatcaatagagtgagatttactggtaaactaccaattgctcatctgctcggtaccaaccagcctttcctattaccatgcacatgttgcctctcaactgcagcatctttcaagccgtgagcagacatgttgcagatcgaagtaaggtatatatgtgcatagtctcctaattcttcatcttcaacctctagctgattgatctctggtatttaccactctttccttccttccttccttcaattctaaataccacaaatcaaagttgctttgcg

SEQ ID NO: 6288 - DNA, 943 bp, Zea mays
ttgggtgtaggtcggagggcgcgcaccaagtttcaaccagtagcgagcctgtgcgagccaagcctagctccgtcaccctccacgcacgctgctccaccgccgctgccggctcccgtgctgcgctgccctgtgccctcttcgttggctgctgccgggcttccgcggttcctccccttcgtcccaaccgccggccgccgcgccggcctctctctccctctcgccccgccttcggccttcttgctcgacgctgtactaattgagttggctcgccgcgtgcgccgccggccggccaccatatcctatcccgccagtccgccgttggctcagccagtagggagcggttgacacgtgggccggtgtcgtcacgaccctgggcccgtgtcagcccattacgcttacaccacttgttcgattccggcccggacagtacacgtcgcctccacgtacctgtcatctcatctcaatcgaatggcgcagtgaagtagcagaccgaggaagccactccaggactttgctcggctgacaccaggtagccgcccctcctctatccaccccttcacttgcttggtcttccactcacccctctctcgttattcacccggtctcctctcctgcaaagaggtacgtaattgcactttcctgctcagtcttttgatcggtttcaggtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaag

SEQ ID NO: 6289 - DNA, 142 bp, Zea mays
cttgctaagaaataagaaagaggaatcttatggaaatagcatggaataaggtttgatcctattcatggggattccgtaaatatcccattccaaaaatcgaaacaatcgggacttttcggagattggctgcagttactaattc

SEQ ID NO: 6290 - DNA, 49 bp, Zea mays
gctgcatgtggacccggacgtgttgtcgctgtagggcgggcgcgccgag

SEQ ID NO: 6291 - DNA, 109 bp, Zea mays
gtaagatagacatggtctgtatctgtccctgtctaccaccgatcccatcaatgaataaataaacaaatataaaaggagcttgaattttagctcagactatatattctca

SEQ ID NO: 6292 - DNA, 253 bp, Zea mays
agcaacgacctgttgacgaaggatgggggtgggtgggtggtgtgtgagtggggtggtggtcccacatgctggtgggtgagagtgggtgcatgtgctctgctgcggcatgtcggttgccggcatcattcctatctatctgtattggacttgttctagagcttttgcttttcgcaaaaaaaaagacatgcgggtcattatgttaaagtcagaagagttttctttacaacgacgatctttatgaactgttaaagat

SEQ ID NO: 6293 - DNA, 790 bp, Zea mays
ctatatatatgtatatgttgtttttgtcaaataatgggtattcaattgaataccattgaattgagccaggctcgcccctggttaggcctacctgatccatctcctccataccataattgctttgccgaaggctttgcttttgcatgattcatgttgcatgtttttctgtttgcaccagacctgcatatacattgcatcgctccatgcatcagctctatggaagcggaaaccgtttcgccgtcccgcggtgccgggggcaggagcgcggctgcttcttgtggcaccttgcggtgcccatccaccgactccttgacacacacgggagacaaggcagcccgcagcctccgtgatcacgtggcaggcacgggcaatactttttttcctctctctctctctctccagcgagcagctcagctgaccaccttatatgaaaggaaactaaacttaaacttgcattttggaaagttaacatcatcgcgtacttgggttatcaatatacaattcatttattttatatgtcatgaagacagtgaaggatctcaattggagttgacaaaacttgcagcaatatttttcttcttggtggcggcggcgggcggtaatcataattcagagctgttaatctccagtcccgctcatttgcttgcagtgaaaggcttggcttgtttgcagcagcctccctccatggctccagctggtgatcggagcgccgccgcccggaaccccacaaaataaaacagctcgtcggtgccccaccccacccaccatctcctcctcaccggctttatat

SEQ ID NO: 6294 - DNA, 792 bp, Zea mays
ggttcatccacacggcccaaacccgattgcttccatccatgcagaacttgggaagccattgttccatgcgactatgcctttggcggtttggcctctgcctcagctggtcagtccagcccctcagggacaactgagcagagaggccgatggcgtggagcccggccagcggccaggccggcagtaataaaaggaaacgaaaagcacgcgcaggttttgcatcagcgcacgcccgttgccgcgtgatttgcacggacaagcaccaaataggtgcatgcgcaacaagcctacgagacgggcacagatatttatcatgtgaggcgcgaacttttgcaaggcccaccataaagtgacccggaaccgaccctccgctccaaccgccgccgagcggcgctgcgcctgagtctgagctccccgagatcttgcctccccgctataaaatctccatctccggacgcttgcgcagggggaggggagctttccacttcacggctgatgagtgatgaccctaccagaaatcgacccgatacggctcctgcgccagatcgtccatcaatagcccgaatcacactcatcacaagcctcaaacttttccaaaccaatttagatgcggcgtgagtgctaaagcgctctctggactctgtttcgcagtggccgcagctgcagcgtcctcttccctttttgccatccagcatcacctgtgccgccggcgcgtaattgcaccgcggtcactggttaataggaagaagggaaggaggaggggggagcggtgtgccggggtatcgtctcgtgccc

SEQ ID NO: 6295 - DNA, 523 bp, Zea mays
tgtaagagttgtgctttgctattatggtgaagtagaattgggctagctacaatatttccacttttcattagatatgtcatttccatttctctgtaattaagcatggttaggaataaataaaaaatgatatatagcaattgccaaagataaacaatttgcatatcttaaggagttcttcaacttgtttataaaactggaataaatgtctatggttataaacttataattatatttgtcactttaactgccttacttttgagccatctcatggccaacttatatgttaatagacctattgtatttctgaaatgctttgacttttgcagttacagtatggggcttttgctgtgaatatcccttttaaaggttctattaaagtgtggtcagctgcaaagtctgaaaggttccgttaaagtgtgatcagctcatgactgttttcttgctgtaggttgttcaccagtggcccggtttgcctaaaggtgtaaaatttgatccttctgaccaggaattaatctggcactta

SEQ ID NO: 6296 - DNA, 1500 bp, Zea mays
cctagtcgtctatctggaactgaatcccataacaacacataagtttagtattcaccaaaaaaagcggaatggagcaatggagttaaagaaataagcgatggaatattataaggaaaacaaattaagttgattgaacaaaaccgcttttacctggagagagagagagagagagagagagagagagagagagagagaggcgttgtagcgacatcaaaagaaaaaaaaaagcaaatttatcgtataattctgcattgtagcatagtaatataagattcatgtagttaatacgttttatggtaattggtaactgagcatatgcgtttccaagtaaaagcgtggccaataatcatatcggaatgaagtcataatgttgcatattaagcagccaattgtatcgaatgtgacaacaaggttttgatacattgaagttccatttgtctcatttactaaattattccaacaatagaatagacattttctcttaagataaatacttctttaaatcctctcattttttgtgaacaaaaaaaagagccttatgctatttcatttaccctgttctcatcattgatctatgtcaagtaatcagaaacgaagaacatggatatcataatctggaaaaaaagatggaataacttgtatccgtatttatatccaaatctatggttgctggtactcttttatttttactgctagctggatctaaatactcttatactgttgataattaataatcggaagtgcagaataggtgatatgggggaggctgcgagagggacctctgcggagcgcacaagagggaggatccgggagtcattgcggagcgcacgaggagggagaacggagaaccagtgttgctgtcgtggggatcggaattttttccccagacgactcttcgtgcggagcctagaatgttcccgacgacgaagaaaagcggtatttttttttgggggtgaagtctagcggagaggacgaatggtgatgatgtccgatgaagaagcatccaacggatatggtgaaacgaactgacgtagagtgacgggattcaagaattgctccgcgaaggtgagccattgattcgtgatcaagtgggtaggaggaattccagtgtcccatcagtgtgatggtttggaaatatggttttctggaggtaaattggaccatacgtgagaaggaccttttcctaaaggaacagaaggtatttgggctgtcatttgttcggcctactcagcccattacacgtgagtgactactttccccatccgacctgcacataagctgccgccaccgtgtctctcctcttcatccacctcgcgcggagttccgcagcggcgcagctcaaaattcctgccctctcgccatcaaatcatgcgaaggatttgctaaacaggccatccatgttttcgtcatctgtcagtgtcaggtacttgcaaattttctagaaaccttctttagagatccgactaatccattccgtcgatcgagtcccgtccgctccat

SEQ ID NO: 6297 - DNA, 1500 bp, Zea mays
atggaatttgaccgtgtttacaccacacccgttccggtctagtattgagtgtagcttaaactaatttatatctcaatctatttcaatatatgtggattatgatcgatattaaagtacacaaacagtgcatacaaaacatgaacggcgtgtgtaaacggcgtccagcgacccaatacatagataactgaatgttcacaccaacgcacatcttgtctagtggtccatgttaggctgtctcccgtctttcattccatttttccattttacactttactctataaacaataatttccattttaaacttcaatctataaacaataattaccattttaaacttcactctctcaataagcaataatgtctactgtacaaaaacagtgctttctatggctatatacataatccatctgctgactgctggatacaactttttgtgtggccgtggatgaaactatcagtttgttggcaccttgcggtacaaggatggatcagcttattttttacagaaaaaacgtagaaaataacgcaacaaaaaaaaaggtttctacgttttgaaggggaatggtgaccctctctctgtttaggctcgaaattcaaagagaggatgattcgattccactccagataaaaaaaagacaggaaggaacaaaatgcatgcgaaataaaataaaatgatggttggattttagtttatttaagagtaaaggctattaacgcctccagattttggccatatataaatctatagcctatctatcacctcattgtgatctacttattttgctggttcctgcgcagtcaccgttttcagatgcatgtattcagttataaaacaacatagttccgaccgctttattacacaacatagttccgaagtatagtccatggacaaaaaaggattaaaacttgttaaaactctctgtgccattattataaaaaaacatgatatattagatgtttggacgaaaaaattacagaatcataatatagttactggaatcgtaaaataaatctggtcaatcggatcttaaagcggtaagatcgtactagaggataagtgagaccgtgaccaactttggctgcgccaccccgtcggtgttacgagacaaagaaagcaagccccataggtccaaccggtggggcatgtcctgctaatcggcgacactcagatacctgttcacttgtatggggagctttaccaccctcaaatcacgcacccttaacaacgtctgtctcgacgacaaggggaaaaaaaaaagaagaaaggtgaaaaacacacacaaagaaagaggaacacccactaccttgggcactttcacctcctcgagcctccctctcctctcctctcctctgactccgcccccttttaaaattgggaccctcgccgccgcgccccgcagacccgcacacacacagaccacaccttctcgccccctcgcaagtcgcagcagggacagcggcagcgacgccaccgcaccaccacctcgtccgccacccgca

SEQ ID NO: 6298 - DNA, 402 bp, Zea mays
ggtaagtcagttgttgttaccttatcactgatattggaatataggatcatcttatatagaaatgcctgaacatgcctggccacttggcaagagaaaatgacatcaagtatatattaccttgtgatggccttcctgttgatcttttacttagctctaatggcacctctctttctctctgactaaacaatgtatttaaatgaattgttttgccttaattgatggaacgctgtattagtgatgtaatcatggaattactatcaatatctttatgtatttcttacagatttaatttaaagatcggttttaaaatatctgaaacttatgtaatgtttctaaccgtctcaataacttaacaggtactatcacaatattacatcgaacacactactgattttggaggct

SEQ ID NO: 6299 - DNA, 235 bp, Zea mays
ggtatgttgataaaagtatgctggagtgtaaatagtacttgaagctcatgtgctgattacaccagtacacatttccccccctgggatgcagctcaaagattaatcttgcttattccaatgctcttgaggattaactctacttccagtctttgcttactccactaaggattttcatttatctattaattcactaagattttgttttatttggcaggattttttttgtacatctaag

SEQ ID NO: 6300 - DNA, 960 bp, Zea mays
actactaaaattatttaggaactaggtgtaagcctaattccctttcaggaacaaaatatttcctttaggaaaaaaaatggacaacaaagttgagcaggcaataatatgacaacttgctgcccatggactggctgctgccgggctttcgcgacgccgttgagaaggcccgggattggaactctggctatgggctatggccctctttttttttcttctgcttcttatgcatgtatgcgaagagatgtgtagacgttgcctggacagttgcctctcttgtatggggccagagccagccctaaactctgggtactctcatggaattatttgagccgaagccatttggaaaccttgtgacaaatatgtggaataataatatttgttatagttgatgtcagatttattacgacgaagagtgagaagccatattactatgatcccgcctgtccagtagaacacatggctcttctaactcctctcaaattttatactccaactgtttatttttagttgtcgctgaatagttcaacgaaacagaaggagtacctactcaatgaaaaaaaaacagctccaacaaaatgctgcgctacttgccatctcctataatttgccagggaggaccagtcgctccacggcgagcggttcacatcaatttatttatattcattcacgttgatttttttacatgtccttgatgccaggaatcggtgcaggtgaacaaagccaagccgtacacgcgttcttccactgattgctgtggagaaccgaaacatctcgtatggaataatcccccttccgctccgcgtaccagacggccggccctagtgtagtgatggtggtgaacgttgtggtggttacccgtgtaaccaacccccatcaccagctccagcaggatttgccccgcacggcaagcagcggcgtgggctgccgaatccccaacccaacctgcgtcggcgcgtggga

SEQ ID NO: 6301 - DNA, 156 bp, Zea mays
tgcgtccgcgagtcccagactcgagaaagaagccatccatcgccttaaaattgaaataccccacctccaccttggcgtcgcgcccaaacgtaaccattccctcccaacgaacacctgctctgctctcgcctctcgccgtcccaatcccctccgaaa

SEQ ID NO: 6302 - DNA, 269 bp, Zea mays
gaccccgtttcgggggacgctttcgtaaagacatgtaccaaccctccggggtaccatatgtggtcgccctgggatttactgacggtcgtctcgacctacgggccctcgggttccgaggaagatgacgagcccgacttttgttgggatttctctaggctcggtaacccaagtgccatgcgggacttcatgaccgcatgcgactactgcctttccgattgttccgacggtagccgtagcttcggcaacgaggactacggcccaagtcgtga

SEQ ID NO: 6303 - DNA, 1500 bp, Zea mays
gagcagtgttcgtctgttcgtcaacggtcaacactcgcattcgggtcaggcggggtggggtgggcaaaattaacatactgtacttcttcgggcctttcaaaatcctccatgcatggcttcacgagagtatacacgaccgctgcagtaacagtgcaggcaccgtctgtgttcgtgcggcgggcgggcctttttcgaatctcctcggcgagagactgcgctgcgagcgagcgagcgagcaagcaaccgtccacgagcatgtgcaaatgcaacaggaaatggcagcaatccatccatccatccgcggccgcgatgctgtaatagtagtaaaaatctgtgcgaaggtgtcgcacccggtcgagacgcgtcgtcaaggaggagacgaggagtagacgtgatgcttcgttycctccgggtgaggccaacccagcccatgtcctgtcagctgccttgtcttttttggcgataactacgaggtgcatggtgggctggctggtggtcgcactcgcacagcggttttcggtatcgccgcatccgccctcaattcctcgccgccctgttctgttcctgcctgcccgctgtcggtctgcaatgtcgagctcggacacggagctgccgaacgaaccgatttttttgcattttaaccctacatcgaaaacaatatcacgtttggaccctagaaaattttaatgtcatttttggaccctttgctcggcgtcataggctatggcgccgaggtaggtgctgcgctggcccaaacggacaacgtggcgccgacgtgataccaatcttggcgccgagcttgattctgtacacaaaggtcgtctagttcagttggtagagcgtaaggcttttaactttgtggttgtgggttcgagccccacggtgggtgttcttttttgtctttgtcactgatttgttttttgttgtccagattttttgtttatgtcgctgatttgtccgtccaaatttatttytcatcctgtttttttgttttttgactgatttgtttattcatcyagatatttttttgtttttcaggagccargctactttgcttttcatatcctaactgacgctcagaacttctatgccatgaaacactggtttgccaggaattcgtataaaaatgcagctatcygtgtcataaactacgaagcaattattttggagaaacttccaaagtatactatccggcagctgtatttgccagaggagttccgtgttctcattaggagcattaagcggcctactgaaaacacaagaatgaaatacctgtcactgttcagccactcacatttcgttattccagaaatattcaagtatctaaacaaggtggtcgtgttggatgacgatgtagttgttcaacgtgatctgtctttcttatggaatattgatatgggagacaaggtaaatggcgctgtcgaactttgtggtctgaaactgggtgagatgaaaaatgtcttgggtaaaacagcatatgatccaaagtcgtgtgcgtag

SEQ ID NO: 6304 - DNA, 143 bp, Zea mays
tgcagcaagggatcaaccagagcgtgatccatctcgtcgcgaacgggatgctgatcggcaccggccatctgatcgcggtcggccagaaactcggcgtgcgcgtcgtcacgctgacgcaacccgcgccgcgcgagcgctgaacg

SEQ ID NO: 6305 - DNA, 137 bp, Zea mays
attgatatattatgatcaccagctattcccccccagcagccaattgctaacacttccagaaactacgtaccccaatgaacgaaaaaggtaaaagtgatcacgataccacttattaattacacatgaaccactaaacc

SEQ ID NO: 6306 - DNA, 543 bp, Zea mays
ctgcagcgggcgggttaggtcatcgacttactggtcagtcgatgactgaagaaacgagtgagccacgagtgggcttgcgctagggaagagaatcaaatggcttagataaagagtggactgagtagtgaaacgtcgatagaaaaatagatcaaaatctaatttttattagattggtccacgctaactatacaaaagtttatttattttgctgtgtacctaaacctaggcataaaggattaaaaaatttgaggtggggccatggcccaccttgcccaccccttgcatccgcccctggcatctcgcatgccttttgaattgcaaaattgtacctagtcaaggtttcgattttcgagaataggcttctatctaagatgttcagcactcggggtccatttcagtgcacttatcagtatcacaacattatgttggacagacagattctcgtgacagtgccttcctggtcgcctttcgttgaagttactgaatctgaaatctgaccatcatgaaccaggttgaggattggtcctttacgagcatgttata

SEQ ID NO: 6307 - DNA, 672 bp, Zea mays
agaggatccttctgcagtaggttgtaatagaaactcgtatccacacacaagaaactttgaagcttcggttctgacgtgctctcgagttaaaatctttactcgtatctattagtactaatagggtcgggtatccatcgcatagtgtttgggccttttagtttaaattaacatccctaattgtcatgcatatagtgggtatattattatgtattattttaaccaagtggtcctttcctgactaaagaatatctggatgcatggattcctacccaaatatagacgcaggacaagggaaacattcatgccaaccacagaaaactaccatgccaaagcgtaacaggcggcgcgatgtactaacggctggctccccggatccccagcagaggagcggcggtgagcgcacacctggcgcccggcggcccgctctcttgaaagctatggaccgttcctcttcctttcctgtctctccaccacccagatcaaccccgcacgcgacatcaatagtccctaccattcggcgaacgtacaaatcaaagtgcggcgtgcccgctcgcaaactttgagtacgtactgctactccggctcgtcctcctctcttctccatcgccgttggttctctcacgccacacggtcatccgatccctgtccaccgcgttgggagcggcgcagccc

SEQ ID NO: 6308 - DNA, 1500 bp, Zea mays
aaaaaaatcaggatatgaaagtaccagacaatgtgattgacaaattaatgaaatactaaaggctcctacttcaccgaccaagaactacattttgcaatgtcatgaagaccgttatattagcttcaaagaccagtggtatactaattttactaacaaagcatcactaccgacacatattatcctgtacagccaaccccaaccaccctgaaaaaagttacccattagcaagttaactaaaatccagggcgtgttaggaaggaaagtatttcaaaaccatggttttggaatactacggttttaagatgtcatgacacaactacaatattttttacatcactcttagcaatacatgtttggagacaaagtattttaaaccatggtatttggtatacatgtgcaaggctagtcattgacaaaaactttgggttggagtgaagtttcaaatactccaaaaattacatggtatttataaaaccatggtattcaaaacaaagtttttttacgaggtagccaaacaatttttgtcaaaaacattatggtattctttgataccatggttttatctcaaaacttcaaaaacactttactaacaaacacctccttagttgcttcatttcaagcaggggagtaagccttcccttgtttaaacttctccgggtctcgagttccttccaattgaccgatgaggacgagtgtcctagaccgccgctataccctcttatgaacgctcaagctcctagaggcgggagactgatttgtgtcgatgcggcggggcaccaaggagacagcaagggtctgtgctcattcatgatggatcatctcccagtagtgctcgtctctctctctaaaacatagtaataaagttatgcgacatatggtccatgccaagtttgtggaaagagagaagcaacgtatcagcactagcacctcattaaagcgatgactgtagcacaacgagatacacacacacagagagagagagagagagagagagagagagagagagagagagagagagagagagagagagagagaggctaatgctatgctatatgctacgtgtataaatcagggcaagagtggtcgctcccccggtggtggactggtggcctggcctcacaagtcacaaccggctgatagcagcagagcgatcaaaagtgaagctaacaagcgagaaaaggaaacacctacttctctcgtctagccacttccatccgtctctagattctagtcgcccttcaacactagctagcctgaaatcaagtgcaggctcgccagctgtggccactgagaagtgacggaaggaagacaagcagctcgccggccggccgggcgccccgtgtgcccccgttctacgagggttgaagtgaagcttcgtagtacgtagtactccatatagcagctgagctcccacttcggagctccatccatcgttagctcccgctgctgctagctggttcgaggcctcctcaagcagcttcttcgtttctgctgtctgca

SEQ ID NO: 6309 - DNA, 667 bp, Zea mays
gttctcttaatttctaaacaccttcttttgttgaattttatcattggtcttaccttattaaggatttggcaacacgaaatttgctcatagtaggaaaatgtaaagctagcctttatccctttaagccattcaatattgagtttctcaaacaagcgcttgtgagctatcctgcctgatatttctaaagaaacgaatctttggagatggtaaatttgtgaagataggaccagtggatcaccaattttccctttgcctatatatgtagagagaggcaccgcaccttcgccgacgcaagggcccccacgccacgcaccgtggtccggtataaaaacgtcgtggtgccgcacggctccggcgccggcgacgcctccgctcggtttactataaatacgccttcacaaccagctgatctttttttcccctctttccgcgttcccaccctgccgtcgttgctactcgcatcgagatttgcgcggccgtgtcttgctcgcgcctgctgctctgttgccccccttccttccaaggtcgcgtcagcgcccagatctctcgctcgctcgccggcgccccggctagatctgggcggagctcggaggcggagccgtgcgccagtgtccaagtttggtaagacccaaagcggtgaggaggcgagggaagacgcgcggacgcc

SEQ ID NO: 6310 - DNA, 1500 bp, Zea mays
agaaagtaattgattcaactgaaatatgtttgagagggtcctcaatcggccgtaccatttatatatatatgggaatatgtagacccatgtttaggcgataggaaacagatcacacgtgattagatgaattatattatctccaacagctatctactgcagatagccttagcccggacaattttgatcttatggttggttttgaagatgtgtttttttattaaaaaaagatttggctaggcttatagaaaaaaagatagtatccacatttaatgtataccctctgaacaggtgtattatgggcataaaatatgactgtaatgatgtctgaacgctgttggtgcacaagctacacagtacgtgctacactctggcacttggcaggatcattgatcggcgccacacacctaccggtaccaggaccagcacccccacgtacgagtgctacactctgtgggtcccgatctatctatatgcatccgtccattccattccattgctctgggaagaggtaggaggatgttgagaacgaagagagttgctgttggtcgaacggatgatgctgctgctgccgtcgcagaaatattgcagatgcagagtggttgggggcgggtggacggactttaattactcccccggccgccttcatctgcattgcatctgcattgcaaggctgttgcgtctcgttctcctccttctcttctttctttattcactctgatcaacgctagacgattttgtttgaactaatataggccatttttttaaaaaaaagtcgactaagttcatagaaataatatcagtgtttatatctttgaataagcttactatgtaaatagatacttactaggtaattgtcggcgtttcgaaacccggggggtccctggaccgacgagtaaattgtcgccgcgtgccccagcccagatgggtcggcgcgaggcggaacgcgaaggggggagagagcagccggagggagacaggcgtgggaggtggaacccgcggccttcgtgttagccccgcgcccaggtcgggtgcgcttgcagtagggggttacaagcgtccacgcgggagggagcgagcggccttgcgcgagcgccgtcccgtccttccccgcgcggccaaccctctgtaagagggccctggacctcccttttataggcgtatggagaggatccaggtgtacaacgggggtgtagcagtgtgctaacgtgtctagcggtggagagctagcgccttaagtacatgccatcgtggcagccggagaggttttgacacccagttcgcgtgatgtcgtggccgtcggaggagcgctggagcctggcagaaggacagctgtcggggctgtcgagtccttggtgacgtcctcttgcttccgtaaggggactgagagctgccgtcgtcacagggcatgcggggcgccatcattactcgtatagtggagcgagccagatgggacaccggtcttgttccccgtagcctgagttagctcggggtagggcaatg

SEQ ID NO: 6311 - DNA, 1500 bp, Zea mays
tatttttatatcatttcttcttttttttcttttctttccaaatccacatttcgatttaaattcaaagtgtgtgagaaattcctcttcacattaaatgttcaatttgaacatagtatggtaattatttatttatttatttataatttttattttgttttttatagtgtttctctctttctatattatttccaatttcccccaatttacacttttgggattaaatataagtctcatctcattattatattccaatattattcctttttgacattacaaaatttctaattccaataaggtttaagaattcaaatttaataccctctaaaagtcaatcatgatgccgtagatatctatttattctaattaatttattagtttgataaatgttttaaatatgaaacacactcatattattactctctttttagcaaaataacattttgaatgtgggatgagagataaaagttacttcaaacttaaatgttcatgtaaataaaggcttatggtgcatcctttaatttaatgatatgcataattatttagttgaatagaaaacttttctattacttcttttctaaaataattcttggtttttacaattcagtcctcaatttttaatactcaagtataattggggatatctgaatttactattttatctcttcatatatttattttattattataaaaaaatatatacagattttggtccttacataaatgaactaattcgtcgcacaatgctgtacaaagagatcataggctatagtccagacaagcgccatcctacaccaggtcaaaaaaaaatgtatgcacgactccaaacagttttcttgggatccaatctaaacaaaagtcacacttttggagactagacaattttcctaggatccaatctaaacagcgcttgcaaggaatccaaaaccacttttcacgttgacaagccaaaattgcgagaacttattgtttctcgtagctttctcacaagtttaatttaataaattattacaataccgttaatgaaactgttttttttgctgaatattatatgtagatagaagagattcagctccgctagaaaaggagcccgactgaaataaacccaagttgacccttcagagctagctagattgacatcggacccactagctagcttcttgcctcgagtggctcaacgaaagagaagagctcagctcccccatgaccatgacctgagcaaaaatggtccctctccggcccgggtgaacggaccaaattaaaacccaaacaaaggcaccaacaactgaagaaggcagccataaaaaggtgagacacctcccagcgtacaatcaatcaatcctgctggctggggtaccaataccatactgcccctgctccatttgatgacctgaccctgaccctgaccctgaccctactataatacaagcgcagcagccactgagtcctgagagcgcgcaacagcagctaagctagcactagcaggcggccgggcaggtcggc

SEQ ID NO: 6312 - DNA, 1500 bp, Zea mays
caccgtaacccctccctccctttttttttggttggaaccatcatcttcggcgccgagtacaccggccgcccgggagtccactacagcgccggaactggtcgcatgcacctgttcgtttcggatccgtttcagagagagagagagagagagagagagagagagagagagaggagacacggctgtctgttaatcgatcaggtatacatacatgtggagaagcagaagagcagtgtggacgactgtgcaacaccgcgtgtcttatccgccatccggagatggagtggagatactacacggccacacttgtcggcgacgggcggtcgtttcggcaccaagcaccgtgggaacgtataattgcgcgccggaccgggccaccggtcttgcggttgggcgttagcgcgcgccttgtcgccgcccctagccccctaccgcgccccttgctccatttacgcttctttacctgccggctgctgcggtagctgtggatgcatgcagcgctgcccgggtgccgtaccctgctgctctcggctcggtgcgcggggagacgagacgagcacgtgccaggtcagtgacggacagcgtggccaacagggttacgggaaaggaaggaaaggttgggccgtgcgccttccacagatgaataaaccccggcctcctgcccctgggttgggccgcgaatggacgggcctagctttgtgtttcgttcggtgatgacacaatggaactcttcaatcaatcaatggcatataataataataataagaataaatatatttcaatggcgttgattcgttgaaggaatctccttttttttgcgaagggctgcatccgttaacctgggaactgattccggcccagctcaaccaaactctaaactagtagtagatgcaacgtacgtatgtgaaagaggaggagaaagggaaaggaggccggccactacgcacggaggatttggttcttttattaatcccctcctttcgagtgccatcactcagctcgggctgtggccatatcacgatggaatggaatgaacgagaacaaggaacgccgaaagaaaaagcgtgtccacatactcctccattcaccgcctctgccgctcacacgtgtactactactactactacctgacgaagtgaacgcggcacacagatttgtctttgctgaagaatccggctcctttcatttgttagaaggatcccagatctagatgcagcagcgcgatctgaaaccgtgttgtcggccagccaagctgcggagtacttagtatttgtttagtcaaatttgacggtggaaaccgaagctgccattgccagtaccgccgaggcgtaccgccgaggctgctgctactactagaggctatcgggctgcctgccgactcccgggcctacctggtcaaacttggcgagcctggggtcgcatcgcgtcgcgtccgcccttcgccgcagccgtcggtccgggtgcggcggccctccctagcccgtgcctgcgcgcggcgcggcg

SEQ ID NO: 6313 - DNA, 329 bp, Zea mays
cactgtagaagcaatagaaaccgttttagattaaagtcaagcgaacagcatatccatgcaatgctgccggtacacataactaaactcactgttcatagcaccaagacacaagctgcttagtgtagcttgccgccaaaatgatcctacatatataaaggatacaatgtcttggggtacctatatatataagactaaaacataggaggactttgtcaagatttgctgttacacgccacctctttttagttcaagtcggaacaaatttggagaacagttctttcagaaggctgggacagctaactgtcaggtggtcaaacccatctgtttcc

SEQ ID NO: 6314 - DNA, 75 bp, Zea mays
gacggcgaggtgagttytggagacttggagaggcattccgcatcggtatcccgtatccagcaaaggcggcaagcc

SEQ ID NO: 6315 - DNA, 1500 bp, Zea mays
taaaaacatgcatgcaaaaaatctaaaacaaaatacgccactaatatgagtttctgatgtatagagaagatatgtttggtttgtctgttcactttctcgactctgttgtgtcaaccatttctaatgctagcaacccagctgctggcaaggttagccttgccgagctagagcaaagcgagctggatggggagggggggaccaaacgccgccggccacatggcaagccgcccggcagctaatcgaccacagtgcacaggcagcagtcaggacggagcagcgaggctgggcgtacagcccaggacggcacgcccgcaattcctcgtgcccctgacctcctctcctccccccctgctacggattccaaaacggatataaaatgcgcgtgtattatctagtccagtccaaccgacccggcatcgtctcgcgagccgcgactcgtctcgtcatttccatcgaacgcccagatcccacattcccacctagctctgcgcgatccatcccggccgccacgccaaggaggccctcgcctgacctcggatcaaagcctcctccatccgccttcatcccggccggtggttcgggccgtcacgggaggggtccatcactggttactcggtggagagctcggggctcggctcccatctcacgattctcaccccacacgcgcaccgggtcacctcgattcggcagcctcgcggtgagttgagttcttcgcttgtcgggccagtccgcctctcgcttggcgcggttatggattcgcgggtggcgtggcgtcgtccgcgatcgctctagctcgcattgagcgattcgcgagttgcgactccttgttttgtttgctctctgtttttttttatgtcgatggtgatatgtggcggcgggattctgagctcggttgcttctaaccttccgcggagtggtttagctaatcggttttgaagctgttgatatggatgtgccgtgtgcgtgacgaatcgaatgggccgcagcaggattcctacgcagctcggcagcagggrgaattggatcctgcgaccatgcgaatttggaaccctggagcagtggagtgctaggaggtctcggtgtcgtcatttttttctaggggcgtaggagtcgacttggttggaatctagttagtcataatttctctttctgatttcattggtctgtccatgcgtctgttttcgtcaaacaagaagtttgttattgccaagcatcccgctatggaggaagctgcctgccgtattgtgttacgcgaatccggtgagctgggctctgcgcgttcctcttgacgccctttgcgcgaacgacgagctttcttccagctcggttgcccctgaacaaccaacgccaaaagcagctccagaattttcctgatgtcgtctctatatttttgccttctaagtcatgcttaatggcagagtccttgttgcgtgggtcactgcctcactgggttctgaggcaaggaaaagaaggcttcagtagtcaggtctgggtcaagcc

SEQ ID NO: 6316 - DNA, 1500 bp, Zea mays
aaattggtgaccaaaaaatcgatcctatcggcgaattaatcggttttgagtcggttgaattcagaaactatgaaacaatggcatgtaatgtatttgaactgataaatgttgttattggacttgtgataatgtttagcgtcatcttctgttcaaattatgggacctcaatgtggtttatttgcaaaaacacatatggctcgctttttgtttctatgccgccggtttatgaggccaggagccgattaaycgaacttatcggccgatttatcagtttcaaaccgttttgaattaaaaaactgagcgatttcgatttcagtcggttttctatcggttttcaccggtttatcgtgataaaccagttatcggtgggcaccggttttaacccttcaaccggtttggtgaaccctgatgtacacatttgtcatccatttttatatggcatgagttcgtctgttttaaaatttatagtgcccgtccgaacgctaccgctatattttcaactcactcaaccatagataatccatgcaacctaacctcaccaggtcacgagaataatcacatcagtaaactgtagcccttgcattttaattgtctctaattagaaccaaggtgtcgtttggttcacatattgttaacgtaatgagtaacccataacgttaaatcatgtttgtttaagtccaaccgtaatcgataccacactataaatggataccgctttattcaaatttgttaccaccagtattcgagtgtgaatcgttaccattaccatttacattacatttcgtgaaccaaacgacaccatagttagtctgtttgcttcttagttggtctctttcaacgtgctccttagttggtctctctttgcttgtagcacaacatataagaaattgtattctttcttttgttgatttgttttttaatgacgaataatatgactattacagtgtttgtgatggttcattgcacaacctaattaagttttatgctacctaccatacgtacatagaaagagtcaactcacaaaaataatagaaatagtcaacaacgcttcttcgtcttgtggaacatgtgtcgtacaagttttactagatcaagcacttgattgcttcttaatacgtagctttacactaatacgtgaaggacaggatggcttagcatcatataaaatacagagcagtttttctttatacaaaaagaaaagaaagaacacacaaaaggcatcgtaggtttaaaccgctgaaataagataactctattgtgtcgtcatcagcaggttcaggttgctagagactatttctccaggtcggttgataggttcaaccaaagacttgttcagctattaatacgtacacgtcgcaacatgcgctcgggcaggctatataaacctcaccgtccccatgcccaaagcatcaacaaccatagacacaaacacaacaagctaataagaagctacgtagctgaattctgagagtataaacacaaaagcgagtgcaaaaccaa

SEQ ID NO: 6317 - DNA, 410 bp, Zea mays
tcgatagtcacagttgttgaatttttgcagtttgtcactatttctgagccggtgaatgctattgcgtttgggtctactatggtgtttggctgatccagtattgtgcaagtgaatcatcatcggacgttgcaaatttgcgacgacgtgatgtgatgatgacttttaaccacgggatctgggcaaagagaggaggatatgacataaaatgggctagggcccatagagaacgggaaactaacaggtccaaacggcccattattagcctaggcaggcagagcagcagaggagattcctttccctttccgttagcaggatagagagggagaggagcagaagatagcagagggccagaggcgcagaaggcagtcgcggacaggaggaagaggaagaagaagcggcagcgagcgagg

SEQ ID NO: 6318 - DNA, 489 bp, Zea mays
cggcagcaagtaggaagcagcctacccagcagcgcagccgagcggagcatcagcagcgagcgggcaatctggcagctgggaaacagggaaagcaacaagcaagcaaggctgcaactgcaaggcagcaagccagcaaacaactgcgcgtccgcgcagactgcgcgcaccagaggcaacgattggatttggagcctacccagtagcgattggatttgccgatttggagctgcgccgcacaggaggccagccggctgggcaagacaagcaacacatgttttttaaggccgcaaggcaagcaacacagtcaacaaaccgggcagcgacgcagcgcaggaagcaggcaagcaggagcagcaagcaagtagcgcagcaagcaccaagcaggtttgttgactgttgttgtcgtttgacaccgagaaaaacattttgtgtttttgtctagaagtttcataattcatagtgatttgtgttacaattacagtgtacaat

SEQ ID NO: 6319 - DNA, 1500 bp, Zea mays
tagaaaactatattggtcctatgaacaatgacatgtgaataatatcttgaaaaaattgaatggtagaaatatgaaaattagagtggaaggagattttagattgaaatatagaatctgttcaatcactttggttggtattttagatttttaatgataaacctagtttgaaaagataaattaaaaatacttggtatgaaaagtttgaaactattttttacgatttagagaagtgcataaaatgtgtctgagtgtaaagtttattttcgaggcagatgcacgatgttcaaaaaataacacctggtttcaagcaattagtagaacaacactcatttcaccaaattaattcagacaacataactctatctatattttgaattcttccattgcttacaccacatacaaatggaccaaattacccctattcatttcacaaccatattttttacctcttctgttcataagaaaaacataaatagataaaatatatgagctccatttttatagtgttaaacatacaaataggcacatatttttttacgaaggaagaagcttagatttaaccgttgaacttcaaacacaggtatcttcagcatcaaactattaaaagtaaacatacttggctcaccgaaagatttgttactatacttcctctattttttatttgacgtggttgtttttttctcaaaaaaaaattaatcactcatcttattcaaaaaatttatatgttctataaaaattactccctctatcccaaaatatagttttaaaattcaacggttaaagctagacgttgtcctttatagaatatctatgtttaatttatttgtatgtttaacaccatgcttaataatatagaaatagagctcatatatttgtatacatttatgtcgttcttatggataaaatagaaaaaaaacaagggtggaaaataggggcaatttggtccatttgctagtgaggtgaaaataaaagaatgaataatatagatggagtgtagttttctaaatttatttaatgaaactggtactattttttgaattgctggaaaacgagcgatattttctaaatactgtctcaaactagtgttgttttgtggattcttcccacttttgttggctagcgagaattcacacgctgatctcctcgtaacaaaatttgacccacttgtcagccgatcccgtcaacggtttgtttgaactaatagctgttggaacgaagcggctggaagaaaatgttcctcgcaaagtttggctgacggcacccaccgcccacagaagcgcacctctgttctttggtgtgtggccgtgtggattcaaaaccgctgaccggccgcttatttaagcccttgccccgccggttttctcttctcccgtcggcgctggtccacgcggctccaacacctgcctgcctgcctgattcttacaccaaccaaccacgcgcgccaagccgaattcgtcttccaccgatccgccccgcccgtttcccattgcttagcttgct

SEQ ID NO: 6320 - DNA, 319 bp, Zea mays
agtgagtaggaaacaagaagaagaatatttgggacgtcttattattgtcttaggtgttatcagatttcttctattgcaaggtctggcttttcgtggtcatgatgagtgtaatagccaaataataaaggcaacttcttagaaatgtttgaatggtacaaaatgaaggattcaagtgctaagaaattgtttgatagcactcctaaaaattgtatgttgacttcactggagattcaaaagcaaatttgtgaggcttgtgcagaagagaccaaaaaagtcatcttagctgaaattagggataagaaatttgctataatcatcg

SEQ ID NO: 6321 - DNA, 1500 bp, Zea mays
ttactcttccaatttactacctcccaggtatcaagggtactacatagtctattgagaaattatactgctacatcttagtttccctccagaattattatataagcacttaatggcctgcttatggattatcataatctaggtacctagattatataatccacttcaataatatgtgttgtttgtttgtctcttaacttatttaaactgaattatataatctagagggtagacagacaggagttaatcaagactttatcagctagcaaatcttcacaccccgactaaaatcaatgttaaacaatttcaggtgaactattattggcaactaaaatggtgcccatataatcgacacatggtgtactaaatcatcgagaaccttaatgcttgtttgtttccttgcataactatataattcagctaattttttatagattatataatccagttcatataatcatattaaagatgtttctttacataaattattagcgggtaaaaaactaaacaataatctaaaataagcatatgatgatatgtttatggattatcataatctatgtagctagattatataatccactataataatttatactatttgtctttgtctgaatttatttaagatggactatataatatataatctaaagtgtaatccactctaataatctatactatttgtctgtctctaaatttatttaagatggactatataatctaaagggtaaacaaacatagcattaggtgttgagaacgttagatgagagttgttgccggacaactgaggcctatttgaaactcaggaatttcacatgaatttcacaaaaaaattatttttaaaacatagaaaacaagaaaacttccagcgtttcaaagaaagacgtaaggtgaacctatatattcattctcccagtggccgagagaaacgacacgagtgagcgctccgtgcgctaccattgcagccagtactcgctagctcacgagtaaaagagttactttcttgttaacaatatatttagagcctatttgttttggaattataatctacccagtttcgatagattataatcccaaacagggctcttattattttgctgatatttacttggagctgcccttatcgtgttgttatatggaaataacattacaaatcagtgccatgtccaaatgctaataacaaacaggtcaagactgggctttctttgcggagttctcctcgagcatcggacgaaaccaggcccacggcccacctcacttcgctggtacatgcccggcatcagagttactgacatatggaccacacctgtcagaaaagatagccggaagccggaaaaaccctcgtctcccgtctcggagcggcggagtacgcacctatcagtcccaagttcccgccacacacctctccattcccctcccgaagtcccgatcctgtcctcaaatcccattgctctatcttctctagcggcgagtcgaggcggggaagacgagctagcggcgagg

SEQ ID NO: 6322 - DNA, 849 bp, Zea mays
ggtaggcaggaggaactttcctctctctctctgtctctctctctctctctcttcttccaccgcgcggccgcgttcgctgcctgcgccaccacaccattggcgacggcacgcgccctccctcccttccagggaagcctcctcgctcgcttcgggggcgtctccgcggccatatcttcctctttctgctcggctttctcgtcaccgcccccctcctcgccgtccactggtgccgagccggcgcgggtggagatccgttcgctttggatcgacttcttcgtgtttgggtagggacctccacccctcacacctgatcgcctttgttctagctgttcattttgtaccgggggaccattttttgctttgactgcgggtgggcaataccatccgaatccttcccaccatctccattctgttactcgcggatttgtttgctgcgtggtgccatgtgaatctgagccactccgattagtctgttgactctgttcctatccttcagcgctcgagattaatcgaactaagatgcggctacagtttatttttctagaattttgggtccgactgatctgtggccgtgtgatcttacgggcagtttgtctcctttttttttgggcgatgtgatcttcttgtgttttattactgattagtcggcttgaatcttgcaggttgaagccgctcgatttgctcaccagaaattcagattttcgagtggaattcgcttaatatagcaatgcactagggtttactgtgcaccactaggctactgcctctgctattaggaagccgacatctgttgtttccgaagtctttcaagtctctgttgggtggcgttgctattgtgggtgtgataac

SEQ ID NO: 6323 - DNA, 419 bp, Zea mays
cgacttgtctttctatattcaatatacttataccgacttaaccctaaaaattattcaaatttaactagaggtgaatggctcagattgccgtacgcgcgcagagcgggacgggacaagctcacggcggattctggtgctgggccgtacccgcgccctcgtagacctgaaccttgcccgtcccccctggccagccctctctataaaatccgtagcccagcagtgcatcacccgctgcccgtcttctacttgcgcggttgcgccctgcccctgcgtctgtacgcccccgcccccgtacggctatctaggctaccactcactggtcactggtcagactcagaaccccagcagcactgcgcagtgcagcgcatagttgatcagctgcagctcgtgcacgtagccgtgtgccgcgcgcggcggac

SEQ ID NO: 6324 - DNA, 611 bp, Zea mays
atctataccccctatataactcactagttaaaacatcactaagtgaatgcaacaaattactcctagccaaatcccaccattaaaaccaacgctccaggtcgcttcatttacctcctctcccttaatcaatcgcatccaacagtcaatgttttttggatcatccctcatctctcactcgcctctaacctccccagcccccgtgatcaatgccaccaccgccctagccccatgcccacatctgcctagacaaacaccagtgcccccgccccccactcctttgcgtcgtcgcggtcttcccatgagctgcggccttcttgttgctcgtggcctccacctcactttgttgagatgtggtgtgcctgttcgccgccgcggccttcttcctgccgcttgtggcctccacctccctttgctacgtggtggcatgtatgtttgctgttgtggagcaaggcacgaccaaggaggtcgtggaggtcatgctcgtgggaggtgaggggaaggccaaggccaggctgttgcaggtgattggcgaggccaacaccagcgcgtttggcgatgggctcggcaacgtccaagtgggatgcttcatccgtaggtccgtgaggtgaggc

SEQ ID NO: 6325 - DNA, 1500 bp, Zea mays
atcatgccttgttgaacttgggagatgtgtccttaggtactcaagagctagtataaaaaaaagacctcgtctatcaaacctctaaattgtgtaaaaaaatcaaacagaatagtaatggaagaagatgtggtcatcaaggtttacacaaaactcgagctattataacgtaaaaaagatgcgaggagaacataaataaagaataaattaacatgtgaatagttacggatgcggatgctgtagcctgcgaatgttcatatgctgttgtatagtttgtcttcgtttttctctatagttttctttttaaacttcaaacttacaagatgtatagctgatgcatggatgcttacatgctctattttcctatctaattttgaagtgtaaaaattaaattaaatttctctcaccattttttttccttcactttctttagaatacggttgtctctccgatcacttatcgagtatataactgtcttgtccgctatgttaaaagcagtaacgaaatagagataagagccataattggcttactctatgatctaactcatgatttttatgtatatacggcatgatgctggtcatagctaataagttacgtaaaactcacggccggaaatcactgtctcctctttggcgcttcatccttgtgcggtgggggatcatcacatggccttcagtattctgctaccatgcattcacgctccgcgctctgcagcgcgccagcaccgccgccgctcggagcagtgtatgagacggacgaatagtaaaggtccagacagacacagagacggacagaggatcgcctgcgctgcgagcctgccctcttctcaaatcccatggacgtgtttggtgttgccacgccgctccggccaccgtgtgttcgcagaatctctcgatccgcgcacccgctttgaccactctctctctctctctctctctctctctctctcgtaacgctgattttaataacccccgtccgtacggattatttgaaaacaactccctccaaacagccgaatttcgcgatcccgcccgcgggcgctgccgtcccacgaacaaaaccacccgaccgcgcgccaaatcgcccgccggctccacccgcgggccgcggcacgcaacacggcccagccaaagccccagccccctcttgcataacagttgcattgcattggttatggatggatggaaatcattgccccgtccatccccccacgcagaaaagctcgccggccgggcgccggggccccgccgcgtacgtgtccgcctggccgacctcacccccgacccacccgccttataaagcgagcgcccgggcacacgcctccatccaccacacacacacagacacaccaccacacgccggtgagccggtctctctcgcccccgtgcccgtgcgcgccacctagccgttcgttcgcatccatccgtccatccgtcacacgcacaccaccaccaacccgcgcggccgtgtctatctgggtctgggatcgagtagcaagca

SEQ ID NO: 6326 - DNA, 228 bp, Zea mays
acactccgacctaaccgaactagcctgaaactgatggcggacaggaccgaacatagccagcggcacccaagataaaagtcgtataatcgcagtcgcagataccaaagcatagctccgaacactgcctctgttcatctgcctggtagaggtagcacgccagatcaccagcgatccgcacgtcgcagcagagcaaagatatcgcggggagcaagagtagtcaacgcacga

SEQ ID NO: 6327 - DNA, 124 bp, Zea mays
tatatatatatatatatatatatatatatatatatatatatatatatatatatattatagcgactcgttccggccttctgggtcatagtcatatagcatctagatcagatccaaacatcatatc

SEQ ID NO: 6328 - DNA, 229 bp, Zea mays
tgttgtgcaatttttatgtgtcaaacaaactaaaataaagtagttaattttaaaatagaaaaattgacgtaactacaaactgaggatagaccagagtggagtttgagaaaaaagtatgctacactagaaccaaaagtccatacggcccggggcccgggcgtccccaaaaacctcacccctctcttatccgccccaacggccgcccgccggccaccacctcaccggcgag

SEQ ID NO: 6329 - DNA, 322 bp, Zea mays
catgcaggtaatatcgcaggtcaaattggctgtctcatgcttcgatgaagacagaagcaagaggccaactatggaatctatagtgcaaatgctccttttagctgatgaatcatgcagcgtgtgctaggatggcgtcctatgtttgatggaactgtccaacaggtaggaacattaagcaggatgtgagctattgaagtatagtctcctagcacttcattctgtggctgtttatatgtatgcttaagtacttttctcgaataatgtatgcttatgtgctgccactcaccaaaatttctccagtaatggctgtctcgaataatgt

SEQ ID NO: 6330 - DNA, 49 bp, Zea mays
ggtttactagctgaactttttaatttcactacttgtgagttgtgggaat

SEQ ID NO: 6331 - DNA, 394 bp, Zea mays
ctagtttttattacgtattaatcaatccgtacgtcggcgtgtttctttccttcctgcctcttctgtcttctctcagaaacgatggcgtcgtggtttcgcccgtggccgttggatcgagcgtcacaccacaccgcggctgatgcatgatatgagtttggaaataggactttggtttcttttttatttgtttatttatttaggcgaagcaaaaaaaaaagaatggtgagaattcgaaccacagagtaattttattgtccgctaagcgtgtgcgtgcgatgacaagtggtcgcttcgcttcttccatcatgtgaatacggaagacgggcgagagacagaggggacggacgtttgtttgctgccggcatctgtacaatcctttccgtttcagatttta

SEQ ID NO: 6332 - DNA, 139 bp, Zea mays
ctagtttttattacgtattaatcaatccgtacgtcggcgtgtttctttccttcctgcctcttctgtcttctctcagaaacgatggcgtcgtggtttcgcccgtggccgttggatcgagcgtcacaccacaccgcggctg

SEQ ID NO: 6333 - DNA, 1500 bp, Zea mays
cagcgcgttcggacggatggtttatttctagatcgacaggtagaaaccctaatagctacgattctgagatttttgggggtgacaggatggccgcacctgcaggagatggaggcagcgtttgcgaacggagcacgcgaggaggggatacgcgggggcgtcgtcgtcgcggtcgccgacgttagagacgtcgtgccgtagggacggtaaggctggcaaagcttttttgctccgtaacggctggcactcgcacgcatatggaagcagcctagaagtctccagccgcgtgaggaaagcaagctgaacagccgctgcgggagacagtcttttcccacctatgtttcagttgcgttgccacgaggtgcttcctcagccgttgatgtagtatcggatgaacaccgatttttagctgacgtggacacactcttgtgcactgtttctaaccggctttgttatatagaagaaataggagtactaggccactacgctacgcactcgcagtagttgtacgtacccacacactgccttcgtttgatactgtagcggcacctcagcacggcacatgttttttcccctcctcctttgaaactgaaacgagattagtacatagtagtttagagggtcttggactgggccctcgagtctgcggcccacacggctcaaagttacggccgacagaaacacaggcgggtggcacggtccgcataaagtggaaggctcggcccagtaaaacatctgcccactgaggcggcggcccatataaggcccggctgcgatataaggtactcccagctgtctcctactcacgcggaaaccctagcagctcaacaccctcgaggtggcggcgcgctcctccccttctccctgctactagtccccccccgtctcaattcgccactgacgtccattccgcttgcttgattgctccaggtacatccattcgcagtcggccgtgtcctcggagccgcgggagatggcgtaagttctcccaccgaaaccatttgctccttgtgctgtttttttttcagaggaggtaccgctggctgctgtgtgggggcggttggtgtcggctgctagccgatggtgatttaccgggatgtttggggttcaggtggatagtaggccggctgacagagctgcaaggtttggctgatctgagggttgcaggggcctagcccgtcttatcatcttccgcaatttttgcgctttattgtagataattattcatatagatgggcattgttgcacaacactggaaagcgatccaacatgatttgctgctaaaacacaggaaggctacctagacgagtttctttattatatattttataattataatcatggtctattagcgattcactgtattatgaattcgatcgtttgttgaccgctacatgcctacaacacaggaagctcatcagttcacgatgattttgtgctttggcagggatcaggagaccgtagctgtggttgaggcacctaccccgggttcttggggaaccg

SEQ ID NO: 6334 - DNA, 1500 bp, Zea mays
cgatcgaattcataatacagtgaatcgctaatagaccatgattataattataaaatatataataaagaaactcgtctaggtagccttcctgtgttttagcagcaaatcatgttggatcgctttccagtgttgtgcaacaatgcccatctatatgaataattatctacaataaagcgcaaaaattgcggaagatgataagacgggctaggcccctgcaaccctcagatcagccaaaccttgcagctctgtcagccggcctactatccacctgaaccccaaacatcccggtaaatcaccatcggctagcagccgacaccaaccgcccccacacagcagccagcggtacctcctctgaaaaaaaaacagcacaaggagcaaatggtttcggtgggagaacttacgccatctcccgcggctccgaggacacggccgactgcgaatggatgtacctggagcaatcaagcaagcggaatggacgtcagtggcgaattgagacggggggggactagtagcagggagaaggggaggagcgcgccgccacctcgagggtgttgagctgctagggtttccgcgtgagtaggagacagctgggagtaccttatatcgcagccgggccttatatgggccgccgcctcagtgggcagatgttttactgggccgagccttccactttatgcggaccgtgccacccgcctgtgtttctgtcggccgtaactttgagccgtgtgggccgcagactcgagggcccagtccaagaccctctaaactactatgtactaatctcgtttcagtttcaaaggaggaggggaaaaaacatgtgccgtgctgaggtgccgctacagtatcaaacgaaggcagtgtgtgggtacgtacaactactgcgagtgcgtagcgtagtggcctagtactcctatttcttctatataacaaagccggttagaaacagtgcacaagagtgtgtccacgtcagctaaaaatcggtgttcatccgatactacatcaacggctgaggaagcacctcgtggcaacgcaactgaaacataggtgggaaaagactgtctcccgcagcggctgttcagcttgctttcctcacgcggctggagacttctaggctgcttccatatgcgtgcgagtgccagccgttacggagcaaaaaagctttgccagccttaccgtccctacggcacgacgtctctaacgtcggcgaccgcgacgacgacgcccccgcgtatcccctcctcgcgtgctccgttcgcaaacgctgcctccatctcctgcaggtgcggccatcctgtcacccccaaaaatctcagaatcgtagctattagggtttctacctgtcgatctagaaataaaccatccgtccgaacgcgctgcggaggttggtggcacggcgaggctgtggctattcgtgtccggagacgagcagcgtgagataacacggctccacctcctacccctcccaatcgacgcaagcctctactgcgaacccgtgaagaa

SEQ ID NO: 6335 - DNA, 653 bp, Zea mays
tgccggtttcggatcaggccaaaaaaatgggacctcgagccgggctacggtgcctcacactgcctatatgttacatgttccgttgtagttttgcttatattagactgaactgtcaactgaagtgactcaggaacggcgcatacaaggacgcagtctatacggtatcccagacgttacggcacagtccggagggagagagatacttgtgtacgtatgcaagcacagtgcacatccgatagggccatagctaggctcggcttatatacgtgtacgtccgtattagaattagaacagggattacgggttgacgtgtgtcattatttattcttttccgagggataggagctgggcctcccagatatcaacagtgccatcctagacttgcgacgaaatacgacatgatgctcgaaaacgtccttcttgcttcgatttccctatttataccgtaccgtacccactacacccagccccatatcatgcgcaggggctgaaagcctgaaactgctcaagacgccaccgtcttcctccgcgatcttcagttctctgtctctccctctctctttcctctagctcccaaccaagccaagagtacgtcgtcaagcgcgccgcgcgtgtgtgtgtcagtaggctacagggctcggaggaacgccgtc

SEQ ID NO: 6336 - DNA, 308 bp, Zea mays
atgcctggacttgcttgatggcatccgctgctgtccctttgcttggaagtgcccacatgaatcaggaggtatcgtccactaggagcaagaagtagcatcacttgcctggagtcgctggtgtcatggggccgcacaaatcactgtggatgagcttgagctgttcttgtgtgcggtatagggcttggcaagggaatgaacgcctcctctgctttgtggccacacaagtgtcacacagctgtttaacgtgaccgaccagtggaagctcacaccaccatcttctctttccacaacttttgcagatcctcgaa

SEQ ID NO: 6337 - DNA, 782 bp, Zea mays
agggtgcgtttggttggagagtcaaatagaatagagtggctccattccagtatttgagaatggagccgttctattctgcgtttggcaagaagaacatagccgctccattttttgtttggaagagtagaatagagtggagctgttccattcttttttttctctcgaaaaaacgcaggaggactgcgttttagatatatattaagaagagagagagaaaggtctaagagacccaaaaacacaacaacgcactccctatggaggccagtaacactcgtacatgaaaggatccataaaaaacacccacacacactccctagtccctacaacaacctatgcaggggggcagccaagaaggagagccctttggctccagcaatttcccagcctcttctttcctcatctgcatgctccataatcagaggaaggctgggagaccctccataaaaaatgactctattacgatgcttccaaatcatccacgaccctaaaatgatgagggagtcaagaccttccctgaccaaaccatttactgtctctctgaaaccatctcccaccaatccataaaagagactgcatctggctgtggggctaaactatgcagcccaaactttcttagcaggttgtaccagaaaatccttgagaagacacaattcagtgaattcacaagcaagtggttcagggtttccccttgctggtcacataaaggacatctgatagggtgattcaatcccctttttgccaagcgatcagctgtccaacatctattttgggccaccaaccaa

SEQ ID NO: 6338 - DNA, 1500 bp, Zea mays
gcggcagtcgtgatggcattcatgtcatgcgcggggacgcaatttcgcgtggcggtcgtcggacgccttgcgcacgcccggcgagccgcccgcccctgcgtgtgccttttctcgtagcgtaaggagcagtagctatcttgggcctaaactttattctagttatatcgaaggtttggacgctaatcaaaagggctaagtataatttaattataaaattaactgtataaactatagttaattcgtgagatacttgatccttcgtgtcgcctcacatacttgctcgccctattcatggttaccggacaacatgcatgagtggatgactgactgtagtgtctagttgcggcgcaatacatccataccaaccatcaggatttgaccggactaagagacagtaaattacaataaaatgttaggttaaatgaaaatatcggtcatgacataacattatattttaattactttataatgcacagaccattattactgagagcttgcttgtttcagcgtgcagatgtcagataatgaactgtacaatccgatgctcaaataaacatcaaaattaccatagcatcactcgtaagcgtaacacggaaattcttgcagaaggcatatgttttgtattccggaattacccccggcctaccttgcatattcttcagttatcggttcacgacgcacccaccgaggccaaaggccaccaccattccttccccaactctgcaggctgctcgtcgccctccctccacgccggacgcgccccgatccagatccaggtatccatcggccgcagctcctcctccgtcccttatcccttagccgttctcgtcgtccccgttccccgcgcaccatcgtcgattgggatccatccaggactggattcgatcctttttttttgtttggttaggaagcctagattgcttcggcgacgcatcgttttgctctgttctgtagaattctctgctttgggcgatcggtgctcccttacatccagtttgctgtggatttgtttgttgtgtggtggcatgctaatacctgtttaacctttgctgttttgtggtgctgttcaagttctgctcctgggtttagcgctagcggggtgctgatctgatgtccaaagatcgtggtgcacgtattttgttggcactatcataattgaaaaagctaactttagattttgagttggcatccttatcggtccaattgatacccgattgatgttttatatgcttttagcagacgaagtcattcaagattcggtatatttgtggatccaccgtgtagattttaatgttagcctatggattacttaggatgtgcaagtacctcagtagccaaatgaatgcctactcctttgctttattctgtttactcatgcttccagagtcccagcttattttatctgagtagcatttgtttaagatttgtttgaactattgtatttgtcatttacgacgaactagtcacaatatacaaatgtggtcaatgcaggggcgtaac

SEQ ID NO: 6339 - DNA, 703 bp, Zea mays
agctgcatagcttagcgagttgaatgactaacctggttggagacttattttttttgttaagtagctcaagtttagctagacgagttatttagctaatctcttgaagatactctcatgtaagactgtctccagcaagagccggtaaacggtcctctccgctaaacatagggatttctcgtctcctttatgcgtccagcaaggttcggtacaacgtcctctaaattttagagtctgcttctcgtctgccaaatatggcgcttgcgctatccggtaccaggccgtcggtgattggttgatgccctgcctcccgcgctgctacaatgtgctgcagtacgatgtgccatcggtggttggccaacgcgctgcctctgacatgacatggtacagttcggtacgaagtatgtttgatttttattaatataaatgctgaaaaatggagtatgagatatagagaacgaaatttagagaacgttgttggagataaagaagatatagagaatgaaatcttttagagtgtactgtaaaggacaaaaaatatttctttagagaatgaaatttagagaaagttgctgtagacaacctaggtaaatgccccctatctagagcgagagtactataaaatgtacctgctggctcacagagatggtattagrccgggacaagttcattctgataatcccaagctcctcgatcatagaaatat

SEQ ID NO: 6340 - DNA, 94 bp, Zea mays
ggttacgtgaacaacccctcgtcccctcgtaacatgtcttgagttttgattaaacttggatggaaatgcactgttttcagtgtgttaactgtta

SEQ ID NO: 6341 - DNA, 781 bp, Zea mays
tccccgggcgtggagatctcgtccagtttagtggagatctggtacgtggttgagcgaagcgctggctggaccgggatggatgggtggtaggcggcggcgacatggatgggcgcctgggcgccgccagtgttgctgacagcatcttccttcatcacggcgtacgtgaccgtgagacgtgagtagctgctggactttatttcggtcaaggagagctagccctggccaaccccaagtgtttcaccagataagaacatcaaactttaacaacgggtagaaatcatttygtgatggcgcagtttttcaggtaaaactgagctgtttttggggggaatttttttgtttcgcaaaacagctctatcaaaagcttcgtacatggctgaaaaagacaacaaacaagagagctatttttcctctgtatgactgtgagagcataaaaacataaaaagaaccttcgcctatctatagtttgtgttgataaacataaaagccacgactagcatggtgaaaaacaggttggatgagcacctatacatgtctcaacacacacgcttatattttgataaatcgtaccatatctatgatttatcttttgttaaatcatagatccctaacacttatattttgttattatggacagtttgcatgaacacttgattgtacacctatatatcaattctacattattgttgtttgcttgagattatttccccaaatattgatatgattccagattgatcatgacatgccatatgttttttttggatttgatgcttacatgtag

SEQ ID NO: 6342 - DNA, 72 bp, Zea mays
cgttcaccggcggcccctctctttcagttcggtcggagggccaacccgacctccgaggcctgagcggcctcg

SEQ ID NO: 6343 - DNA, 49 bp, Zea mays
aaacaagataagagaagagaagagaagggatcaattagtttagtgctct

SEQ ID NO: 6344 - DNA, 318 bp, Zea mays
tcggaaatttaaagtgtggtgaagagagcagcagacacgggcaacggcaatgatgggttggggtagagggagacacggagagggacacactgctacgcccactggccactgccaatcatggatccatccgccgctcccatcactcgctctcgcgcgcgttccaatctcgatttcttcttttttttttcgcgcgcgcacggcgatggccccagcaatcccggtgaacaacggcggacacttgtcgccctcgtggagctagcactgtgctgacgcgctgtgcgtgcaggtatcgcgccgcagacgacgagcggcgacggg

SEQ ID NO: 6345 - DNA, 1500 bp, Zea mays
aatttgatcaaaccgagtggtggcaaagaatgatccaaatatgtcaaaatttgtgcgaatataattttgttctcaattacattaatgttgcacttctgttggttgcttttggatgtgttggcataaatcaccaaaaagggggagaatgaaagggaaatgtgcccttgggcaatttctataaatgttttggtgattaagatgcccaacacatagtgattttaaggtgatgtgtactaagtgttaaagagatgcaaatcaagaatcaaagtatgactctagccttagtaacttgtttttggtactaacatattcctctaagtgctaggaaccatatcaaagcaaatgagattggagaagtttggctaagtctagccagacttgcaccagcctgtggcgcaccggactgtccggtgcctaggctggcgcagcgacaaactcactgctctcgggaatcgccaaggatgccgtggctaaaattcaccagactgtccggtgagccaacaacgcccgcgccaacagttggcagcgcgataagcgggtgatgtgtggctagagccaacagtcactaggccgcaccagacagtgtacggtgtgcaccggacagtgtccgatgtgccaaggggaccgagggctcaacggtcggctttgccagaaaaggaaagaaattgggcactgttcatgtccggcggtgcaccggactgtctggtgcgccaaccgacagaaggcaaaaattacctaccaaatggagatccaacggctcctagctgccttggggctataaaagggacccataggcgcatggagcacaataccaagcctccattgaacatcttaagacgcctagacaccgcaagcacgcatccggatcactgtgattaagatttgagcacttgttgagttgtagactcgttgcgctatgttttgtgtgctcatgtcttgacttgtgtgcgtgtcattgctacgactctagcttttgcgtgtctttctttccctctcttactcttgtggttttcattgagatcaatcttgtaagggtgagagactccaacttgtggagattcctcacaaagggaacatctactataatgaagaaaactgtggtattcaagtgaatcattggatcgcttgaaaggggttgagtgcaacactcatccattgggacgccacaacgtggaagaaggcaagtattctacttggccgaaccacgagataaaaatcatcgtgtcacatgttgttattgttgtgagattctctctggttctactcacttgataattgctctaagtttaatactcactttgtgaagagcaattaagtgaataagtcacctctctctctctctagtcataacaccttggttttgatttcactaacatttcataacccaagtttgtgccatttaaagttgattttcataggatcacctattcacccccctttaggtgctctcaattggtatcagagtcgtactctttattaagggactaaccgcccgaagag

SEQ ID NO: 6346 - DNA, 379 bp, Zea mays
atgaagaagattggtttatttctcacgtgtgtatctgttcatagcatcataggagaataagtgagatggccatttgtcaagagccgcacagattgacaagtccttattggtggttacaagccatggtggcttatgtgtatgcatgggttgattagctgaagttggtgttgaaaggaacattttttgcagccatttggtatatccatgcttagtcaatagcggatttggatgggaaggctagagggagatctgtcatgtggtttgttctggatcagatccatgttttggcagcgattgaagagctggtgatatgtgtagcattctttcaaaatggtgtaactagtatatcaatttaatcgttgtggaattttgttgccta

SEQ ID NO: 6347 - DNA, 1500 bp, Zea mays
ctagcagctacggtacgtgtgttttactcgatcggcgcggtattgtttttctgtaagagcatcgctggcaattagtttgatattatcattatcatagatggttattgtttgtgagactactgctgcaactagacctgtcacctgcttactttacactgattttctgctctgtatcatttgctttttaattctctatttagctgtttgctaagccctacagttctgtagcatctgcttttcagatggaagtcaccactgacaacaataatcagacaatcccgacaggacagaaatcctagcctaaagcgcagaagattcgcgaacacacgcgcgcggctattggcaactgaccaggtccccaattcccatttgggccaggatatactgtattattactaatcacgtcgggtgtggtctctggaagagtttagagcgatccagagggccctgcagccactggatcgtcgaaagcaattccattcatagcacaggaactttctctacagaaacttcactaaaatcagttcaaatttatataaaaaaatacaaaaacacggaattgtctcgtgttccaagcgggccgaaaaagacgtgaaatgaaaaaaaaaacaacaacaacaagagtgacggtagaagctggcggcgctgaaataaacagcagatgctgaacctcttggtatgattcggacttgtgactgttggacgtgacagcaagaatgaaaacgctggcaggcggcctcgactccgaaagcgcgggaagcatctcaagctgtccgatccgtcgttatatataacaccggccgcacgcatcagccatcagactgtcagacatcagcaggtggtacgtcggatccaccgcgatctcaccagagagagagacctcgtcggccaagggcaggcggcacacgtcggctccaccagacacggcacgtcggcagcacggtcgatcaggaacggaatgcaaaaactaatcacgtcgggtgtggtctctggaagagtttagagcgatccagagggccctgcggccactggatcgtcgaaagcagttccattcatagcacatgaactttatctacagaaacttcactaaaatcagttcaaatttatataaaaaatgccaaaacacggaattgtctcgtgttccaagcgggctgaaaaagacgtgaaatgaaaaaaaaaacaagagtgacggtagaagctggcggcgctgaaataaacagcagatgctgaacctcttgacttgtgactgttggacgtgacagcaataatgaaaacgctgcaggcggcctcgactccgaaagcgcgggaagcatctcaagctgtccgatccatcgttatatataacaccggccgcacgcatcagactgtcagacatcagcagggtggtacgtcggatccaccgcgatctcaccagagagagacctcgtcggccaagcgcaggcggcacacgtcggatccaccagacacggcacgtcggcagcacgatcgatcaggaacgga

SEQ ID NO: 6348 - DNA, 757 bp, Zea mays
gaagttttagcatatgaagcatgagcatgagaaaaatgaacattataagcaattggagccttgtccttttccttcgcaaagttgggaaactcatgccatttattttaatcttggtattttctttgccttccctttggaagacaacaccatccttaattcacgggtgcctaccattcaaataagcacccccaacataatttagcttttcatcctcaatttcttgtttgacaattttagcttgttcttcaatttcgaatatttttaaagacaaaaaagaaaaaaaaaacatggcaacccgtgttaaattaacgaaaaagtggaggcctgttgtctaaggttagggctcaacatttaatgggccggccgaaatccgaaagtcagccgagcccacgtcggttcgtcggtctccaaccgacctcgtctcgtctcgtcaagcatcatctgctttctgcgactctgccgcgaagccctcttcgctttctattcatcagaccatatcgaatcaagtcagattcagggaggggaaggcaaaaccctaacctctctcactccgccgccaccgggggagcgcgaggaggactcttcatcgacccgccgcacgaacaaaggtatatttctctgaatctctgttctcgccccacactgccgctcctcttctgcttcgatttccactccatattagagatgatgcttagggttttcagattcgataacttgtcctgctgattccgatccgccttcctccgccgcagctccc

SEQ ID NO: 6349 - DNA, 1236 bp, Zea mays
atgttagaccatgctatcattagttaaaaaggtcataaatatctattacatgatataactaatttaaaaggtcctaatttgttgaagccttggtacaatatagacattccaaaatagcactaaacaaactaaggcaacaatgcacttcaatagaataaacattttgtgactaattccatctaaaatagatagattctttatcagttcttcattggttgacttctcctattggttcatctgttcatatataggtgcactctcatcggtcacctcaattgacttttgcacatgcttaacatactcttcattgcaatatcaacctttacttcccactgaaaggagaacaccaaattaataaaaagtttaatcaaagtcatcataaaaatgactacaaaccattaaataggtggatcaaaataactcacactgtaatctacgcacttgtagaagatgaagccctagttgggacacacattcttcactctatgctccaacatagtcttcttcttacactcaacgtatgcaatcatagggaggtctcacctcagttgctcatgaactctatacgagttcatggacccagaagaagtcgacatctactctatactttttttttgatcaactactattgatttctctatttctaaatcataaaaggtggataatcattttgatcaactactatgaactttcttcttctacatatatcaattatcaagtgactttaaccttaaacaacatataataaaaggtgcttatttaggccttgtttattttcgccttttctggttatgattcttgcggtcaccgattcctcgtatcccccaaaagttgttaccggtttttcgattctccattactagttcaattttttactctggaaaatgacacgacaggaaggagcgagtttatcgtagggtgtttggtggtattatacgtttcttgccacggtcaccaccaaataagcgaaaataagcagggccttatttgtctcgtgttgatcattgtgatgaccaccacctcaactggacatggcggtatggcaccgacgctgccaacaagccatgcatgctatacatcattttctttctttttttcatttttagggaggaactatatagcatattattatgaatacaaagcatgacactccacccacatggtagccgcacggcatggtactgtgtgtggcaataaaaaggacctctgatcaagcctcatttcgcatcggcggac

SEQ ID NO: 6350 - DNA, 1500 bp, Zea mays
aaagtcttaagtccaaaagcagacatgtatttgttgtcatatatttgttttcatgttgagacatgtagacatgtatttttgttatgttaagaatgttgcttgttgaaggacatgtatatttgtttaattttttattaaatttttaagttgtgtatgatattgaattgagaacaaatttgattaattatgttattcaattgctgaaaatggttttttgttatattcgatggatatccaatggatatccgaaatccgatgagcatggatatggatatgaatttctactcgtgggtatagtcacgggcggatattatctatgaccgtggatatgactgcgcgcagatattttcaatatccgatccgaatccgacccgttgccatccctactatttagtattctaaatcattatttacatatatgttatatgaatgaatagaaacaaatttatgacaaagctgcttggacattcgacaacagtagaattttttgtgaaatatgcatccaagaaatcaatgctgggaataggtctaatggtatcatgacttcccgaggttacaacaacatagctgagacctgagaagtataaaatagcaactgggctgcgtcattcaaaagtgcaattgaagaacaattggaatttacttaaaggcttgtatgggttttggttacaactgcataaagataccggacttgggatttaggaacatattctgcattcgatgggtacaggaataggttgacaaaggtatgcatcatttttttgcttattttcaatgttttcttaatgatttcagtttaactaaccattcttttacatgcatgtagggccattcaaactggaaacgattaaagaaaggtcgattaaagaaaggtccactagagcatggagaattgttacataaaatgtttggtggcattgttgtggatagatctagtgcaagcgcaccccgtgaagtgtttggagggaatgatgaagaagaggttgttgttgatggatgttatggtggagatgacagtgatatcatgccactaaggaaaattataaaattgcaaacaaagtcatgctaggtgagcatctagatgaagtatatcaaggaagttagttaatcgtaaaattagttagtttgaactttgacccggtgaaatttccacgctcctacatgcgtggaaacaggaaattctcccgtgtccgtccccagcccgcaccgcggcgtgattttgagtttttgaccctgtacaacgggcataccctgactacgcagaggtagagaccgccacgacatgtcgtgactcgtgacctcactgcttgcgttgcccgccgcgcacgagtggcggcgcagcagaaaattaaacgacccgacccggactacttacacatgtaaaggctcttctgctcccattctgattggcacccgtaaatcatctgctttgtctacctcggcaggtttgcaacatttacgcgatccattgcattgcgacttgcagctgcagagccggtg

SEQ ID NO: 6351 - DNA, 1100 bp, Zea mays
aaaatatactttgccgagtgtctaggtatggcactcggcaaatagttctttgccgagtgctaaccgttggcgctcggcaaagactgacggccgtcagctttgggacggccgctgacggccctttgccgagagccccgtttgccgagtgttcgacactcggcaaacatggatttgccgagtgtggacctgtaccgagtgtcctactctcggtaaagatgctcgttaccgagagccaagctttgccgagtgcggctctcggcaaagccgtctttgccgagtgcccgagaaaaggcactcggcaaagcggccggcactcggcaaagtctcggattccggtagtgttaggcacgccacacatattgcaacctgctaagcttaggcgtggcgtcttaggcgtcaaacaaaatagctcctgaacctacaaattgtgccaaatggtaccgcaaatgtcctacacctgtgttcaatattggaggaccaaataaaagaacttcaagctaaggatgaagagatacaacacataaataagagtaaagtactgagaaataaattttaaggtttaaggtcgatgaacaagcaatattaattgtgctatgaaaattggatgtgtaatgtgggagatgagaagatcatgaaaagtatccaagtgtgacttatatgcatcaaactaagagatgtttgtagcagtctagtacttgaaaaaaaaacttttatgagactcactacaacagtgtgacttacagacttctctccgtcagctagtcagctacagtagagccatggaagattcctctctcgtgtactattgccgttcaaacattcctctctcattctcatgtgtttccacgttcagtacgtgtgtgtatatgtcattgtccgagctggtcagctgcgaatgcgcatctcgagaagtaggcaagttaatgcacactgtcaatccacgtgttaaggactgatctaccgctcctagtttttattaatttgttccttggacttgtacgcttcttccagctagtttcaggcttcttctgttctgtttatatatttggagattggagtactggaggcacgtaccgaccggccggccgggcgacccagag

SEQ ID NO: 6352 - DNA, 1500 bp, Zea mays
cgcgaagaaagatcagcgtccgtccatgacgtgtgggccaccagccggttggccagcggcgggaccgcggggctgcaggctgctgctgcctacaggccacaggccatgagccaacgccaacgtctcctactcgtactctaccagtcgtcgcaacgcaaccggctaacgtcttctgccgcgactggtctgcggccgcgtggcgggccccagctgtcatgctcccctcggcggggccgccccgctgccaatataagaggcgaacagggacagcgcctttcggctggcaccgggagcgtgcgtgaccgtcacgaggaaggagatcgggagcgcagccgcaagccggcaagcggaagggaacggctcgtcgccggcggggccacgtacccaggccggggtcaccgtccgggcggctggggtgggcgaatcgattctgcgtgcgcggctgggtcgaggtcgagatagcctttggacggggtgaggaaagcgagagataaaaggttgggccgcttgcttgcccttccacttctatctatccccacctccttctccctttccgcccccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaaggtgaggggctcagggcttttcggtgggtgcttgactcgcttcgacgtgaaagcttgcctttctcgcggtaaattcggatcttttggggtttcgcgcgccctgctgttcgtgttcggttcctctcggtacggttggctttgcctgaggttttgttctgggggtccgggtttctggctggttttgcgcagcgactgtggaagaggtgccaggctcagtcttcccgtttgtgtctcggccttccggtgagtygttccctgctgaacgcttacttgatcgagtgcccaaggatagaagttgccacacgaagcttggtttctgtgccaacgcccctttcttcttctgtgaagaaattgccgtttacggcgaagacttgtgcgctggctcagtttcacctagttcgtgcttatttttactygatccactccaatctttggtatgcttgtaatcctgctaattcgtggtgaagacgggattttcttttctttttttctgtacgacatttgagcagtgggaactggggagctattcttgttgtcgatttgtgatagaagtccgtagaacctctcttgttttttagaacttttactcttggatgcatgaattatgagagagtactgctgacctttttttcgtgtttaacatcatgttttagttgctgatgcaaatactagattctgatggtcaaatatttgggtaccgcctttttttagtggggacattctggcacacctctgatctgttcttgtacttgcaatctttcagcgagacattgaaggcgcagaacccaaaga

SEQ ID NO: 6353 - DNA, 1500 bp, Zea mays
cttagagtaatcagtagtagcagagatggcaagggtcaaccttgaccctttgagacagaacgcttttggtactccccttcaaatctggaactgacgggtatttttaggggcctctttttttttttaccttccacgatgggcatttatttagttttagaactatctagctagcgttgatatgaattggaaaaccggaagcggcagcaggactcgcgctgctgtcaggcgtcactattcggcctatttgattgcctttagtatgaactgttttctagtgtttatatagtgactagacttgcagctgcatcagctcgttgggccctccgtccgctgaccaagccgcagacgagctagggctagtggtggaaccgtggaaggcggctcggaccggtaggagccacgtcggcatccctgagacagaattccctgtttttttagtcagtcgtctcttccctttctgatttctgaatagccgttcaactgcaactgctcctttgtggccgtgcgtgcggccaacggaaggaacgcgcggctgctgtctgcgccatctgccaatgcagggcaggccttgttagcgagaacgggaagagaccgaaggatccgtgccaacttacatttgttcggttaaccccgttatccattaattaaatagaattagaaaatattaaaaaagaattcacttaatttatatgtattgacagctaaccaaacaagcccttacaaagagaccggttgcctgtttgaagctccaaactggtacggtattgtatagaggttgcgtgcggtccgatacgacgcctgcattcgctgggacgtggaatagttcgaattcatgccgccaaagaatctccgcgtcccgacaggagatggcacgcacggcacggatcggggctcgcaaattcaccgagcccggcccgaagccaaagcccgtgccgttaccctgtgacggtgcgggcccaccacgcagtgcctgacacgcgcggcttctgttccgttcgaagccgaagccggggggtggaagtgtaatggatgtcaccacggtccacctccacccgtgaccgctcgacccgaacgtggctgacgcgcggggccacgcccgggtgcggaggctgcccggcgcaaccgcgcaggccagaccccaccggctgccagcgggccgacctaatactcgacgggggggcacgcgaaaagagacaggccccgtgggcccttgtgggggtcgtggtaggggcgtagggctgctagggatggtggtggtggctcggcctgcgggtacaaagcggagcggcgcggcgctatataggtccgcccccatctcctcccgttccactcgacgcccagcaagcgctactactccaccaccaccactactttgcttgcttgcccctttcccttcccttctcacacgagaagagaagcgagtcggcgttcgcgtggcatatgcccgtgtctgccgccgggcttggcttctagggtccgctccagcgccggccgaccgcc

SEQ ID NO: 6354 - DNA, 622 bp, Zea mays
ggtatattgtcagtgtttgccacagtgatgctgtggtcgttgattgcaccaatgagatctcaattctagtgccccctcctcgcatgtgttgtggattggtcctaagctcctgattatgctctgggatgttatgaattatgcagtagagctgggctgaacactggacactgctgctaggtcaagacttaccaaggagtgtgccatgtcaaacaaaaaacactgaataaattcattgaagtttgaatccatttagatgagcatctacttggtaaatttcagagtttcaggagcaatgaaccattcttagatgaagcacatcaatgtattgtggagttgcagtgtcctgattactacccagaaattgttaaagaagttgtcaatcttgccctagataaaggcaccaattttgttgatcctctttgttaggctactggagcatttgtacacaaagaaaattttcaagactcaagacctggaatccggttgcttgttatatggtactctgctggatgacattggcattgaccttcctaaagctccagcacaatttggtgagatcattgctcgcctgactttgttgggtgccttgagatttgaagctctggaggttattttaaagaaa

SEQ ID NO: 6355 - DNA, 878 bp, Zea mays
ggtaattaaagaagctgtgctgagttgatctataaaaggaggtgttttttatattaaaaatgataggacttctatagtattcatttttttatgtgacaacttctgcttgaatgatctgctgttaaacatcaagtaattgacatgttcttgccagagtttggtatctgtttcctagaatataatccttttgcacttaataataatacttagataatttatggtcatcctttttgaccagatgatctctttaggtaccatgagtagctagatgcatcacctgatttgcatactataaactatacagaattatagacatcgccgcacaattaaagatgaccaaagattgtggcctcggagtttagctaaaaactaacttaattttcgccctgatatctgaaaactgtcccctaacctttgtttagtagccattaggcttagaagctgatttttgacggtcacataccttccccttgtcccataaaagcatgagtagtccaatactgaaaaggcagtccaatggataccatctatttttaagtttttgttctctggttgtgaacataaacatgtgcacaagtagcaacagtgcttccactttttcatatttcaactctgtagaataaaatccatttacctaacagaagtatattaactgacactaggaatgataaaccatgctcctacagttagcaaaatcattatttgaccagttagcattctcatggttgcactaacattgagaataacttacactgtagcttagaattgttagatacgtgtgtgacaatatgtcaagttatcatctcagaacttcaaccagagtctttcacctgctttaactttgttatgacactttgccatgcctttaactttgattg

SEQ ID NO: 6356 - DNA, 1500 bp, Zea mays
tggctatttctaatttctatgtcggattgtaatataaattgataatgtcacttactgtgatataaccatagagtgtatagtagtgttcttagtaaccaggttctcggatcgatgggatcgaggaacgagaacatggtacgcggtacgctactaaaactaggatttaacactacgagaactagattgttcccacgtttaccggaacgaggaacgtggccaagttcccagttccgggttactaagctccaaataataatgtaaaattttaaaaataatatatgtaaaatatttgaaattagtaagataaatagattactaatatattataaaaatagattaattttgtactataattttaaataatataaattaattatctattggatattaatactatatattaattagaatcttacgtaacaaattgtgttagatcaagccacgagcgtgagtagcaacgaatcaagctaagctgagctggtttactcttttcacacgctacaaaatagacttatctaaccgagccgctgagcctactcgtcaaactcaagcttttttttaacctacatctgagcaaggaagcctaggattgaaacggaatgggcaagcgccgcaagcctagtgacaagtgtgaagtgccccggcactgcacgaaagcgagggcttgccccgcacgctggccaccccggggcgcgacacgtcagcacgctcgcggcaggatgattggcctgtgtggacccgcgccccccttggacggcggggatctcgtccagcccaggccccagggttataaaacttatccgtcccggccgcgaggctcgctccaatccttaacccaatcggttggtggttgcgtcgcgttgtgtcggaggttggagttggagcgtctcgcgtgcgagaggatctgagcggagaaggccatggaggagagtaattagcggttgctgggtcgggaggaggtggtgtggttttgatcgtagtcgcgtttgccggggctcgatttcgatcagaaaactttttttaccggatattcttgggtgggtgtgtttttgggccgcaaattgttatcgccggtgttcggggctcgattttgaagaagaacccaatttattaggggggaaatttcctgcttttgttttcggggcaatggttttggactcccagacgcttcggattagagaatttttgccccaataacgagccattttttcagttgtgctactcgtcaatcaatccagtgattctgaactctgaaagaaagaagaagctttcctaattttcgtgctcactgtgtccaaaagctttccgttggatctacttgtgaatcggttccttttttttttaatctgagatatccttgtcgctttaggttttcgactcggcagatccaagggaacgacgaatttgcctgatttctccgcgatttttggtccgatcgagaggctccaagcctctttttttctcgcgaggagaagcaagggttttccttttttttacgcc

SEQ ID NO: 6357 - DNA, 1251 bp, Zea mays
acagataggtggaaacctgttggagctgcggcctctagatctcgtggatgccgatcgatcgcgtgttgttttctggggaagcaaactggttaatggagctagcccgccttaccggctcgtgtaaatcctctgtccatcaattctgtaactctgttttatcgattaatgaaaagaaccgggcttgctcgactgattcctggccgatgcaaatgttgttttttttggaagagaatcgaacttgaaatgaaaacgagatgggtgccgtaccatctggtgcgaattattggagattactacatgtgattctgagtgcagagaaacggaacatgataaggcgaaattcgaaggaatcaatcatatataaatcatatatagtttctttttgtttaggaaaaacgtaggaaccggggcctagagcatctccaagagactagctaaataactcgctaagccaaattttggctactcaatagcaaaataactctttaacagattagctatctgactcgccaagctatccgattttttaaattgagtctctcactagttaaatttggctagccacatgactatctaaaataggtacatagtctgttgttgcagtgagatgctacatatagagtaatctttataaaaagttaaatagatagttaaatatagagctaaaaatgaagagttttttggagatgtttttttattcggccactcgtcaattcgtcatatacaccacacccgccaatcggttgacttaaataaaatatggacaaatcttgaaaccgtccaccggggacccccttctgtttccctctagggctccagggctccaggctccatcgacaattccacatccacggatccacccatgcactgcacgcacgcacgcaccgaccgggtcgtggactcgtggatcagtcgcggcgcaggtctccgagtccgctctccagccaaaaaactaaccaaacgtccaaacccctcgcgacgggtcgtggatcagtcgcggactcgcggcgcaggtctccgagatgtctatccagcgttccagcccccctccagcctctataaataaaacccgtctcctctcgactccttcatcacctcaccctaccccgtcccgtccggattgaggatctgacgtgacgcgcgcgagcacgaagcctcggccccaacccgactaaaacctagccgggcttccctttcgctaggtttgcgccaccgccgatccggccgacctctccccgcccgccggcggcg

SEQ ID NO: 6358 - DNA, 1500 bp, Zea mays
ggaggcgccggtggccgccgcctcaggttgcttcgccagcgcgccgtgccagcgggggagatggcagattcgcgcaccttatcgccgcccgccaaagaaacctcctgcgcgtcgcccggacccgccgacccgcctgcccgcctggtgctcgacctaatgccgcggcgccccccggcatccaatctttatatgaaggctagtttttatatgaaggagcaccgtacatcaatccaagccgagttccacctcgaggtaatcatgagcctctcttccattcttgttctcacttcattggtgccactgaattgcctgggagcacatggcatcccagccgtcactgatggttctcggaatcgggtcgcgcaaataagcttcttgcctcgaggcttaatatgcagcttctttattggggggaactgtacatgcttctcaggattggtagccactacatttttcttcttcttgttctatcgcagtgcccccttaagctgtagagcaagaccgaattgcaaattgcatactaaattcatcggctgaggttttctagttttttctgcggaccagagaagagcttagcatatctgaagaatcatcataagaaaataaaatgagggcatcagtatctagtgcttatcttttcttgcctttgttgtttaaagatgcattttttcttgcataggtatgttaattattacgacactgttgtggtattgatgacaactgtaggtttcatacttcctccatgtaggaacctaatatattttatgttgctcaggagtataataactgtttggaccattattctagttgcattatactccctccgttcttttttatttgtcacggtttagttaaaaaatgaactagctttttttatttgtcccggtttagtttaaaaatgaactagcggacgataaatattcgagaatagatgtaataccacaaaagagagaattctttacaccatcagttgttgtgatggtccaaagattaatcctgatattttatatcaaataaaataatagaaaagtgatgaactttgcataaaaaaatcctttgtgttgattataaaatttaaactgagtcaaactaatatgtttggaaccaactcagtttttataaactagtttattaaaaactgggtcattccaaacacgcactaagtctatatgcatctgcaaattgaaaaagtcgaatgcaaatggtaaaatagatgatggcgctttatgtaggatcctataaatcctgaaataccacggcacaagtagcgtggttgtgtgggtgcaataaagagctgtgtcagtggaatggctgagcatgatctagaaatgtggtccccacgcattagtgtcttgtacagttgtacttgtcggcaccagaatagcaccaggaaggaccgaaggagtcgaagaagccaggcagcccaggcccagcactgagctctactgtattattgtgtggctcaggctctcagctcaacaagctcgccgcaccgtcgcc

SEQ ID NO: 6359 - DNA, 891 bp, Zea mays
gtgatttagtgtccaatacaagtgcctaagtgtcaaatggtggacaaagtacaaatcaagtataaaggtatgtttctcagacttagtacattgttttagagactaatgtattgtgtctaagtactggaaacaggagaaatcgaattggaagagagatggctttgttcagccaaagtcagctctgtctgggtgcaccggactgtccggtggtgcaccggacagtgtccggtgcgccaggctggctcaagcgaacttgctgctctcgggaaggaattaacggcgtacggctacaattcaccggactgtccggtgtgcaccggattgtccggtgagccaacggtcggccgggccaacggtcggctgcgcgatccgctcgagacacgtggccgagccaacggtcgggagggggcaccggactgtccggtgtgcaccggacagtgtccggtgcgccaacggctccaaggctgccaacgatcggcttcgccaaataaggaaggaaatccgcaccggacagtgtccggtggtgcatcggactgtccggtgcgccaggcgacagaaggcaagaattgccttcccggattgctctcaacggctcctagctgccttggggctataaaagggacccctaggcgcatggaggaggataccaagcattccttgagcactcttgatcactcacaccccattcttgcgcacttgttcgacattctagtgatttgagctccgttctagtgtgctagtcttttgagcttaagtctgggtcttgtgtgtgtgtatttgttgtgatctttgtgtcttgttttcacaggatcacctattcacccccctctaggtgctctcaattggtatcaaagtcgttctcttcaagaaagggactaaccacccgaagat

SEQ ID NO: 6360 - DNA, 130 bp, Zea mays
tccggttccggtttccggggcctcgggcctcggcctcatatatatatacacgcgcgcggccgtcccctctctataccccctagcatgctcggctcgctccccggattgatcgagctcgctcgttgcagag

SEQ ID NO: 6361 - DNA, 635 bp, Zea mays
gactttatattgttatgatatttagagtttatgtagtcaaatgatgctaagattgtttaatatctttaatttaataagctattaacttttatttggttgtaatattttaattttatatggtcaaatatatgagtcgggcttgaaccggcacgactcaacgaaggcacgacgtggtttaggaccgagttggactactgtttttacacttcgacctggcacaacacggtcaaaaagtttttttttttgagcttttctagtctaaactcgttttacacgaaacacaaatttcttggatggacccactcgacccgacccaattcccaacactacaacgcgctaggtgcacatacacacattgcacactcgctcacatgcacgaccgtcgctaggtaggtatagctcctggtctgggatctcctttcttcctccctgtgctgtgtccgcatcttgtctcccactctcttctcccagctatatctcacttctcgcctcgcttcccacaacctcaaagaaccttcttgctagctagccgttgaggtagaaataaacacacagagaaagagaggttcacacggcgaggcgaggacgacgtcgtatagctagcaggagaaggacataatatggcaaagtcgtca

SEQ ID NO: 6362 - DNA, 798 bp, Zea mays
ggccaccataaaataatgcagactgccaaatgtctaattttttagtcagtttttatgagaatcactttaacagaaaactgttcaaaatcaacgtgaacatagaatagaccgagtcgttgagatagtagaaaaccatcaattccacatcttaaactatatgaactcttttatatttctctatatataatcttcacgatgctctgccatcggattcttcctaaccagattctcataaaaatttatttaaaaaagctgaactaaacagacccaacatgggtgcggatacgtccacgtgaagaaatacgatgattatgatcaatggtaaaattatacctttattattatacttttgaaaaaaaaaggagcaaacacgtgaacttccaacagctttgatgcatcatccatggagcgggctgacgtcgacccccaaaaccagctcgactgtagtgcggcgccgcctctaattttcaactagagcaggctgacgtcggcccagcccaaacccaactcgaccgaagtatccaagcgctacgctagtccaaattaaacgcaacaatcccataaaccaccgacttccaggagtacttccagcgacccagcaccccaccacaaaggcacaaatccacaatcccctcttcggtacctttctccgagtcgtcttcccgttgatcggcaaagagactttagggttttagcggcttctatttctgagcgagggtttatccgccaggggcggcgcgacgcggcggcagttgagctgggatttccttcccatcccgttcccttccaggcgaggcg

SEQ ID NO: 6363 - DNA, 1500 bp, Zea mays
ccaccattgaagacatccaagtttccagcaatttgcattcaatacaagagctctagacttcactccaagacacaaaacaaaagatcaaatcctatccaagtcccaaactcattccaaagacttagtggcttgtgagagagagacatttgtgttcatttgagttcttgtcgcttggatcacttttcttcttcctctattattgttctcaagcaacttgtaatcaaagcaagagacaccaagttgtggtggtccttgtgggggtttaagtgacccgtttgattaaggagaaaagcccactcggtctaagtgaccgtttgagagagggaaagggttgaaagagacccggtctttgtgtccatctcaacggggagtaggtttgaaagaaccgaacctcggtaaaacaaatcaccgtgtcatccgcttcatttgcctttgatttgatttttttcaccctctcttgtggactcggtttttttattctaacgctaaccccggcttgtagttctacttaaagtttgtaaatttgagattccgcctattcaccccctctaggcgacttttatttttaatattaaatataaattgtatatatgtatatatgttttttaaaataaaaaatataatcgtgtcgggccgggccagcactacgggccgaggctacagcccaagcgcagcacgacgttcttggctcttgcaaacattaggttgtttctgagaccatattaactcaatacactccatggtgtttgaggttgctgaattagatggagcaacaatgatttgtcacactaacagtaaaatgaaagggtatttgatggttttaaacgttagtaattgctacgaagtagcataatttatatagagcgcatccagtttttattgatgcctgactttagcaatcactgtatattttgatctatttttttataagtttgacttcatgggatttattttagaaatttgattctcacaaactttctcttaattggtctctgtatgatgaaattatgtcattttataatcttcgttcatttagtcaatcgttgtgaactcccttttaatcactcactttattggtcgtgttgtaccaagacatattgcatggagtaaacaataacatcagttagccaaatcaaaaaatatattatacagagagcggagacaataaataaaaaatcttgaaatttttttgatggatagtttacgtgagtattgttgtaagtcgtcgtaacgcacgaataaccgactagtatttattatatataacagaaataagttgattctaccaaaaattataaaataaactcatataatgcattaacttatgacataggcacaaacacgccgtttattttgggacggctccacagtcccacctgacaggcacactgatggccccgccagatccaagccgcgacccagacggcaagatagagcgagcgacctctcgattctccccatcccgccgtgcttcccgtcttcaccaaatccttcgccacg

SEQ ID NO: 6364 - DNA, 1500 bp, Zea mays
ttaagatataaattagtttaagttactattcaatccatctcaatccacttaatatatatagattaaagtcagtactacagtacccaaactaagccacttatttcgtgccttttgtaccggtgtgggtgtagctctcctaggcaccacacatgaaaaaagacaaaaaaaaaatgtgtgacaccaactacacttgggatgcttctggagcaagcgaagtatacgaggcagagagacaaacgagcttcaatcaggtcaagcagtttgtctttttctaagcataacaagcggcactgggatgctccacgtggacactccatgctgccgatacgcctcgctagtttacaagtggaaacatttgttaggacctgatgaaggggtgctgatgatgggtcctagtacagtggtaggtggtttgcatatattgcgcttgaagagaagcgctgcgcatccatgttcacacaaactctcagctgttgctgggtacatctgatgagtagtaaagattagagcacatttcagcccttttctttattcttaacatatttgcttagctttaatccatactgatactgggcttttatggtgtgttgtttctataaattatggttgcagtctaaataactgaatttaatcaaagcgaacggactatacggtaattaaaaagagattgtcatgctatatgtcaaaacaagacatgttccttgtttccctagcctgtcgctttcgccagaccctttcaccaccacgcagtcgtcgttggcaggcgtgccaaggacgacaaggccggccgggtcggccaccaccctgccgtcgctttccggcgggaatcctcccagctgccaatcatcacgacgcgcccccgcgcgcgcgccgaccatgacatatgccttcccccgccggagacgcaaacaccacaacgcacaccaacgctacctgctttcgatcatgtacgtacgtacgtacgcgacccaagttgcgtggcgcgacgggcagcgggattccgcggacaccccgcacgctttgtccacgctggatgcgtcgccgccgccgtcacggtcaccgcgcggacagagcgagagaccgcgtgcggccgggctggagtggccgtcgcgtcgaccacaccagcagcagcagcgcgcggaacatgtgggcgggcgacctggtgggcaccgtcccacacgtaccgagtacgtgtccctctccccgcgcgctatccagccgccgacgcacgcccccttttgcccggccggctcgtcgtcttctcctcctgcctttttagtctccacgctcggcgcggggacagaccaaacgccgaggcgcgattccgcaaagcgaccggccgcgcgacacgactgagcgagctcgctcgaccctcctgccgcggtgctgctacacagctagtactagtaagtaaattactccgccaccggtgcaactttccatacacgccgaggccacttgtgttctctgtatataaagggcgagggggtggtgggcgct

SEQ ID NO: 6365 - DNA, 1500 bp, Zea mays
catgggaatgagtccacgcccgcgcgtgtgatggcagagacattggcaattttgccgttatgatttatgggcttcgccagtatactatcggaccacaaatcatagacacagatggtcccatcagtcatagatacggaatggcataataatagaaaaccaaaattgagagtgacacaaatttctttacgatggcgagcctctggcgataggcccaccgatcagcaccgaattgcccatgagcgtgcacaaatagagaatgtgtgcacgcgatagtgcagctaacctatggggcccgcgcgacaacgtgtttgcacaaggtttcccgggctgacgtgcgtcagcgtttcagaaaagaaaagactaagggcttgttcggttttactccaatccatatggattgagtgggattgagggagtttcaatccctagtaagtcaaaatctctcataatccgtatcaatcccctccaatccatatggattcaaaataaccgaacaagcccttagtggtcaatctattttgcatgacttcttctcttggctaatacgatcaccatttttggacggagggagtgcaacattacaagagtatatcttatctgtggtgttgcattgtagttatttaaactgttaggaacaagaattgatagtgaagacattttgatagtatgagacacctgccatccaaattttagcaaaggatggcatactttttgtcacacaaatacgatacccattttcagattgtagcaatggatgataatttactcgtcaaccatgcagtcaatgtgttttattaaataattttactcattttgcactgatatgttccctgggatctttctatttgcagtttgatttgtgttcatatatatgaatccggttttgagaccttgctgaaagtatgttaaactatacttgtgggtgttgattcttgtcaattgttgagaaaaatccatacttactggacaggatggggttgtgtaccgatacaagtggtaagttcgtggatccgttttctatctgagcaatatgattcaattttcaaaccgtaaactagagcaataataataagatgtgtactgtttgtactttgtaagaggaatctgaaattgagtgtaattttaatcggctgtttgttcatggtatcattctctttgcggtttgatctggatagtggatacccctctgctgcagatacgtctttacctattccgattttttcttctcgataaaaaagcaaaactttacctattcgttctttccctgagtttggatccatgaattgaaatcaatatctacaaagtgcttcacattttattatcagattatttttcaattcctgggaaccaaacaggtctgaaagaaatgaaagcttctcgatgaaaaaagaaggaaagccgaaagttgagtagccaatgggtatggttagagtcttggagaatcgatccaggatatagctagtgtagtgtagtcggataagcctccaaacactcgtacat

SEQ ID NO: 6366 - DNA, 1500 bp, Zea mays
gttgtggttgaaaaataataggtaatttatgcatcaaagggatccagtgagcttgccgtgcttatccagcgaagggggaaggagagcgcgcggaactggcttctagctccactgcctggcgtagacttgcagatctggcctccacgagacggcacgaacgctccgataactatgcaacatgaacaagcaaacatacaaaccagcaagtataccaacaaatatttagtatagtggtcagaatagcgatatatggatgggtagagtcttgagtagaatctgtgtcatgtggtgttgtgatattagtggtggtggagcgaaggtgcttaccaggagggtggactggaggcgaagcgacactatgcgtgtagccggcagagcggagtaactgagtgggtggggtgtttgccttggctgagggtgttgagtgtgtgtggagagggagagggtagctgggtgtatttatagctgggtgtatgtggtgtagcacagtgaagttcactgttggtgagaatagtgacgaatgaatcgtctgacttagtatgaacatgagagttataggcagaatatgggacaagagtattttgggagttttctggaatatgggccatgcttaagggatgacatggttggatagggaatagtttgataagaatttagaaacaagaattattggaatctgagtttggaagcctggttcgaaggaatctcaaagttaagcgtgctcaacttggagaaacctgggatgggtgaccagatgggaagttcccactggaaggaaaatcacagtcaccggagttcgtatgactgaaatattggtctggctggtcttaggtgaactggacagcatgacggatgagtagttgaaatttggggtgatcggatgatcgatgaatagtgacgacgaaaaggttgccatagatatcatcgatgaatagtaatgatgaatagtaacgatgaatagtaatggtgaatagtgatggtgaatagtcgtatgaacgaatgatgaacgatgaatagtgacgatgaacgaatgatgaacgatgaataggaactatgaacgaacggacgaacgatcgaatgatcggacgaacgaacgatcggaatttcggcagcataatgggaggacaaagattatctggaagaatgatgaatagggaccatgaacgaacgatgaacaatgaataggaactatgaacgaacgatgaacgatcgaatgatcgaacgaacgatcggaatttcggcagcataacagcaggacaaagattatttggatgaacgaacggacgaacgatcgagtgatcggacgaacgaacgatcggaatttctgcagcataacggcaggacaaagattatctggaagaacgatgaatagggactatgaacgaatgatgaacgatgaataggaactatgaacgaacgatgaacgatcgaatgatcgaacgaacgaacgatcagaatttcggcagcataacagtgagaccgtgagagggcggaactagc

SEQ ID NO: 6367 - DNA, 295 bp, Zea mays
atgtttctctacggactgcgtgcttggacccgcctcttgcgtgtgcggtcggaaactcggaacggcgtgtgtcactttcccacctcccgtcgtcactccaccgccgtccccttgagcgctcgccccaacctggggacgctcgccccagccgatccgatccgtctcaactccattaaaaaaatctctcctttccccctccctatccaggaaaaggagaaggtaccacctcggtcgatcttccctccatttactcctccgggcgaggtcccgattcgatcgaaggcggcggagagag

SEQ ID NO: 6368 - DNA, 111 bp, Zea mays
ggtggaggccttgtccgctcttttcgggtggcccacgccaccagcagggcctgtatgaaacctagtttcctccccctgtcctttgtggttgtgttatgtagacagtgatcc

SEQ ID NO: 6369 - DNA, 1026 bp, Zea mays
tcgccctttaccagcatggggtaataataattttaggaatcaaaaattatgttttgtgatttgtgtcgcattaattcggaccagcatgaatttaattaaaattttagattcagaagtagtcaaatataaattattccaaaaacttttgtagtatgaattctaatcaagcggagtagcaatcctaagagaaaaattgggattattgttgtgtacgaatatgaattggagagaagaatagataactattaggggtatatggagataatatgggagaagaaagaattatcattttttttcttctttattgggttaaccgtgaacgtgcacctcatctcaggagatttttttgttttttttctcgtcttgcttatcctctcccagtggctggtgaacgtcggtttctgaagaaacaaaaaaaatctccaccgctctatctccagctcgatcgctatctctgatcttttccccaacgcttgcatcttcaggtcgttctctcccacaccgtccttatctccgtgcttggtgctggaatacttggagtgaagtttcgtaccttcttctcacatcacaagcaagcgttctggttcctaggaaaaaaatcccaccgctgttgctcctgtccgtgcccggccttgcctgggcgacatcatccttggccgattcgctccatcagtcgcgagctcggcaccctgctgcggtcggcgtagtcgtcttcagccaccggacaccactagccctgcttgtctccgtcgcggcccagaagcccagccgcccctgctactcgtccttgtgcctacaccctgccgcatccgctcaagccactggacgccggcgtcgcgttcggtctggtcgcgctcgtccttgcctctacatctaccagcgttcagcgtcctacaactgctcacctgctccccatcgcattcaacaccgccacagcctcaagcggcactcgctgaacaacatcctcctcgtcgcgcttggaatccgccacctgactyatttttccttgctctggtgcgtcgtctc

SEQ ID NO: 6370 - DNA, 1500 bp, Zea mays
gtcgacgcacaacgacgaggcgccgatggaacatcacaagatgctacacgtgtggccgatgacacacctttgactgcatctagagctatgctcaaggagaatggtcgaggcctcgctaatgggtgtgaccatgggaatgacggccttcgatccatctcagacatgaagaagatcaggaaaaggggaccagggagacgaaccaggagaggcaggatgatggataggggcggaggccttcaacgacgccgagatgggaacagagcatgcttgagatgggaacagggtggtcgtgtggcggcaacgaataagaagactaaaatatccgtggaggttggatcgagcacggacaatataaggccacgagtctttgagccacaaatatgctacccttcaagttgggcctcaaaacgtttagacgaaatttattaaaatgagattccggttagagctgtattttttcagaccctatattttaatttatttatgtgtttagggctctatttgaagtcactcttctataccctacaaactaatcttctataccctacaaaatgatctttactacatttaggaacaagagttgtgagttgtgttgtgtcccatatagccaagcccttagccctcaaagagtactacgcgcacacaatctaatccaatattattatgaatttacttattctaaacaaagaaaaaaaaaatccaggccaaaaagcgaccacggcggatatgccgagtggctctctctctccggcgtgccaaccttatcaccacccattcgagcttgctgcggctgcccgctgcccccacgatcccgatagttttccgaaaaaagacacttccccaatccgtagtggttcacgtcctggttcctcgccggcggcaaccgcgctggacgaggtttcatctgcgcttcgccggcggcaaccgcgctggacgaggtcatccactagatatgccgccctttccctttccgttcctcgtgtgccggtgtgcggaacgagcaccctgcaccccgaactcaactagagcgtgaggccgtccgtacccgtgcaagcggaaacgcccacgcctgcttactccgcctcctctctctttatatcttatcttcttccctccaccacactcccccgctgccgccgccgtcagcgactgcagccgccgctaatcccagcgtgttctccgtctccggctcgaactccgtcgcctcccgccggctcccgcctctcaacgccgccttctcttctccgtccgccgctttctcttctccgtccgctgcccccaccacctgcaccgcccaaccgacctctttattttttttatttctcacatttttcccttgtcgacctagccacacattctatttggggctgctaactgagcttgaactctgttacacaatttgattttgtatttgattatcgaacaggtagcgctgctatcaaacaccttgtgctgtcaacatttatgagtgcaaggcagtattgctaagagtatcttgcc

SEQ ID NO: 6371 - DNA, 1500 bp, Zea mays
atgtggccctctctcatgggccacgatacgacggtgcacacgaactaggagactgacaaccttcgtgttggcgtgcaatgagcaaatgtttccaagcatcaatttgcttcgaactagataaacactatcgagatagtatcgtttgattcaatttggctgcttattcaagccaataaaaacaatgtggcacaataataacaatcctcaggctcagctgagggatgccacattatggtctgcgtgtggtcctctcccacgggccaaggcatgacggtgtgcgagaactaggagactacgacttttatgttgacacgtggagcaaacattttcaagcattgattggcatcaaaccagacaaactttatctagatagtatcatttgattcagtttgactgcctattcaaaacggtaaaaagaacatgatgacactgtaataaccgtgctcaggctctgattacggggcttatagatctgccaccggtggcaaccacaaccatcatcttacgtatttgctgttttaaattggtatacatttattttattgtttcttttgattaattaattagtaaatttggctgattattttatgagcagattcgagtaaagacgatcgcttcatttgcatagatcactttagttttcaattatagtttacatatctacattatatcgaaaagagactaccaaccaagtactgtttgatacgctgttaaaaggaacgaaacaaaaaaaaagcgccgttgccggggatcgaacccgggtcacccgcgtgacaggcgggaatactcaccactatactacaacgaccgaattgatgtctcagcgaagaacgaatctgttaaccgtgggtgaatactgcagacggctgagtattggtatttattactgggagaggaccgctcggccaagcggccagcgccagcatcgaccctggtcgccaaaagtggcacaaaaccgaaggagagagaggacagagtccctgtactgtacgtcgccgcacaggccacagcaggatttcagcacatgtaaacgatcaggatgcactcgatttgtttaaaatcaatttcatacatattaaacaagtgtactgaatagacatgtaaatgaatcaattctgaattaatagaccagaaattgaaacctttatcctatgcatattgggacggttaaattttgaaataggtagagctcgtgacgagtgtaagcatccatatgacaggaaaaaaaaaaactgatttggtgaagcattgctgatagacactgaccactttatatattgctgacagatacagagagtttcgaacaaatttactttttcttctagaaattcctggaaactagacagaatgctacaacaccaataacccccattaaaacttcaacaaatcctaaagacattgtcatcttctcatttttctagtttccatcaatttgagatgaattttacacaatgcccttatgcccacaaagcaaaactcaaactttggaaatgactataa

SEQ ID NO: 6372 - DNA, 930 bp, Zea mays
ctcggcacccctggcagaatacgcgtcgacagtcgaccgaacggagaagtacctgctccgaagagtacctcctgggttgtcacttgtcctgggttgtgttctgatgcgtgcgtaggtgtacgtgtaccttggcgcgtcaactgccggacgtcccgtgccccgacagcagtcaccatcgcatcgatgcgcagatgagaaggagagagatggtgctaatagctaccagtatccaattccgcatcgttctagaacacctgaaaagaaaagaagtgaaatcccctggcgctggcggccaggagcccaggagggtggggacgtactacggaagaaggttcccgatgcatcttgttgtcttctccttttgcgagcccaagaagaaaatgaagctgctcaagtgctgtcgcgacgcgacgcgacgcgcgcgcttcaacccggcggcagcggcaatgctggacctgggcgttggaaccgcatggaaatcgagatggatatgccgcggcataaacccggacgccggcgaatattccctccctctaggcggccgaactctattcccggtccgagatgcccatgctccgctccgctgcctgtccgtcccaacctaattaacctgcccatgtcttcgtcgtgctcctcgtgctgtacctgctccgaagagtacctcccgtgtgtataaatagccagctgtcctcgctcggcgcctccacaaattagcaaagccgcgcgcattacattacattacatacaaacatacacagtttggccgttaattagccagcgctgacaaattaaccctcgtcttcgtcgcctgacccgccgccgaccgccgtacgtgaccaccaaccaggctatagagctacctccagccgccggcccgcgcgtcgtccgccgcggtgtacgtacgtctgccgcggagccacgcgcgcggac

SEQ ID NO: 6373 - DNA, 55 bp, Zea mays
gaagaaggccggaacagtacattcatactagtataatagctttattattggaata

SEQ ID NO: 6374 - DNA, 982 bp, Zea mays
ggcctttgcaaagatgtctttaatcgagtaagaaatcatagaaatgctcatgatttgtggatggatatttgtgctctacatgaagggactaaaagtgagcgtgaggagagatatcacattgcaatgaaaaaattaaattcttttgaaatgcttgcaaatgaaaatgccaatgatatgtactcacgtcttaacattattgtagaggaagtcaatggcttggggctcacccaaatttcacaaccggatgttgtgaggaagattctcagtgtcctcccaattgacaaatatggatgttgggggcctgcttctccaccgaaggtcctctaagcaaaaacacyttcagcaagacgatatgcaagcagatacgacatgaagatatgtgccgaagctacaattgaaagagcttcggcatgatggtatgcctaagacgaaggatggcaccgacttaaagagaaaaagaccacatagtccctgataatttgtattatgattataattagttatcaaggacatgaatgtaattttgtacgggctgcgtcccgtgcctataaatagatgaacagtacccccgtactgttcacgctgacttgtaatcattcacgcgtcactcctggatttttaccttctgtcaagtcgaaggtacaaatgtaatttaaatatcattgatgtttgttcatgattatataataataatgtgaatagtctaacgatttaaaatgattattcatactccttttgcgttccatatgtccctgtttatatccttgcatattgaaatgatgaaggtgaatccttcatgaccttcgtccgaagatcattatatcgttagagagaatatgcttcgaaggacgaagatctttttaccattaacatttgtgttgccttgttcttgattcatagcttttgagaacaagtaaccaacattggcgcccacctccggtgaactcattgacccaccttcgacaaagctgtgaccttcgtc

SEQ ID NO: 6375 - DNA, 1500 bp, Zea mays
ttcggaacattgtgctctaatgagttatttatgtaatcgatgtgtacgttaatttcagaatctgacacgtatacattcagttgaactttaaaaccggatgtgacacttaaattggtcttccttatcccaagaaacatgcatgattgcctgataactgataccacagtaaagaaaaaaaaggaaatgctggtattcggcaggatgatttctttctgcaaaagagacaaaaaaaaaaaagaaacaggaaaatcctgccaaaccttcgccatcacaatctcatcgcgtttttttcttgccagcaaaagtacagtgaacccccacctatcctgtgtccctccctctataaataaataaataaacttttttaggagacgaagcacaccgcaggacaggagaagcttgggtctcctatcctccccacccctctctcggtctcttccccaccgcgtcttcgtcgtctcgtcttcctgcctccttcgcccgagaaaggagaggtaagcccgccgagatctccttttcttgcgtgcttcatcacgccaggctcgtcccggtgactggctggttttggctctgggttgtcggctccggcctccgggtccgggcacagagcgcgccgcgcaatggcgccgtgcggatgtctttcggttgactgagtccatgcatgcaggttttgtgcctggaattgctaggattttttaggattttccatagtagcttcgttaatccgcccgtttccaacttcccgtggaggaataacctgggaagccatgtctaggctgtcgccctgttttgccttgcgaatcctaggatggcgcttgcctgttttaccgtgtgaaatctgttgtgcagcagcgtcgttgttcgatttagggacggcggttgacttttcggccgccaagatcctgcctgactagcaagtacggctctcatgtaggcaacattagaggcacaaggcttacaagctctcttctctgtttccttcactctctgtttatcatgagatggtaacttggaaattgctactctgctactggaaagtaaaagtttcagaatttacatcattcagaaggtttgattatttgcacgtctctgatagccttgtttatttaatgcctaggtttgttaatgagctttgcgctctgtttactacgtactgcacatgtttttcgttcatctggccgcgcttaggcttttaagtcaaccagatctgcaacggtactttgagttaagaagcttcagaagtatcatgcgtgttcagattccttgatgccataacggacaatatttaattgccaccggcacacacgacttgctgtaaagattccctggacccatgattggctgataatttggtatcttcttgttttgtttttattgagtatatgtgccacacattggctatacgttgatgatccatgagctggactttagcaactgctgatgtgtgtgtgattcatgagctggactctagcaattgattgtcttgcttcaaatgacaga

SEQ ID NO: 6376 - DNA, 267 bp, Zea mays
tgcagcctcgcatcgccaaacagagcatcaaatctttatctgagagcgactccgtgtctgaaggattggtgctcacgtcgcgacatccaaagccagccacaagataggcacacagcgctgctccgcaccaagaatgacgccaagtgtcacgccctggattcctctggcacccaccctcctattagtactctgcactggacttgcagcgctggtgacctgacttcccccacatactcatactgacagtggatccatcactgcaacttc

SEQ ID NO: 6377 - DNA, 1500 bp, Zea mays
atgtgatcatgttgggaagggagttactatataattcccattgagaatacccttagctaaataaacaacaatttcatagactcaactaaaaataatatatagtcaagggttagttgcaattgtttcttacaacacataagtgaatatttcggaaattttagattttagatgctctgtactagtgttagtggagcaaaatttttttgagtgctgcaataaaaaaccttaatggtttgtataataatagttactttagtttttatcgctttaacaatagtcatcttaaactcaaatttaggaggtgtatgatatgactccgttccaccatagacctcagctctaatactccaaggagcagctacaaacatactctcaaaatttgcaatgtgtcttttaaaattttatagagtttgtaactctgaagttaagatgtttggctgactttgatcaacttcccaatggagttttactcttatgtattaaatccaacatctaccgattctacgacaatttcaaacaatttagagtcatgttatatatttgtcatatgaaacaattgtatataattcaagtgcatcgatccactaagcctcgatctcaacttactattcaaaatgatttgacttgtatctactcgtattaagagtttgtttagaaacagatggctagttactaggtaagatttaaacatacaacttattcaccactcttggagtcgttattattagtccgtcttcataagaccatgtatataatcgtgtgaaacattattttgtaatatagattgtactgttcacagtaaaatttaaaaataaaaataaaaatgattaagctgatgctgctacagttcataatatctataattttttctcatatcagctcagttcataatatctataattttttctcatatcagctcagttcataatatctattttaatattttcataagaaataacggccgccccactgaggcccaaaattccagccgaggtttttgctggccagatctacctatggaatgtgagcccataagcagcccattcgtgacgctaaaaaggcctagcccacccggctatcagccgcgtattcgcatctccccgtatcgctcgttcctctccggcaggactcgtgtttcagccaccggcggcggcggcaccctccacacctccggttatcatcaatctctgcgccgactaaggcactggcagcctgcggcttgcgtggcggcacctccagcatcccagggttgatgcaaatccagcatcatccttcaagatcgccccccactttgtccggtctttagatccgccattgagtcaagctgcggcgatcgcgtgcgagactgggacggcgatgctcctctgcatctccacctgccctgtcgaccgctagccgccgcctgtttcctccaattgctaagggcttaaaaagtcgaacacccaattgccaagggcttctgccccccagcggtgaaggggagtgagaagcaccgggaag

SEQ ID NO: 6378 - DNA, 379 bp, Zea mays
cgagctcgagcttttttttttgcagccctagcccagctgaccagagacgtgacctggtactggggtcccgttgccgaaaattaacatggcggcacggcacttgcgtgacgcgcgcccgcccgcccgcccgcgggagccacgtgacatgattgatttcaattgaaatcttatttattttgacatcgacgacacccgcgagccgagacagccacccagttgctcaagtgattccaggcccacgccacgccaaccccgggctcaactcgagtccacacgccccagcaccacccctgcctctcagtccagtcccccacccaccaccaccactcctcccctcgccgccgcccgttcccgaccgatccggccggatcgccccgcc

SEQ ID NO: 6379 - DNA, 1097 bp, Zea mays
gtttgtgttgaaagaggcttgcttacatcaagttatgctgaataaatgatatgggtgggccatggacttgttgtagattgctcgacagaaatggttatagcgctgagttgatgtgatggttgcttggaatggattccattgtcttttctcaataattgatagtaaaagaaagcaaagctagcattgaatatcagaaacaggaatgacctttttctttagctgcatgaatcaaaggttgtatatatatcgatgataaataagcataggtttacaatgacaggctccattcttaacactatttgcatcagaatctaataagtgctaattttaggttttgcctttcctttcatatattttgtgcgatggtcgatgtagtgcgatgagttgtactgttggcatacattatgttttctgtcttttagcacagatatgtttgttgttttggaacgtgttataccttcaaaattaggaagttaactgcatcgacttgaagtatgccatgaaaacagagaatatttacatgcacgccatatttcggatgctataccaacctagctccttctcaaatttcatactgcagcgttatcctgtattttggatagatattattgtgagcacacgccatatttccaaagcacaagaatacgaagaagaagtgcgcatccctcctccatcccatgtctcaaaagatgttgccacggcaggctaagatgcagggcaaaggaggcattcaaactccctccccataattctttttccctttaatggcgctttctcttcttttctttaactccccctcttagctttctttctttcttttcttcttgtagttttacgtgattcccttgttcttcgcgcgggcaccaagaatcaaaggcacaaagataggctcactctcggtttcagcatcccctccaaacttcgctataaatacccctgcacagacgcaccttgctgcataaccatttcgctagctccatagcacttgttccagctagctaggagagagagctttgtttaggtaatttagctttgtgtatatcttcttggttctagctctttgaaattttttttatctgggtgcaggcggcggcaag

SEQ ID NO: 6380 - DNA, 498 bp, Zea mays
cccctgatgtttctgtagaatgaatacacgctgatgggcttgaactgtcactatttgggccatgggctgtatacttatagctgcatgtgtgttttcatttcatgttagtaatgctaatgccttatgtatttctcataattaaacttttcgactggatcatgaagttttcaataaaaagaagggacaactcggtggtatcaatttctacaatcatgaaaaaccacatggaagtagcaaattcttataaattataattgtcacgacaactcggtggtatcaatttctacaatcatgaaaacatgtatttgaggctgtctcctcttaatttatctcttatggtaaaataatagaaagttaaagagtatatttttttatcacatgttagatttaacgcagtacgattcatcagagaagaaaatccttccctttactcctctcccacaatagacataagttgaatactataacatatggtttacaaactattatatattgtgg

SEQ ID NO: 6381 - DNA, 443 bp, Zea mays
ggtatgccacttcttctaaatactatccaaccacagattgttattgccctttatatcaaacgatttttatattgataatagtacttcattgattcttcatttaattggaattcaaacaaggatttcggtaaataacgagtgtcaacttttgacaggaagtattcttgttgattgtcaattcaattgttatgttcatactctttggtactttgttaacttggaatgctttataggaagaggaatagctgggctatgggacttctcataggcaaccgagttatgagcttgcttttgtacttgcaatcctctaaaatgatacattctttcttctgatgtcattatttttttctccagcaaccattttaattcaatacatgcattcatttttataaattgtttgattgatctttaggggaccaagttatggttatcgaggtagagtg

SEQ ID NO: 6382 - DNA, 575 bp, Zea mays
gtaacatactcaatttgtttgcctggaatctagacttgcatggtgtccgttagatgttttgatcccctctacacttctttctctttaagcgtttttagtgttgattattatctggtcaaagtcaagcagatagaaaaagtggagtatgattgcaataactgagagatagtcagttccctgtcaaactatcattctcaagtggacgagctggttgccaatcagtgcttagagtttagtatccattagagacgccaatgttgaccgacgactagaaaattgacctcatagttctatcatggaacttctaaaactcataactctgaatgttcatcccaaaagttttacccgctggcactccccaccacgcattctctctccccacccccaacgcagcgattgcaggaaccatttcacttatctgggagaattcagagaggtacatttcacttatttgggagaattcagagaggtacggagaaattcaatccctttcctcatgattatgtcagtgcatttctctcttgctgctttgatttgattagcctagtttggtaatcggagtaaagcagatagcc

SEQ ID NO: 6383 - DNA, 712 bp, Zea mays
cccacaacccataataattattttattaagtttttaattatgtatgattgtgaattggaaagattttgattaatcgtgctattaaattgttaaaaatgattgtgtatattatattagatggatatccgaaatccatcgaaaacccgatcgatatagacatggatatgaatttctacccgctgatataattaaatacaaccttggatatagttgcagatcgatctgttgtcatccctgttctttgcccactttcaccttgctttccccatttcacacgctttccttccgcccattgacgagttgacgaccaacagacccaggyctccgaccagatcgaggtgagcgaacgtgccccgcctgcgctggtgacggtgagggtgaggccgcacgccatccgccatcctcactgatggttccgtcccrccgccatcggagagtgtagaagtggaagcaagcagataaaccccaggttctgtacttctgtcaactgtcctgtttttcagacgaaatcgaaacatgttagatcaatcaatggaracctctttttagtgtcgcacttgttgaaacggatccactcgagactttttcagatcgattaggcttattcttggggctggtaatgtgagcttctcactaccggattttcctgctgttttctgatgcccatgcccgtctctcgcccgtgcagcacaagtagttcgtaacgccatcc

SEQ ID NO: 6384 - DNA, 227 bp, Zea mays
gaaatagcaccaacctccagcccagagcaccaccgccgttcgcagttcaccctccttcaagaataaaaagggtaattagcatgtccagcaactcaactctggcccccggcctcaagcagcgccatgtcaccatgctgtcaatcgccggcgctatcggcgccggcctgttcatcggatcggggcatgccattgcggcagccggccctgcggcaattctcgcgtacatc

SEQ ID NO: 6385 - DNA, 341 bp, Zea mays
  unsure (1)..(341): unsure at all n locations
gcagcccaccctcagatnnccagtgaatgtgtgataaactgtttggtatatggagcaactcctatgatcccttggctgctgatgttcataatcccactcatattgaataatcccactcaccactactaatcccttgctgttgatgttcataatcccttggctcctataatccactcctaatcccttgttgctgatgttagaaaaattcagtgcatactagttactcgacagttgctaccagagttatatcagtatttgtcgttagtcggtatgctagtccacaaataatgcagtagcactagcacaagaactctgataatttatgtcattgtgtagtggag

SEQ ID NO: 6386 - DNA, 143 bp, Zea mays
cagtagcttggctatcccgctcgccgtctcgtttgggcccccaacaccccccaccccaccgtctgaccgtcctatagactatagtcctatgatcctatccatcatcctctcccatttcgtcgcaatcctcaaaaagggaagac

SEQ ID NO: 6387 - DNA, 808 bp, Zea mays
tagctctttttcgttaccatttgtttaaatataattttcgaatgatgagctaccaactcgtcttctttagactgtggatatgcctagaagatcctcaaagaagtataaggtgtcgttaatggatcaacactcctacacatgagaaagatgttagtacgataaacaatgcctaggaaggatttttttttgcatttaagattaatgatagtgagagatgaacatgctagtcgtagaattaatgagaactaaattatcaaatacaaaaactaaaattctatttaaagaataaaataaaataaaatagaggattaaaaattagtctccgtaaatcaaacactcttaaatcaagagggatgaattggtgttaagtatttggttgatgctagagaaaaaaccaaacattctccccgttattctgaacagatacaaatgcgaacaaaaaagcatatccatccaaatatcgtaatccatttcattcccctgagaaattaatttatttctgcagtttcctcaaattctcatggtctcggtttctcgcctcgccgcttctccgcctcccgtctcgtctgcaactgcaactccacctcggccctctcatcctcgtcaccaccggccacggccggcctccaccgctgcctgcccaccgctcgctacactcatctccccaaagtggaagaagaatcgggctgttgctcactcgtaccctctaagtgaggcgggcctcaccaaccttgctgctatgccttccacgacgctcgctgcagtccaccaccaccggacaggaagcaccacctagttcctgaccctg

SEQ ID NO: 6388 - DNA, 1477 bp, Zea mays
tcgcaccagcttcaaccacgcatgtagcatgttggatgaatgtgtgggggtggggtcacgctagcttctggtctggccggctgcaccagctacaaccacgtgtgctacggactgccgacgagacatgttactttaatccaaagtacatgttcattgctgcgatttttatttatattttaatataaagtataaaacacaaacatatatatattttgttggttaggtgaatgtaaatgcaagtttaaaactacaataatggtttgaatctttatttatacataatttttcttataaccaattaaatgtttaaatgtggatccgaccaagtcagagggaccatgattgattagaaagaaatataagtttttttttttttttgtaaaagtgaatacggaaaccgtggaaccaggaaaacttgtaatttagacgctgcttggragagctatacttcaataatttcaggtctattttagcttcttctatccaaacaggtcgagctcaacgagctctagtttaaaaaaaattaaaacaagagaccagttttatgaaattttttatgctcctcaaagtgtgcttcacaaacactgtttttatacctctttatgaagttacataaaaattacccaccagctattcgttacatgatgtatcgattcatatctctttctccacccgctaaacatcaagggtaattaagaaaactcgcacaagtcagttgtattatagaagctggagtctatgtgcaagtcaaacacttttgaaccctatcttatcaatcttttgaagttgtctttttggtgaagttggaaaatggaagctgcaatttaaaaatgaagccctctcaaataggatcttaatatagtatagattttggtctctaaacttaatgtgtcgtgtcccttaggtctctaaatttagcaatattgtgtcatttggatctccaaactttcattaatatgatttagcgttgtacaccacgtcgacatccagcttgatcaaattttttggatgtactgattaggttacaacatccgttttttttctagtttgagtgacacatcatgccaaatgtgaggatgatgatatactttacttaataaaaaacatggtgcttcgtctgcttgatctttgctgcagtcaattgctgccgacctgatcggtggcggcctcggctctcttgttgctgctgtgacaacagtcagtcgtcagttggaactggatgcaccgactcctccgcgcgggcgcatcacacagcgttgagcgatacagtctgcgggcaagctgaacgatggtaacggaacgtcagtggctctgaaatcttgtagggaaaagaacgtggaagcatgcataccgacttggctgacgtgctgactatatataaaaaaaatcagagttcacccacaccgtacgtagcagagcatcagtttcataaacaagtccatacgtactacttcaccttcaagcagcagcagcagcc

SEQ ID NO: 6389 - DNA, 1281 bp, Zea mays
tggtggccatggggacggtgggacgtctgcttgcgtgcggtggaggcgagtggtgggggtgctctgcttctgcctgtcggataggatgtgggcttcgttacggcccataacaaaggtccatttctgcaggcaaagttgtccggcctggtggccttctaaacccacctgcgaaaacagccttgtgtggcccagtctcaacttttgttatttatttatttatttatttatttatcttccgttctcaatgaacatattgacagcaaggggggttcatgcaaagcgaacatgtttatagaaccatatcgatgagtgtcacgcgtctctttcgtgtctgtcccactaggcaagcagttttgttaaattccttaatgtgtttcatttgtcctgtgtactactcttaaaaaacatacctatataagcatgattgttaaacatcacaatttatgagactttcttcgataaactcatgaagggataagaaactctaggcatgagttaaatttaattgtctctgccgaaatgttggcatataaactggagaaggaaaactttttagttgagcatttgatatctagtaagggttgctacaatgtatttggcatagaccattagactcagttgcaaatattctaatttgggtcattagtctatgttatgtaatagattttagtgtttaagtccacacgtggaagtgaaaggtgaaacatcaattaataccatactgctagttgtgtggaggctagggattctcctcacgatatatgtgcaccaatccctccgagaaaagttgcgccagaaattattatactaggagcccctaggtttgggaatccctatgataataaattggatttattcctcttttatctattgcaccgctagcgtgcaccggtgattgggtgagcaagcctttccaatctctcgctcttgtgaccctacgccaagagtgggtgaataggttttttttggaaagcacatttctattaggccctcaacactgggtccactcaaggtattatattctaaccagttattttttttgtttattctagtactatgttatattttgtgtattgcatgaaaacaaaacaattgacatgtgtcaatgcaaaaaaggcatgtagtatcttctagaaggtcccatcttataaagtatttggctattttttatatatattcccttatatgtttgctcatttatttttttagagtccgcttcccttyattcctggcctcctcagtcatctagtttcaccagtgttttggttggagggaataaag

SEQ ID NO: 6390 - DNA, 1500 bp, Zea mays
gcagcaaagtgtagtgctcccttctttgatacatgtcttccatgtggatgttttttttcatgagcacctttcatccatagtgattcaactggtttagtgtgtagtggttttttgactaacacctctgtcaactttgaacgtttgtgcaaatggtaatgattttagcttatattctaacgccattttaaggttttcttcagcattttagtagccttctttacgtcccagttccttgctatcaggtaccttgcaattgaagcatctaagcaatatagagytgattttccagatagttatggtggatgacacaaaggatgggctcctcaggccatgacatcccctcagagacgcaatacctcgtcgtcaaagggtcgcggctcaccggcgagcagcccttcgtgtacaccgtcttcctccccatactggagggatcattctgtgacattcttcagtgaaacatcgacgatgagctggagatctacttggagggtggtaagtagcaggaaacaacagatagacatacaccactgcacaatcatctattctatgtcctagaacagttctgaaaatgtgtattataacagttcgtggttatgttgaggttgttttgaatagtctggcagcaaatgttccaaaggttcatattgttctgtgaattagtttaaatggccttttatttgtgtcaatttatcaccattcatctgtacttgttaggctactatgctttgccaagtggagaaagcaaatgaagacatgcttaaccagctatacagctcgataaaattgatgttttgtacattaatagtccctgtgttctcaaacactagacattctgaacaagatgcagttgaacttttgaaactccacccatcagtttataagatattgtttagtttgcaaatagaagagccatgtggggttgaaaagtaagttcataatcccataaatattatctttataattaaatatgacatgaaagtggtcaaagttgtatctctaatacctaatgagaatataatggatggagtatgtgttttctctaattacaagtgtgattttcttgatttctgttgttcacctgttcgtgtttgatgtcaatgtttttttgctgttttgcagatctgagattgagcaaagctaagcttttcatcgagattgcgcttgtaagtgtttgttcaattagtggttgtttaagtagcctctggcttttacattttatcctagaggcatgtttaagttggtactgcatctagctgttctccttcccgaattaagagtcttcagcactagattggattacgatgcgcggttgcaagctttgccctyaacaatcaccctagatgccatggtagtgggctgctttactaggttcatcgttcatgcttctcagcctttaaactttgaatattaggcgttgaacagccagttccttcaaaccattggagggcgtccaaaggacaccagatgtttcaatgttaacgatgttgttgttatacactg

SEQ ID NO: 6391 - DNA, 1139 bp, Zea mays
ccagtggcctagtcggcgctagggatggcaatgggtacgagtatgggtaaataaccactgataactatccattgaatatgggtatagtggaatttggtatccgcgggtacggttatggatataataaggtatccacggttaattttttcgcgggtacggatatccagtatccatatccgttacccaatggatatctaacatgtgggccatccggatttaatatattatcctaaattctaattttccaatttttatctatgacatgttgattggtgctgaaattatcatttgatgatgatggaatgataattgtttttgaaatgtgataaaattgttgtttgatgttgaatgctaaaattgtagtgggcgggcgggtaacgggtatccaccggatagcggatacccggcgggtacgggtatggatatagatccatacccacgaacgtttacgggtacgagtatgggttgagttttgtctcgcgggtatggattcacgaactatatatccgtgtactacccgcccgattgccatccctaattggagtagagtgaataatgagtgtcccaactagggtcgcatcttctacaaatatttgaactgcaatatgagttcttttggccacctattttatggtttgtagccattttgatgatgattttgtttaagtttttaattaatatagtgtcttaatttcaatgggatggtactagatgtaaatgttggtagtggaagaaagagtatgtaaagaacatgcgaaagtcgattggggcggttgatgagtgtgcacctatgcataaagaggtgaaccaacaaaagaagccaatacwtaaagaattaacaaagaatctatctattttagctagaatttgtcatgaaatctgtattctgttgaagtgcattgtatatttagtttatttagtgctatttgagattatctatattgtatcaaggctttaacaaattaggaccttttaactaactagttatattatgtaatggatatttaggagcttttaactcatgtatgttgcataagggatattttagaccttttaaattctacatatggtgaaatatatggatattgtcatgttcaagttcctgatatactcatataattcaaatgaatcggtaatag

SEQ ID NO: 6392 - DNA, 815 bp, Zea mays
gttttttcttactccagctacttattctaagtctatattatttttacatgcttagttgatacacaggaaagttgtgtgaagaacaaacttaatcgtaaaaatgtacaatatcaacaatgcacatgctctcagtcctacattgcaaaggctattatattggtaagaaaataaccattgtttacttatctacatagttgaatgatacgtgaatgtgtaatattgccaatatagtcagtttaacatctatgttacctcatatagttgcccctggttgttacatttgtgttcacttacatttcttgattatgcaacaacctttattttatgtgcatagttgaataatctatgaatgtgtaatgctgcaaatgaacacccataaccatttaaagaggtggttattacgtgtgcttgcctccattaatcagagaccatgtctcctaaatcatttttattgtagtgttaatagttgactaacagttcatccaccaaactataatgttttaggttgtagctacgttacctacaagtatcctaatcctccttatttgagcattgtgcagctcctcatgctctttctctaaaaagtccatttacatattcatcaagtactgaatagacagaacaataataacagataatgtatagcttgttgtttttctatttatgttttcgactctaacatctctatttatgtaatcgactctaacatctctctagcatttaaatatatgtatagcttgctaaagcatttagatatgcagtaatcgactctaacatctctgtttctgtttctgtataccaaagcacaatttaac

SEQ ID NO: 6393 - DNA, 508 bp, Zea mays
cgtatttccaacaggcccttaacaataaaaaatattgttaagaaaattatatttgcattggtggtgtactggtgtcctataaggtagcaacaggccaacaggtggattaggtcggagtgttgcgtcacttgagcggctgagcagctgagcctgtgcgtgttcctgcgtgtgcaacctgtgcgtgtggccagggatgccgcagcggctgccgcccattctgtcgccctgttcttgcgtgcatctgaattacgcgatagtaattgtactatttgcccgccatggcattctcagccatcaaccattgattaattccgtatcgatttgtccatttgctgcacgcatgactcgacatggaattggatgggtcctactaatgctgtggcgctgcagcctatataagaacactacacacatagctcttgacacgtcgcttcatctagtcccagcactactcactcacttccagtctctagagccatcgagatcgtagctgagcgagttagtattc

SEQ ID NO: 6394 - DNA, 499 bp, Zea mays
gaaaacaagtaaaaaaatcgatccggttttggaaccaatcgatcgggttttggtttctgaaaactaaagttttagggaacccaaaaccgaaccaaaatattgggttaaacaattgcccaattcatcggtttctaacctaagaattttatgaaaactatacgatttttttttaaaaaaatacagaatcgcactaggtgctagtacataaataaagaaaaagaaaatccgaacacacgaaggagcgtgcctggtgctgggaccccagctgtcatccgcctggctagtaaccgtaggcaggcagtagcattaaaatcttccaaaaaatggaacagaaaaagaaaatataaacagcccccctcccgttccacccgcaacacttcgcactcttctccccctcttctcttctcgtagacggcagatctccaggggtgtcgccgtctccggccacggcggccggcgctcggagcatcggtggggttcggtgcggaggtgggcggcc

SEQ ID NO: 6395 - DNA, 1500 bp, Zea mays
agcaaagcaaagcaaagcgagcaccaaacactactgatatttctcttcatataattcctactggaaaacagataaccccctcatccataagtgcgtcgccctcttttcctctctacggctttcttttatcgccacatcgcagcagctagcgtgccctagcgaggccctctagtcacctcacctcactgcaatggtggaagctgcaaaggctgaagcccttgcccccctgctgctcctttgtcctctcgattagcccttgacgcaacaaggttggttggcttttggtctcttggtctctctctctatctccctttctctctcctcctcctccgctgttcagacagggagagcacagagcagcctgctagtggaaaacctcttgtggcttccgagactcacacacaaacaaacaaaaaaacaaacactgcactaggcttaaacacaaaacatctgcagcagcatgagagctcctcctcttcctcctcaatagctttaatttagtccgtgtctcgttcaaggagagggagttaagagtgaagtggtgtgttgtaaagcctaggattagagagagagagagaaggggaggtgtcagaggctcgtccatatagctcatacatatacacatctagtgggggaggaaaacagaagagtataagagtaggtgcagtatatcagtaaccagtaaatacttggacccagcagtaaccaggaccaggagagatcatcaaagtaaccttgctgccttttggtaagaacaacatcctcactgttcatccttcttccttccactatagccgagtagctttctccttccttccgtcctcccttgcttccaacttgtatgtaatgtaatcttgtgcgcattgcattgcattgcatggggaagagcccaagaaagtagcagaagaagaagaaagaagctggcaagatagatatgtagtatagggcatggcagcaagcacagataacaatatgcattattctatggcctcaaaatttagcagcttgcttacaacctccctcctggggtttgcaattgcaactagtatcttgttgataaggtcccaagatcccccaccaagcacctcaccgcaggagcaccctttttgttctctctgatccctcctcctcctcctcctctctctctctctctcacagtctctctctctttccttcagtgccttctgcctgtgttgagagtcccaagaagcactgagaattttgttgcatctacccttgagagtgaggggagctaggagctctctgggcgccattggccttttcttgctcgctctctcatcatggtttccattgtgccgctgcagagaacagaagcgtcagcagcaccagcaagaagcatcttctctctggagcggcgcctccgagaagaggacgacggatcgggaccaggaggcatggatctatctggcacgcagggcgagctcgcgatcccaatgcacgccaacgtcgcgtcgccctacggagccggcgtcggcggcc

SEQ ID NO: 6396 - DNA, 1500 bp, Zea mays
ctgtgtgatgccaatttcttgctccatttatgccagagaagaagcgacggccgaagaagccacaccacgctttcgccctgccctaaaagtcatggctactcggctaggcattccgtcgagcagatgggcagcgccctgtatcaacagaggcgcacgacgcaggggcggcaatttgcatcggcgaggctgcggcggtgcggcctgggaacaaccgaagcgaatggaactgggatcggagtgatggatagcaatatagcatcggtgtagattcctgtggcgaggaatttgcgtgggattttcggaaatgcagaagcctgactggacagggcctgctgcagagcaaacgccttttttgggcggaagaaccgcaccgcagcacaaaaaaaaagccctctgcatccacccgtccacgtgtccgattccgatctgacggacccgatggaagcaccggaactgacggccccgccggtcactgagagtggcaaagtagcaattttttcgacggcgagacgacaccgggaagagagaggagccgcccgccgccgcctcaggctcagtccagacccctcgtctcactcgctccgccgctggcgattggtgaagagagctccgaggtcggctctactcgtcgcggttctcgcgaggtccgccgatccgcgccccgctctggatctctggctgatttgttgttctgcaaggtgtgtaaaagaatggttcggagtagttccgcctcttgtgatctgctgcttctctgtggtagcctactattttgaccctttgcagtacctcggcgatcgggtagtggctagtctattatgtctgggttttgcggctgcagaaatctaggggttttgggtgaattgtaagtagggtaacgcgaaggaaaaccactaaatttacatttattccttctcattacatcacggagtctgcaaattgagatccttcactgacgatccatgttttcctacatgaaaatgtgatgcgttcagttacatggctctgatatttggtattatcgaatagtacttttggattttaatatatatttgtttctctcaaggttctgcaaagagcattggattttagtcgataatttgacattccatttagtagttatttttatattggaaaggtgtgtgtaggatgcagcattgaatgttagtttaatttaattgttataaacattgaacacaaccaggacaacatgaggaaaccagagtactatagtagatggtaatgtttgattaaggttttcaaccagtgatatgatacccaatttctcttggtaatctgtttcgaccatgcaacatatggatggtttttgatgaaatctggatctcttttttttttgaaagggaaatctagatctaggactccattgatttacttcctagttcctgccttttcctattgttgaggaactttgatattgttttacctaggtatcaactagactggcttactgaatcttaatgtcaaattctgttagggtgtggt

SEQ ID NO: 6397 - DNA, 510 bp, Zea mays
ggtaactgtaaattatccaaacccgaatccattttttacccgaattttcgggtacccgaaaaaaatcagatcaattttggggttacctattgaatatccgaattatttaaaacccgaacaactcgatccgaaatttcggatacaccccaatgcccagtcgtatatatcacacctcgtgtgcagctgtgcttggccagttggccacatgccttgccttgcctttgcctacctgttgatcgagccgagcgagcagggagagacacggcaccgagtgaggccgccgcatcctcctcctctccgatccgtacgtttcctcctccctagcaatcgcaacccgttcagccaatcattgccgtctccaccaactccgttcccctattacctagttagtccagtccgcctgctgcctgcctcaacggatcgacgcgacaggagggagggaggaaggagacggtcgatcagagtctgagacggaggccgatccaccaccgcagcgacgagcgggaggag

SEQ ID NO: 6398 - DNA, 308 bp, Zea mays
cgccacacacacacgcctgctgttcccgtgcacgcatgcaggtgtcaggtgatgtgccgcggctaccgcaggagttaaaacccgagcacatgctatggttaacgagcaaacgccgcagcggcactgcggtagcagcatcgcgcggcaagctcacctcatccctctttcaccccacctctgcaattgcaagcaaagctccggcctccggatcaggatcacactgaccaccgcgagcgcgtgccggcgtccagtggttacgtcgagggagcctaggctagcgaggaacaagcagccaccagcccgccacg

SEQ ID NO: 6399 - DNA, 337 bp, Zea mays
agtctattcaatgtcgttgaggcaacagttacaagatcctggaagaaaacccgtggcaactctacactacaataagggtgataaagatgtctcacccaatggaaggtatgcttgaaagttccattatattaatttgaatgatacatctgatacatattttcatttctgttgtgggctggcctcagtttatccctgggactttggcactgtttctttaacggactggcgcaagtatagtatcagattttaatgcgaacgacgaggacagcaaacttatataatgtgttgctgatatatgatggcagggacggttaattaagcattccaatcctcagcc

SEQ ID NO: 6400 - DNA, 278 bp, Zea mays
cgggaccttaatgaataacttgctagctccgatccattacgtgcatcgtatatacccaggaccacgaaccacatatacccaggaccacgaaccacagttgcagtctctctactagcaacaagtgactcaaagcagagatagtacacccagcacatatatacacgctgcaacacatcgcaaagttgctaaagccactcgctgactcatctccatccacaacatcacatactcgctccaacagtcccacccacgctacctagacagtagacacgtgtacc

SEQ ID NO: 6401 - DNA, 482 bp, Zea mays
aattggaccataattgaaaattttaaaaggcaagataattttttttagaaacaggcctgcacctgagccggcccactgcccaggctaaagcttggttcgcgcggcctggcaccaacagtccaaaacagcccgcgccagggaccaaagcaaacagctcgcgcccgcctccttccccggcgccaaaacttctaaaatatttcccgcgcgagcgccagaccggagccaaaacgaaactacattagcagcgaaccccgcggcggcaaggctaaaaaacgcgcaaaacctcgagcgccgctcgcctcccgccatttccttcccaaatctaccttatcatattataagcgcgcgtagccttggcagctcgacgcatcttcgcctccgctcaacgctcgcccacgcccccagcccccaaccgatccaagagaaaccttctcgcctccgcgggacgattcgccagggagagcaaaggtagcagaggcgcc

SEQ ID NO: 6402 - DNA, 1050 bp, Zea mays
tcgctcccgcttctggcctgcattctcgtgttgtactcgtgatgaggatccagtgtaggctctgaataccaaatgttaggcgcatacagatgacagaggcagactctcggataacagagtagttcgattattctttcttgctttccaagttcagttgtgtctaatgccaaaagccactttacaatattgcagatgctttccttttatacttgagaacaaaaagcaaaaccacagtctaacaaccctgtaattctattacatccagttggcaccaatgtattttggattcagcttccttgctcgcgtacctcttcttaatttctggacagcttcaacttccagcttcccttcatctccaacagcttcatttcctgtcccttcctggtccggtccaccattagagttgttaacagagctgcaaccaaggactacgctacggtccccggaaactctctggtcagccccccacttgcctctgccattaccctcttcactctgttcccctcttctgttttgagggtccctatttttatccatggcaagcgaccaagcgtgtgcatcatcttgtacgctcgagcggatccgttgtgacctctagttgcgacatgacagcgccataacaatgcagaacccaccggactggattgcttgggagcctcgaggctggaggcgaaccaagtcaactagtgttcgtccctccgccggcaaggtggcaactataacagactaattaatcaatctcacgatctggatcagatgctaacctcgacgccctttcgcccgtgcaggcgagcttgctagccataattcagacacgacagcctcgtgatcaagctcaatgagcgatgagattcttggcttcgcttgcagtgcaaggggacgcagttggtcacacatgagaatgattctttctgtctgatggtcagctgcagttgcttcaacctctctggctatataaaacaaggcaaagcttagaagggagaacaccattacaacagcttgcatttgctctttccttctcttccacctccagtagcttcattccaaagg

SEQ ID NO: 6403 - DNA, 1410 bp, Zea mays
ggtttcatgaatatacgagcattttcatgcctatatatgagtcgtttcgtgcctaccttaaacgagtcgtaatcgtgttcgtccatgaacccccaatctcgatcctaatccgacccgatgcatcatgccgaatcccctatactaaaatatattggattgtgccacgtttggaccgtgcctttttcgtgcttaggatcggtccattagatccgaccgaaatatacaactatagacaggaggagttgcgtgtgaggaatcaggaacaaggggtggacggtggaggcttccatggagttagattgctaaaaaagagttagaaagtgtttggaagcaaagtatttatgaatttttgaggtaaaaccatggtatcaaatagtaccatagtgttttttttgctaagaggtgttgtaaaaaatactacagttatatcatgacatcttaaaaccgtagtatttcaaaatcacggtttttggaatattttgcttctaaacacgtccttaaagtatttacatggcttcatctcactttaatctagagtttaaagttggagtcatacgagacacattttagcacttctctttttttagttttatcgcctcatgatgattttatttgctctctcagtcctgaataaaacttttttgattatttaaagtcaatttgtttctagtttaatcaactttatttaaaatattaaaatttgtgtcatcaaattagtatcgttcgacttattacaggttatattttttgtattatacctattcgatattataaatattcatattttttataattctagtctaatttaagatgagtttttagtctggatagttaatagcttaatagtttaattagttaacatagaaaccatctcgtatcttgtttctttgtcacagactcgcaatattcaggggtattttgaatatactaaaactaatagttatttagctaaaaaattactagtgaattagctagctaataaatatctacctagctattatctaatttgttaaaaatatttaatagttaaactattagttagtctgtttagatatgtacaactaattttagtaactaattattagttataatgcaacccttatgtacaaagtttgcagttaatttccggtcggaccgggctgtggaatactcacgtaccggggtcagtcagtccaagaccgtagctatcagcccatgaccagcccagccccagaccagagcaaaatcgaaccagtgcttttacgattcgtgcgtgaccatccggcggccctgatcgccctaccggctcgtctccttccctgtgaccctgtcccataaattcgacgcgccgacgcgtcgattcatcgcctcccccaagccgagccccccacacctgacagaaaagcgccactaaaaccctagccatccgcc

SEQ ID NO: 6404 - DNA, 791 bp, Zea mays
cccgctggctggctttgcctctcctccggtcccgcacgcccccggcccccatatgtccgccaagtgttcgaccgccgtccccgctgtcaaggccgtgttacgatcaccgtgccacgcgtgagctatcgcggttcgtttcctttcggccaaagcgcgcgcggccggttctatgggcccgatttgctcgttatatttttgctcgtcagaaccgagcgaacacttgtactagttaccgatacaaaccgaaatattcgggtacgagttcttaaaaaaaaaggtggtcacacgactacgagtcgaagacctacctacccacgacgaggccacgaccagaccacgagtccaaccagaaaggaaaatcaggaacctgttccgccgttccggttcacacgcactctgccgggtgtccgggacatgagagccaatccgaggcttgcacccacaccgaagcttctgcgcgtacgtggcgcggcgttttaaggcagggccggcgagcagttgctgcctggatgcctgctactatactaccgcgcgcgcgcaggacaggtcaaaccaaacccgcgagtcgcgacgccgcaccccccgccccacgtccccctcaaccgtccgacggcttcaacgcggcgaagcaaccacagacgagctgctagctgcctggccgcgtgtccgcacccgcacccgcatccgcttcccttcccataaaaaagactccggcgcgcagccccaccgcctgatcaccggggtcgcccgttcgtcttgtctagcgaccagcgcgcccaggccgcccggcc

SEQ ID NO: 6405 - DNA, 808 bp, Zea mays
aactcctgtggttcgcctgggacggagttgctgaagtgaaatggttcccttctctgaatgctgaaaaaaagaaaaaaaaaactatgtgaaaatgatggtagacgtgtctgggtcagtaataagagtttctaaaatctgaatgagatttgaatcgctccccgttgatgaatttctcatggtctgtgtattccaccatgattcataaggtcattctcagtgatgagttttaatacactgtttctaatgctgccacatcaaatttaaactaaccagggaactgtatagacagagtttcatccctataaagtctatcattttctatgaaattctctctatatctctcttattaattacattgctgtgtcaccaagtggaatgatgtatcactgtttaatgagtatgaaatgaaacttctgttgaaaatgacctaataattcttctatcaataaagcgtgactttcgaactgtttcacgccaattttgacttctatttctcccgcagcgagcttcgtcccaccttcttattacagtatcacagacaggtggtcccattgtctttccaccccaccctcgtgttacttttcagaaaagggccccactcccagcggatagtcgagtcccctgtcccctccgaactccgatggcgcgaggtcgcgaacaggaacagcctcgttctgtccaagtccaactccaacgaggcaacgactcgtcagtggtcagtacactacaccgtaaccgtcgccggaatcgatcgacccaaagctccctttagagcccgagctctatccaacccacgaacgggatcccg

SEQ ID NO: 6406 - DNA, 999 bp, Zea mays
tgttgatgtaatgaaaatcctttgatgatatagatgtgtattatcttttggagctgtactaaagtctatcggactacgttgttttattaaaactaaatctggacatagccatatgagctgctgccctgtttggtgttaccaacactacatgtcgtgttgaatttgtttagtactcgagacaagtctatcgtttttatttgttaaagcctattggtatataatcattgtgactttatttgtctaattttggtgccacattaaactatttatcctatatggtgtaacatatggtttaatttattcctctgcgtgcatgaggtgtccagcgcccgatagggcgcttccttttctagttcagataaaaacgggatgtgtaaccctggtcctgaagtcagtcaatgcacagaagcatagggtcgttaccggtagggatgaaaatggtcgaaagtgtttttgatcgtttttattacgaataaataggatatagaatatactgtacacatttgtattttttttcttttaacactgagcttgtaaagatttataaaagataaatctcaaatttattctatattttctcgaatgatatatatacaaattcgctattgattccgaaacaaatgcggtattttttttcattttttgttattgtagagaataaataatgtataaaacaatttatgcaatattttatttttatttgtaacgtaaaaaatcaacatcaaattatctatttaaaaatattaaatttatttttatagttcagattaccattttttatccctagctgccggaaggatactctcgaggaaattggacggaaacttccccgtcatagctcggagaaccactcgagrcctcgtccggttggtgagcgcggcaccccgctcccacaaggcccgtcgcagccgctgactccatcggtcctcactgtcctgtagtctccttggtcacccaacatccgcgcgctgtgcgcagcctcgatctccgatcggcgag

SEQ ID NO: 6407 - DNA, 1500 bp, Zea mays
ttaaccaaagacggagaatgtagcacctactttaggtgccacgttgacaagatcacaattactagagatgttaaccaaagacggagaatgtagcacctactttaggttttcgtatctactatatattatatacttgtagacttttagattatgcctaaaaaggatatgttgtatccgagagatatatattaggataggatacaaaatgattctatatccgcctatatccatcctattttcacccctaatccctccatgaaccattccataaggaaggtagacatgagtaccacgaagggaagagcccaagtgctcacctccattaacataatccatgttgctaaaggccaacattttaattgcaagtggacaagccattagtcaacattaaaggtcatgaatcatgtatggtttgcgggttaaagaagctaagcaaactacaactatccatatgaaaccaaggtacaaggaatgataaacaagtctagctaggtatattttatggtttgcaaaattagacatatgcatataaagtaaatttcatttgattaggtaaagaacatggttaaatggcacttgccacaaaactcttgttgctcaacctcctcgaacacatactccatcgttgtatatagagatggcaatgggtaaatacccaccgggtattactactccatacccatacccacgacaaaaaaataaccccaccgggtcacccatatacactggtgggtatggatttacacccatacccacgtgggtatggtcacccatcgggtcacccatacccacaaaaattaaacatctatcaaaatattatattatacaaatatcaagtatatccatctaaataccattacaaaattttctagcatcatttaaccgtccattcaacacacattgggtgaattacatgttccattacatggtcattaaattgtcgttaagccttctatgacataatggcctaaaaggttattaaatagtaaaaaagatggatgactaaagtctaagttcatgcttgggataagtttatattgggtattttatacccacgggttaacgggtatgggtgaaggtggaacgttctaatacccgtttacccattgggtgaagatttttgtctaataacagacccacgggtagaatatttagcccacatacatatcctaatagaataaatacgcatcggatatcgggtcgcgtgtacccattgccatctctagccgtcgcctattgctggatatccactgcccagtgatgcgggtggccgctcccctcgcgcagccgcacaccgcccggagaaaaggttccaccgtctctaccttgccccgaccggaactggaacccctaaaaatttccctttcgtacctttccccttcctcctcccgtccaccacaccccggctccaccccgtgcaaatccgctggccgcagcaagagaggtcgaggagggaaacagatcggctggcggcaatcggtagccggcttggctggcacg

SEQ ID NO: 6408 - DNA, 123 bp, Zea mays
ggtagtaacattcgtactgccaagttccactgccacaatgctaagttatagtatatgctaattggttcctgacagacccaggtcacaccgattgttgaaggatatggcggttgggcacttcgt

SEQ ID NO: 6409 - DNA, 654 bp, Zea mays
ggtatcttcggatttgaattagtaccacagtggaagaagcacaaagaatacaaaggttgatgcagcgccgaagctgtgagcaggagagcttcggcatgatagcagaaaaggaaaccgacttaaagatgaaaaggctatttagacctcgatggattactatagagttatttgcggatgtaaagggcatgggtgtaattttacatgggctacgtcacgtgcctataaatagatgaacagtgctcccgtactgttcacgctgacttggcatttgtctttacgtcacgcttgtacctttaccttctttcaagccgaaggtacacttgtaatttgatatcatttctgtttttccttaataataaaatagaaatgaaataatggtaacacatgactgtttatattatcttttattttctacatgattctttctccattattatatgtcgtgacttacgaaggtatgaccttcataaccttcgtccgaaaatcattatatcctaagggaaataatgcttcgaaggacgaaggactttaacgtctaacattctctgtgttgccttgttcttgactcatagcgtttgagaacaagtccccaacattggcgcccacctccggtgaacccttttcgaccaccttcggcaagcatcgaccttcgtc

SEQ ID NO: 6410 - DNA, 382 bp, Zea mays
ggtgtgcccccggtggttctctcgtcggtcgcggtcgcggcaatgcatgccgcctagctcgttggcagcagcgccgggcggccccccgggcctggtccggggtacaggggcagtaagaaacttttgcagaagaagagagagaccctgatagtttttgctctcgttcagtcgttctctcctcttctctctctcacacacacaaacacacgcagaatggcaggagagagagagatagacagagagaaagggatgtatgaaagatctagcaagcagtattcttcgttacatgtatacaagacatggcaaatgatgcatcggtgatggcaaatcatgccagtgtcgtgtcgtcgctgagctagctagctagctgcgtgctgatcat

SEQ ID NO: 6411 - DNA, 1500 bp, Zea mays
tgatgttgtgtttaatcacgcgtccgtctcattttggttttcaattcgcgtttttctttcgattagtggtctgtgtgcagtgggttttcggccggtctgggttgacaactaaagcttccttgtgcacttgtttatgtcaaaaaaagttttttgtcagttcacgcaaaccatgtgtagcctcacattcttttttggaaaccttgtccaaattcctcattaaattctcctctactcaacctagaagccatctggattgatgacatctcttttcacctagatctagtaaacctttacctttgtgaaagggaaatgtgcccttgggccatttctaagtattttggtgatttagtgtccaacacaagtgactaagtgttaaatggtggacaaagtacaaatcaagtataaaggtatgtttctaagacttagtatattgttttggagactaatgtattatgtctaagtgctggaaacaggaaaaatcaagttggaattaaagatggctttgttcagccgaagtcagctcagtctgggtgcaccggacactgtccggtgcgccaggctgactcaggcgaacttgctgctctcgggaaatcgtcggtgagccaacggtcggccgggccaacggtcggccgcgtaatccgcgcgcgacgcgtggccgagccaacggtcagaagggggcaccggacagtgtccggtgcgccaacggctccaaagcgccaacggtcggcttcgccaaagaaggaaagaaatccgcaccggacagtgtccggtggtgcaccgaactgtccggtgcgccaggcgacagaaggcaagaattgccttcctggaatgctctcaacagctcctagctgccttggggctataaaagggacccctaggcgcatggaggacaacaccaagcattcctaagcatcaagactctaattccgcgcatttgattctttgtgatagcaactagagctccatttgagtagagaactctctgggttgtgttgtgagctcgagttgtgacttgtgtgcgtggttgtgctctgattttgtgtcttgtgtgcgttgctcatcccagccttacttccgtgcttcttggtgaacatcaaattgtaagggcgagaggctccaagttgtggagattcctcgcaagcgggatatagtaaaacaaagcaaaacatcgtggtattcaagtgggtctttggaccgcttgagaggggttgattgcaaccctcgtccgttgggacgccacaacgtggagtaggcaagtgttggacttggccgaaccacgggataaaccactgtgcctatctgtgttgatcctcttgtggttatcgtgtcttgcaagaactcctctctagccacttggctttattgtgctaactcctaatcaagttttgtggcattaagtttcaagtttttacaggatcacctattcaccccccctctaggtgctctcaattggtatcagagccaggttctcttcaagaaagggactaatcgtccgaagag

SEQ ID NO: 6412 - DNA, 1500 bp, Zea mays
ggcaaaaacacgcgcgcccgcgcccgcggtgccgattttgcacagaagaccctagctttttaaacaacccgaaagagtccgcgacactattgttttgtctcactgacattttcattagggtcccttcctttctaactgaaagggaattaggcttacacctagtccctaattaattttgatggttgaattgcccaacacaaataattggactaactagtttgcccaagtgtagagattatacaggtgttaaaggttcacactcaaccaataaaaagatcaagttttggattcaacaaaggagcaaagggccaaccgaaggcacctctggtctggcgcaccggactgtccggtgtgccaccggacagtgtccggtgcaccaccggacatgtccggtgcaccagaggactccaactcaaactcgccaccttcgggaatttccagaggcactcgcgctataattcaccggactgtccggtgtacaccggacagtgtccggtgcgccaaggaggagcggcctcaggaactcggctgcctcgggaattcagaacggctgctccgctataattcaccggacatgtccggtgtacaccggactgtccggtgcgactgcggagcaacggctacttcgcgccaacggtcacctgcaggcgcattcaatgcgcgccagaagcgcgcagaagtcaggcacgcccatactggcgcaccggacattgaacagtatatgtccggtgtgcaccggacatccaggcgggcccagaagtcagaactccaacggtcaaattccaacggctttggtgacgtggctggtgcaccggactgtccggtgcaccatacgacagacaacctccaccaaacgactagtttggtggttggggctataaataccctaaccacccccacattcaatccatccaagttttccagcttccaactactatacaagagctagcattcattgcaaagcacaccaaaagagatcaaatcctctcccaactccacacaaagccttagtgactagagagagagagtgatttgtagtgtttatttgagctcttgcgcttggatcgcttcttttctttcgcattctttcttgtgatcaaacactcacttgtatttgaggcaagagacaccaattgtgtggtggtccttgcgggaagtttgattcccaaagtgatttgagaagagaagctcactcggtccgagggaccgtttgagagagggaagggttgaaagagacccgacctttgtggcctcctcaacggggagtaggtttgcgagaaccgaacctcggtaaaacaaatccgcgtgtcacactcttcatttgcttgcgatttgttttgcaccctctctcgcggactcatttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 6413 - DNA, 1500 bp, Zea mays
accaactttgaccaccccatgctacgttttgcctttttcctaaatgcattgtttttattacatatttaagtatagtacatacctagatatatagcaaaatctatataaaatatctcttagtctgaaataaaaaaaggcgtaatcacgtattccaaggtagtatactaatatataacactagtggtacatgtttagcaaaaaccatatgatatataaaattattagagcatatataaaccttcttagaaaaaaaatacgtgaaaaatgcaaccttaaaaggtttgacgtcgactagatgaaaacagtcagaaaaaataaaatcattttgtttttagtataaaaaatagttttgtcttgaaaaaaagttccaaaatagcagcttctatactttatataccttacattgtactactcgtacttgttcttcactaaggtaaggggagtaatatgtacatttctttttgcaatttcaaatctgtaatggaagatatttttcttgttctgctgagaatatttgcttcacatatccagcattaattgctagagctctatggctgacttggctctttataagtgcttctggagtactttatgtgccagccaattttgttaaccgtttcagatgtaagcaaattcagcaccatatcacatcggattttttttattattatctctcagcaagtgattgatgtagcacattattttctgcatcacagtagaaaaatactgtacaaaatacaatgtcacagttcagttcctggttttgggattaccggcaaaattaacacacgatttttttttaccgtgctctattagaatctaaaaacatccgtatcatgagaagtccaaagcgacgaaagtaaaagtgaaaaaggggaaagaaaagaagctctcgaggtctatccgaggaccatgggtgacaaggttttaaacaaaccggctgtcgctgggccccacactgacagccagccatccctgctgctacggccacagttatcagtcatcacagaggagaccagactctggcaacggaggttcacgtgagcgcccaaaaggccagagcgaagcagccacggtccgggccacgccaaaccaaaccaaacaaaccatcctctccctccctctctccccgctcgcttcttgcaactctcccgtaaatctgcacaggcgcagcgcggcatttaatgctctccaacctttggtctctgcctgcccccaaacgctcccccattccgtccactcccctctctccccaccaagcaccagcccacggatgcggtcgcgaccaccgcggcaaggtcgaatccatggctagagctagcagaagcagaagcagaagccgcgggctcggcgcttgagccctcgatcctcgggggtcccggttccttctccctgcattgatcgcgtcactcgacgcgagaaggcgagcaaagaggggaaaaaaaggaggatcctttcccgtgtttcttctgtcgattctgcggttctttgcaagtggca

SEQ ID NO: 6414 - DNA, 1190 bp, Zea mays
actctgtggccgtttttgagagggaaatggttgatagagacccggtctttgtgaccacctcaacggggagtaggtttgcaagaaccaaacctcggtaaaacaaatcatcgtgtcatccgctcttatttgcttgtgatttgtttttcaccctctctttcggactcgaatttaattctaacgctaaccccggcttgtagtgtgcttaaactttataaattttagattccgcctattcaccccccctctaggcgactttcaatgggacagactaaaacaagattcgatttgatattataaatcggcgatttgatttagtcaagcctagaaaaaatttcgccgctatccgaacattcgactacaacacaactcaactaataagtttatgccttgtatttcttggataatagcgttgtcgaattttaaaaaaatgaaatcttttcaaaaacacattcacgcactcaaccaatctgaacaacaccggactcgacattacggaagattattaaagtctaaacttcgtgaaatatttttgacggtccaaatagacggagacagatgcgatatcaaaatcgccacaacaaagatggttagaatttgttgtccattttattttcaccgatattccgtgcttaagtccataagcacagtttaacagaaggtaaacaccaacggcttgttcgctgcggcttgctgcggctgcaatccggctgcggctgcggcttctacagtatttttctctctatggattgcagctgcagcagtccaaacagctgcaacagtgtcggcttgcagccaaccgaacacgccctcagtctcgtctcgccttcaatttcccatccatttctcccttcccttccttcccgacccgaaccaccgcgcattaaaatctgccccctcctgccactgccagcgaccaatccaatccctacctgctcgggaaccacccgtcgggctcctcccgcccccctcgccgcatctgcatgcggcggggatctccgggctcgctccgtcaccggagccccaatcaccgccacctcatccaagcccccgaatcccccgggcgcgcagcacaaccttgccgcgatcgcgcgcgggaaccgccgctgattgggtcgtgaaagctcgattttgggcgattttgattcggagaacccgccgtcattcgattttggcgcgcgttgcgagccggg

SEQ ID NO: 6415 - DNA, 544 bp, Zea mays
atttaccggatagtcatcgctctatatctgacccgaatctaaagctgcagtatcgaggtattaccgatatccgttctgaatataaaaataaccaaatctatatgaaaaaacggatgtttgcacctttcccgttttcacctacgtgggtctaaggacatactccccagtccccacaggtcggtgatctgacctttcaggcgggccgagtaggtgaacacccacccgttccgtggtgacgtcgtacggcatcctcatcccaggtcgcatagccacgaggaacacacccttatcttactgacgagtggcaccagtagtgctcgggcccaaagtgtcacagactaacacctaaccgagtcagttccgaggccctgcgtcattagtttaaccagagctccggtttaaaccgaaaccacactgctaatcggccatcagtttacacaaaacgcaagatcgattatccggtcgcctcccgggccgggggcctttaactcgagtcgctaatccgtttccttgtatcgccccgtctccgacctcgctcgccgcc

SEQ ID NO: 6416 - DNA, 392 bp, Zea mays
aaaacttataacatttttttggcttgttttgtctttgagatgcaacttggccataattttgccattaagttatagctacattgtctaataaatatatgtaaatatagaagttcttttcaagacaagtctagcgatgtcatttttgaatctctaaacttgttaaagtttggaaagcttgacacgagattttagtcaagagagtgacaaatttgtgacctagagagttaaaaaaatagcttggatacaaaaatgatccacaatagaagagtggatcaaccgagcaagtatatataaatagaggtacactgttcgttctcaatggaacaggaccgatctagctagtttagcatatcttctcgagtgccaaccagagtgcgcacgttcctgtgtca

SEQ ID NO: 6417 - DNA, 1155 bp, Zea mays
ctagatggaaattataagttgtagttagttttgtaaaaaaaatagtttgcataatttatcctgtcttatacgtccaaatgtcataacattaaaataactgcttacaggctgataattgtcaaaatgcacgaatctactaattaaaagtttttttattttcggtggtagtttcatttctaacatgtcagcaatttggatggtgtggcaatcaatcagtgaagaaagagatgaaaccatgtgtacactattacctgggcatattatgtcttgcatgttacctaaaataatgcaccaaatgaaaatctccgctatgagagaatgtttcaaccaagatttcatttcttttaatttgtttggactttgtaacttttgaacattagttttagttttttttttaaawaaaactcctcgattacgttaaaaaaaatcctcgaagccaaaaggtcacttcggagcattagtttttagtttttttagacttagtgtgcttttagaattttgtcttataatagctctttagcttttaaaagatcaaacaaacggcgatagaataggagatcacacaacagcgcatatttagatttttataggataggatacaagaacacaagttacttacataaacaaattggaaaaggaatcttcgacccggttgcattgaacggtaatgcaggtcgtaccatgtgcgcgaagcctgaattattggcttaattttagtccacaacgactcaaagcatcacgccagccgcacctgcggaccgcggcgctgtcctgtgtcttctcctcccagtagcgtcgccatgatttacgcaagcttgcagaacgggaggccatggcagcgcgcacgggtatgatggcccgacgtcccggttcctcacgtgctcattttccacctccatggtctccaggtcgacggagaagagccaggttttctcccccggcgtcagcaccacggaggtattgtctgcagcgacaatactcgccggcagcctaaagaaccagtattcccaaccgggcagattcgcggtcgcgtccctcagactgatgctcctctctatcacccactcgccggaatccggtagctgacagaacacctcgaggtcatcgccgtccaagcgcacgacgcgcaccgtgtctccaccgtccacgccacca

SEQ ID NO: 6418 - DNA, 1500 bp, Zea mays
cagccccgacagctatgcttctatagggctcaagcactcctccgacggccacgacatcgcatgaacagggtgccaaaacctctctggctgccacgatggcatgtacttagggctctagctcctctctgccggacacgttagcatattgctacaccccccattatacacctggaccctctccttacatctataaaagggaggtctagggccctcgtacaggggggtgggtggtcgcgtgggggactctgtctctctctctctccctcgcgaacgcttgtaaccccctactgcaagcgcatccactctggcgcaggacaacacgaagccgcggttttctcccccttgtgttccgtctcgcgccaacccatctgggctggggcacgcagcgacaatttactcgtcggtccagggaccccccggggtcgaaacgctgacagtaactgccattaaaataaaatcccttaatgaactctcctaattaacccttaatatatcaaatcccttgatttatggaggtcacattgacatgggagctgttggttgagagtgaatcaatatcttcgttgttatctaccactatctatgctccaacttgaggatttttattatcagtaatacaaggcatcagagttaccaacacctctcactttgggtcagtttttacgatcataactgagagtttttacactcaaattgaaggttttttcgctcgaacatgtagatgcgttcaccaatgaaccgcatgacagatttttacgtagtgtaccaagttgcataaatacctacatcatatatcataattagtaccactatatatatatcataaactggttataacgagcctagctgtatgactgttgtagcgatcctatatttatagaatcatccaattttagtgcgcatgcagtggaaacgaaaatatattccaaaattttcacacatgcaacgaaaactcatatgatctgctataattatcggatctaccataaaatgcaacgaaaactcacatgatctgctataattatcgaatctaccataaaataggacacacacatgctcctgcacatgtgtacgtggtccagtggctgagcgaggtttcctttgctatctctatgaagtatttacgctattttcgtgaagtatttttgctattacgcaaaaaaaacataaccgtaacttgtggcgtgcacgtgggggttgtgtgttggaccgggagtttgactgacgcgtggggcaagtttgacatgacagtgggtcgcacccgacagcctggcgtagggtgtgagggcacgcgacgcggtccaggtcgagccaggtcacacggtggtcagacagggttcctctaactattggaagccctagactcctaatatatatattgcattattttcttcctacaacggaaaaggtaaaacaacattcgaatccgaataatatccgcatccgaattttaaatcaaatatttaaaatgatatataacatatttgatatttaaatttt

SEQ ID NO: 6419 - DNA, 492 bp, Zea mays
ttagcttaacaaaacagctcaaagtcggtcgagccagcctaaccgtgtattggtgtgggcaacttttttttcccaaccgggcacacttccgtttacatctatcccctcagccagcggccagcgcacagcgcaaccgcctcaaaacacccgcgtgtgcgtgacagtgcagctagatccacccacaacctcgccaccactctccacgccttccgatccaatcacccgcccctttcactgacgccaggatcaatcaggcacggtcccacgggacagcgagaatatctaggtcgaccctgagagccagccgccaggcgctgatttctcttttgtagcctccggattttttttcgcctataattactcttccccgtgcgccctcgcgaggtcgaacccccaaggcgaggcgacgaaaccctcgccagtccccaactcgaacctcagtcaggcagcgtgaggagggagagttcaaggaccgaggcggcgtcgggcgag

SEQ ID NO: 6420 - DNA, 244 bp, Zea mays
cgttatcgacattattcatgtccgactagtttcgtattcgacccacgactatccgtatttgcatccgagaacatccatattcgtattcgcattcaaaactatccgtattcgaatccgaatgaaaataaataagaaaaacaaatataattttattgatattgtattcatcctattacaactctagtgcccaccagccacccctaaaccctcgcttcgcccccaacgtttgctcacccagaccaag

SEQ ID NO: 6421 - DNA, 1500 bp, Zea mays
tgaggaggtactgttgggtaataactgggtttattactaaaagttggctctaccaataataataaatactttactaacttaaaagcaactgcttaacctcaactctatatacagctagtccactttagccaaacgggacatttgctgagtacgttgatgtgtactcacccttgctttacaaaccaccccaccctaggttgtcccctctgttctcagtgcttaggaggtgatgctggcaacatggatgatttcgaggagttccaggaatatgacgagttctagttctttcttagtggcaaaccccaagtctctacctgtgtaggcttagcatctacgtttcgtatttccgcactttgataattatgttaaacaatggttatgtaatagactctgtggatgtcttggacatcttgatgtaataaaataactttccgctatttatttcgagcattgtgtgatgatgtccaattatgtaatcactgtgtacgtgagtttctgatcctggcacgtacatggttcgcattcggtttgccttccaaaactgggtctgacataagtggtatcaaagccttactgactgtaggaccactactctagactagaatggtcgtcctaaggactataaacccttactcttaccttgactttagagttctttcaaaagttggtcatcttgaccaactctatgttatttacttatctcaaaaagttttgtctcacttttctttctgttcactttctggtctcatagttctaatcttactcttgtgcttacgatgtcttttgtagatggcccgtatcaggtgcactgcacgtaagtctgtgatcccctttttgccttctcgcctggcggagcgtcccctgcgtcgcacggtgccaggtcagtccagccacctggagagactgcatcgtcgcctgcacgaggagcaggagcgccgacgccaggagcaggagcatatagagctctagtggagttgtgaactcattgagttgtgttgcgagctcttgttgcgacttgtgtgcgtgttgacactctgattcttgtgtcttgtgtgcgttgctaatccctcccttgctccgtgttctttgtgaatttcaagtgtaagggcgagaggctccaagttgtggagattcctcgcaaacgggattgagaaaaagcaagcaaaacaccgtggtattcaagtgggtctttggaccgcttgagaggggttgattgcaaccctcgtccattgggacgccacaacgtggagtaggcaagcgttggtcttggccgaaccacgggataaccaccgtgccatctctgtgattgatccttgttggttattgtgttttgttgaggattcctctttagccacttggcaattattgtgctaacgattaaccaagttttgtggcttaagttttcaagtttcacaggatcacctattcacccccccctctaggtgctctcaattggtatcggagccgttctcttcacaaagggactaaccgcccgaagag

SEQ ID NO: 6422 - DNA, 360 bp, Zea mays
cctcctcgccctcgcttcctttcccaattcccatttcccattcctccgcaataagccaataactccaccccacgcctaactttaatccgccaaacaccgagtgagccacgccaccacacgcagacgcagcgagcggcgaaggcaagcgccagaaaacgccgctacagccaccaccaccaaccccttcctcccttcccttttccctctccgtagcccgcctctcctacaagaaccccgacccgaccgccgatagctacctagctcccaccccgcacccctgactccaccttctccattcttgatcccttcgccgcgcggagatccaagaacaggggcagcctgacaggggaacgggcggct

SEQ ID NO: 6423 - DNA, 85 bp, Zea mays
ataaatgaattttataaccatataaagtattagaaaacattttggtagccggcagtgcctctgtgaagataccatatcactaccc

SEQ ID NO: 6424 - DNA, 723 bp, Zea mays
gctgagaaggcaataaaatcagtctgcaaaccaattttgcccatatcatcctagcatttcagtgcgccaactgcattaccgtctctgaagtatgcatccaagctgatagtaaatgatgtacttagacaatatcctttgctaaccatgtgctctaaaagaagctgtgcctcatcaagttttacttgattgcagagtcccattatcaagtaattaaaagtagacgaggatggtgccagtcctaacttgttcataattctatacagttcagaagcttcttcgtggagtccctccttactataagcagcgatcaatgcattaaatccagtaacacgcaatggaacaccctgctcaatagcaccaagcagaagctcccaggcatcatccaatcgatgatcccaacaaagcctacagaccaacatatccaacccatcagccgacatatgtgaactaaacatgtcatggtcatggactaactgggcagcatacccgaacttgtgagctctagcaacaataatgttgaaggtgcaggagtctggcactaatcccctcgcttgcatctccctataggctgcactggcctgatccatctgtccactctttgcatatccatcaatcaaaacattgaacgtgattgtatttacttggatccccacctgggccatttcatcgaacaacctccttgcttctggcatcctcccctcatggcacagaacatccactagt

SEQ ID NO: 6425 - DNA, 274 bp, Zea mays
tgcctgcagcgcgctgaggcgcttgacggccaccaagacgccgtcctctagcaccgccttgtacgtgctcccggacacgcccttgccaagcacctctgcggatgccttgaggaggctgtccagccgcagctcgtcgccgccctcgaagcagacgagcccgccggtcttgtggcacctgtcttccccctgggctctcttgtcttcctcctcgaagcacagccccgcgtcgggagcatcactcgcggaccggagctttctcctcatgtagacgaac

SEQ ID NO: 6426 - DNA, 1380 bp, Zea mays
aaacatggtagaagggcgtgagagattttctatttgcttaaagcgtttggacatgtgccctggaataaaagaaagtagtatgaagatgagatagggacatctatacacctgcgtggataggagagtccgatcagcacaagctaaaacatacgtgttcttcttttctaaggaaaaagtggataggaacggctggagttaaggagagaggaaaagacgtatagaattttcagtaatccaagaatcctacgtgagatatttccaaggaatcaataattagctccattcttctcttatttgaaaaaacaataccacttatcctaacacatatttgtttgtattgttattatatgtatatatactcttgtctctgattcgaatattttcttttacagcccgtttggttccctagaattggtccaaattgaatccaattctatgtctcggcctgtttggatccccttagaattgaattgaccatttcagtccatttcttattcctggaaatttggcattgactcatttcagaccagcacccatcggaaaacgttagaaagtggctagggttagccgctccctgctcgcggcatcgctctgcatagccgctcacaccgcattgctctggctctgcatcgccgctcacgcaatactaacagctcagtgagatccagagccaaagggcggggcgtctcctaatcccaagtccagccgccgccgtctcttctcgctccaaaagtcgttttccagagatttttttcaacgccagccgttgtctctcgcttgcctgcatttccgatcctgaggcagtcctcatctcattcttatccaaccgggaggttgggaacgagatcacagctacagttacctgtaagttctcttctccttctgctcctttttatttcccgagtccagcgagagacggctttctgactactacacaattgaatatccatttcctttaccgtcgtgtatctgtaccaagaaaagctccgaatttcccaaccaacgtcttgtgcgacccatccatcagctgcacaacactagccttcacgaatattcaacactagcgtagcgtagcaacttcggaggccgcgtgtggccggttgacctgtgctccgtggtgcccctgtccagaatccagatccaaagaatgtttttttttatcattttccttttaaaaatgcacatccctcttcttttgttttagtgaataatactctctgacatgatgtttttccattgcgagatgtggtataacgatctctgtaaaaccattcccgcacgtgacactgaaagcgaaaccacttggctgcgtgtaggagtagtaggatcctcctcagatcggcttcaaaaatcaaagtgggggggacaacaaggcagggg

SEQ ID NO: 6427 - DNA, 243 bp, Zea mays
gcaaagtagcgatcattttaatattagcatttccacatcaagctctctaacccgcccgtctcttaacgaatcattcgcccgcaggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgcc

SEQ ID NO: 6428 - DNA, 286 bp, Zea mays
tatatatatatatattccatttgtacgcacggggacaggcgctacgagacacgaacagcggcagcacggagcagagacgacgagcccgagcccccggccctgccgctgcccatctataaatatcgcgcacccacacctcgctcctgtcacacaagaacacacgcgagctccagatcgcacttgccagccttgagccactaatcacctggcagcactctacacggcgagagggaatcgaggagagcttacgaggtagttagtagctacaagacacagcaccataggc

SEQ ID NO: 6429 - DNA, 242 bp, Zea mays
tttcacgatcgtccgagaagaaggatccagaggagtgagcagccacaggcccacagccgcatacagcagccgagacgtagcaacaggtcgtgacactcgcgcacgtcagcactcagccactcagcacagccactgacccgtcgcctccccggctcgcgaccgcatctctctcgccccttccaagttcctaatcgccaccgctgtccccaaccagcaaaccctagccctcatcgccggcggcc

SEQ ID NO: 6430 - DNA, 1500 bp, Zea mays
tataattaaacaaagtgtatataaaataatatttagtttgtccataatagaaaattcataagagtttaaattaaagccaactcacaacattttttcacagagctgaaccaaacacacccttacctaaagttatgagttttttctcacaagggttcatgcagaattttttaatgatatctctagcaacttactcttcctcatctctcatttcaaacttcactctataaatagtacagtttacagtgcactataaacaatacagtctacagtacaaaacagtgttttacacgaccaaatgcacgatctgctgaccatacctactgagatggtatgaacataagcatgtgtcatattactctttttaccatatgttttttaaagacatatattgccttctgaaatataaatgagttttcttcgaaaaaggtttttctataagtttacaattaggaaaaaatcattatatgttatatctttcttcttatttttcgactggatataaaaggagttttaatgatatatcaatcagtattcttttttgtcctattggctttttttaggaatggtgctatttattgatctcaaaggcagattcaataaacagggtcttacaaatattctatacggtatgatctgagccttctatccaaatcagatggaagaggataatatctcgttagtcctcgtatagtcgtatgattctcgtatatgacctcgtgacgagtcatgacaagtcataagatatgatagataaatttcttctcggattttcgcttcgacccgctctttatgtaagctcctctactgctcccatattttaatttcctcctgatactcggcaacaataaacaaaaaagtattctgtaaatcataatcgtcttgttcgttagcatttccgcgcggtacggtcgagggaggaggcaagtcatgacacgcgacyatgacgtcttttgcgtgcgatgattttgggatccccgcacgcttctgtctttttccaaaaaaaaaaagccacacgagcgcggcacgtcagatccgtgggagtgtgcagttaatctggcaaaccgagcgcacgcgttggacggcacgtcgatgggtattgtcgtattgacgtttggcggatggcggggaggcacagtgctcgactgcagccaccgcccaccactaccaccaccgatcgacacgaaacacccaggccccactccccaggcgcccagcaggtagcagccgcgccgccaaaagcgatcgcgcggcctcctccgtctccgtggctccgtccaaatccgctgggtcaagaggaggacgggtcgcgcggccccctcgccgagacccacgggccgacgcaaacccaggaaagaaacgaagcgagcggcaccaccggcgcgtcctcggctcctcgcgtgcgtgcttaccccggcgaatattcgaccacggaagccgcataacctccgtccatcccatccccgctcgcctctcctctcctcgccccgctctagacgatcg

SEQ ID NO: 6431 - DNA, 1097 bp, Zea mays
ggtaaaagagtgtacatctgacaaaccaccttgrcttatttattgatgtaagtttggttaactgtgcatgcgaatttattttttctacaaaagccatcatgatttttttcctacaaaacccaccatgagcctaaagttcatgagatattttcaatgactacttgatgattcttttcctttcttgttaagggttttattttttatttctgtatatattcagattgcaatataacctctgactcgatgtagagccaccactcaccaccctcgccactgtgaatgtatctgtttaatcatatgttgaaggttgaagactcaattagaatgtttaaaagtataaggatctgaatgaagcttaagtaaaacatgagaccaatagcgacatttattcaattaattttacctgacagcaatatttaggttgtgaccccatacatgcaattcaaggattgtgagtggcaacttgaagagacaaaatttcagtatgtcttggtatttctggagcctgtgcgaaaatactagactctcaatagtgttttttagcattgcaatatcatagcagtggaaaaagagaatgaagatgaccctcgcctgtcgcctcccaggctcccaattcccaccctctaaatctgcccactcccacaactactccccctctgccgctgccggaaattcatgttaactatttttttggtgcrtctacatcagaatctcataaggtcgaattactttgtccaataataacgttttgtatgctcgacatatcttcttggctgtgattcagaratctattttttgtttaatttatctactagggatctgcagctatttttggtaaacattagctcatgtatgttagtatactgtgttcatgtggagaaaagaaatgcaattagtacattccagaaaaatcacatgatttcattttcttacttgcttggataacgcatatcctcctctcccttccattatgatctgtgagtttttctaatagaatagttaccaactcttttcttttgcagcctgcagtcaatttgtcagtttattgagacatccaacttgcatgagttgatcaacaagcccatccctggttcctg

SEQ ID NO: 6432 - DNA, 131 bp, Zea mays
catctaccacgacggtacaaaccttgcaccttcttcgactcttcccgtctgatttgactatctaaaactgttgtttctgattcggtgcgctggcgatctggtcgcccacagggagttcgtgaagaagaact

SEQ ID NO: 6433 - DNA, 459 bp, Zea mays
ggagatattttatttttaacttggttcttgtgatagagttaattaccttgtttcggtgctttcttagtatcctttttatgatatttgagttgtaaataacacttccccaatcgtgttatcattataactcaatgacattattaaaatcatatatataaatcaatatgttactaatggttgcaatgtaatggtgaaataactagattaaaataacaaaatttatatatgagtaagattacaatagatttcgaaatattttctcataacaatataacacacatttgtacataagttatcgtattattatacattcctgttgtaacgcatggacactcatcatctagtaattactttaataacaaataactctcccacaaaacaccacaagtccacaacacctaccattcgcagctgccgccgccagtgccggtgagaagagtagggaggcgcagcgcgggg

SEQ ID NO: 6434 - DNA, 1500 bp, Zea mays
tgcaagctcgagctggctcgtttagctcgcgagccacaacaaaaaatagtatacatgtgtatatacaacaatataatcaattgctagttaatttcatactaaattaacactagaaaagactaacaatactcataattttatacatcacatcatttaaaccttaaattaacatagttcatcacttattaattcatccaatacatatataagctttgttttgcagataaatgctagctcattcgagctaacgagctggctcgagctcgtgtcgagctggctcgttaacgaaccgagctaagatgttagctcagctcgtgacaaaattgaaacgagccgagtcgagccgagccgagctgaccacgagtcgagcgagctcacgagccacaagtattttgtccagccctactcccagccaaggaggcgcgcgactccatggcaactttgcaagcaagcagacaaagtcaacgttgcctcgtggatgcctgtgccctgcccctgccctccacaggaagcaacgaaacatgaggggtttttgtttgatttgattattagccagccaatcattctcaagcaggcggctacacccccacacggttagagaatgtgatgcrggtgacgggtgtacggtagcgcgtagcttctgctatctgttctgtscggcgttatccggattagcgacagtagtcggtaaccagctaggtgtaatagatcataatttaaatatttcttcgtaaaaaattaaaatcattaataaattttagttaaaaataaatagaaatatagctcgatcataattcgatctgatgtttagattttataatatacaatttagagcttattatcactcttaataaataggaaaatctagcatatcaagtttgtttgtaaactatgctgatatatactttttccgttttttttaaaataccccttttttataactttttcccatccacaccgagtacatgagaagaaacaagcgcaaatccctgaagcaaacggcgacgcaagtactcacggccagccgtcaacggataaacccatggaccacccaaaaccgcttgctataaacccaaaccggcaaaacatcacctcatcatcatctgcagtcctcttacctcttactatacaattccttcgtttccaacgacccaacggagcctttctcgctgccactgccacgcgggtcccggacccgcacgtcatccacgcgcgtcgccgactcaggagtcgataacgccctcgctttctctgctttccttcctccggttccattccaagtccacctgcccctcctccctccctatctatcctgtactctctctcagtttctctctccccccgttctccgttccacatcgcgtgcgcattgagacgacgagtttctagagcgccgtaccgcgcacggctcccgagccccaccgcaaagcgccggaatcgtgagcgcgtccggcctcgcctagctgctccgcgccgagaggcggccgaggaggacgggcg

SEQ ID NO: 6435 - DNA, 403 bp, Zea mays
tgtactttaaaatagaaaattttatgccgtctgtctctattaactattaaccgagacgggcgcaaatacggtgatcttgccatcatttaacggagggcggccaatagacccgtccacctccgaacatatcttgccactgttattgtgggaaatcctaaccctagtttagagttgggacttgtattaatcgatcaatagatgtagggcctgaaccattacacaagtatattaaggtaattacaaggggctaacctaaaaccctaaatggggtttgaaacaccccgcagtctcaactctataatgatgttgaaacacccccgcagtctcaaccctaaatgccccttggtgaagatgtcggtgagctgcaacgtggtccgaatgctgagaacccgaacgtcaaccc

SEQ ID NO: 6436 - DNA, 197 bp, Zea mays
attttgattatttgagaaacgatatgtatatttattttagcatggagtgaatattccactcccactgagcaactcaaaaaggccaaaacccttccccaggggccgtctcgctagtcgctactcactgtaccgcaccgccgccgccgtctcgcacacggggcacaggacgcgcgcgatcccctcgagtccggattgcc

SEQ ID NO: 6437 - DNA, 494 bp, Zea mays
tcacgccaagctactcacctccgctcgacttgcaagcttcggccgcacctcgctccttagccacctcgccggcgcctacctacgtcacagtcccctcttgtggtaggcgtcgcgacgttcctgctccacgccgtggcgtctccccggtgtctccctgccttcaacgggtctcacccggctgcgtcctcggcctggctcgctgtgctcgtccatggccaccggtgttcgccttcttgcgtcgcgcccgacccagccgtgtgctcgcccggccgcgtcctatcgaggttgttcctgcacacgcgcctctggttcctgcttcagctccatcgcgccctcccggttgctcgcgtgctacctactcggtggaatgtgaaaaccggtggacacgatcttgctccgccgttaatttcggttcgcagctcggctgctgtcgtggtgctgctatcccacgacaatcatactggtgcatcgtctgttccttgtgttcgtgctgg

SEQ ID NO: 6438 - DNA, 395 bp, Zea mays
tttgccgagttaaaatagcctttgccgagtgtctagacactcggcagccaaagaacacgatcccggtagtgcgagcaagctcgatatccacttctacccgtgaaacattagtttatccatgctcgtgccgcgagttatataatgtggcatagcaaggcagcaggagatatgtgcgggcacaccggccggcccctgccagtctgccaccgatacttggcaaacgtggccgtttctgctgcctcctcaggtgtataagtagcagaggaacacaatgcaagctaggagcgactgcaaggaactaactggtccgggaggtgcaggcaggagaggcgagctgaccgatcgatcaccaggggataccgtaccgtggcgtggtgggggagagagagagcgag

SEQ ID NO: 6439 - DNA, 905 bp, Zea mays
aaacatagagcttctgcaacttatcagtccagttgcttctcaaaatgaactaaaaacagacgataagcagaatatgcttttcaccagcttttcagataagccgctttctccataagcaacagctgtcccgaacagggctatatgtgcctagatatatgatttgtctaatgtactataaaatctatgaatataaaaaatttaaaaatggcttctgattcagaacgaaagaagtatatacttacgagagtttaaacttaatctcactctgcactgttagtctgttcctctgaaatgatgaccactcacttttctacaaagtagatgggtaattaagccgggcaaatgcagcattgcttagtggtctatagaaaagcactctacccacctaaagacaccaacacctagaccaagcgaagcaagcaaagcagagataaagaaagcaagaaaaaaagatggtcatgctgtgtgtaaagagaaaggatcaaatctcacgcactcgccacttgccagccaccactgagcagtaaaccgagcaaaggggaccgttgccaaccccacccgggaacgttcaaaaagccatcccctcgacccctccacggctaacgccccccacccccgcctttcccgcactcgccttgcttcgcctcctgcgttccccgtcttcctctgctccatccccaccaatccccagcaccccaaacgcaggcgatcgatcgccaaaaggcaaaagccgcccgcctcgatctacgcccgctgcagaaaaaagcggtaaagcttagcggcgaaggcgatccccaaagccaaagcgaggagataaaaaccgagtgatcgcgattcgcgatggcgttgctgaatgctggccctgccgccgcattggcctcctcgtcctcctcctctcccgctcc

SEQ ID NO: 6440 - DNA, 71 bp, Zea mays
ggtcaatttctaagttttgactacatcttttctttttttcatgtcttcacgactactttgtgctgcagact

SEQ ID NO: 6441 - DNA, 1008 bp, Zea mays
tggcggccggtggacagatggatgatgcggccgggtggtgtgatgatygacggactggatggmtatggcgattcgtcgtcrtgcactggaggtctgctgatcggaagcacgtggagtggggctgtggggcgtatgtatgcatggcggtctcgcgacgtggccgtcagaacgtccctgaccggcagccacgtagggatgagggacgtgtcacgctgtgtcgtcaccttccagaggaaaggatcgcctgcccagtgcccagtgcccaggaggtaggtcgtaggtgtccccggggtgctttcttttttctgcccgtccgccgccatggctccaagctccatcatccagatggcgaagaagaaacacgtggcaccccaaggacgacgaagaagaaacacgtggcacggagctgttgagatgacctcgccgaagccgccggcgagcaggccgccgacgggatgcacctgcagaagcgaagccgaccacgaccgcatggagccgggatggacatactgcgctaggcgacttttgagaagtgttgacgaagccagcgttgatgaacttatcctgcgaaccgaggatggagaaatccaagatgcatcactagcacgggtcctgattgtattgcctacggattcaatgttaaaacagatgagtctcttccgatcacgacatgaacgacttcgagctagcttgccttagtttacaaacaaaagacagtcccgctaagcattgtcgaatcgaagccacgagcacaaaatatacacgcatcatctgatcatctccctcagaaatcagagccgattcgtcagcacgaggttcatcagcggaaaaaaaatcatcatctccgcaattctgcttaaagtcgactgactgaagattgcagaggatgcaagtagagtagtgcaccattttttttttggtcatcttcagtaacataacagaagcgtcagaggactgaggtctgagcctctgaggagggagagggacacaggcacagagctacagagg

SEQ ID NO: 6442 - DNA, 989 bp, Zea mays
gaatagatatgttctataagattgctacgttatattttgccactactacagtgatacttttgtttatactaatttttactttttgttagtcgtatccatgtttatactaatttttaacttctatgacaacacatgagcacatacctaatattaatataaacattaatatttggcggctagcccatatatcaaaaccaaacataataaataaaacaaaaaaaacctagcatagaagtgggtctatatcaaactaagacaaacaacaccgtacatgaaaataaatgtctacatattaaagtaggctgcaactacaatctatgaagataaaattataraagtattagaagccggtacgaattaaagtcaaacgaacaaactattaattttcacgaaagattattgacgatcgattgaagcatctatgtttcgcatggctgtcctttgtttcagagcgactyaactctgggtggagcagttatactctaaagtttaaattattttctcataacaagtaatagtggcggataaataactctaaactccacgtctgggttgtttttaggagtttttagagtagcgaaagacgtactccaacaaaactgtactgcaattattaaaactccatgaaagtttgaaactctggaattatggtgtttatggtgtttgacatgttcttactggatcctctttaaatttctacactggagtcatacaatgatacaaacacacctttaatatttaaaaagattattttattgaagacgaattagtgagatctgtacccatgcggcacgttacagcctacgtactggactacaggcgtgcagccgcaacaaaccactgaaggagaaaacaacagaccatcaatgatctcgagatccccaaatctctttcttaagtaggtaccgctgcgccgcaaacccaccgcttccaccatcgccacccgtcagtccgtcacccctcgcgcccatagtccccttccccatacc

SEQ ID NO: 6443 - DNA, 1500 bp, Zea mays
ccaagtgcggattagttgactggagagtgactccaacgatccgctattgccgacaccattacaaaaacacttctcgactccacgtcagctagctatttgagaccgtcattacggacgcgcttacaaaaacaccacttctctctagctctctctctcgataactaatcgcgtggaaatcccgaggcggcgcaaaatccacgtgctgcttgtgatcgcagttatttccctgtgaatctcgatgcacggaggccttctggccatgccacggcagacgacggcacgacgcgggcgtcggcgagcgtgaaaactgccacagggatcctaccgcgccgtctgggtgaatcccgagccaccgcaccagcatcaactcgtgactcttcacttgcctcggctgcccccacgccgccgtacaatcgctgaaacctcagaatatttccttgtgcctgccgtcactgcgacgtggggtccaaggaccagccggagatgcgcaaactttattattataacctgttgcccgtcagacgtgagcggcaagccttgctgtctcctgtcctggtcctgctagtacgtgggttacttgaggagtttgctgaaaaatcagtttactagtgcggtagctagcaatagcatggtggattcggaaaccatcatatgattatgaatatgatactggtggtgggtttagttaactcccgccccctcttgattatttgctcagtttttttttaaacacacatacgagtaagctggttggtggattcggtctacactgaccacagatttttcagatgcctttttccctctggattccgattctggcgcgtcttcctgtgtggaccgtttctttctctcgctgacaaggatctgaaaaatagcaatagattgaccattcgaactggtaggcagcatagtagaaaccgtttagtataccgaacgcaactacatggtatagattattgttggcgactctattaattaatttcgacatgacgaccctttctctccgatcatattcctacgtatcattgcgtcctcttttttttttctttttgctaatcagtgaagagagtaagaatggagcagcagcagagagagagagagaaatatgtcagttgcgagtagtaatctagataggcaattacagttacgcagacataacggaaactagcatccactttggcgcaaaaccaggaaaaatcgtcccgtcacggccagccactcgtctcgtcgtctataaaaaacactcgtccctctcgaacccacatccatgccccgcagccgcagccccggcccctaccttctccttctccttccgcttccctcccaccccacaccgcaagcccaaacaaaacgcaacgcgaaccagccacacgaatccaccagcgcacgcgcaccgtcacgcgaggggccctcccttctcgccccgtccggacccccgcccgtcgccgtctctcccgtcgcgcgcgccacgcgaacggcacctaggcgaagcggcgcacg

SEQ ID NO: 6444 - DNA, 290 bp, Zea mays
tgagggagtatataattttgtttgcaacaaaaacaaactagattttcctttttagaaaggaaggtttctcctgcttttgtatttaaaaagcaaatccctagacgacacgcatcaagtggcaccacctctgctataaatagctcaagccatctagcgacgaccagtatcgtttcttcctcagtggcagtggatagtggacacagagcgcgcacacatacccacagagatttgcactcttttcacttcatcgtgaacgggaagcgagcatacaatagactgaaacccaaata

SEQ ID NO: 6445 - DNA, 682 bp, Zea mays
accaagtgactaaagcaatgtaggccccaacatggtgtaatcgggttggttacaaacgtatattacttattcaatattttttataatttgtattcgaattcggatacagatattattaagttgtgtcaaataagatttaaatggatatcacatcttaaatatctagctttgataatatagatataaataaagatagaatacagatcagatacttagtatccaaagataaaattgtaatattacagagaatataaatttaaattgtacgtactagaagagagaagcatgataaaataaaaataaaaagagtattataatcgcattgcatcttcacgaccatcaccggccggccagttacgcgcaccttttcttcctatcctgctgtgcgaaaccgagcagacaaagtcaaagttcgaatcccatctgattcgattcgactactagcgtacatgcggacatatttctgtttcgtgtgtccgcctacaacaactcggcatctgaggcggaattggagcccgccgaggcgccgactcggcgatatatatatatctccaccgatcccatggcgcctcagctgtttggggatttctcgcgggttgttgagatacgactccaagaacttggcaagaagtttttcaaaatgtgagacgaggggggcggcggctgcgtggccgatcgagcg

SEQ ID NO: 6446 - DNA, 1274 bp, Zea mays
atatcatcgccaagaaatatgcttcggttaattatcctccgtcagggatgacgctgtagaggcttcaggaggcggcggcgtgggcttgctcgtctgggagggccctgtttggctatcatatgtagtatttagtttactgtctacttctgttgttgacagtacctgtgaattctgttgttgacagtacatgtgatgttgcttggtcctttgaagcctgtgatttgttgtcctaatattcagcattgaattggtaaggaagtcttgtgatgtcatgagcaaagtgtaggtgttttttttctgcttaagctgagggcttgtctttcttacataaaagcaatgcattttgtatcatgtaatgtttcgttatactttttgatgtgcatatggaagtctaggcgaagcaaatgagaagttcttgattttgtttgggttctagacttcgatcttcctttcccttctccattcatccaatatgttttagatgcaagtcaaccactaccattcagcatttctatatatgcaagacatgcgatgtttttgttgtcacggtataattctttatttgttttataatacagtttatgatgcaattctacatgtagcaactaaatgggaggccttctccttgcagatgtgcctgatataaactttacaatctgtttctccatatatatatatatatacactaatttttaactcatgtggcaacgcacagacacacacctagttattctttaagtcctcaattattgtgcaagttaaatcgaagtcagcttacattacaacgaccgaagctatcgtcctttaattacccccttctttttcaccaaaactgcaaaagctagtggcacaaattaagctcacaagacaattatggagttcgatcgtgttcatatatgagcaccaacaatcagaaacacaaagccgatgggctagctagctagtgcttgatgtagaggttgtactcgacggtggcgtcgccggtgttgaggtcgaaggtgtgcgtgcgggcctgcgcgtacccgcgcgccatcctgaacgcgccggtgccgcccacgacggccatctcgcggacggcgtcgaacacggcgttccggcccatgatggcgacggtgctgccgttgtactcgccggcctggaacacgaagttcatgttcatcatcagggagagctcgtccttgccggcgccgacgtaggtgccctgcgcgcggccgagcggcttggaggacttgaggtcggggccctcggtcagcgggtcgtcgatcaccaccacc

SEQ ID NO: 6447 - DNA, 354 bp, Zea mays
tgacgactcggccgctggcgctgcacggcggctcgggcaccccggcggaggatatacgccgcgtcagcgcctgtggcgatgcttagatcaacgtcggcgctgcggtgttcgacgccggtaagcacgcggtgcagcagtcgctacgccagcacccgcaggctgagctggccgatgtgctggcgctgatggagtccgcctgtcgcgaagtggttattgaatatctgagctggtcagggtcggcaaaccgctactgacgccccgatcgcggcgcaatttccaactgtttctttttatccctcatcgggtcggcgcgtgcgccggctctggtaaaactcacgctaaggaaatataaac

SEQ ID NO: 6448 - DNA, 405 bp, Zea mays
acttttaaagagaattagcatataaagatggcatgtttgagatatttaattatgttttattattacaatggttctttaatcctgctgtaggcctattacacgtgggacgctatatccaagaactcattattagaactacgtcgtggtaaccttatcttctctctctacggaacacacaccgtgtcgttctagcgttctcatcctccatccgcttgctcctgctccctcgagtcaaagcagtggatatggtggcgcgagcagcgagctagggaggctaggtagcagactagtgtcgctattaatcgtaccacgccgccgccgggaaattgcccttctccgccactgccactgaagctatactgtcgcagagagagcgccccaccacccgcggaccagacatctgcg

SEQ ID NO: 6449 - DNA, 390 bp, Zea mays
ttccccatatttttatactcactccattcataaatatatgacactgttgatttttttttaaaatttttttactacttctcttattaaaaaataatgagttatcatttattttttgatttgttttatcacttaagttagtttgtgtttgacttaaaattttacatttttaaataatattttgaataagatgagtggtaaaagtttttgaagaaatcaatgatgtcgtacggagatattatttttttaaaaaatgaacaaaataaaaaaacggctgaaaaaccttttctagtccaggctaggaacagaaagccggccggtttctggtggttttcgaacggtttttgaaacccttgctccagtgcgtcgtcagccgcgtcacccaccgcggca

SEQ ID NO: 6450 - DNA, 1097 bp, Zea mays
ggtaaggccttcaaaattttctgactttatgatagcgtaattatgtttgtgtattgttgccgaacttaatctttttggtgcttcacagattctcatgccttgattaattggtaacaaaatatcatttttcttgtcagacgtttgaaagataaacatctgagacgatgcttgaacgtgtgttggaatttcttggatctctttcaataaaaatgacagaatttgatatttgttatgattattgaattgattcttaatagcaccactaaacaatcccaccattatactcatgttgcccgttgctactgtcctgagctattggaggctcgtcaatttatgttccgtagtattgcacgggcatgtacctatttaagattaaccatcaaaccacatgtatcttagtgtttagaaataaacaataattatatttaataaatatctcgatacatatatgtattatatttgaataaatgtctgaatacctacttatatataataacggtagaaaaacaacttgccagtacagtaataaaaaagaacggtaccagtggcccagcccgcgtgcgctctctycctccgccgctagccgctaggtgccgaggccttcatcggtcttccgctggcgacggttcgcctcgcgcgtgcgacgcctgggtggacaaccgccgcggcggcctcaggtgccgaggcattcgtcggtgtcttagctggcgacgaacaccaccaggtattcccaccccttattttcccttcctgctgtgcgaaaccgaccayccaaacacacaaaccctaacttaaagctatttggctattagatccctactaacttcgaaccttttgcaaaagttatcgagtgtgcatgtgtacatccatgcccctttattggctccgccccaggttatttaagaagctattttttccattgttctctcctttgttattggggattcggtattaatcgtgttcctacaattcctgttcaggtggccgacgaatttgcaacgtctttataagacggctgtaaatctgtgacagttaatattttgcagttgaagctctgtgattttgctgtgggcacattctgtttattgtcttatgat

SEQ ID NO: 6451 - DNA, 1500 bp, Zea mays
aatcagatcgatgagcgctgatagtcgtcgtcgatgacatactatactaacaagaccatatatcgcatgactacgtgcgcggcgcgagatgtagcaatcaagcaggacaagtgtccagccagcacgcgagagcgatcagactaggtatatagattaggcagatgcgtacgtggagagagcgcggcgccggcacacgcgcgctgtcactgccctcgagaataccagatggagtagatcctgccgcggtgcgcgatccctgtcctgaggagctcttcggcaggcaggcaccagctagattaggcagtcaccagcatctttatttgtccaaaaggcaatcaccagctagattaaggcagtcacactggccaggatatgtcacgcatgcataggcgcgcacagtctctcagcacctaaaaaatctcatgaacatgacgtcatggtgactccacagtccacacgcgaggccggacatgaggaaggctcacgagctcgccacttgtcgcccgccggacccggccagggcgccccccgcctatagtatctatcaacacgttccggccggatcggagaggccacagacgacggggctggctcactagctattactccctccgccctaggagtatatgatattatgataagtacgtgccgttcgccttcgggacatactcatattaaatattaaactgtggccatctattatatatccaatatcttattatatgtactatagatattattttagattgatgattataatttaatatatgtactttatgtatgtgtaccaatgttctacgtgcatctgatctgatgtgttctctagactctagtgtttgcttcagtcttggttggatctaggagttaaagtaaaaaaacggactagattttagctatttcttataaactaaaattgattaaaaatatctttttattactttattcacttttatcttcttctgctwggatgtttagcatctaaagcgactaaacttcagtcacttttactttagctcctgtgattcaaacagactcttgattcttgtgcggctagtttattagtcatgccccgctcctgtcacgcatgtagggtgataatgaaatctgtatcagatcatattagaattagactctatttctctttattttaaattaaactaaaattaattaagagttcagaaaaactataatatatagaacatttgaatcgtgattcattatcgccctacagacacgatcgacaacggtgtggccgtataagccccatgattcggaataccccggcccctccgccatcaactccgccccccggctcccttttgagagaattgacacccatccatccagctcggagcctgggctagctcgcacgggggcttgcctgctgcgtgcggagcggagcggacggccggcgctgcaagggaaggcccgatcgtgtttcgtttcctaccctacctaccatcgtccggttctctccaagccccccctccggcgctgacg

SEQ ID NO: 6452 - DNA, 1500 bp, Zea mays
aagtattttctgtagataataaagaaatccttaattaactttgaagcatcgagaactgcatttatctgaagtcgaaaagaggacgaagagttaaagttgacatccttgcccaggaaggaggttctagtttgatgataaaatgctaggcagagggagaaccacgtggcgaataatagtacagtaagtacaaaaaaaaagactttcatgtttttgcaaaccattgaaaatcgaggaaatatataataacaacaacaataacaataattggttgaaaaaaaagaagggcgtttccgttgtgcgcgtgcagctgccacctccaccttttctcgttctgtcgccgcctccacttccaccatcccaggccctctatcgtccctcagtccgctgccggtgccggtgccgcatcgggtagttcagcggcggcggcgctgctgatcaggtggtgcccaggccgtccacggaccgagccctctcgtcctcgtccgacgcgagggcaatcacccacccgggacgccttccgaagcggcatccctcctctggccaacgtcccagcaacgagtgagcatccacccgacttagattagcagattcgtttcctctggttccttcatggacgcatgctgaaatggattgctaattaatgctattgtgggttgttcattactgattgatgagtactatacattacctgacatgccgtcacaccacaaacttccttgctttactcaattactcagtgtacaattggcgcatcaaaattaaaaatggacttgctgctgtgatttattcatgcttggatcgattcaggtggcacaagtactaactttttttagcagttcaatgggcacatccattccatgcaaccggcaacccttttcattttccttcgtcatcatgtgctaatccataacaaagcattgcagatcatgctttatttctctggagtaattagctttttttaggaatggtaattaaccgttttaaagagaaatacttcttcgtttataccctgctttgcatatgtctccatgagcacaagtataacaatggcgccatatcaactgtacagagctcactgatgcgatatggaacaactgcttcctagacaagctcgccttcaggtatcgaagtcgaaccaaaggaggttgaagccatggccctcatcgtagctgcagctggaggaaaccttcttgtcagaaagttggtcaatttaactccctcgcaagtaatcacctatgttctttgcccctttactctctttttttgttgccattcctgcccttctgtatattattgccagttagattatgatccctggagctaatcctctcagctcatttgcatgcaataagctatcggcatccattattaatgtcttatgatcatatagtccatcctgttgcccattcggtcctttgcatacattccatgcacacgacacagacacacatatctagttgctaatattgctgtttccttgccatgttactgtatgtagac

SEQ ID NO: 6453 - DNA, 1500 bp, Zea mays
gggtgccccctaggccttatatactcggccgtggagcagtacatgtgatacgataacaacaagtagctaaaagatagtgaacctcttgagtttatccctacgtaaccttcgccgacttatcctcgcatggctctgttgcatgagggcttcagcgcgggaaagtcgggtctctgttgtgatccattcgttcgacgttgtgggccgcctgtgtttgcactaatcagtctcacgtctcctttgttggctgtctctccctaggcccacgaaagaatgaccttacgaattattgggcccttgggccgttcgtgaggccttttacttctttagtggacccaggggatatctatcccccacaagcccccgatctttgggttgatttagaggtaatcaactcaaagatccaaggtccaaaaaatgattccttgctgtcttctctggttttgatcactcgtccgaccaaagttcggctttgtgcttgtgccttagaggtcggcattttggattgtaagactccggaattcattgggtgcaccggaggtgcacccaatgggtgtagcccccgacctttgagtagattttagaagataatctactcgaaggtcttcttccaaaggttatctccattcgcgctcctgcatctcggttgaggattagtcttttcaatcttgctctacgccttagaagtcggcgctataccggtttagaataatattccatggggtgcaccggaggtgcacccaatgggtgtagcccccgaccttcaaatggattttttaaggataatccattcgaaggtcttcctttcacttgcgaaaactggcatgaggctattttgcattatgctttggaggtcagcattatgtcatcaatattttgctgcctaggtcagcgtatattttgtctttagcggccgagtttgcaatccatccatatcttgctaggtagtgcaatttatttgcttctgcgattgattggacgtttgacggacgttctctgtctagtcttcacgtcgcttctgtcggccatatcttgtactttgctggttatatttggctttcctctgatccttactgatatctcatttttgtcttgaggtattcactgcatgccctgcacggatgtgaccgtttgaaaaatatactgataattcctgggcgtccccccccaatgggtgtgggcaagggacgacttggtatgcttagtgttttagtcggctgcttctgagtagtaatgtgatgtgacggcgagtgtaatcatatcctccgcgctgttgactggagtcccaatgggtgttgtgttgtgtgaaacggcgtcagccgcctgacgtgtcttcagacgggttgaagtgcttattgaatgctttgcgactgttcaatgaccgcggttggaggtgagcggttgccttctccttctataaataatgtcgttgtctctccggcttttccacatctcttgctgttctccgttgcttgcttttcttctctccctttcgcttccacc

SEQ ID NO: 6454 - DNA, 924 bp, Zea mays
tatagcatgttatttaatgagaatgaaaccttcataacatgcccagtgagaatgacttaaggtaactatattattaacttgttttattttagtatagtcttggtcatccatcctacatgaaaataaacacagttatagctaataacatgcccagtgagaatgacttaaggtaactatattattaacttgttttattttagtatattcttggtcatccatcctacatgaaaataaacacggttatagctaatttataaacttaaatcccttcgagattctcatatattaaatgagaaattaagctaatttccacttaaatttggagaatcctggaggactaattttagggattgtggaattttatcttcaaccccttcaattcaaaagagatttaaggtttcaaactagccttagggggtgtttggttagagagactaaagattagtctctagtttttagtcctatttagtcctttttttaccaaacactaggactaaaatatggactaaaatgatttagtctttagtccttcacatatgtgctaaaagtgactaaaccatattaattccacatttacccctcgtttagttcaattgtactaataggaggagaatgttaaaggtcattttaatctttttatgagtcatttagtatattcttactattttagtccttagaaccaaacatgttaaagactaaactttagtcctctaactaaactttagtgctctaactaaaccaaatatggccatagtactagagaatccccgacaggatttagcactccatacattttccctgcaactcggtcggttctccttccccatatcgttcctctcctgatacgtggcgaaggaggaactgaacgtctgaatctgaaccctttcgttcctctcctattcgaactcctcgcagccaaatccg

SEQ ID NO: 6455 - DNA, 1065 bp, Zea mays
gtcgcgcagaggccggccggagcctcgccctaccctcacgaaataacttcaaaatgctgagccctcgagctagatatctcgcttggtgtgattgcaactgctgtatcaagtatagtcctagtgcgctttggctgtaaagatggatgtgaacatcgtcctagtgtatttactcttaattccaaaccatcgcctgtcatagcctaatatactcttttgtgtataatatcgggtgtaccggagctgaaagcgaaacttgtcgacaagtatcgtgaaagcatgttgcgaagggagagaaaaaaaaagggaagaggagcgtcccctgtcgcttctggttgctgcatctggacacagggaataccccgcgagaaaattggtgccgtccaggtccaggggtttagttggttagctagtgcccgatggggctgcccgctgccggcgtacagacattagttttctgttgcgacatggtcgtgggtgccgtgcggtgcagacctgcgacgtcgaggcttttggatcctttccccgtcgcccgccccccctggggggtccaccgtccacccttgggtgtgcccatcacgcgttctcgcccccgccgcgcttttgctccgccgggcacgctttgctttttgcggggtacaagcaagttttatacggaaacaaaccgccgtgagtgagagtgagctcgcacggcgtggtttggctttggcccgaggtccatcgccatgatgtggtccgccggcagcacggcgcgcagaattatgtagtgcgcctgtgcgcgtgccattagaccaactccagcagactccctctccgtatccctaaaacgcgcggccaacacattctctctcctctccgtatccgtctccgttttcagcaacactccccatcccactccgcatgcagtctatgacacctggggcccgccagcaggcgcgcgcgcacgcagagagctgcggagaggagagagaaagtgtggaaatggggagcgcagggacacggcgtccattttgcggagagggatgcggagcctgctggagcgcgcaatagtgcctcagaccgtgcaaa

SEQ ID NO: 6456 - DNA, 105 bp, Zea mays
ggtgggtgatctgtagagcgaaacgccgagccgggagaggagggaggccgcaccggcgattgtagaagcagaaccggtggaggagtagaggagggcgccgaatcg

SEQ ID NO: 6457 - DNA, 1079 bp, Zea mays
tccgctgctgacaacctggccctccgaccgcgccgtggaaggtacgcgaggaattgggtgcggcagcttttgctgattcgcagccttttctaccgtgttctccactcccctcctcgactcctcggctcatccacgcagaagaaaaaaaaacccggccaataaatacagcggataataaaacccgcagcaaaaatcgcgcaccttcccctcccctacccctcgtctgcccctgttacctcgcgcggttggctgcgccagcgaggctcgtatcgccctcctcctcggctcctcgcgccgcttacttctattctattttgcccggtcccataaattcgaatccaaacgcgcgaccatcgccgctgcggccgtgggaaaggaaacacagaaaaaggacaacgccgtcgtctcttcctcgcaccagcctcccgctagggtttcccctcttctcggtggaggcgccgcgcctccgggacctggatcctatcaggtgagtgctgctacctcggcctaatctgtcgtccttcggcgtcggtgccgggtgagggatctcgagcgccgtgggtggggggtggggtgtcaattcgtttcgtccggctgccaggacgctcccgccggctggttttcggtggggacgaggcggcggtccagctggatcgtcggaggcggagttggggcttcctctcgtacgcgtgatggagctggtcggagttttggtcaaatttttgcaacggagctggacgtgtacgattcatgcgttccttcgcgcgatttctcgtattggtttgcaatcacagggtgggggaatattgagcgttttctcctttttttgggacgattcgtctgcatatcaccatcgcgtattgtcatgccggtgccttttttaaaaaggatacgtgttcggctagaaatgcttccgaatattttggatcggaatcccccaatcgtggcatatttcccccactaggagcagggcttgatctattctgacgtcgaatttcgcatgtcaattttgatccaggtccacgctgatgccagcgaggtgcagccgtctttgattcccctcctgtagctgcatcctc

SEQ ID NO: 6458 - DNA, 1379 bp, Zea mays
ttttttgttgctttggcctctcctcaagactgcctgtacgtacgtcttttatgtgtatatgttttcaatatctgctgctctgctagcttggattgctttgatgggtggtggcgatcgaggtgttggttttatagctaggcgtttttgcatcgagtcgtgtgtcattgttctgcaagtttgggttaattcagattaatgggttaagtttccggcttgagtgtagtgacgatctgttattgcagctatcagtgtacgtgcggtgtacgaaaggagggataaatgtgcaattggcatgtaaacatgctggcagctgagggtagctgaagaacttgcggcattcttgcctgaacagcttccattgtttaatttggtagtacaaatgacatcagtgctccggcggttggttgtgggtatgtgggaatctgcaatttggagaaccagcccaagaaaaccacttttccaagaacgattaaaatcttaacaccttttatttgatttttttcactattttgaaataaaaaaattcaaatccaaagcataaaggtcatcttattcaaaaccgtgttggacaattaagtcgaccaattataatagatgactagagtttctactaacgaataagcgccaacatatgcccataaggttcaaacagtttcagatatacaccataggacagagcatgatttttcaaaaaatatataatgtgtttcataatttctaaagtaaacagattctttataatttttaagatacaaactagatttcaggaattttaattcttattatcttttcatgaaaaaactgaataatttatggaaaaattatgattgcttggatatttttttaaaaaaatatttcgaaacccaatttacctccctaacttctttgtccgttctaccctattcttacatggcgctagtttcatatcagcaaaaccactgttaaaatccccaaagataaaaaaaaatcataactgttttcaatgttggtatatgtaaaaaaaatgtttttaaagttcagagagaaaaactagaagatcaaaatagttgaaaaaggtaaattagatttgttttcccttttttcaccagaaaactggattgccaattatctgcgcttcggtcacggcctcacgggcagccaaaatttttttaccatctcacgggcagcccacctaaactcgggttccgcaattaaaacgattcggcccaaacatcgccggcccataagtagaacagcgaaaaatctcatgtcctagccgggaggaggagtttgtgttcccgacctccagcctcctggaaccaggatagggacagagacggagccacggtcgcacagagcagtcttagctccggccacggccaccgggagtagctctggcc

SEQ ID NO: 6459 - DNA, 1500 bp, Zea mays
cagtggaatgccatcatccctcgccctatagactgcaacggtaagtcacggactttccttaattaatcatgtgggggtaaagactcaagcatgcgggaatgcagcagcagcgtagccggcaagcaatgctgctgttgggctggtagtggtacgataatgatgagagactgctgctgctgggctggttgtacgataatactattagtgatgagagtgacgctagctagctgctctgctctgcgttgctctgctatgtgtccccgatcaaacgagagagggatggcccatgcagacgcagcagcgcccggctgtttgcatgtgctataaaatggaccaacacctcaatcgagagggacggccgggtcacaatcgccactaacctacccactatacgtacatactatagcagccgatggcctcctcctccgtttcgctgctcgtcaccacatcatgttgccgccgtcacctacttgctcctcgtttagttgtaggcttgatttcaccagcgtgacactcagtaaagattactcttcggttgtgttggtaatggttggcgagtgctgactcttgttgttgggaagcagcgacctagcagcaacaaaagtcgctgtataaaggagcacgcatacgatatgatgtgcggaaatgccgttccagtcatgagtgttccagtcgacatcgacatgacaattgaatgttttctcgatatcgatcgtcttcggtcgtggaccacatgcactcccaaccgctcagcttgctagctttgacgtcaaggcgacgtacgggtatatatacactgcttgtaggtcgatgtgaacatagcaacgtcagcgtatgtgtgagcttttcatggtctttcgtaatcgaacgatagtgtacaatagcaatcaagctactaggaacagtactgtaaccaagaagctagcttttgtacgtagcttctcccccacacacacctaaacacacttaataagtaggtgtaaaaaggaatgcacgcgcgtgtatacattggtgcacgtaacatctatatatattatctagctgcgtggtgctgctagctttacgtttttctacacttgcacttgcttgacgacgccttgggagaggcctccaaaacatccatcttgtcgatcagctcgtcgtcacccatcccagctatcatcttctccgtccagaggcgtccatcgccggcgtacgtcctcggtccaaataaaaagtaatggggcgcctccgttgtgggtcgttggccgaaccctcctcgctccatttccacccgccttttgcatctcgacggggcctacttgccttcacgcctccactccacttcaatggatggagcctataaaacgggagcacccccggcggccattgccaaccaccagtccactcatcatcgccatctcttctcttgttttgctcgctctatacataccagagaggtaggtagctagctagctagtggtgaacgtacaataatacaatcagcacagcaagacagta

SEQ ID NO: 6460 - DNA, 106 bp, Zea mays
ccccacctgccctttaaactcaattataagaaaaacttagataacaagggtagtctaatttgtggatttaacttaaaaagggcttccttctgaagttgcaaagaga

SEQ ID NO: 6461 - DNA, 548 bp, Zea mays
gttcttttgttgctcttgtcgcttggattgcctttcttctttcctcacttcttttctaagtgcttgtaagcaaaacaagagacaccaagtgtgtggtggtccttgcggggtcttagtgacccgtgagtttaaggaaaaggctcactcggtctaagtgaccgtttgacagagagggaaagggttgaaataaacccggcctttgtggtctcctcaacggggtctaggttcttcagaaccgaacatcggtaaaacaaatcaccgtgtctaaccgctttgattctcgcttgatttgtttgccctctttcctctctctaacatttccttgctagtattaatttgagttttctcccatacgtcatccgcactctttgagcaactcctaccaagagaaacaatcttttggacttgaatttaattctaacgctaaccccggcctttagtgtgtgtttaggtttgtaatttcagatttctcctattcaccccctctaggcgactttcaattggtatcagagccaatgctttattaagagtctaaccaactcgaagtg

SEQ ID NO: 6462 - DNA, 249 bp, Zea mays
ctgccgaacaggacgacaggatagacatccctccccggctcgctatatagtaagcgcgcatctcacttctgacttgccgtaggcgttaccgtcatccaacgcgccctgaaccggaatgggcctctgcgcagaggaaaaccggaacagcgccacggcatcgttcacgctttctacgcatcctgttgatcgggatcgctagcagtgcatcaccgcacgtggcctttcattctctgactgacaaggcacatt

SEQ ID NO: 6463 - DNA, 710 bp, Zea mays
catcttcgacaaatgaaataaatatatcgtacatatcgaatgatattaattcgatgtcgtaaattttaatagtttttttcagcaattcaattaagttataaaaagtttaacttaaataatcctagcaacctatttgtttaacttcaaaagtttcaaaagctatttcttgtccatccggcttcgggctgcggtaaaagatctgccgacgtggatgtccgtgccgccggcacgccgcgtgccgaccagcgagcagctggcagggccgggccccaggccccagctcagctacgacagcagagtgaaaccagtactacctggccctccggacgggcgaatgggagcgcgcgacgtcgcctccaccgaccggtcatctccgatctaccgctgtcgccgttcgttcgtacggacccctcccttcccgcccccgcgataatatctcccgcctccgccctccgccacgcctcaactcccaaccgtccccgcgtgcgtgacgctgacggccgcatccgccggatccatcgtccacctgacaaaaccccgcccccgctaggcggctgagcttcccttccactctctcttcccctgcagcctgcagctaagctaatccacccccacccccgagctgaatcgcccctcttcccctttctatcctcatcctccccccgctgccgcgagctcaacctgtgcatggtcgtcgcagcaacagctcc

SEQ ID NO: 6464 - DNA, 1500 bp, Zea mays
attttgacaagacaagtgtgataaaatattcgatgagttaattaaaatggcaacattcaaccgaacactctagctgatatttcagctattagctatttttagtaaattagctaatagctagctagctaattctactagcaaatttttagacaactaattattaactcattcaaacaccacttagcgtagcaatcgcccatcgtcatccatgtacgtctgcagcctgcagctgcaggtgatgtccggccgggatcgggggatggatatggactttgttgggctgtggctaccgcctaccggtatccgcgcgagtggtcggggcgcgcttcacgcccgctgggatcggtggagacgacgtcagacgtggacccggagtggacatagaatcgatgaggactgaggagacgggggtctcggcggctgctcatctcggccggccgcgctttaatttatttggctttggccacggcccggccggccctctgcgtagctacggctggctagctgcgctacgcgcgcgccagagcttgcatgccgggccgccgcccgccttccttgccggcaaggagccgccggagggctagcggggcgcgcgctgagctgcctagcgcagctagtgatctggccaaacgtcgctacgacgcgtgcgtgcacactgcagacccattcgactccatgaatcgttatttctcgatcggcgctcatgtcacccaccatcgctctaacttcttggggtagtttggtggacatgtatctcttgttattcaattttgaataacaagtgcatagggatccgctctatttccatgtctaccaaattagtccttattagtatatacctgtctgttagtatatatatacctgtagcaggctagctagctctttgttaaggttccatgcatgtatacaaatgcgtcatgcgtgggtggggcaagatgcatacatatacatgtgtgtagtgcctgttgctatcgagttgctatagtggagtggtactttgctagcttcgcgacaccttcatcgaatatattatattatatctatatttgccatcatctcgtgtttgctttgtctgtttacgaaacagaagggtcttgctagcttagtttgggcgagccagaaccgctccaaaggcccatgtgcatgtgcatgtgcgtgcatgacctacggatacggaatccatcacactgatactgcccttgacctgcacagtgtgcgtggccatcaacgacgacccataatttagagagtagagacccctagctagcgagtcgcgccgatcgctttccgccggcggccgcccgtcgtcagcgcgtgcatcaccaatacggccggcccccggcgctctcggtgtataaaatagtggacgataggcgcggccgggtggcggctatatgcctgtgagtgcctccggctctctcggtgcagacgtccgggactagtacgtggatcgggccgggggcaactcgagtcgtcaagaaggctgctacctgctagagg

SEQ ID NO: 6465 - DNA, 68 bp, Zea mays
ggctacaatatgaagaataaaagatgttttggggctttggtgcttgatggtgaaactagacgtcgtga

SEQ ID NO: 6466 - DNA, 1500 bp, Zea mays
tttagatgattggctctcccgcgccttcacaataatgcaccgcgtgtgacacgcattattgagagctctctcatttaatttgcaactagttttctggagagaaaaaagagaccgagcgacatactccctccggtgcagtaaaagaagtcatcctgcgcgtgaccgagcgtgcacaaaaagaagtcatagcgcgcgtgtgtctgggatttggacgttgttgcccctagtaattgcacaaaaaaagatgcatttaagaggaatcgaacttaagacctccagtctagaatgccttgaagctgctgcagcaaccaatcaagcttgattgttttagttacgttaatgcacccatatccctatttaataggggcaaacagggaaaactctatgataattaatcactccttgctatgcacaatcatgtcctaaacgactacctttactgcactggagggagtatgtaaaaattatgtgaggcaccgcacgtacagcgctgagttccaagtcaccacgcactttatttatttacatttataccaatcatcaataggacctgtttgggattggtcgagctcaaaaaattagtagagttggtggagcattgagtgctctagaaaatcatagagctaaagctgtaagtcttttaaagacatttagataaattattttatttattatttatattaaaatatttttaaaatatttaaattgatattataaactataactctacactggagctgtaacctaaagtcatcccaaaggctctcttacctgcagtacgtactgacactgacggaagagagatctttctgtagaatctgatgctttgacgagctgactccgctgggcaaggtgttaactgcttgcagagcatcgaaatctgaaaaacggtagtatatactaatcatcgagaacgccaaaacacaagtaaacgcggaccgcggcaagatgcaaaacgcaccaggacgatccagagttccagaccaccgacaagggcagggatgccatttcgtagagatcttttctgcactactactcactctactggcaatggtaagtatcacactccgtttgtatttcaaaagagaactagaaatattttcccccgagttatcatctcacgtctcacctaaatctacctaactgtgggaccgaggtctctttttagttacaccgtcactagcgagacccaccgtctgcgggtcccgcggctcagggagtttctcccggtcccacagtcagtggaagtagtaccaaaagtacttgtttctagtcccacatggcagtctcagagaggctcccactcacacacgtaccactacgcggacatccggtcgtcgtcgtccgccagacgctttaaaacggcgagtccatttttcctctcacataaacccgcgctcattcctttttctctcacctaattcccgtcctcgtgtgttggcgctgctcgcttgggtttggatccgatcgagggctcggcccggcggatgctgtagagga

SEQ ID NO: 6467 - DNA, 521 bp, Zea mays
ggtcagcgagcctctctgctcttctcgcgtctccctcttgagtgagtaaatgttgaatgtcctcattttcgaggaattgcttgctggaccttctgtaattcgaccgctttcgacgggaatggctcggggcagtcactgttatttgtagggtgcgtcccttttttcttttcgactaacatagaaccatcttgggatgacaggtttgtctgattgatatagcgaattagctacattgagtcttggctgcacatgtcttccgggtttttagataggatagaatagcgagcaggaccaatctctgcacggccgaactgttaaatagaaaactatgcttcagtcgcagaaattactacaaaaatgtttttttttgcatatgtgaaattcacacttcacagtccatttattaaactttttagaagtcgtggtatgcattgcaatataccattcattacttcaccttggcgtgctgaatggaattctcaaacttacagctgattcatacgcttgttccattttaggcc

SEQ ID NO: 6468 - DNA, 101 bp, Zea mays
caaaacagtttgggtacctaaagtcaagaactaaatttgttttgtaggtttatgcatccgggggctcaagttggatactcgacagcgggtgcacaaaccac

SEQ ID NO: 6469 - DNA, 458 bp, Zea mays
ggtatgctagtaaatacagacactcttctcaatcaaatcttttggttgcaactggtttgagctagcttaccttgtttaacttaatcacatatagtgatttggttagaggaactatttttgggaagagttgggaatttggaaatactgtctcgcagaataataagtacacatattctttgtaagcagtttggaaaatagcttgggatcgtgatagttgattttgtgcttcattggaggattcaacttttttatgtgttgcacatgtctgcagtgccttgttgactttgtttatttcggtaataagagccaatgctgataagatttgaccaggtctgtcccatgaatcatgtatatgttttggtttggggttgaaactggtgtgttgtgattttcaggctttgcagcttggacaagatgccaatacaccttttggattctttaacggccagagatgccag

SEQ ID NO: 6470 - DNA, 1415 bp, Zea mays
gctgtttccttattgactacaaggtttaaacaacgatacaagaaaatgtttagattttttatttattacacataatttgtgttctttagatgacaagagttttatgtttacttgtactcaacttaagatggttctagagaatgaccaacattctgatgtggatggcaaaagcttgtatatagagtttcttcaagagtacgaggagaagaaaaatcagagccaaagcccagagctgccgatatggagacagagacagatagtactaattgcgtaggagtacacacttgatattattactgattaataaacactgatgaacgtacaaccatgtggcacgcaaaacccaccgaacgcttggcactggcaggaacgacctggatcggaggtgcacggaaaatggtcggcgtagaactgttcgagatacagtcagaattctcgagaaaccctcggacctccctgcaaccgcaaaatggagcgcatatacgtgcaggcgtgcagccggatgaggtgtcccaagtcacccaacgatttttttatttgaaagggagagtcacccaaagattgttgtccatacttcagtttacgagcagttttttttttattaacagctccttttacagctagtgcaggtgcagatatatggactacaccgtattttctgagtacaagacaagtgctgcagatatatgccgcggactttccagtctgtcatgagctgctccctacgactcctgcgtcctaccagcccccgtcgcgtaccctacgagtcgcggcccatggacccagccgctgacgcgtggcctcgtaggcgccagacagccgcgcggtgcatggaccgcgttcacggatacggctgttcccgacggcggcccaccgatggttaaccccaatctgttatcgttaatgacatgatcactgtacaattacgtactatcttttgcagaacaaaccctccgcgccggtccgtgtcagtgcacatagtcacacacaggtccctagaaaggagccttcctgtgatttactaggagtactgatagtgtcctggctaagataatgcaatatccaatgcaatcaaccacccccactcgtctatttcggcctcccaccttcctctttaaattgcccctcctattcccccgtcccgaagctagaggctctctggcgccgacggccgacccacacgcgcgtccagcgatttcgccggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtc

SEQ ID NO: 6471 - DNA, 82 bp, Zea mays
ggtgtgcgaattgaaccaccacattatgcgtgcctacgtatataccaacttcccaccatccctgtcgccacagagtatctaa

SEQ ID NO: 6472 - DNA, 316 bp, Zea mays
cctaagtattaaagtatacctatatatataggcgcacattctgtcactccgttcctctccccggccagcgtctctctccgatccagctggtcagtagtgatcagtactagctagctactaccaccgcccccaaaaccattccacctctcaagaacagcgctctggcagcgctggtagtgtagcatcgcgcgttcatcactacgctactaggaatcatatatcatcatcggtcgagagagagagagagcaagcaagtttcctccggcggccggagggtacgtaatcgatcgccggccgccacagcaggatgagcagg

SEQ ID NO: 6473 - DNA, 1324 bp, Zea mays
tgaccagtcacgcacacgcacccaagccaaacccaacaatcaggataagctgcttatctttacctgctcttccactagccgccccatagtgtgtagccgttttcccaacttcccccaaaggatgtcccgcccttgttcggttggttgcattgcacctagattagtggggattgaagggattaagggtatggttggttcgttgctaactataccacactttgcctaagattaattgtttaaattgaaaactaatcttagatagaaaaattaggcaaagtgtgacaagttagacagtgaatcaaacataccctaaatctaattttgggggccttactcttccaaaggtcctcaaaaacacaactaacatattttccagtatagtatactgtcacaggaagcttcggttttggaataaaggtgtgcatggtataaaaggcgtgatttggaagaaggatgaaccagctccgaagctgtggccggagaagcttcggtttagcacaaggacggtggtggaggatgaaaccgacctaaaagagaaaagaccgcttagtccttgacaacttaccttctggctaatagtaaatgtcagggggcatgaatgtaattttccccaggctacgtcttgtgcctataaatagatgaacagtaacaccgttctgttcacgctgacttgtaatcactcacacgtcattcctgcttttctaccttctgtcaagccgaaggtacaaatataattcagatatcattgatgtttgtttataattatataatagagatatgaatagtctaatgattcgaaatgattattcttatttcctctatgtttcatatctttgtttatgtccatgtttactgagatgatgaaggtacgtccttcatgaccttcgtctaaagaccattgtatcctaagggagacaatgcttcgaaggacgaaggtcgttaactgttgggactatgcttcgtcgccgaaggtcttcaagggaaaagctacaaagttgacacagcgccgaagctgtgaagcaggaaagcttcggcatgttcgcagaaaagggaaccgacttaaagatgaaaaggccatttagacctcgatagagtgctatagaattatcactaaatgtaaagggcatgtatgtaattttgtatgggttgtaccccgtgcctataaataggtgaacagtacccccgtactgttcacgtgatcttggcgtttacccttgcgtcacacttgtattctcatctccttccaagccgaaggtatatttataattcgatattgtctctatttctctatgatgatataataaagttaaatgaatgatgttat

SEQ ID NO: 6474 - DNA, 139 bp, Zea mays
ggtacatgatggtttcacctcgctttactgcagattgttggcttgctgctttgcgcatagtgtacctgtggttacttctgcttgttgcttgcccgtttgcatttacctggtgctgctattgctttctgttcagaaggcc

SEQ ID NO: 6475 - DNA, 647 bp, Zea mays
ggtatgcttcgtagccgaagatcctaaaaagaacaccttcgaaaggtcttctcagaagcaagcgccgaagctattatctgtacagcttcggcacaaagacaaatctcaagatgaaggatcgaaccgacttaaagatgaattgacttaaagacccatgatgttttgtgtcatcattgtagttgatttgtaaaggacataaatgtaattttgcacaggttgcatcctgtgcctataaataggtgaacagtatcccggtactgttcacacgatccggtaatcacggacacatcacgcttgtacatttgctttcattcaagccgaaggtacacttgtaatttaatgtcatttctatttttccgtgttaatagaatagaaatgatttaataataatatataaatgtttgtgttatcttttgtatttcacatgtttttcattcattatcatatgtcataattatgaaggtatgtccttcatgaccttcgtccgaagatcgttatatcccaagggaaataatgtttcgaaggacgaagggcattaaccatttaaccctcttttgtgttgccttgttcttgattcatattatttgagaacaagtcctcaacattggcacccacctccagtgaactcacatccacttgctgagctg

SEQ ID NO: 6476 - DNA, 1500 bp, Zea mays
aaagcatacatttttttcatcctactccaattatataaaaattatcaaattcaaattcattatacttaacttttttttttataaaattggctaaaatattctctcttttttaattacagataaagtataacgaatttaaacttaattttttgtaaataattgaagtatgatgaaaactaatttgtatgtttttttgctaaaattattattaattcatgtgcatcgtcaaaatctcatgtaaatgagatatgtttctcggtagaaaaaacaaaccgatgcgaacaaagtttgcgattctcaaagcgccgatgcggtccaccaccacctctgctgcaacggctcggctggggagcagagcacggcaagcgaaatgtgagagctagggagtatccaaaggcccaccaccacagatacacacatgccaggaactgcttgctacaggtccccaaccccactcgaggacagtacgccctgctgtggtaacagtactaaaatttgctgtatttctcgcagaatttgtgatgttatatgcgtcatgtatggtacttagggcggggtagaaaggaaaaggttatgacaacaaaaccttattccaagcgaggtcgaaaactacaataccaactaaacttttagggttagtttggtggacaggaaaataaggttttgtcaagaaaatctatcccttaccatttaattttgaataataagggaatctatcctcgtaaaatccccttcatttttttccaccaaagggaccgttatcttgccctgtggtcaccgttctagagcgtacaagaacgccaaaccttttgggttatctcatacgaatgttttgtcaagtatgtggattgcttacttactatttatgctcgtgacatgctacatggctggattcacacaaaagaacagcatggcctggatttccatattgactcgcttgtgagcgtcatccggaaaggaacagatcattttttgtgtgcgcggggggcatcgggccaaaccaaaagcacggacaccaaccaaaggccaactcatgaacaccaacaactagtgtagtgtgtagttgtgtgcacgctggcttggtccccgtagcagagaaccccacccccataaaagctcctctccattggccgaacgccgagagcaccactccctccctccggctcccaaccccagcacagcgcagcagcagtcctctctcctctcactctactcctccagctccccacccctctcccaaaacctcagttcaatcccaggtttcaaatccgccaccttttggacacacaccacacttgcctacccccagagctgagctagctagctgctctctctctctcttttcacctaagcgagaacagagcccaagaggcctcaaaagaaccactgcacttcctccgcatagctcgtcgccctctctctcctatcagtcctcccagctccagctaccacagcagccctctcgcttaaaggaggagggagaagagggcggggcgagca

SEQ ID NO: 6477 - DNA, 281 bp, Zea mays
gggagtggattaagcacatgcacgcaacttgcaaatagatcgagaggcctttccaattatagcataatactacatcgatcaatcgaaacagatgctaagcatctcttcctgacccaaaattacacggtactacgtactattagtagaactggtcgccccagcaaacaaacgcagcagcagtacacgctagcctgctaatttaaccatggctagcccaaaacggcatgtgatcgccaactaggagctcgccgctccagcaaacacgtaggcgcgcatgcagc

SEQ ID NO: 6478 - DNA, 542 bp, Zea mays
cccctaaaacaccttaagagcccccatattaaacaccactgtacatgccctaatgacctagtactaatcactggcggccaagaccagggatgatagctcgtgcgggccccacggctcccatgacccggcatcggcacgtgggccctcgccacccaaaaatccacgagatcaacatttctcgtgttttcgcttggcccgcgacggcccacgtgtccccaagcccacgtcaccgtcgccgcccatgccccacctaccggtactatctactctctctctcctccggcctccgccttcgacaagcgcgcccacccgcgcgacagcgggcgcgcgcggctgcgactgctgctgctgcttcttctccacttctccttccttcccctataaagcaaggaatagtcgcagcttgccccagcttcgcaagctttcctgctaatccctgccattagtagcaagcaagcaagaaagcagtggtagtaggtgccacccacacggttttcacggctgccggctgggagcgaccgaggagatcgtcgtcacgctcg

SEQ ID NO: 6479 - DNA, 417 bp, Zea mays
cttcctctttctgatttccaactcaatgtaaaccaagacaagagacaccaattgtgtggtggtccttgtgaggacttagtgtcccgtttgattgagaagagaagctcactcggtctaagtgaccgtttgagagagggaaagggttgaaagagacccggtctttgtgaccacctcaacggggagtaggtttgcaagaaccgaacctcggtaaaacaaatcaccgtgtctcactcttcatttgctcgtgatttgttttcgccctctcttttcggactcattcatatttctaacgctaaccccgacttgtagttgtgcttaagtttgtaaatttcagattcgccctattcacccccctctaggcgactttcaattggtatcggagcctggtacttcattagagcttaaccgctcgaagtg

SEQ ID NO: 6480 - DNA, 1500 bp, Zea mays
ccattcgattaaatcaacgtaagatgttaaaaacggtgcaggaggtgggggttcaaacccatgccctgatggaagaagagcgggagacattgggtaaagttgtctaacacagtagaacatcatgctaagatgtttttaatattaaatataaattatatatatgttttttataaaataaaaatatataatcatgtcgggccggaccagtactacgggctgaggttacagcccaagcacgacacgacgtttttggctcttgcaagcattatgtcgtttctgagacgatattggcgcaatggactccatggtgtttgaggttgataatttgatggagcaacaatgatttgtcacactaacagtaaaaataaaggttatttattggggtttaaacgttagtaattgctacaaagtatcataatttatatggagcacatccagtttttattgatgcctgactttagaaatcactccatattttgatctatcttttttataagtttgagttcatgtgacttattttagaaacttgagctcacaaattttctcttatttagtctatgtatggtggaattatgtcattttataatctctgttcgttcagtcagtcgttgtgaactcttttctaattgctcacttcattggtcgtgttgtaccaatacatattgcatggagtaaataataacatcagttagccaaatcaaaaaatattatactgagagtggagacaattgataaaaaatcttgaattttttaagtgaatagtttacgtgggtattgttgtaaccgtcgcaacgcactggcaaccgactagtataattaatagttcatctattaactactcactcctttttttatttatcgcggtttagttaaaatttcagctactaactactcacttcattttttatttatcgcggtttagttaaaaataaatagcggatgacgaatatttgagaataaatgcagtactttttagttaattagttaatagttagtttttagctagctaattttatcagtaagtttttaacaactaactctagtgtatttaatcatgtcctaaaccagtaatccgcatatacaatcgcgatgaccgcgtagacgacgaccagcccacccgcgtctgctggccccccacggccacggtccaccagaccaccaccacccattcgtctgggctccatgtccatgggtatggtgatgggccccagagattcccctccgcgcacacaaggcccaacacgtccccgtccagattcatccaccctccccctttcccttcgtctccgtccgctcccggcatcgtcccctcttccccgtctcgcgttcgtcgcccacgggcttcgattgatcttcttccggtgctggtggcaggtaaggaacctttccctatcctcggttcgatggattcgctcgttcgttttgtctccggttgaatccgattttttccacgttcccaggtggacggatcgtgtccttgcttggccgcccacagcagca

SEQ ID NO: 6481 - DNA, 190 bp, Zea mays
acggcgccgctgttctagcacgtgtgtgtgtgctgcctctcggtcggtcgagctcgagcctcagcatgcatgtcgatcgccgatcgtggtgtttttaatttgttgcattcggtttgttttttccctgctgttctcgaatcgggatggaccagaattctcgccgcgtggtgtgaatcttgtataattaata

SEQ ID NO: 6482 - DNA, 77 bp, Zea mays
tctactgaagcacttaatggctctctctgtttttattttgttattagctatggacacccgatgcaaatgctacatca

SEQ ID NO: 6483 - DNA, 91 bp, Zea mays
gtaattttttttaatattaattaaggacttgtatgtttgtatggaacatcgcatttgtatgcagaaattaaacttattgtgatttggatgt

SEQ ID NO: 6484 - DNA, 245 bp, Zea mays
ttttacgagcgacaaggagcctggcgtattcttaatttcttcatcgccttcgagtagagccgagaatcaaaacgccagcactccgacatgtgggacctgtaaagttctagggtccacatgttggtgacacaagcgttctgtttgcctcttcacattcacacacgtgaggcttccaaaaacccaaggcgcactcggcagtggaactccgctttctcttgctagggtttcagctctccgccaccgtc

SEQ ID NO: 6485 - DNA, 562 bp, Zea mays
tgcttgcatttgcctccgtccggatgacactcacactcttgagcctacctacagcagaacgaactcgaaagttgctcgacgacgaacagcctgcatgcatcatgcgacatgctaaaaatgggaagagggagttctctccaggattaggcggtgcatgcgaaatcgtggctgacggttgaaaccacggagacattcttggggagggacgacacgagtagcaccggagagaacgcgcgcatggcgaccaccgtgccatgcatgcgtccgacgatttaggacgggacacacggcagccttctgccaatcgcgcacgtaccaccattgccgccgcgccactcgccgagcccttccccggtttaagtgctcactgctctggccttgacgcattcttgtttggacacatacgtacgtgtgaaggaccaacacgagggccgggcgcgcaccccccctctatctctcccgccgccgttgatctatcaccgggccgccggtccgtgactgtcgccagcggctgctggttgttgcttggttgcgtcgccgcgggacccgtgacccgggcgca

SEQ ID NO: 6486 - DNA, 317 bp, Zea mays
tctcccgcacgaacgcgcccatcccgccctgcttgtactccctgaacttgtggttctcctggaacttgatgaggcggcagggcatctgctcgccggcggaggtgcggttcatgccctcctcgccgctgttcgggtcgtcctcgtcgtggcagatggactgccagccgtcgtcgatgagcaccagccccggcgggcagccgccctccgccaggcggcgcacgccctcccacacgccctccgggtgcaccttgaggtagaaggcgtcccacgtgcaccacccgaacttgtccacgatcggcggcggcgtcttctcctcc

SEQ ID NO: 6487 - DNA, 1466 bp, Zea mays
gtattcaaacaccccctaatagaccagctaaatcgttagttatatcatttaaattgctatttagttattagttgcaagctaacaacttattagttgattaacaattagctctaaagatttagagggacctaagatatatagattataataatttattctcttggtcctagaatgtagtctctcttgctaaatccaactcatatatcctgatatccattcgctcagtcaaaatgtgggaaaacttttatgcacccttgtttgtcaaacgttgaagtaaaatgtttgacagtttttttaatcttattgtcgagctttcatttcattttatcagggcagcaaggtaactggtttttgccagcttttgctcttagcaccagcagcataatagcaaaagtgctgattttttttgggtcgaggcatattgacaaaagtaaccacatatcgtgagacaaactttccctctcgtgaacagcaaaccaaagattcatctggaagttaattgaattttacatcgaaccaaaaaaaatcacctgttaacgctactaaaaacgccaagaattcactttttttttcctgaacgtttggcactcgcagtaatggagcaaagccaaacagagccatagccgtcagttatgtgccgtaaacctgacgagtttctccaaaggtcttgcggtttcaaaaggcaggcgacggcgacccgaaccgcggggaagggccgaggaaacaagattcgcgagggggagaaaaggaaaggagagtaggagacaacacgaggcgccgaatcgaaacagggaaagccaaggcccctcccccgcgtacgcgtcactgtgcggcgcctcccccttcctcgctccgctttctgctctgttcgtgtgtgagtcgttgacgaaaccccaagtccatgtgggaggttttgacttgatccaaccaagaacgcgcatttcagccgtaaaatactcgtaccggtttccaggtccggtcgcgtcttgctctcttccgtccctcatttgccttcccgtccctgctattcgcgtgtgggcctttgcttacccattcttgcttccgctgtctttgctgcgtgtaaatctgatccagtacttgtgtgtccgcgtcactggggattctttactttaagttggatttggcaatgtcaatggaaggagcgatatctgatctgaattggtgacatttcttgctgctgctttggtcctggggtgggcggattggagagcgaccactgtcttgccggttgcttttggggtagctactgttcttgtgaatttctgatgcggagtttcgctcaggatagggaaaggagtgatctatagatttctaggcttctgtagggaaagaagtgatctttgatagatttctacgcttctgttggcgattcctcttcatctcaacttggggatttctgccgaggagactttcctgactggtttgggttcagctgaggagcagag

SEQ ID NO: 6488 - DNA, 1137 bp, Zea mays
tctatctcgtttcaaactatccgatcctaaatccaattaaaataaattaagtaggatatagaataatctattatccgacgtctgtccgttttcacacctatcccaaggtcatttcggttaatctccacacgcatcgcggacacggagacttgccttccttttggtgcggaaaaagaaagagaggagaagcgaaggaggttctcagttggagcggctccctctccccgcgcgcgccaccgcctccgatccgagcagccggtgagtctcctcagagtcctctcctccgcgcggcagcgccagttctaggctcttccggagccggaaccagagcgttcccgctggcccggatccttgggtccaccggtcccggcggcgcaaagctctactctgtttcctgttgcgtgttggatgcgtctctttccttccttagtgctccccctttcgctggtgaacgcttattgtggttcgtttagctccgtctccgtggagagcctctctcgcggataaccggtaggcactgccaaggggacggcggcgcctggtgccgtcggccagcgcggctgcgcggtgcgcgcgtctcgccgactcgatgtgccgttgcgtgttcgttcgtttcttggactacagtttcttactttctttggagaaaagtccgctgtttagaaattaagcttcggatctgaaataagcttctagattgtggaatgacgcgtcttttctgactagtagctcgcatataattctttctttacgaaaaggactccaggtggttacttgggatctacgtgctccaagaaatgagcaatagccagtaggaatccgtaagctgcgagaccaatcttcatatttactctgaaacagtatggacagtggtaaacttttttctcacgagctgcagtcataattcgagagtaacaagcagcggatgtcgtaatggttagattggatggatggatgctactagtgtagaaaccacttgatgatggttacctggtttctacccaatacccaccagttccatttagatgatggttagttcatcatccatattgttatgcattactgaactgttttttctttctcaatttgcagcctacagtcaacccattcaacctcaaatgttccttgtgaggtatc

SEQ ID NO: 6489 - DNA, 1500 bp, Zea mays
gtactttgtgtggtaggttacaaggaggctctctagtgtcgaaaatgtagagaaccgggtggatggctaagtggtgagatgcttttgagggggtgccccctaggccttatatactcgaccggggggcattacatgcggataagataaaaacgtgtgcctaagtaatagtgaactgactgagtctatcttcctataatccagccgacctatccccgctctgttccgatgtataaggcccctgcgcgggaaggccgggtctccgttgcggtcgtgatttaaactcgtcgagccatatgagtttgcgtcgatctgcttctttagatgttcctccccaggcccacgaaggaacgaccctgtgaattattgggcccacgggccttttgcgaggtcttttacccttccggtggacccggaggatatctgtcccccacaagcccccgatctttgggttgatttttaaaataaccggcccaaagatcttaggtccagcttgtggccttttttgattttgataaggaatgtcttgaaaataagtccaccgggccactgtttctgaactctgagtgatccggtaaaaacgaccttttactgtcttcctccgctattattcctcaaagttcggtgttctgtctcaggcttatgcttcggaggtcagcattttgctctatagaacttcaaaattcattgtgcacccaatgggtgtagcccccgagctttgagtggatttttgcaaataatctactcgaaggtcttcatttcaagtcttctcagaaattacttttatcttccacttgtgctttttcagaagtcagcattgtcttagtttcgccttatgctttagaaatcagcattctgcctcttggggatgatgattcgttgggtgcactgaaggtgcacctaatgggtgtagcccccgagcttcgagtggatttttgaaaataatccactcgaaggtctttatctcatgctgtttttcagaaatcattctttccttttgtcgaatgccttagagatcagcattatatcatcaacattatgctttagatgtcagcatacatttttgtctttgagatcgagcgcgcgatctgcccgtatcttgttgggtcttgcaatttatttgatctgcgactgattggacatttggtagatggcctttggctagtcttcatatcacttcgtgcttcaatgcttctgttgattagacttgtacctcatcggctatatttggctttcctctgatctctgttgatatcttccttctgtcttgaggtattcattgcgtatactgtatggatgtgactgcttgggaaaatctattgaaaattcctggacgtccccccccaatgggtgtaggcaagggacggcttggtgcgctgagcgtttagcaaactactcttgagtagtaacttgacgtgaccgcgggtgtaatcatatcgtccaagcagttgactagagtcccaatgggtgtcgtgttacgtggaacggcgccagccgcctgac

SEQ ID NO: 6490 - DNA, 1132 bp, Zea mays
ggtcagtctgcgcgtcagtctgccagtcagactggcagacaggctgccaggcctgccaggggcggttcaaccgccctagggggcggttcaaccggtctcaggcagaaaaatctgcccaaacggctagttttgagctccacctatatatactacctcctacctctctccccacagcagtgagcacgatttgaactccatttctaacccaagaaacacctccctctctctctcacacatctcttgcctctcccatttcaaatctttggagagaaatctttgagtgagcttgagagctgcggttttgtgcttcatctctaaatctctcttgctcttcttcttgattcgagctttggtactacatcgagttctttgtggattcattactcttggagcttctagctcctagacgactaggtgtctcttgtgagtctccaaatcttgtggaagaccacaagaaagtttgtattacccgctcgtttgagcaaagattagtgtgtgagcttgacctttgtggtcggcaaagggaggattagggttgaaagagacccggctctttgtgggcgcctcaacgaggaagtagggcaccttggtggtgtgaccgaacctcgggataaatcttgtgtctcttgtgttcttgctcattgtgtttgtttgtgttcttcgttctctcaccattgtgtggaagatttgtttatatctttttggtgtgtggattttgagaagtgtccttctcagatctactactttgaaccctgtggatcatttagaacatctcatttccaaagttaactgggtgaatttcgagatcaattcagttttacccagtttgcttctagtttttgttgattaagttttaacttgcctattcaccccccctctaggcaactttcaattggtatcagagcctaatcctcgttctaacgcttaaccgcgtgaggaaagatcatgtcggggggactaagaaacgaaagtgcttctaagcttgaaaaagttgaggttgtctcgacttcatcttttggtgcagatgttgatcctagggcaatagatcttgccatgagaatcgccgaaaggatgttcctcaaaatgaaagaagatgaggcgaagaacaagattgaagaagaagaaatgatcg

SEQ ID NO: 6491 - DNA, 641 bp, Zea mays
ggtagattgattagccttggaaactcctctccttttcttttcaattgaaagaagcaacgatgtgcaatttgcacggcacaattacgctaacctactgcaaattttgaaatggaaaataacaacatcctttgcatttttatctcaatgaaatgataagatagtccttctgtagtcttatatacgtgttcagcatccatcaagaaataactccacgcctcgttttttaagaggcgagcttaacatttatgatgcacaataagtataattacattaagcacgataaacttcctcataataaaatatattctctataataaacatactagagatawaaatgttgataacagatgcgcagttattttttgagactggaggaataacctgttgtgtgctcgcaatttcctaatgcggcaggtggctgcggtgcgtgcgtggtccttatctccaagtacaacccggccaccgacgaggcgaccgagttctcagcgagctcctgcctgacactgctccgtagcattgaccgctgctcagtgaccacgagcgagggcattggcaacaccaaggatggctaccacgcggtgcagcagcggctcgcaggcttccacgcttcccagtgcggcttctgcacgccgggcatctgc

SEQ ID NO: 6492 - DNA, 849 bp, Zea mays
atacacaaaacctgcccgtttgacagcattgatgttaagctgtaattttttgttgcttctgtggaatgtggatgttctggtttcatcaataagaaaaataagctttcaattgccgttgtcctatgcgtcatattttatgctacacagctacagccacagaatgactcgttcagaacgttatattttggccacttgctgtggagtatgctgacagtttttgagaaacccacgctgcatgcctgcgtctgatctagatcttcgcccattaggtgacaagattgatgaccttgatctgtctttgacatcttttattcgtctttgataaactgatttatctctgaacgtcaatattcttgagtgaaattcagatctggctcatcttttggggtcgaaaattccacctggatactccgagcttcagcagccaccttgcttgaagtctctgggagaccggcactgactgaggtcgtgggaacgtttgctttctacgccaaacgtctggcccaggctgaagcaaggaaaccgcaataattcgcgccaccatcgggacggccggacgggagccacgccaaactaagaaacgccaagttgccagccaaacgaaccagctaaaacaagggggggcagcaccgcggcgcggcgcggcgtggggacagagccctcgtgatcgatccgtccgtgggatctcgcgcacgccaggattggagagccgcggcctccccccgccccaaccagccatgggttcccgcgcggatcgcggctcttagacgcggaggaggagagagacagggggaggggaaggccgaggcctaggaggcgtggtgcagcgcgcgagcgcgttcgttcggc

SEQ ID NO: 6493 - DNA, 1500 bp, Zea mays
tggcggatgaactcctcgtgccagaaggtcagagggaacccatgaacagacaagaccgcaagcacatcaaccggctgtttgacactcctcccgtcgtggcgctcgaagaagatcgccacatcctcatgcaataggggggagcgactcacagcagcagtacaatcacctgccgactgaaagcgcaccagcaacgatccgaacgacgaggggagaacctcgaaggtgatgagcgggaaagcagcacggatcgcctcccgaataaatggtgccggggcagacactgccaattgcggagttatacgaacaaatgcgaatgcagcggccacgtcgtgccggccgagagagagaaaaacttcgagggatccctggcggaccgagctagtcagggaggcacactcgacagtttccgacaaggaactgatgggggtaacaccaacaggaggaggatgggcggaggtggtggaaggggcgtggcgcggtggtaaagcagggaatgcagggagaagaggcgaagtaggggagcgggagggagccggtggtggggcatggtgttgggaggttagaggagctgtagcagccatacgaggcggcgacagagagacctgcggcgtaggagggagaagcgtagggcagcggtggggcaagggggttagtttatggttaactggcatggggcactcacgacaacggtgaccctggcgtcgacaagagcgacagcggatgggatcccggcaagcagcaatttggtgatcagtggcgaagcagcggaagcaggcgaactgttttatttttgtgggggagcgacgagagggagaggtggatgagcgggcttcaacagcgccgagcaatagcacgtcccggacgagagggaataataaatttggattttatatttctaagtgcactctgaatttataagtttataacatttaggggctgtggtataactgaataagttcaaaaatctaaacaagtgttttttaagtttagaaaccggaatgatataatcagcaaccgaaataacatagataaataagtttgagatctaaaacgatggtatttagaggacgcgatgacacggctgaatcacggcccaggcacggcccgtgataagttcattgcgattctccgccacagagcaaaggcccacgaaactcagataatgtcgaagcgggttgaggttagagcgcacgagaatgttcaagagaagccgacaagcgtggagaaccccgccccgccgtcgcgaagctctctcccctcgcactcccgggaccaggctacggcatctgtccggaagcttcaacgtctttccccatccttccacggcactcgtgacatgacctataaaaggagccgtcgatccacggtctccaaccaggaaagcaaagcgcttcgcaagcacaggcagtgatcggtaaccaaatccggacagtcttgagctctctcagtctcagcatttcagttcccagattcacatagccccagcccccaagtagcgaa

SEQ ID NO: 6494 - DNA, 797 bp, Zea mays
gagctcggtaccctgagtctaggtggatgttcaatttaacggttcataaaactggtatataaacatcatttgtgaacatttgaactcatcttggctaggctggagcaatcccctgctgtgagtaacaatgagttttttgtatcgctcttgtttctgctagatgcgttcgaaatagatctaatgtactatatggacatgattttatttgttacgtgtagtttattcattgctcatgcaatgattgctttagagactaatttaatcaaaaaaggcgcataattatgtaacgattattattccatcggcgccaatcagctagcacgttgtcacatggagagcttgccatcttgtctgctcgtcaaactggtgcgagaggccctctgtccgccaccaaatttaaattcactgcttgctgtggaagctgatttgagcaacacacccctcatcagttcatcagcacactcctgcttccgtatactatgctcctcgtcctgccccctggcggccccccatttagtttgaagcggtgctagctagctagctgctttgctcagctcgcaagcatgcatataaactcttgtctcttctcacgcagtgacgcagagctagctagctagtagctagctgcgcaccggcagtacgtagatcccgggcgggcaatcgaaccgcaaacgcctctgggtttcgggaagggtgctttgctctttgcagccagctggccggccggccctggtgttttatataacttggaaggttcagtcgctgacagagaggaagaagaaggaaggaggaggagg

SEQ ID NO: 6495 - DNA, 544 bp, Zea mays
ctgtgttttatgttttatgttgcattatcaaattaatcttagcccctaataattttataacatttaagtgacacatcctgtcaagttccgcaacccaattgactggttacatgtgttctagtcgttaaccttccttcgctgcgtgtctaggtatctcgtatggtgtcgtgacggatgccatgacgctgtcgtcgtccacaaccacacggtaggaaaggaatccatcgcgtcgctccctgcctgcactcattcggagcatcggcacacgtagcattggacacggaccggcagcatcagatgcacacggacgacgtgtacgtttggaatttaagtaatttttttagtggaagaattatatcacccaccacctgctgttggatcgagcgtgtgcgtgtcggtgtctgtgtctcatcatcgccgtcgtcatctgtttaatactactagtcacatgggcatttgctgtagctttctggcatcgctactaccagacagagaggacaggggaggtcagactcagaaacgctcgctcacgacggcagcagcc

SEQ ID NO: 6496 - DNA, 144 bp, Zea mays
gaaccctcctccgatccaaaccctcctcgcatcgtgccgcatgcctccacgcgccacgaggcggcggcgctgcagctgaccaccccacttgaccagccggggggcagaaagagagagagagacaaccggacgcggacggcaggc

SEQ ID NO: 6497 - DNA, 1500 bp, Zea mays
agcaaactaaagtttagttctcgtactggtattattcgctaaggagaggacccacgaagaaattcacacttaaaaggtgtatagatttagataattcattttatttattatttagattaaaaatatattctaaactatttattttttatgggactgctctagatctataaaatttggtagagttggaaaagtaggttattatgtgctccaaaaatcatatagctagagttgtgaacttttagaagattcctttttgtttattgtttatatttaaaatatttttaaactatttaaatttatattataaactacagtttcacacttgagcttcaacctagagcagtctcaatcacttctataaactacaactttacgctaaagctagaatagagtagtcctaaatactccctatatcacagctcgatagcccgactcaatttgttaatggcttgatttgactgacttattcatatttttgaagatagttagcaaacaagtcatctctaggctcaaagactaataattgaaacttatcggcttcaaacttaaggacccttttggaaaacgggattttttttgtttcatgtgtttttcctataaaatgaactagtttctgtaaaattcatgtatgatccctctaaaattcctgcattctaaaggaactctaagctagctttgtattacacgatgtcctgcagtttacagtctaacaatagttagatttagatctttaaaacttagattattatgtctctacaaatttgtttttaataaatatatagatatagataatctgtaatggactatgaatatatacgtgtagtatgaaatatggactatagatatatactggtttattatcgtacgtacatatacatatgcacgctattcatcacctagggggtgaagattcacccagcgataattactaagagatcttcaattattacacgctagttgaagcttcatctagattgtagagtgacaaatagtgctgccatatacataaacacaaatgtatacacatatgctatataacacctagtgtgaagcttcacccaaactcaattggcccaaccgaggagccagccatgcgccatgatttttcggatccacacaccatttttatcggttccattggtgatcccagaaaaaaattaaacataatactcggacccacataacctatttcgcacattggtttgacctaacgtgaccatagctgcgtgcagctgtggggctggtacacaccctgtggtgtcaacacaacctattcggaccggcgggtgcagggctgcatctgcatgcggtcattcctgtgagatccagctttacagctctgcgcgggtcccattgtcccatatcttgacaggtgtcttgactagttcaacaactcttcttccaacggcctgtggcggcgacagttgtccaaaccaaatacattgaggatagcacgagaaaggggcgccaagcaaaccgggtcggccagcagacaccgcc

SEQ ID NO: 6498 - DNA, 176 bp, Zea mays
ggtttgccagacactgcagttggtttgcatgcttgaatcagaaaattgttcacacttcgcattagtagtagaaatgcaggactgggctcgctgtgtcccagccctggttctgggcacaaaagtgcaaggaagcatacttaaaaaagtgtagaaattttagtcaaaaaatctttagc

SEQ ID NO: 6499 - DNA, 893 bp, Zea mays
tggtaaaaccgaaagatcgctactggattattatgcctcctcacttgtggcttatcgtggagtttggagcttttatgcactgcagcctggcagccagaatggactagcgatagattctcaaacagctgatcttgacgaaaaaaaatgacggatcgagacactggacattcggtcgccgtcggagtaaacctgatcatctagatggtagacttttggtggaagacaccgttctttctctctctgaactctgaagactcgtgacctgccgtgcgacgtcctgataccaactgcggctgtgtaccaggtcgacggggagatcggatttgctccgtaaatacgcactgatgcggttgcttatatgtcagtgcgtttgaagtcttctttttcatctttctctctttttggttttttaggcgcacctttctctcattttagtgagagtagttcttttcctttcctagacccaaacccaagcagacctgtgggccgtggccttgctcgagaccaacagcaaatttcggctgtgcctttgtatgtcctaacaagcccatagtggaagaccggcccggtccacgaaacctgttctctcctgttaacgattccatagaaatacgccgtcgtgcgtcattgcttacacgatagtgaccacgcacgccgcgggccggcaaaccgtaccgtcgccggaagattcgtattgcttgctgcgtttcgactttggattggacccgtccccttgcgaccaaccgaaccgcccctcaatcgtctctctgaatcatccctctcgcactctcgcgctgcacgtgctctcctccacgggccaccaccacaaaccaaacgcgagcgcgacgcacgcgcgcaaaaagaagatccagcgcagcgagcgcgacgacata

SEQ ID NO: 6500 - DNA, 470 bp, Zea mays
cactgagtcattataggtatataacttgattctaacatacatataagatgtatctatatttgtcctggaatctaagtgtgacataagaacatctcaattttaacatttgttttttaaaatgtagacttaaaatttgatatataaagaaagtaaataaggaaatacatctataaatatttttaaaacatttcttattgtaaataatttgattatatgacgattgtagggaaagatgaattgtaccaccgttttttccttctctatgaaagtctgaaaatagctagtgcggagcgtgcctctgcggtccgataggcgggttcgcatccggccatccgatactgtgccagtgcggccgcgcggcggcggagcaaccacgcgcgcagaccgccgtcgccacctcctccctccctccgctccccggcgtgcgtccgatccaccaggaatcgaaggctcccacacgccccaacgcg

SEQ ID NO: 6501 - DNA, 501 bp, Zea mays
aaagatgacgcatgacgaccgttgaaactggtgctttaagtatagtataaatatagatattaactatatatttaataatcttgtctcgtcttttcatcttcatttatttaattaatttttataattagactatatttaatacacacaattaatacacacaattatcacttgtaaacatttgatgtgacatgacccctaatcatcagggagctgatggagtgatgagcacgagacgtgctatttgcaattaggcctgtcatgttgctggtccatcttttatcagatggaaagacaaaaaaaaacgaaaaagcgttttaacacctcgcgatctaaaaccctagctttctccagacagcccttcggaacatcaggaccgttggttgcaatctgcgagccaatcgagaccgctcttctctacttccgctgctacatataaacctgcacgagctctctctcgtctccggcggcggaagcagaagtggaaggaagcaggcggccacc

SEQ ID NO: 6502 - DNA, 570 bp, Zea mays
ccgaatatcccgattacctgctaacctgacatgtgggttgctagggtttggaaagagtctcccaatcccactcatccggttcgcacacggcacactacagaccccgcccccaacctcggtctttcccagtcccagccgccaccgtgcgtctgtgcaagtggccttcggcggtgcgcagagcagagctggtgacgtggcccgtggtgcgcgtttccctgcagcctcgaggtctgcacgccgccggcctccctctcagcgccacgcgccgccggcctccgttgctcactaccggacttcgcacacgcccggcggcggccgaccatcctcggaggtgcagttacgcgcgccgtaggaaggtaggttcccttctccggccacagttgttttaaagtttaggtagaaatatcctttcctcatcgttccacgggtggttcgtgccccacgccccgctgctttctggatttgttttgatttctgagccttctcttgtgtcgttctgtgttgggttgcggacgcgtcctcaactaggtttttcttccatcatttgtgtgttcgttcaactgagccgcc

SEQ ID NO: 6503 - DNA, 763 bp, Zea mays
gccgaaacaaacaggggctaaacaagatgcaaacactttacgtacgtataaaaataggaggtgaggctgtcaatcccacatcacaaacgacaactttcggttccaccactgctgtccttctcttttgaaacgttaattcattcagcttgttttttttgtgccagacgaaagtcaccgcgtgttggcaccacgggagctccactaattcattcagtttgatttggacgttcggtaacaaacatgtataggatgggatgggaatgggactcacaaaaactagacgcaacgcaagaaagaaccatgcgaaaacaaaaccagacgccgtgcccgtgcccgtgctctcctatcccacctacccgttgtcctgccctgccccgtccgtctcccacggtttccgcgtcccacccatcccttccacactttctcacccccgcccttctcaccccccgaaaaaattcccccggaaatcagagacgcgaatccctccctcgccccacgtccgaggtcgctcgccaattcgatccgcctcgtcgtcgcccgcccgcccgtccgccggtcgaccttgactgctccgtcgcacgtggcgtttcgcagcgcggaatctaccctgggttgggttgggagatccggggaaacccttgttcccgggcgctccgggctcgaatctcgctgcagacgggcaatgtgagcgctctccatcggagagggacgatctgcggggcggttgttggccgggtgaatcgtgcggtgcggggttgcggga

SEQ ID NO: 6504 - DNA, 228 bp, Zea mays
aacgtccacattaggtcatcgattgacgtgttgatattgtgactgactcgagaatatgtgcaagaaaaaataagaaaaataaggtaaatctgacggcccacgagagcccataaattctgccccgccgcctcgtgtcaaccccgtcactcttgtgtcctcctaaaaccctaaccctccgccgcccctcggacccccaaccagcagctgccgcggccatccgccggcgag

SEQ ID NO: 6505 - DNA, 1500 bp, Zea mays
gtgcgcgcgctgcctgcctccacgagtccacacaccccatgcaagatctcggcacgctctccggcgagcacgggacacagacacagacacagacagaggagactgtcctggccggggactgggagtgccactgccggccacacagatgcatccggctgctaccaggcgcttgaaatcgacggcatggagagggagggagactgggagagagagagatttagttgccgcgcgcattgaccttaggggagaaaaaaaaatatgctaggttacgagggggtagatctgctgaagtttaataatagcaggctagcagctgcaaagcgggcgtcaaaaaggcgtgtgggcgggcgcacgggcagatggcgtttctttctcggttgaccacgtacgcgggcgatcaggcggtggtctgtcagatctgagccgaaccccaacaacagtctcgtgacaggctagcctttcgtaaccgaatacttagggcatgtacagtggagagacaccaaaacggttctccaagcacaggagacaactaagagactctattgtacaatggagtgtctataaacgtagtctattaataaatacagaattaaatgtatttgtatagcatcagatcgatagaacagacgacaaattcgtacagtgggaagtgaggcgtctgttgttacttggtttacgagccagaggcgtctcttcacggagagacggctctaagatttttttgcaaataaccccctaaaacaccttaagagcccccacattaaacaccactgtacatgccctaagaactcgattttggccgccgcccccatcgataaccatgagacacgtgtcaaaacgtggccataagggcatgtacaaccccatttaatttggggtctcttgaggggtctctaaggggttaagtgaaaaaaaaatacaagagacgagaactagtatcttcacaattctctatacatgttgtctcttaactatacttatgatacttaatctcagagttgtatcatacaatacttaatctcagagttgtatcatacaaggaggttcagagttagcaatgactaatatgtaagcaatcattagatgtaaatgtgccagcaactctcttggttcgttagatctagatatagtcgtatgtgtaatcatggcttgttagagcaagatgctggcgtgaggatttaaacactaaatatgagatatatatctatatgtaacgtaccaagataccttgcatattactcgcatatgagtcgttgcctcgcagtttatatccctactgtttcggactttcgggttttggccgacacccgacaatcttaacatcaaactcgtcgtccacgcctcctcggcaaggttgcgtacggcgtggccctaaggttcatctcgccgcctccctcaacctcttgattccgcctccctcaacctcttgattccgcctccctgaaggcataccagcgggatcaagctattttgctggccaaccgaacggtcaagccgacg

SEQ ID NO: 6506 - DNA, 457 bp, Zea mays
cagggccccctcattgctctgcgcctctgcctcgccacgcccacggcccacgggcccacttgccaaggaacatttgcaggcctgctcccttcccttgcgcgcgccttccccgacctctcggctctcgcagtctcgctctgatgcatggcgactggcgaaggcgcattggcgcgggagtcctccggacaaggcatgcatgtcatcatccatgtccctcgtggccccttgttgccctacacgtcgcagagccacttgtacatctctctcgtctcgatccactgcccgctcgctgccccgtttatagcagtgacaggctaccgcgcacctcctgaatcctcctctcagtcacagacacactcgttcgctcgctctcactctctgctgttcgtccatccatccggatccgtcttcctcggtctcccacgagcagcgaggaggctacagctgggaccggcca

SEQ ID NO: 6507 - DNA, 1485 bp, Zea mays
gttgagatagttcaacatggtagttgagagaatcagggaaagaatagaaggttattagtttagagaatctaggaaagaatagcagattagtagtcgagaaagtcagattaatggattaagaagaaagttgttccaaaatcttcccctctgctaatccggtcttcctcctttgttgtcatgtcaacatcagcgtctagtcgatcgtccttgacaaaggtgaagccagggaccgcctctcgagcccttgcctcttcctcccaactgccgaacccataacaagcaatgttgtgatgtaatattggactttggaattgctactggttttggatttaacttgatcatgtaacattgtggacgctcatgtaccgtgattattcagatggctttaactgcgccacacctaagaaaactatggaatcaaacaagcatcggtttcaagatatagtatgatttcggtacggtaaaggaaaaccgtagtatttatgctatggacagttgcagaaaccatggtatttcaaaaccacagtttttaaaaaactaagttaccaaacagggacttattgttattgccagagagagagaagttaagggtcgatgtcgatgaggcgaggtgacgcgtcagcgtcaactgtactgtcggagatagaggctgcactgcctcacgctggctcggcctcctgatttggccagtccgggacaccgtaggtgtctctgctgtcccacatcattcaaggcagccggcagcgcgtcgacatgcgcacggccgtcctccgctggccggccgccacctcccatggcaacgccgcgcgccctcgcgttgagacttgagagagggccaactgccaagagcatccgcccgcattcatggccgccccgctggcccgctgttgcatggtgacccgtgtcgatctgtggtcaccgtgcgccactgctcacggtcagattcttcgatcgggctcctttcagctaaccgtccgcgcgcgacgatttcagctgaatgcacaataccgcgccttcgagtccagccagcatcttcctccgttccatcaacgtcctcgctctctgcccccggccgtaactaccagcccaatcaatggattggcacgtacatgctgcggccgccgcgtcgtgcggtgcctgccaccgtttccggccgccgacctcctcacgcacgcagctcagctcagctcatgggcgtccgccaccgagttggggtcggcgggtcgccgccgtcgccgcccatgcatgcccggccgtccgggtgaccagatgcgacacctccttgggcaccgacgacgccgtcagcgcatacatctacgtgcatgcccacaaggccaccgccgggctccaaggggagtggagtgtcatggagccatgaatatccatgcctaacgagtgacctggaaacagggacaacacacaaaggttccggtcccctcccccgcggtaccaccggctgcattcaagaccaaatctacaggacag

SEQ ID NO: 6508 - DNA, 149 bp, Zea mays
aaaacaatgttgcctttttagagcgaccagttgagatcgagaccgaccacaccaaaaatccatctcgcaaccagctccgacaccggccagcgaagatccacctcgcaaccagctccgctgctccgcagctccggcacagactagcgagg

SEQ ID NO: 6509 - DNA, 127 bp, Zea mays
aaatttgcttcccctagggatcccgcggttttttagtgtggtttaccggcgactgtgctccctgattaacctatgtgaatctggatgggatcacataatttttatctacatcttttattttaattct

SEQ ID NO: 6510 - DNA, 312 bp, Zea mays
ggtcctgatctggcttcacaattggttgcttcgaatgaagtcccagtccatggttgatcaattgcgcattttgcctatttatttccttcttgcagttctgtgaatagtgagggtgtgtgcttcattgaaagttgaatcgctcaaagtgccatggtttatcgtttctggagtaggcatccaaatttttttttcagcttgtcattgagcatgccatgtatattgcttgatattgtgttcatgtttaaaattcccaatcttgtgtatattggatttatatgtctttggacatcctaggattgttgcaatacgtca

SEQ ID NO: 6511 - DNA, 206 bp, Zea mays
agtttccagttcagaggaacaatcagccacagcagcagcagtagtaccgtcaggccaatgacaacaggtgtttcacttgtggtaacaccggacattatgccaagaattgccccagaaaccagcagaggcaggggcagaatgccaaccagaaccaaggcaagaggcagaaggtgcaagtgaggcaaggcagactgaacttcaccacc

SEQ ID NO: 6512 - DNA, 1500 bp, Zea mays
cactgtgagaatgtctacactttctctttcgttcattctcgtattccttcagtmactagctttagattatgaactgccagtgagttatacgtttatgaaacatgttattttttattttattattgtcggaatcattttgttcatcactaaattgctgttatttctaacattctagtgttttgttgcacatagaattgagatttggaatcaaagacccaattctctggaattggactataactagaagctcactcccccaatacaaaagcatcacccctctatattgcgtggaattagaccgcacaattccaaactttaattcaatgataaccaaataatagaattggaactacatctcatttcaataccatgactgttttggtacccaattcaattccttacccgccaatattgacatccaaatggagcattagagctggttcgacgataagagaactggagaggaaattcattgctatttaaaattgattagcaggggattttctctcccatggatccactctgattcccttgtcaccaaaccagctcttatagagacgaaatggacatgatcggtcggaataaccactatctcatttcatttccatgttttatttcaaaaacggcatcattggaaacgggactagcgaatgacgttaaataaccaaaaacgagcgaaataaatcgataacaaattagaatcagacgtaaaaagcaaaaacatcgatgcataaaatatattatatgcatatgggtaccaacgaaaataactaattatgagcggaatgacgtaaatgaaccaaaacgatcgaaataaatcgataacgaaccagaatcagacgtaaaaagcaaaaacattgttgcataaagtataaaaataaagtagtattacgatcaattgaaatattccatctacacatatggaagaaatatattattatatgcatatggatactaaagaaaataactaattgtgaattagtttgttgtgatgttatatagtcgtttatgatgtgttcgctatattttctaaaacgggatattatagatagataaaaacgagatatcccaattaaaaacaggaaaagcaaaaacagtcggaaaaacattcgataggataccaataaatatgaatttaaacgctttaatatataaatcggaacggaacagaacgagatatattccgactttttttcagtcctctctttcacgtgagcaggaacagcaggagggatcaaaggtagggtagggagggtgccaggccaactaataaaaacaacaaatcttttcgccggtcgccatacatatttgcttactgctaccaatttgtcggtcttcaggcccatctccctcattaatgtcttgccttttaagcactctttcgtccccaactttacacctctacatgtctcatatctctctgtctgtccaacgatccctctcctttgtcatctccgtctccatctcccaagcaccggagaggagagctagcatgcctgg

SEQ ID NO: 6513 - DNA, 643 bp, Zea mays
caaatatttaacgtgacatagactaactttatgttcaggaaccgaacacctcttttagttcgtcgcgtcgtttaccagctactgctagggattgtaacgagctcaatataaaatttgaggatggaattaaactagagtcgaactctatttctatttattttaaatttaaaatatttaagagtcctaatttattataaaatatatttagatcatgatacattacaatttaccgccgtgtgcgcagcagcacagatccaccgccgtacgttctcacagcaaagaacaacgctaccgtgcattacacgaggacatagccgtgaaccgcgggccgcgaagtgcgcgactgccacgctggtgtcgggtccacgccgacgcccaccaccgccccacggccaaccaggccagatcgcacctgcccgcggcacgcctgacgcctccgctgcaatcatcagcagcgcgccaagcccgccacccgctaggccggtggcaaaaacaagttcccggtcacgtgtccgactgcccacggcacatatgactgtgagatgacccgacgccgaccagattgacctgttgccctgttgagtgtgaaggaggcgcacgcgcttgagctgaagaaactgccgcgctgatctagcccgccggg

SEQ ID NO: 6514 - DNA, 1500 bp, Zea mays
gtttttcttgaaacgaacatgaatgcacgtcactggggaggagttgggaggcaggcaactggtagctcaccgaccaaaaggccaactgtgcgggacggcagggcgaaagcagcccaggtaccgctagcacggcgacaagcgagcgagagagcacgaaagcggcggcttcgcccttgcacacgtgctaccgcatctgcatgccccgccccgaccgaccgcacgcgtccttgtctcgttcccggccggcggcctaccaaatatccagcggtccagccgacgcgagcgccaccagacgcggtgctttgctgccccccgtactactagtgatcggtggccccggtcccggatgtctgaacccacgccgagcacgcggcaccggcgaccaatttcttgccccgccagcccgacccgtagggcgcacgcgcaccggccgtgcgcgaggcacacgcgcgcatcggagagctgcgtgccgtgcgtggctgcctgcctgcccgcggtcaagtccaccgtgcgagtgacgcgacgccgacggcacgcggtcggcggttgcgctcgcgggccatggccgctgactgtctcgcaggcagcaccagccctcggtggccatatctttcgagcacagaagaaaaaggagaaaaaaaagttggaggaggtcgcgaataccaaatcccactgcgggacgggagacgtgcaacggaaggaagagtacgctaggagaccagcttgctttgaccgtccgccgggcgggcgtgcgtgcgtgcgtggaaaaaaaagagctgtctgcgtttcctttgagcgggacgtgtgtggcgaaacaagggacgggagtggccggagactgcaaacatacgctggaaacttcgccacaaaaataaaataaaataaaataaagcatgctagtcgtcgcccaccttttcttcccacctgtaaaaatcatgcctgctgattagtggaatcatagattggtttcctcaagggtcaatcaggaattcacctaagctggtggtaacttggcagaaaaggacaaactaatgctcctttttatcggcgacaaatgggaacatgtggaattattagccgtgcagtgcaggtatctatctcactgcgctgcgctacaactgcgccctcgtttaacagcaccatgctccgctctttggtttggtaaccgctgagtgtgagtccatttcgtggcttctatttatttttaataattcaaaaacggaagcaaaatgatgctccgatatattggctcgcgtaacgcggccccgcccccttttttatctcaacgacccttcccttaccttcccatcccccatttcctcaacggaccccgcccgcgatttcactccttctctcccccgcgcgcgcggcctccccgtgcccgtgcgtgcgccaacacggggcagccaagccaggccaagccggtggaaagccccaagcacccggccagcacgcgcagtaggccgccgaggcacagagccgcgggccggcgcttcggct

SEQ ID NO: 6515 - DNA, 585 bp, Zea mays
cttgcatgcctgcagcgagcattttcaggcaacagtggtaactattagtagtattattctctcatgcgatcaacatacatagtggctgtatggatggttaaccatggttgcctcttgaccgcactaccggcgtggcgtgacctaacctaacccgagctccctccctttcgcccccctgtctccctcgcccacgcacgccctttattaaggcacagaggacagcacacagtattgtgggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtcccgcggtgccctccgaattccacttgatccaactctcgac

SEQ ID NO: 6516 - DNA, 1367 bp, Zea mays
atctatcaacttaagcgggaaaattgattcaggataggcacatgtttgttgatctttgaacttttgaggacaatgagattttggtttaccgagctgttgccgtggcttgacatggttttgtgatcctcctttttttgttacattaaattattaaagcagcaagtcatcattcgcatcgatggtgctattgccccctgttttgatatctgatctcgctgggaatgaccttgctctctgtattgttgtgctcagagttttgatatcgctggacaaggcattgcactccctatcgcttgaaatcgtctctgttggtgctggtgtataaaactttgacgtgtgccgtttataatatatatgtaactgcaaaaccaagtttctatacaagtcaaaacagtatacaatttggatcagaaggtggtgcaatgtataacccttctaaatttaaggatgttttgtgtctgatatacttgttcgctggtgcttctacagtggattacagcagttgtgacttgtttgactttttttagtttaagtttgatcgacttttttagtttaagtttgatcggctcgtcttattcaaaacatatcttattcaaaaaaatcatagttattttaatctttagtatgatattgtttagcatataatatatttttagtttagttttgacttttcatttttctaaaaataataataaaatgaattggtcaaacttggtttaaataaaaaagtcgaagggattataaaatgagatgggtggagtatttaactacctatgtagatgtggaaagcgtattgctgtacatctaaatatatagtggattttttatataaaaaaactaaatatctataatttaaaatgtatttctttttttttaacgtagcataagagcacttaacgataccacgtttcaagaaaatttgtttcattttcagatatccatatctgacatgaaaaccaaatacacggccaaaaaaaagtctgaaatgatcgactcagacaatcaaacagcgaatacataacaatcctggtttaagccacctatggaatgccattttttattatttcctgcattttgtctgtaacaaaaaaattgattgtcgtaggatctcaaataaaatacctgaatttaacggagccatcagccatgtgatctttggcacagccgtttgcctgaaaaaagacaaatcaaaaaggaaaaaagaagggaaaaattcttccattgcgtgcttggcagctcgtccgacgcgccgcagcgggcgctgataaacctccagttaaaccctagtatctcctcgcgtcgccgyacacatcgcccgttcgcacgcgccgtccccctggaggatcgagccaccctcctcacctgga

SEQ ID NO: 6517 - DNA, 206 bp, Zea mays
tgccgccatccatcctttttcccttcctcccctcaccccctcgtcggaatcggaacggctgtcgtctgccccttcgcccccctcttcgatccctcaccccacccagtgctagctagctagctagcttctagtggctagtagctcccctcccctgtgggctgcaacctggtttgggttcgcggatcgatcgcgagatcaatcaatcc

SEQ ID NO: 6518 - DNA, 523 bp, Zea mays
tgcggttgcagcctcttcaggatcatgacaatgaaaaggcgtcccggtcgaaaggacgctttgttctttgtctcgatcgccagagtggagacggcagataaacaccatgtgtagcacgtgcggcattccttgccattacaaaacaaacattcctcactcggccaggacgcacacggcgggagccctttttttaaataattcgaggctagttaactaaactttaaaactgtgtccacagtccacaccacaccacacacacaggagctaatagaacacgtttgcattgtgtgtgtgtgtgtgtgtccacaggccacagcacgagcgatgcgcactagtataaatgagcgcagggcatccccctcccctccccggcagtgcagctggaggagcacctcaccagtggacattgctccagtcccgcgttcgtctcctcccgcgaaataccttccttctccgggtacacagaagagagtccgagaccgctagctacattaacgctagtcccgcacacgcagagtacgta

SEQ ID NO: 6519 - DNA, 457 bp, Zea mays
ggtgtacaatccaagatgcatccacaaaaatatattatcttgcctctctggcacacctgcaaagtcggtacagtccctatctggtgcataactaataatctatatagcctttcatttttttccttttcatgtgaaagaaattactcttgcatgaaccgtaaggaaccccaccaattaatcttgcattcagcactccaaagcccaacctatttctttcgttgaacaggatctgtaagcaaatgcactagatgcaagtgtctcgttaagataatcaatcgaatttgagggagaaatctgtaaatcaaggtttactggtatgaatgttagggtaagccaagagaggttcaccaattggagttattgtctgaagaacctacctggtggatcttcaggtatctggatcagcttcggtacaacacaaagagctactgcagacagaccttggttggaggcaact

SEQ ID NO: 6520 - DNA, 672 bp, Zea mays
aaggtgctttgggtattatataaggacaagggagaggtgaagaaaattttggaagcggcaagcataaggaatgtgaaatatgtgttaatcattgacttgccctgttacctgcatgccagtttctggttcatatttagagacaatgagaagagagagaggaaggatgaccgaagttgacatagagttagacatggaaggaggagatatacccaaagatttagtcttgaataaaagtgcatgaaaagcagctatctatgtgaccgaaccttgacttgtgggttctatcgggtttctaccttaatttacttgggataacagtctttgttgttatcactgttactaggtgagtgcccgtgcgttgcgacggtagtaaaaaaatttgtataaaacataaaaacgaaacgacaaacatcactatgatatgtaaaaatctgtgtggtaaacattatcaatatcacacaaattattcctaaagagtcaattttagagttttgtaaagacagacaaatatgtcgacaaccatacactaatctaatcctttttaccacgacgtagcgacgacaagcacgacagggagaagatcactacgcggacgaactcgatacggagcaacgtacgaaggagaagcggcactcggtgcagcttcggacgtcaggcgcacacggctcgagc

SEQ ID NO: 6521 - DNA, 367 bp, Zea mays
ggggcaggaaaccttacaatgatgtctgggtgaatggtggctgagagatggcccatgaaattatttataaaagtgaaagacacccgcaacgcccgaacagaagcaagacgagctgaagaagctgcagagcgcgaaaagcgtataggtattattttttggtttttagcttcgacatttgtttttgtggcttcagactaattaatttttcctacttcagtgccggaccagtacaggaccgcggatttcctgagcatcggggccgacggcgactcggtgtgcggcatagctcaacagcaactactccgtcgcgtgctgggggaggaccgacagattcggcaccggcggtagcctggtctacaacagcacc

SEQ ID NO: 6522 - DNA, 1257 bp, Zea mays
gcgtgtttttattctgagggagtgtgtgttcctctaaaagtttagtttggatcacgtcttttagtttttatctatattagttagtttttataagtacactatatttaatacctgtaaaaaaatatttgccatttactatttaaagtctgtcaaataaagtcgaatatgtaaagggtcagatcaatcgctaacgtgacattccacctaaggccttgttcgattattccaatttcatgtggattgaagtgtattaggatggattgagatggattttgacttgctatggatttaaaccgactcgataccacccagtccacatggattaaaggtgaaacgaacaagctctaatagggggagggggtcatgtgacctttgaaaaagtttataaacctagatgacacactttacatcgttaatgggggtttatgtgaccttgaatgaatagtacatggacatagataacacccgaaattgtttatggactgttgatgcactttgctcaaactaaaattgaggacacctaaattttagtaaatctccataacaaaaataatgtatatctagaaaaacctaaatgtcttataatcaaaaataaattccgtagtactattctggtcccgcttgttattgaagaacatttgatatttttttggggtgtaaacacctacgcacggaatatgttttgtacaaactaaaacgcacgggtgtattttctacgaagtataagtgtacgtcacaggaataaagcaagatacgacacgcgggacaatttgtcatcatggcgcaatgataagtaaaggcgaaacatgctaatccaagagagagagatagttagagctgtgttgtttttatatctagctagagctgttagcttagagcaatgtatttatgggactgctggcagatgtatttattacagaacgacaaagaaagtacaacaaacgtagtacttatggccgggttgagggagtagtattatgggacgacggaggggagtgcatccaagcgtgcatttactgtttccagccgaattcgctagattgcgagtgtttgtcattttctaatccatttgcagcagtagctaggctgtggtgcagaaygtttcggcggggggcgcagcgcagtggctcgagcacgaggccgataaattagcagccctcggccttggaaatggaatcccaaggcataatttagctactacccctacccccgcgcattggttccgttccatcccaagctaacacaggcatcgtatat

SEQ ID NO: 6523 - DNA, 238 bp, Zea mays
cacccccaacctgaagctggagcctcgccctcgcacgcggaggctcctgcgctgcgccctcagctctgagcctgtggtatgtatagtgtactgacgtgataatctctagctagcactatctcatacagtagatatgaatccatccatgtttctctgccttgccaccaatcaatagacatacatcattactatactacctaactttgatatgcttacttatcggtttcagcagcctccc

SEQ ID NO: 6524 - DNA, 975 bp, Zea mays
gtagggtttacggcatggtgttacgcacgtacgtgtatagcagtgtgtgttgtggatgccttgtgcttgtgcatatatgttacgtctctctgtgtgctgttcttgtgtgatgaaatgatcacatctgatcctgatttgtttagagctgtaacggaataatcatggatgtctgctcaccagtgtcaggatactgcaatggaagaatcatgattcgttgtcatgaatgcgctggactaattggcaactagtggtactcgatcagatccgtttctaccaccagtcagtcagatcaacaggaatacattctgctctgctgtcagtaaattggtgatgaaagatgtccattttactggctcgagacctacaactactacacaatgacatcgagtagacttcacacacaccgatgattatccaacggcaaagcgctcgtcagtaccagcagtgtccggagatccagattttagaaataggatccaaaaggcatgaacacaggaaacgctgagtagctacagatcatattcagagtcttatttccaaaacagacatggcaatcaaagataccgacagaattattggcattcttttgtggttatcttgggctttcagcaagatgcaatcgcgccgaagaggtcccagttgccccccgagttgaattcaggacatgaaagaaatagcctgagtagcaacttccagcgcagcagaaacatggacacaaacatgaagacggaattaaaaacacatatgctccgttagcctttagcttgcaaagctcgccaacgactacgaattttccagatccagaaaagggaagaagtaaaacaaaaacaaaagaggaaacaagtaaaccacgatttcctgacagttgtacaccagtagcatcttcggtacaagactatcgcacttggccaatatttttaactcgaagtttgtatcccttactacttgatacaaagctaaaatttcatagcattc

SEQ ID NO: 6525 - DNA, 473 bp, Zea mays
tattttctaagattcgaagccccttagcaagtcacggacccacccgaaacagaagcgtcctcacaaatcggggaaaccacgcgcagtcccgggacgcgatcgcagtggttgttgggtccgccgtccgcgacagcgaagctacaaatccctcgccgctagttgctacacaccaaatcattcgaaacgccaaaataaataaattcgtgcttcagtgacggcaccaacagcgacccgttcgatacccggattcaaaaccggagaggaatccatccccaattcccttcctccccccaccccgtcgcccaacagatctggttctccttcccaaacagttcgaattcgatcgcgccacggtccgtcacccgcgccggccagatttatgcagccatgcagagcggcggggcccggtgcagtttgactactgccgctgccgctgctacggggctgaggagggaccactttcgggatccgca

SEQ ID NO: 6526 - DNA, 325 bp, Zea mays
ttcatttaggtacggctgattgaatgacatctactatcatatgcatatttaatgtcgtgttaagttaaatattgttatttgatgccattggccatcatattctttttcatactaattctacaatagtctgattgactgtgtctacatgtgcttttcctttagtaagtgtttgtgattgtttctttttcttcgagtcatgtctatatggaaagcactattacttatctgtcattaactaatcttataatgttcattatttgggtaggaagagcaagacgttgctttaaaacaactaaggaagtcattggtgattagagcgaaaccc

SEQ ID NO: 6527 - DNA, 1044 bp, Zea mays
gttggcacaaagggtgttcaaggtagaatgaaagcaagatgcaaagacccaagacaattgtaaattggtcgaatggatgtgactacacgttttggagagacacaaagcagagtcctcgtggttgttcgcgtttgacaactgtagataaaaattcatacaccggaaaaaagaactagatgtgttcggtagctaaaatttacatgtcatcatctagatttagagagtatattgggtacaccgcccattagaattttttctatcatttttacagttctcgatactctaaatttagctaggatttatacctaggtcgttggagttgcttttaatagttagctagttatttgttagttagctaattctagctagcaatttttagtcaactaaggacatgcttggttttttagtccgaagactaaagtttaattatggtactaaagtttagaccttacctgttttattgtagaggctacaagtattcagaacatattaaatgaatcataaaaagaccaaaatactctttagcattctcccgcagttagtgtaactgaaataaatgaggaacaaaaaaattagtaattacttgagtgactagagactaaatcggtttagtctctattttaatcttattgtttggtaatttagagactaaatttaactaaaataaaaaaaatctttagtgactattacataactcttagtcacgtggacctgcagactcccgagcacaagatacgttttccaaagagagatagcaggtcggctgacgtgtggagccgaccatggcttggcccacacatcagccgccggacgaggaaacctttgcgatagcaggagcagtccaggactcgttttttttcttgctagaaccttgcgagttccgactccctcactcatctccgtccgtccgccgcaccgtcgccgagcgccgctccgcgccggagacgtcctgtttttttgccgcctacgagcgctgtccctcttttctttccgcggctctgccccaacttctgcatccgaatctcccacgaagttgtcacggcg

SEQ ID NO: 6528 - DNA, 539 bp, Zea mays
acgaggttgtcagttaccaccttgtgaaaagcttagtggagcttggctatcatcgtccaagattctgaggctactacaaagatgctgctagtgtacaattgtcaaatattgtatatgattggtgtgtgtgtgtgtttctattactcccaaaaacactatatacgggagaagcgtcgacaatacagcgggacaagcaaagacacggaatccttgtacaaaatggcttgcaagcagcataaaatgccctctagtttttgtatacaaaacatgaaaaatatatgtgcatgagccgtgcgtgcttcctgtgattctgtatctccatgaatcctgttctttgattctacatctcctgccaaagttacatttcttcttgaatctgaaagtagctctgacgttttctttctgtttcatgagccattgcattcttgggcctggtctgtttgctctataagggcagtaggagaaagggcccacataacgatcatgggccgttatcgtatttacttacgtgatttgccgtgctctcccgtcttctcgcg

SEQ ID NO: 6529 - DNA, 220 bp, Zea mays
tgcagttgcaggaacagcggtccgatggccgccatcaccggacgcaaattcagcgccaccacaaaaaccagtaaagcaaacaagccaatagcagataaggtacgattcacattctgtctccatacgtcaaagtatcttaacgttaagatactttgcgaaagaacgatagcgggtgcgcacaaagcgacacattgcccgccgtgaactgatgagaattaac

SEQ ID NO: 6530 - DNA, 799 bp, Zea mays
actgacaggcactcgctgaagttgtggacctcatgccttgcctttctatgctccaatgaggcaaacgttcatagggaattgcatacactgggaccttgtgtgtatcagtgcatgcaatgttctgtataaaaataaagagccaattgtttgtgattacggataaaataatcggtggagatattgaagcaaacatggaagtcagcctgggactgactgaagaacaaattgttagtgaacgcaacagggaactgcttgtattcaaaattgtgctttcggagtgtggtactgctgttactcatcaaaactgaaaaaaatcgttcttaccatcataattaagtatgatgaatgagtatatattctgcatggtttttttttcgcgaggaagagcatgatctttcctatgaatctgcaagctcaaaaacaagaaaccacgcatgaagcaagagttgacggtatctttttttaatccaaagctgggtaccacgtatccttaattaattatgttccgcgtgaatctcttttctttttcgttacttaaaagaaagaaataaaattctctatacgaatctcatactgatctgccaaggtggccatgtcccaataatgtggggagcccgattcggtatttttttttggaagcccaagtccagagcgggcccagtccagttcatcctccacctgctccgccggctgctcttcttctcccctctcgctatatccccggggacctcacagccacatctctccactgctccgtccagcgcgtccacctcccaaacccctactcccccaggaagca

SEQ ID NO: 6531 - DNA, 699 bp, Zea mays
ttgcgtttagaaaattttgttttctgctaaggacatcagctagaccttaattggccaaacattctcagcttgtaggcagcattgtgaccttgattggccaaacaatctcagcttacagattatgggattcaccatacattctcagcttacagattacgggattagctagatattctcagctagtcagcctacgtattatgtggttggccaaacattctcagcgttcaggttactggaggtcaagactgaatacaagctcgtagtatttttgcgcgaaacagaccaattactctatctcatcgttgcttggcagtgatgcaaagtccacttaccaagaaaacaatatggaggcgcacaatcagctacattgttaccggctcacagcagcagcccgctgatcaaaaagccccctggcctctaacaacaaattatggctattaattggcataaccgagaccgagagttcacagaaccttattcattttattacatgtacaactatgcccacgctctttacctcctatgaaaaacttgcatcccgaatcaccagaaattgcattcctcaaatgaaactggaacagcagttctgatcatattgatgtcatgcattgattcctgaccaaatataatgcgccgataagctgcacttgactgatcattctttggacattggcgccacatcctaaatttctgatagag

SEQ ID NO: 6532 - DNA, 223 bp, Zea mays
ggcgggcctgatgcctgatggcccttgtgccattggttcctgggtcgatgtccctgacagtgagagctgagaccctgatcccctgactttttctgctgatggaagacctagtaccagtagcactactaaaaaaattgtccgatctcttggacggttagattggctatgggctatggcacctagtgcaatgatctatatgtataaaaaatatctgtagtgttta

SEQ ID NO: 6533 - DNA, 685 bp, Zea mays
ggtgcgggctgttcctcacggaaccaacatatctacatatatttttcatcttctcatcaagggagtatatgggtcgggagcaaggtgtgttgaagtctcatacccattcattggtttggtttacttgctattcttttgtagactacagagatgatctgactgttattttgagatgcttgttctagacaacttggcgatgtgctttacattagacttccaatcattattattttaagtaagttcctattccaggttctacatgacctactagggtatgtaaaaattatggaagtagggccacgagatggtctacagaatgagaaggacatcgtgccaacacctgtaaaggttgagcttatacgaagattggccacatccggattacctgttgtggaggcaacgagttttgtatctccaaaacgggtacctcaggtatagtgctttacaaaatctctggagaacattcagattaaacacatgttttatctgcacctattgtacacactgattttctcaggaccctgatttacaacttgggtttttcttcaatatgtaattgaattttcatggagcaggcaggactgaggctgtttcatcctcctctgctgcggggtgggctaggtcgtcaccatggcgtcactcgtggcgtcttgtgcagtagggacgacagcagggagctgtcaag

SEQ ID NO: 6534 - DNA, 1500 bp, Zea mays
gatttacaacttttatgttggtgttttttgagaaactcgaaaaattaagaataaaaatgatttctagtgatattttcttaagaaaaccgcaactagaaatcgatttttacaaacggttccttaagaaattatggatttctagtgacggttttcttaagtaaccgatcgtaaaatattatttctatatgcggttttgttaagaaaccgccactagtaatactactgacgcttgataactgagttgatccattacctactcattctttatagttagtcagtaaaaattaaacccacccgtaagattagagtttttttttctactagtgtaaggctaaccgaggacaaggaatgactacctgatgaacactgatagatgtaggcgtcttcgaatgaataatgcaatgtctatgaaaaacacggatagagaatcggtgggctctctgttttagattgttttaaaaagcattggaaattcttggaggaagacaaaaactttttctcctacttattttatctatctagaattatagtcgtatatttagactgggtttgacgagctagccgaaacacaaaaaaccacggcttgcctaggcacgacacccgctagcctctctgtctacgccactgtcgatgagttaacaactactagtagtaatttttcaaagcgtcatagatgctctgacaagttgcgctaggaaggagtttgccacctacttatatcggataatacaacgaccaaattccaaccctctaaagcttcgcgtgtgataggatttcacagaaattaattacaaaattctcgttcttgtgttccaattacaattcagtgctctgtggatggggatggggccatgggggttagcgtagcggaggccgcaggggccatggcgcaacgcaagaatgggaatggcacttgtcactggcactgggcatggcgtggcgcaagcggccgcattgacaaaacgcagcagcaccgcaatttggcgtcctagttgccatgtgggggagccgagccgaggtcgggtgggagtgggaggctgtcccctacaccagccccagtcgtcgccgcgcaccatcacagcctcctccatctatcccctccctctcgagtctcgcctgctgctgctcccttcttcttcttcctcctcctcctcttcttggtcttggagctggaccttcctcttcccctcgttgatcgttcgcggttgccgattcgccatcccctccaaatcaagacaagattgagtgggtcttgggcccctgtccctagctgcattgcgaattgaggcgccaatttgggagacgactgcattgatgaatgccggaggccacagcactcactgatttaggggtaggtcaaagtgtttagccggattcaaaaagggtggcttttgatgtcagatatttgttcgggggttgcttcaccattccccaaaggccaaagcgcgttgcagttaacccttttttgtcttttgcagattcgatgtcacgggcacccgg

SEQ ID NO: 6535 - DNA, 376 bp, Zea mays
ggatcctttaaagtcgacctgcagctgccttgtattgtagcaaacaaacgaaggccgcaagcaactagccgttggctggcaggttggccatgcaccgcaaaggcaaagccacccccgcctgccgcagcccacgggccccacgagcacaacggcccgacccaacggctcactccttcgccgcctgcctacctgtcggcatttggccaccactccgtagccgttgccccctcactatatagccgtttcttccctctccgctgctcctcccacagtcccactcctctctctctcgcgctctctctctttcatcgccaccaccgccgtgaaatccgcacgcgtgcttcctgtcgatttttgagctgtgactgtgaccgcc

SEQ ID NO: 6536 - DNA, 812 bp, Zea mays
atgggtttgggcaaaattttatacccgtcatgggtatgggttttttagcgggcgtattttttcttcgcgggtacgggtttgggcaagtaatacccagcgggtttttacccattgccatctctaatgatgtgtcatgtagaatatcaacaggttaagacttaagagggtgtttggtttctagggactaatttttagtccatctattttatttcattttagtcctacattgccaaatataggaactaaatctctaatttagtttttatatttagtaatttagggacaaaaatggaataaaatgaagtaactaaaaattagtccatataaaccaaacaccccataagtatagtactagcctactaagttgacatgcttctgtaggttttgacatgctacagttattgaaatgtttctcaataaaagagttaaatctactaggaaacacttaagtttgtctaaatctttcgaagtgaaaggaaaaactgttctgccgtaaaatggtaactatccctgctcacatttatgctacagcggattgaggttggtgggagaaaagtatatgcagatcgcagtgcaataataacacagaaggatagaactatagtagtcgattctgatctcataaaaccaaataaataaattacatacacacaccataactgcattatcttacttgccatacagaaacaacctaaagrtctcaaatccacacttttgtacgagccatcaataaatggtgattacatagcttatagtagcgcttagtttcacatattaccggagagccctctaaaatacgagatcagcatcgc

SEQ ID NO: 6537 - DNA, 795 bp, Zea mays
atcgatttcttcgagctctacaattttcatataaactttatcttcattcgattttatatgtaaaagttatgattttataactatattattatgtaaaaaatgagtacccgaattccggatatccgtatccgacccgaatattcgagtatttatcggatagtactcgcttcgtatccgaccctaaatccgaagctacactgtccgtgtattactcgtattcgtttcgaatataaaaaatatccgaattcgtatccgaaaaacaggtatttacactatccgtatcctgtaaccggcaggtatacccaacccgttttcacccattgaaatcgatgaggaggagatgtgtggagcagagattgggtccagcccagaagcctaccgagacgtaaggcccagcacatgcacacatgggccctgcacctgcccccgaacgggcccgtttccacctctcgcacgctgtacggacgggcgcacggcacatcgtcacaaattccatggtctttttttcttttcattcactgctgcttccagtttcgcgtccgactgctcgcttcctgcccttccctttgcctctctccctagggtttctacctcgcgcccgcttccgactagcaggttggtgctctccattcctctccagtgcaagctattagtcctctcgatcgatctattacacggggcccgttttttttttccagcgctagcgtcgcctaactccgaccgaggggacaacgagggttttgggacggacggagggagatttgaaggaggcagcggagggccggagaccagacc

SEQ ID NO: 6538 - DNA, 986 bp, Zea mays
cgttttagataattaatatatttatacaacacttgatgatgtgtgtgttttatatacatgcatccagattcattatcatctatttgaatatagtagatataaaaatcaatagctaaaccgaatactactttaggacggagagagtaaaatataagtataattttttttggtttttttttgtaattttgattacacggcgattatattatattgtacggccggggaagcagccttgattgtgcacagactgcatgccgtacaaactgcaagaataatcgtacatgcatgctgatgaactgaaagatcttgagctcgtggccctcctaatttgttaaataaaaatgcacatcggaaagcaacaaactgcaaatcacgccttacgcatgagatctcagattcccagcacgctctctctctctgtctgcacatcacgtcacgtgtccctcccctcttgtgaattgatgcccggatcagcacactactggcagcagaaggtcccaaatctaagctatgcatgggcgggctacatacataacacaagaattcacagtacccccatgctatttctagcagtggctccaaacctcagcatccacatagtacaggctacagcgtgtggttgtgatggtgaccacaagaatcctactacatgcatgctgatgatgtgctgcagtgaacactcactcactgcccataaacagcgtctcctacctgccagccagtgccattgtgccaagaacaaatgaatgaatgattaactggcgtcgcttgctgaatcattcccctcctccttcttcttctcgtgtgcgcatgatggtcatgcagtggcggcgtcggtggggccgcgggagtggtacttcttcagcctcaaggaccgcaagtacgcgacggggcagcggacgaaccgggccacggtgtccgggtactggaaggcgacggggaaggaccgacccgtggtggcggcgcggcgaggcgcgctggtgggg

SEQ ID NO: 6539 - DNA, 1500 bp, Zea mays
acaccccctacctggcgcgccagctgtcggtgttttgggtccgaccgcacacccggggttgcccctcaaggtgtttttaggagtaggacggtgtcaacgactgtagcaaaatggttcgtgccgatcgcacgagggacaatggacaagatttgcaggttcgggccgcttagaagtgcgtaacaccctacgtcctggtgagtatatgggcgtggttacaagaggactctctggatagagggcgcagagagtttacgtgggcggctaagtaaaacagggtcgatcgttctgaaggggtgccccctaggccttatatactcgaccgtagggcaatacacgtggatatgataacaacaagtagctaaaaggtagtgaacctcttgagtttatcgctacataatcctcgccgacttatcctcgcatggctttgttgcatgggggcttcagcgcgggaaagtcgggcctctgttgcgatttactcgttcgacgatgtgggccgtccgtgtttgctccaatctggtttcatgtcttctcttctttgttggttgcctttccctaggcccacgaaagaatgaccttacgaattgttgggcccttgggcctttcgtgaggccttttacttctttagtggacccaggggatatctatcccccacaattccaaaatgaatggagtatatgaatgtgtgcaccaaaatttaaataaaaataaagaacaaattaatctatatattgtaaagtggagagttgtagttgattaagtattttggattctaaatatattttatattaggtatatttatatcttggactcaaaaaatcccaataatgtaatgtatacgtatttacaattaatcttttaatattaattaattttaacatttcatatcactagtaatataagattactataattatttatttatcatataaatatttttaatattttaaatggtgcacataatttttctagtatattgtgaaaaataaaatcatttgtagtttgtaattcggaataaagatttttttttctttgatactatcggatattctacgattttttccaatacaaatatagattcggttagagaaaaaactagaaatcaaattcggatatttaatatccatattaaaattaaatatgagtacgaatatttatattagtattttaagtaaatataactacggataaatttagatctttcatatccgatcccatctctagctagcaatagccgagtggatgtcagtatgtcacaactgagacgaccaaagcaatagcagttaggtggcggcaggtcaggtcaaatgccggagggcgaggcaggtggcacgaggctagctacgcggcgcccatgcatcgcgcctggatgccacttctccgcgcggtccatccgtctatcactgatcttggccacgtatatatacgtggtccatgtcagttcgttcgtctcagcagtccgatagccaggaagcccgtgcacgtcgaccgacgtacgccacc

SEQ ID NO: 6540 - DNA, 638 bp, Zea mays
cccttgcagggcatatgaagtgataagctcgccatgtttcacaatagcaaacttgcaaaatcacacaataatgacagtgctatagatagagacgcctgattgcttgttctgaggccagttttggggcaggtcccctgttcaaggacagcacaaccttttcttttcattcggtccttccaggtccttactgtgagtgagcctatattagtatatagtcaatgctcccatcaatcaatcaaaaactagtatacagctcaaacccatctgccaaaggctatatacattttatacacatatagggtttgtctttgaagagaatcttggacttgatatctatacctcacacccccactccatataaggcagcaatacatcccttttcccttgtactatcactttcctcttgtttttcttgcctgtctccatactcatcgatcgattgctttttggcgtcagttgcttttgaggagctgagctacaatcaggcaagggatatttccgaggtttggtctgttactctttatacaggagcagtaaagtatataaggatgttgcaatttgaagcatctaatcttgtttcccatttgctccatgcatatatggtgtgcttcttagatcatagctaggttttacgagga

SEQ ID NO: 6541 - DNA, 653 bp, Zea mays
agccgatacctacccgagtagtatccgttatccgtttcttacccgtccggattattactcggtcccgtcctgtatccgtcctgaatcttaactactcgtatctggtgtcgtatccgagagaaatacattagactaggatacgtgatgaccctatatccggctgtattcgtctcgttttcatccctaccgttttcatccctagccacaagagtatacactatacatcataaataacatatagtttcgagtaattcgggtaccacgatatattacccgattttcgtgatataattttgagtttttagagtaattcaatttcgggtaggttggatatgagttggttagtttagattcgagtatatggttcgatagttcggatccgggtaacgcatatcaggttttttccccaccccttgggcatgatgtagaccgaacatacgtggctgccgacacaacatttttatatacacttggtaggagtagagtataccgtgaaacctcctcctcatctggtcccggcacggcagcggtgtagcagtctctctctcgggccctcggcgtagcagtctgtctgtctctcttcaccctcctcccttcccttcccttcccttctcgcgcctccacaactgcccgcccgcccgcccgcaaacacc

SEQ ID NO: 6542 - DNA, 1500 bp, Zea mays
atgataacaacgtgtagctaaaatatagtgaactgcttgagtttatctccttgtagttctgccgacttatcctcgcatggctccgttgcatgggggctccagcgcgggaaagtcggatctctgttgtggtcgctcgctcgacgttgtgggtcgtccgggtttgcaccaatccggcctcatgtcgatctgctttgctggttgtctctccccaggcccacgaaagaatgaccttacgatttattgggcccttgggcctttcgtgaggtcttttactcttttagtggacccgggggatatctatcccccacaagcccccgatctttgggttaatttagaggtaatcagcccaaagatcccaggtccagcttgcaggtgatttgaagaaaacgacttcttattgtctcctcctgctttgatcactcgtaaaccgaagctttgtttcgtgcttgtgccttagaggtcggcatttcaatttgtaggattctgaacttcattgggtgcaccggaggtgcacccaatgggtgtagcccccgagcttcgagtagattttagaaaataatctgctcgaaggtcttccccagaaattatttccatttgtgctcctgcgttttggttgagggccggccttgtttttaatcttgtcccacgccttagaagtcggcactatcttggcttggaatgataatccatggggtgcaccggaggtgcacccaatgggtgtagcccccgaccttcaaatggatttttgaggataatccattcgaaggtcttccttttgtgtctctttgctgaaaattatcctttctgtttgtaaaaattggcatgaagctatccgcattatgctttggaggtcagcattatgtcatcaatattatgcttcagaggtcagcatatattttgtctttagcagccgagttcgcaatccatccatatcttgctaggtagtgcaatttatttgctctgcgactgattggacgtttgatggacgttctctgtctagtcttcacgtcgcttctgtcggccatattttgtacttcactggctatatttggctttcctctgatccttactgatatctcatttttgtcttgaggtattcactgcgtgccctgcacagatgtgaccgttttgaaaaatatactgataattcctgggcgtcccccccaatgggtgtgggcaagggacggcttggtacgctgagtgttttagccggctgcttctgagtagtaatgtgatgtgacggcgggtgtaatcatatcctccgcgctgttgactggagtcccaatgggtgttgtgttgcgtgaaacggcgtcagccgcctgacgtgtcttcagacgggttgaagtgcttattgaatgctttgcgactgttcagtgaccgcggttggaggtgagcggttgccttctccttctataaataacgccgttgtctctctggctttttcacatctcttcgctgttctctgttgcttccctttcttctctcccttttgcttccacc

SEQ ID NO: 6543 - DNA, 1078 bp, Zea mays
cctggcggtgtacccggcagctcggcagcgacgtggcgaggggagaggcggagacgacggcggcgaggtacgtggtgctctcgctttttttttcgcgctcgcagctcggggacggtgagggaggaagaacctgctgctgtgcgcgcgaccatgggccgcccaaacctaattggagtatgggctgcaccaaaaaagcagcccaaaacgcctgcactgctgtattgttgtattgtcttgcaaaactttagtaccatattggctagtaaaggagacatggagcggcttataagctttggcgcggtggctgaactgattagtttcaaatggtggctgaactggtggtcagtttcaactcgcgcatgcataagaatttttgctggacacctgcgtgtacgacctgtgggggcagaaccagagccatggcagaacaggtcaaaggcagaacaagtcaatggcagactactattgcttacttaataagtagtagagattttatttaatcaatgtctacttacatgaaatatagaaaccttaacaaatgtatgggaaattaactagttaattattatagcagcacaaccgatcgcactaattttcggagattggaaagcttatttaatcggttatcattttttaataaaatgataaatatgacgttgaaaaccacttctaaccagatcgtaagctgtccaaacgtaggaagctgtccaaactgtggaaagagattcaaaaaatttgaaaacgtaggaagctgtccaaactcgcagaatcgcgggttccaggcttcgagccaaacgtttgggctttggtctagccgcacgcctgcactccacgggccgtttctctgcacaaccaattaaccaaacacccgggaaaacgcagaaaccccactccgtaaaaccacaggaaacctcacacgtcttcctccgtccagcctgtctccggccggccccccgccttccttaactccgcatcatccccttccaatctcgtcttcccagcacccgaaccgatcaaattcacttccgctcgattctccgggagggggagggtagctgaaggacatcccggggacgca

SEQ ID NO: 6544 - DNA, 285 bp, Zea mays
ggtgcgggctgttcctcacggaaccaacatatctacatatatttttcatcttctcatcaagggagtatatgggtcgggagcaaggtgtgttgaagtctcatacccattcattggtttggtttacttgctattcttttgtagactacagagatgatctgactgttattttgagatgcttgttctagacaacttggcgatgtgctttacattagacttccaatcattattattttaagtaagttcctattccaggttctacatgacctactagggtatgtaaaaatt

SEQ ID NO: 6545 - DNA, 999 bp, Zea mays
gcggcgaccgctagctcacgccgagccagcgcttgctaacgtttgccgcgcgcgttcttctggccgtggccgatcagatgtgcttctgctcccagaaatgaaatgtgagctcgggagggctttttatggaggtggaaggaggagattttcgttcacgattcattgtgttgttgtggcgcctggcgccggccgccggcgaagtgggttgctgtatcgttgcatgcaatggtggaggaggcgacggaaatggttatcttcgaacgtccagttggttttgcagttgagagattgttcttcgtctgaataactcgccggtttggtattaaccgaggagctggcaaaacgatctgaactttttctctgtcttcaaaaagtgtagtacagacgctaatcacattgacgggcgcttctttcagaataattagccgcagatacgtatccgtattcccataccaagttgaaattctcagagctaaactcaagcagattcttctgccgcaacaaaacttaaccattatactgataaaaaatggacaagaaattaagaatgagcaaccatactttacatttgtgccaagacgccaagaaacaatagtgaatagactaaattcttgacgaaatgaaggacgactgctggttttaaacggaggaagtgcataccttcctgaactttcttacagatcgccgcgcaagctctgaatggattgacttggcgcgactgttcctcccgcggcgggacagcaacacacagcagagcgccggatgcgtcggcacgtgtcctcttccggagcttgtaccgcaacgtgtctttggacgtgtcacctcccctcgtctcgtcagctccacctccttggctcctttataaacagcgcacagtctccgcttgcaagctcattgatccctgaaacccatccacaattggtagctcgttgatccaaatccaagacctcacgtcaacgcactgtctcgcctgttaattagtcgtcgacgtcgtcgtct

SEQ ID NO: 6546 - DNA, 95 bp, Zea mays
catactacactgtagtccgtaggagcgctacacgcgagggaatctaattagaagaaggtttggtacaaaacagacgtacaatgccgtaaaatgtg

SEQ ID NO: 6547 - DNA, 218 bp, Zea mays
ggtcaagggttcttttgggtgattagtgaagagcaggtgtgtgtggtctgctggcactttttgttgttcgatctcctattgcgtgctgctgtttccaggcgcatatatgaaggctgcagttctgtgcgcagcaggagtgggtggttttgtgttttgtgttttgcctattttggcattgtactttggtctattttggactgttttcttctcttaattta

SEQ ID NO: 6548 - DNA, 999 bp, Zea mays
tcacaataatgtgagctggttcgttaactatatgagctaaaatactagctcatctcgctaaaaaaaattataaacgggttgagttgagccgagctgaaccacttaacgagtcgagatgagcgaggtattaagctgtgagcttttggtccagtcctaaacgatgttaactaaccgctgtagaaagaattgtcacagttattttttatatgaattgtggataaagaataacctccaagaagaagccggtactgtaacaaccatgttaactattttatatgaagctaagtactatagtaccagtagtaatatagtgctatgactataacccgagaagctaggtcattacggtgagcagtaaaaggcaaccgagttaccgagctgtcagcaaaacaaattatattggcaggaaagcgtcaccaagccaactgcaagcatagtacattgtcgcgccacctgcctggcttctacgatggctccctgcagataggtgatgatcccgatgcacacttcacctcgcttttatcgctgcatggagagcaacacagtccatttgtgtggcgctaccaatggtctttacttgctgcagaggaatatacaataaaatagatggtctattttattctattttagtctctaaaataaaatagaggaactgaaaattagtctattgaaactaaacacctcgttattaaaaaatgaacagaattagatttcgatcctaactagatctgtcaaatttagagctaattattatcaccctaactagacgaagatgacctcgtcgcaacgatagctagctagcaagctccttcgtctgccgccgtgcccctctgctgtataatagtagacatgagtgtcacccctcagtcctcactcctgcttgccaagctacagcagcagcagcagccgcagcaagatagtgtagcgtggcaagggcagtgatagttagctagctgctcgctcgcctgggacgacggcgacgacgaagcggcaacgcta

SEQ ID NO: 6549 - DNA, 696 bp, Zea mays
gagtccacctgggagccactcaagcacttccaatcttcgtatccacagttccagctcgaggacgagctgttcgtcgagggagggagagatcttatgactggcagagtctaaccgccggcctaaacaacatgtaagtgggccgtcactagagggctcagcctagttaattagttgtggctatcagccagctgataagcttagggagaaaagataggagagagttgtttagctccctgaaataatgctagattttgttaggccaaggctatgtaaaagcccctggattgtattgatcggttaagcaagtttaatttaaaggagattgcacttgcctcatcctattcacttgttccgggcgtggagcacctgagttcatcacggctcccgcacgaccttcctgctcccatcctaagtccagcagccatacatacaatcttcgtaatcggggtaatcctgacacttgatgtttatttttttgtgcaataaattgaataggatctttgttatttgtgctagagcctagaaggtcaggccactctagttgtttcattgcaatttagcagagtgaaaatatttttttggttttcagtttttttcgtttgtgcaaatttgattgattatattcttttttatgtttgttttgcaacttttggttgaaaactggcatttggtctgcaggttttggaaggatccaag

SEQ ID NO: 6550 - DNA, 1432 bp, Zea mays
acattaacaattacgcaaataaatattaatacattatttataaaatatgttttataataatttggtttagtactaaaatacaaatattcatcgattaaaaacttagttgaacacaagctttttaaattagcatataatacctcataattatattatgaggtccttccgcgccaatcttttttgtgtagctctggaccccgcccaagtgagaaccaactggacaattccgtgttgttgctctgacagaggtggtggtagctagctagctatagggacgtacgactagggagaacttgaatacttcatatcatacctctgcgcatgcattgcgtacggcagtgctgtgcgcccatgcacatgcatgctctgcgctgtatatatgtacgtggttgtggtctcggactcgcggtacgtacgcatggcatgcacggtacggcacagtggcgttccgtacgcatgcgtgtcagcgcggttcggccacgtgtcgtcatcctgcgtgggacccacacggatacatgccctccttccctgatttgggactcgatcgagcgggccccccgtcttcagcaaaagattccatcccaattagctaatcatcatccaggtccaggctaggcatgcatccgccgtatggcatggcttctcttatatatggagctagatcgagccattatgtgccgctccaaccaaccgtaccgtacgctgcgtctgcagtcgtcgtcagagatcgagctgagatccatctcgccactgttgctggccggccggccagcttcctcccacgctcgtctcaggagtctggaggaatagtccaagtccaggctgtgcgacgcttggaccccgtaccagaccagaatggaccggatcgatcggaccagctgcgcgactgcgaccaaaagctctcattcgttccctagctagctagaagctccagttcggtgatgcatgcattgcatgcccagtgatttccagttttccactgctgtaaacgcttcactatcagtcaccctggcagttacagtccttataataaacagcggttagatgtaaacgcttcgaagcaacagccacgaggcgtccgcgggcaactgcacgctcacagcgctctgccaggacgagccggccgccattattgcatgcgccggcccaagcccaatcatggatatcaaatcatgagcttaacattgtagctggcctctcttgaagtgactttgtttgcgacccggcccgccgcgggccatcacgcgcgttgcctagcgcgctatatataagggccaccaccaccgtgatgatgattatatataaatatccaatcccacatcgcatccatccgctcagctcagctcagctcgatcgaacttcgcacacgcgtacattaattttcaagaacgtactggttggtggtggtagtagctactagctactataaacg

SEQ ID NO: 6551 - DNA, 461 bp, Zea mays
gtttctactcatttcaactacaaagtcataatgactgaacaggtacgacataccgaaagcggtttccaaaggtgctgctagcttcgaattggttgtcaattgaaaagacttcttcctactcaaatggtggtgtactactagctagctatgctacacataagatgatcttgataatctctattttttctacagtgtttttgtccctataaattgtggctgtaaccgtccaaatagctgactttaatccgaagtgaacagaattaattattctgccacttgtagcgcgtgcatggaattgtgtacatatacttggctcaaaatcatgcacctcccattatatttattgccgctctggtatatatagagacgatcgacacagcagccctcccctcccatgtaatgctccatggtgcacatcaaaccatactgatcgagagagggacacaaagagagagagagag

SEQ ID NO: 6552 - DNA, 217 bp, Zea mays
ttgctttcgcgaggtcactggcatggggaatcctctgcgcatttgcggcgtatctcctgttagcgttcgcctcttcggtcgtaatgcgatgacattgcggtcgattgggttcaagattcgtctgttctatcattcgtttagctagcctaatcagccgctggctaacgtctcggtgctcgcgcgcctgctgacggtcgcagggcgcgctcaagtggcg

SEQ ID NO: 6553 - DNA, 1401 bp, Zea mays
catagaaatcgggaaattttcatttgttccaaaagatgtcttatttataattgctcttagcggcagggattatttatagccttgtgcagtcggtggtcttgggaaatgaaatcctatccttatctaccaatgggaccagtagttaaaatagttaagtgtctaagggcagttctaatagctagcatcgtattatgtaatgcctcgtacaccatgcactttatttatatattctcgctccgattaagatagtgaaattatatttgtctcatactccacgtgatcttagcctttcacttcccatgaggtcaaaggttttgagcccctctatttttattctaagctaggtgaatcgtttataagaaaatgatgattactgtatacctttggttcacatatttgtaatgtaatagataactgataaaattaaattatatttgtttgagtycaaccataatcagataccacgcaataaaaattgatatcggcctattcaaactttaccgttattattcgagtgtgaatcattatcgttgtcatttatgttacatttgatgaaccaaataacactaaaatgattttttaaaaaaaatatcggtttgttttgtttatctataaaataagtttttgatgaaattaaaacacggcgataactttttaaatcactggagaagcgcctagccataatttgtagagatgattttttatgacatccagtgcaaatccaaaaatcgatttctaaatatgaaccatgatcattggatcctctcctagccgtatttatttctacacatgattggactatttttcaaggcaattgttttttttatgccattaggttgaaatgggctcttttaaaacgtgggaatctcgtgtagaaatatcctcatttttcttagaacaagcgcagaaacatgaaaaaaaaattgcctcgtgttccagatggatcgatctatatatatagtatctctaaattagcgctaaatatggtttttagcagtgatagtagtacgtcctgtaactataatactatcactgcacctgttattggccgccatggaacatgagtaacctgccacgtacgaaacccagcggattctcttctcgacgggactgtaacttctgctgccacgtgcagcgggcccacctgtctgtgtcagatgttgaaattgattcccaatcctatctactaactccgaactaccgttgagctagctaaaaaacaactcattatcagtacatatgacacgaaggatcacatgataacccaacaaactacagtattatatttggcaaccctagctaagctcgtctataaatagaggcatctgctccaccaagtctactcaccagctcaaagctgctttagctagctagcaagagagagagagagagagaaaaaat

SEQ ID NO: 6554 - DNA, 1500 bp, Zea mays
gaacggttgacctgcttgtgacgatacatctcctcgactcctcttgtcaatctacggtggcgcggtgctaccatcagcctgatgacacttcggcggacgacagttcagcgattatattacattgatctcaaatttgacataggaagattttgaatactagatccgtcgctgccatctaaagacttgtttagaaccaatgatatcggagagggtttaaatagcacgtggattttagctttccccctccggtatctttggttccaaacaaaccctaatctataatgcttggtgaattgacacctttgtttcatcctatctgtttgtggatttttgcttttcgaaagggcccataagttgattagttgggtgtctatttcagctttctgctgcaatagttttaatctgatgtggattttgtttctcaaaagaaagacgcggcactgcaagattgaggttgaaatacgtgcttgctcaaagggacaaggtaggtagaggatcctttcacactcgaggctgcagccatccgacgcgcggcatgcacgcccgtgttaaccttcactgcagacgctcgctatgttttaaactgttgattagtagtgctgcttggtaccttgacagttgttacgtactccctccctccaaaagaaaaatacaaatatgttatctgtatccgcaaagataattttagtttaactagatttttagtaaatactgctccctctccctcggtcacaaattaaattttattttagtttttttaattaatcgattcatactataattgatggtatgtgtcagaattcattgttatccatttaaatatagacataaaaactaagagctagaattaatattaatttggaacgtaaagagtatttatatttatttcaccaaattattttattataaaaatgtatatatctcataataaatcttgatggtatttattttatattacaaatgatagtatgttttctatagattttttaaaatttaaaagtgactagtttcttaaggtatgagcattacattttttttatagacggaataagtagttgtttccaatttcaaaagcccttcagtgcagttcgactactgccgctgctatcggctatccttaccaactactcgagactgacgagtaaatcatgcatatgactatataaaatactgttttattatatagatgtagagcagtctgcgggcgatagacaaacaaaaattaggatcatgtaaatattcacccgtactttacccgacacgtcgccgtccctaccggctaccgtgttcgtcatggttggctggttgctgtctgtggtctctgacgagtgatcactgcctctcctcgtctcgctttaaattctccctgcctctcctccatctcgcttcagtaatcactcctcagtgctcactagcccaagtcgccctaaacctagcccgggcacccgccagaccagccagcccaacaacgcaaaacgcgacgcggccaccgccttgtcc

SEQ ID NO: 6555 - DNA, 110 bp, Zea mays
ggttaaatctcaaccgcactgtctcgtattaaatgataggagggaaaaaaatttcttgtcacaatatcagatatcaaatcatcgcaaaaattgagtactgactacctgtt

SEQ ID NO: 6556 - DNA, 1500 bp, Zea mays
ttcaggaaaataccaggattttgacaaggaacgggaggcagagggaagagggttcaaaccaatgacaacagaaggatgtgacaccaaaaacatagcaatgtagtgcagcagataaaccatacactacttaatcctgctgaaggaacagcaccaggatggaagcaaaagccgtcagtgtttctttaatcaatctatagctataatgaaacggtttcacaaatactgctaaaccactaacaactgatccaaccattaaccccccagcaaaactgtagccctcttcttcttcttcttcttctttttttttaaaaaaaataatttcgttcaaatgaacactcaagttccatttcaattacagttgctaaggcttcacctgaaatattctcgctcctttgcatacaaacagagacaaataacacactcgagcaatttggagcccgggtcagtttctccacaacaatgtttttgttacttaagcaggagctcagccaatcagtagtagctaggcccacaatcaaaccaacacagagaactcttggttgtgcaccctaacaaaactggggcatacctaacagaataaaaagctgtagacctaactatataaagactggagcatacctaagatcttgagaaatgaaggcccaattcatgagaaggtaagaattttgagaaatcagagtatctcaatgacgatgaatagagaactcttggttctggaccataacgaaaacgaaccaggagtaaatttgatttgagagacagagcccttctagcttcacgctaaaaactgacctatggcagaataaaaaactcaagactggcggttcgccagatctaagattttgagaaatgaaggcccaattgtcactgtattttctcccggtggtgaaagaaacattgcattggatagcgaaacggatacatcaacaacaaaatggctcaaaaagtgtctgcaagaaaactttatgtaacttgcaaatgctccaattggtgcgttacaaatggagcaactttgctgagtgggtaaaccatccagcacggtgcacggagtagaggacattgtatacatcacgtcgaggcaagaacacacacacacacactaaactacaccaaatcaatgaccacaaacaaaaccaccgtaatctgtgttaactagaatgtgacagcatgtgaagcagcatgtcgttccatgcgtcgatgggtcctggcaagcaccagtggatgcagtcgttgtagagcgtccgcttctcgtccggccagtgcccgtaccggctggggtggccgtcgggccgcatcagcatcgcggcggtggggtccatgagcacaacgtccaggcccttggcctccctgaactcctccagctgcgacgtgtagaactccagctccagccctcccatcggcgccgtctcgtcggccctgtacggccgcgtgcgccggcagtccccgccggcgtcgtacgccccgccctcgaagtgcgacatcggcgacagcgtccgcagg

SEQ ID NO: 6557 - DNA, 1500 bp, Zea mays
tgcctcatttaggcaaagactgctcgttttctgtagaggtttggaacatgatcctatcttgggccaatctgttctttctaagtggcgtttctaacctcggctcgttgtatgattggtggaagagattaaggaaccgttgctgcaaggagtcaaagaagattttcgatggactcctcatctctttttggtggaatatatggttggaaagaaataacagaatttttcagagacttcaaagatctgctatccaggttacgcaattggtgaaagatcaaattgggagttgcagtgtatgttagattgagttagtgtatgtttttctcctttttgttttttcttttgctccgtcttctgaagactgttatctaattctcttctaatatattgaagaggcaagtcttttgccgcttcctttaaaaaaaaaagagagtgccgttagaaatcgttaaccctacaatttctttctcgcaatgggagtgccgcattgccgttctggattgaaaatgcacgtatctgaacttttaacagctagtggagttaatatagttcaatagttgttcgaaccaaaaccaaggcaggcgagatgtctaccggctcccacttgtttcaataatgctatactacaaagaaaaattgcagccggcctgaaattgcagagtcctcgaggggataaaactagcgttcgtcaacgtgagactcgactccacagcctctccctgttgccaagttcaactcctcgataagattaaacaaagcataaaaccttattggccaaaaacaacgacgctgatcggaggcgattgataggaactaggaggaattttgatctgttaggtattaaaacaactaggagaaattttgatctgttaggtgattcgattcaatccacgtatattgagattgaacaggccctaattgtttttcttgtactcttgccagtatcgcgcgtgaactacgcttagatcgatcgaagtgcaggcaaagccttgttcggatttgttttcttattctgaagttctgaattgtgacaccaggagaaaaaactgatcgtgtgaagcaatgcatgcatgactcaggaggcgcactagtcccaaattacgagcaaggacatcgttgaacattcgtggctagtgcagagatcggattacaatacagcagataagcgttcgggcatttatagcactgacaccagaacgtatttgcctgcattagaaaaatacagagagctagaggattagctactgctgtagtctgtggtgtccactgtcgagtattgttttcaacccatctgatccatcgatctgaagaaggttcccttttctcctccatttgcaagcatgcagtactgaattatgaattctttgtgatctcagctccgatcgatcgatcaaatgttgaacattggaacacgcgagtagcagtattaaactgccactgatccagacgctcacactctccggtgcacagtacacagtctggtgagcggtagagagagcaggc

SEQ ID NO: 6558 - DNA, 278 bp, Zea mays
tctaattctaccgatattcactccttagctcttttagatttcacttgcaagtttcagttcagatatgacatattgaatatggtagcagtgccctcttaaataaggtcttaatttatgggatcctgttatctaagaatactatttgtgattctttttctatagcatccatctttcattatctatccacaaagtaaataggaaaactgttatttttttggtttgcaacagctcagcattcataagttagggtcacacttatatcttaaattgaattacag

SEQ ID NO: 6559 - DNA, 128 bp, Zea mays
ggttctttgtacttgatagtcgaggaatgttgtactactatcgraaacaaattactagaccacctgtaggtctctattgtaacatttgytgttgaaatgctcattaaattggcacaatattttgttcc

SEQ ID NO: 6560 - DNA, 239 bp, Zea mays
ccacccacgtaccgtggtgagcagcttttgctcccgttttctagtgcgcggacggacgcgcacaccactcagcgcccgaagagccagcccttccaattcaaaacgcttcccgctatatataaccagttaaccaccaccaccagtccatcagtcttgtccgacaccacactcgccgtcccgcaatgaactacggcggcggcagcaggagcagcagccggctccgggaccggctggcccgg

SEQ ID NO: 6561 - DNA, 1500 bp, Zea mays
gtgcagtgcaggccgccggcccgccgcgcgcagcttcctggatcatccttttttttccctgcaagcaaaggctgcttgctgcagcggcattcgtttgggccggcattaactgcggcatatgcgctctttccagttcctgattcctacagtgctctatgctacactggctaggtaggcctgcctctgcctgtcgtcgaatacgctacgcatatagtactactacgtactgtacgtactatggccgtatggcaacgcgcgcgtactatacagtacgtacacaggggacaaagttaaagctaccagacatgctattcataaatactgtagtattattaccatcgtttagcttgaactcttccaaaacacacacaaacacacacagtcagtgggccggcctgttgactgacgcgtactacgtcggccgtgtcctgcgatcggcggtcacttttttcctcgatctggatgcacgcaccaaactcaccgggaccgaggtgacctttcagacagagcgcgcgacgcaggtgcagcagtgagattactaggagtatactagtagcgctgtgcgtggacaccgaggcatgcacaccttggctggccgggtggacgactagacagatcgttgacaaggaagccaaacactggtcaagcgggggcctcgagctcagcagcccacaaacctaatcccaactactactagtacctcgagcgggcaagacacttcttccactagccatctagcatgcatgcatgattcggcgaatgcgccaagggccgtcactttttttcttttgtttttattttctttttcaaagtccccactctccaggggtgaaaagggctcaaatcccaagctcgtgagagaaaggagtgagacgccatcttccattccttttttcccattgacctcttgcgcgcagcagcgattcttttgaggggagggaaacgcctgcttgcttgctcaatcgtcgtttggattttatcggcatgcgatgcgacctggctagcagtagtagtatagtacgtactgtgctgtactctactctacccctctacatgcatggtgttactacagttttatataagcgactttcttgacgcgtagccaccgtcagtttgtgccgggcttttcacctcacctagcctaggcttgtcctgctaaaccgatcgaagcgtctccttttttcaaatggtggcatgcatataataaaaggaaaggcggcagcagtggacagtggtcgctcgcacaggattgatttcaaacttgagctcattgacaagccctcgccttaactaacaaataataataataacaacaacaaggcaggttaatcgcgcatgaacatgcatggacaggacagcaggcttattggcgacgagacgacgatggcggacgaagttgcaggcgcatgcgtccggcacagctagctagccggaccgatccggccggtgcacgtgaaggctagctagctaggtacctagccgccgtggacgactacccag

SEQ ID NO: 6562 - DNA, 897 bp, Zea mays
ttttgttgctcacatattattatcaactggggcgtaaattaactatttgaggccgtaaataaattcaaacaaaaaggttgtcaactacaaagttgaataacttttcaagttctataactttggttttgatactttctccatctgatgtcgttttcaaaatttgcatttcgaatttgacaaatttgaatgtaatttttgagagtcgagatgatttcaaataaagaagttgtcaactataaagtttcataacttttcgagatcgacaacattattttagtagttttatcatccgaagtcatttaaaaactcaaaaaactaaggaaaaaatgatttctagcggcggtttcttaagaaaattgtcactagaaatcgatttctagtgacggtttcttgagaatagcgccactagaaatcatggatttctacatatggttttcttaacgaaccgcctataagaatatgatttttgtgacagttttttaattaaccgacagtaaaaatagcactgacggttgataatcaaaatcgcctgtaaaaattaggcatcaccgtaaggttagagcttttttctactagtgttttttcagatttgtcaaaaaccgaaaaaaaataaaaaacagttgaaacaaccgttaatacgaatttgagagatagcatataaaaattgggataaacggaaggggatttattgcaaccgttttcttcctagtggtgacgacgacgtaattaaagtcggtggtggaaagtggcgagctcgctctatcctctataaatatgcagctccacggtcggcctcctccgcagcacatctcagcgaccaaacccgggcacctcgtctagctcgccttccatttcgtcccttcctattcatactaccttctacgagtttgagcagcc

SEQ ID NO: 6563 - DNA, 620 bp, Zea mays
aatcatcctggaaatgtacgctgtgctaattttgatcaagaaattgatctgtcttgttcttcaagtgagttgttcttagattagcatctcatgttggcgacataaagaacatgacatatgatatattgcctgtctgacttatttttgatattgagatgaatacatgcagacatgcagttgctgtgatgcatatatttagttttgaaccgacctatgtatatgggttgcctggcttctgttctccacttgttgaatccagtgctcctttgcattcttacattcattttccccttaagttttagttgcattattttgtgagccatggagaaaacatcccttttcaaagcaattactgaggacatatgcattagcgaaagaagattttaatatttgttggcactattaacaagcatattcacatatttttaatatttttcatcactgtaggtcttgacacatctatcttgactggataacttaccttgttaatgaaggtttctctgatattccggtggcctagcagttactgtggaggatattcatttgtgtttatcatttatttggtcttgttcagggccacaacgacattgggaacaagtgtatgacatacaaacagtaaa

SEQ ID NO: 6564 - DNA, 471 bp, Zea mays
cacctctacaacgcgctgatgaaggcgaacgtcgcggcggacgactctggggccgtcctcagggtgttccggcaggtttcagtttgataattcttacagtatttatgtttttcacctccatagaccacagtttgataattcttgtttgttagttagtagtttgtagtactcatgtttctttctagctaattattctaaagatgcaggtttaagttactggtacattcttggtgaataaagaacatgtggaaagtcacaggtggtcatgtatgtttggagatgttgaagtaccagctgaggttttgaccgatggcacgctacgctgttatgcactagcacaccaatcaggaagagttccattttatatgacctgttcaaacatggtggcttgtagtgaagtgcgagaatttgagtatcgtgattctgaagctcattacatggagacttctcattcccaagccaatggtgtaa

SEQ ID NO: 6565 - DNA, 1500 bp, Zea mays
ttttgctccttttaacctgtttgaggtcggggttggactccaaaactccaagtctccatgacttgatcgttatagccatctatgagctccaaaaccttgcaatggtcacatagaacgttttcaaacacaagaatgtcacaaactaaaattcaaagtgaacttagttcttttggtcccttccaggttctgactttgatacttctcctctttcttgtgaccatgtcctacttcttgagctaggatcttgagcctcatgacttgaaccataaactttagaaattacctcaatggttccaagtcatgtccttatgttgtgatcctcgatacaccagaacccttctcatcttgaccaaccttgaccttgtaagtaatcttcttcaccctggctttaggtaccttggtcttcttgactagggatgaaaacggacggaaacagacgggaaaacccctctctcgtttctgtatccgcattttattatcggaaacgggaccgggttcggaatagtcgggaacggaaacgggagcgggataaacggaattgcgaaaatgaacggaaacggaaatactaacggaaactcataatttaatacaaatagaaatgttattgatgtttgactagtgattgattggtagaacaataacataaaacaaatagatatagagaggcaacattctattgttgtttggttgctaaatgtgtacatttagctatatctgatgttatttaagactttagatcacttgttgaaaagagccggtggttacaatgcccaattgtgctataatttgtcacctaaatacatgaggatttagtttatatactaatgcatattaggctcgtcccatatttatcaaatacggaataaatatgggtttaatccggaaaaaaagatctcgcaaaaacggacggaataagccatctcccgtttccattccatttccatatttttccgtaaatacagaaacggtcgggtcaaatgtagaaaacggtacgggtcggaacgggattttttccgttcgttttcaaccctacgcgtaggaaagagagtgaatctagcaagtgaaatagctagcattgaagacgtcctaagagcttaaggtaaaggttagtaacgactcaatgcaagggctctttgtcatcatgagaaaattgcgtaggatctggcgtcggtatccagcagcttacggacgaggtattgtccaaatgaaggccaagtgagttgaaccacgagtgagtcgtgtggtaggtgtaggtgtcgaggcgggattataagccaatgtaaccgaaggatgccttaacgaataacacgattcaaaatctttccccccttgttgcctgttgtgttcttccacgttctttgccaaattccggcttccttttccatgcccaagcatctcgttatccaagaccgtgacaagcaccacggcaccagtccgcgacaagtcaaccaaacgaaccaaaggcagagctgaacgcgaaagggagggagctcggatcgg

SEQ ID NO: 6566 - DNA, 49 bp, Zea mays
gcgacgtgccacggatgacttcgtcgctggcctgtgttgtgttgaaata

SEQ ID NO: 6567 - DNA, 989 bp, Zea mays
ccacgccgcagtccattctttcgtcacccatcgcagctccaacacctctcgctagtcgtcatggcggcttccgcggcagcgttccccctcccaccgccgacgcctcctcttcgtgagtctcttcgccccaaccccgttttcctggctcctgcaactggatctctcctccaacacgtatcccactgttcagctcccgggcctcttatcagttgatttagggctgattccactcagttgcagtgattgctgacttgctgtggttaccagaacgtccccaatagttcgtaaacgtgcgctccttgtttgcatgacggattagttttgcttgacagcagatctctgttcatgcctgcatccgcacttccactctagtttgggtgagcccgctttgttttgggtgataacatttccacaccaatccgctacaattggttgtttctcacactgctaaagctgaatccattccacttccgcatcccgtgtatttgcttgagtttcttcaagttagattacgtcattttgggaaaagaattaactatttgccactctgtttggaggtgggtggaaaatcctttgccatgactcatgggtcagtgacacatgattaaggggttttggtaaggatgacaaatagttaaatgtcccgtcattttgtcatgttgagttttacaagacagagacatacacttttccttttcaatcacatgttcctaataacacaccggtgcattctttcgtgcaggactttcacatgtcttttgatatcacagaaaaggattgcccctgccytcactgctgtgaatgccagggacgtttctgtcgccctacaatatatggacattggacttgatagttggcaaactttcttctatatactggacgttccagctttcgccaacctgctgctttaaccacatcttttccttctttcccgattttgcctctcactatcatcaattaccgctaaaagtgaaacaagtgttctccct

SEQ ID NO: 6568 - DNA, 1471 bp, Zea mays
tgtctgccatggatatttttgagtatgttagcgaagtggattcttatcctaataccgctattgcttatcgacttttatttactgtgcccgtgaccgttgcatcagctgaaagaagtttttcaaagttgaagttgcttaaaaattatttgaggtccaaaatgtctcaagaaagactaaatggtttggctgttttatgcatcgagaaaatattattagatgaaattggtaccgatgctatcatcaatgacttcgcttcgaaacatgttagaagacaattttaaggttatcacatatttgtatttttttcttacgctgaataattttttgatgtatttttaaatgtttattaccaatatgtattatatattattattgtaaggcccctatattaaatctggcctcgggcccctaatttgtcaggaccgtcgctggtgtgtgtgtgtgtgtgtcgtctgtgtgtaacgtaaaagccggccggccgcccgccctgcaccaacttttactttggcaatgctgcagatggacaaacacgtccgggccaattaacccctcatccctcagcctcctgctcatccactccctttctttcttagccaccaagagatcaagaaaaagcgttcgttacttcccgccggccgggcccagctaacgggggttcaacaagctaacggcggcggcacgtggctctgtaggaatgtttcccaaaacatttcatttatacgacaaatctaatatcttaacataggtaaatatagaatttaaagttaatttttagctatgttattaagaatactgtgaagtacacgaataaaaattttgtgttcattattttcttcgtacaacagaaaaatgagagaaaaaactttcgaatccctattcgtatctatccgtattcgaattttatatatatatttttttaaaatggaacgagactgaggtttattttttataaaaatttttaggctcactgctacaaaaataacatagatgtatatagaaaaatctatatattttttgtttacaatctataaaataagacaaaaaacttaagatccaaatccatcccttcatctccccggcaccgtgccaccgtcacttgctgtttctttttttttctcgctcgctctctcgcgcgcagacagtgacagacgcgccaacgccgaggcaaagctaggcggcctcgatcgtcgctggccagtcatcactcgcgtcacgcttgatccctccctcctcctctctttccttagttcttaagtcctctctgccagtgggctccactccgcaccccggccgggccccggggccgcctttaaataccaccccgacctcctcgtcccattcgttccattccattcccaacacccacagccagatcgagcctagcaaaacacagccagagagcaaaaggccacgtgagataaaggaccgttagctgactcgaccgccaccacgccactagcagcagcagata

SEQ ID NO: 6569 - DNA, 1500 bp, Zea mays
gaggacctccaattcagtgaccgagcactaaatagtaatcaggttctttttgacataatggagaagctgagtttttgacggcaaagatgaagttcctgcccaccaaatgaaatctgcagatgccactttgatgccgctgcgtgcctgaattaacggttcataaggagtgcctcccttcctttttcttttcttttcttatttgtttcttctgtactttgacttgccaaggatatacatcagtgtttgagctgttccaaacttgcaatgacagactttaaagtgcaattattttccggatcacatggctgcccaagttctcagagctgtgcgcacacacacacacacatatacagatagataaatatatatttctctgaatgcaaacaggcaggatatgcatacagatagatgtatgtatgtatttgttaattgcaagtgtggcgtggaggctgctgaggaagtctccatgcactcccagtgatgaggtagcagcagatctggattctggagtgggcagtggatgataaaacaagcatttgcgcaacacatgcgttgctccagatctcccacatgcatatgcctggctgccccagctcttcttttgagtggtgcatctgaatctgtgtacttgaaacctgaggctctgcgacccagctggttggtgttgggttaggagctgcgcacatagaaactggatctgtgttgcattctacagtggcagggccaccttcccccaatgctgtcagtcaccaccacatcttcgtcttgggatcaataatcccctccatgtatggaggaaggagaggatgtggagacttcttgaccactataatgctgttgctgtcctctcactttcacacgacgctacaaaagactgcaccgacatccatcagcgcaaatcaaggaggagcagtgaactgaaatgcatggatacaatacaacaaacaagagagaaaactaaacagaacaaataattcaataccaaaaccaccgagctctgactggtcgttgcctttaatttcttatatatacatacacgtattcaaagatgatgacgatgatgataatgatccatccatacatacatacacagtacgtatatacaatacaatacatgcatgtatccaacaaacagcccatcatccaacacacgaatccaatgcaattatatatgtcctgtatccagcagagccgatcgatctgaatagaatagtttagtgatggcgaaaggcatcgtagctctatgatgatggtgatgatgagttcgtcacccaccaccgtacgctatcatccatgcatgttcttcttcctccttcctcccctctctgcaagcagcaaattaagatggtcgtcagtcgtcactatataagcatctcttgttcctcccctgcgccttcctctctctctttccttttcctcccgtcccatctctctctctctcccccttctacatgacgttgtcgatgctgtagcggcagccggcagtgtatagagctagcc

SEQ ID NO: 6570 - DNA, 1500 bp, Zea mays
tgatgatttttttaattgaatcacgatgtatatgatgatatatgagctgacgtacgtcagccgcaccagcacataggggccaactcgctagctaggagacctcttacgaagaattaggaaatgctagccttgtctggtgtttatctcattgtgttgcgtcacttgttccgattattgtgattccggtcttgcattgcattcatacattctctaatttgaatatatatatataactgctagctgaagtagtatttgatattgagctcttgatgatgttgtttccttctaagatttagatacaagacgcatatatatatattcacccggttcctggtaacatgcatgccggtagttttgattcaacaccacgtaacatgcatgccgcattttagaggcgcgcggacccatatcacgatttaaaatataaatttatatgacatttgtatatcatgtttaaaaatataaataaacttataaataattctagtagtgtgcttcttccttggtaaccataagactatgggcgccagctagcagatcgtgtatatagctgcaccttgattcattcctagctatgagttcatatttatcttccaaattttagatttcctgttcttccttcttattagctataagtatatttttattttctaaagtttagtcctcttcttgttttgtctagtgagatctctacaccttagctatatatatgtttattttttaaattttagtctccttgttctgtctggtgagatccctataccttattttttttcaaatttttttgcacttttcttactgaatgaatatgattttattgaataaaaataactttactgaatttcataaaaaatatttttatacggtatcatctagtacaaaatcttgtatcatctgccggtgccgctggctgttttgatcggttcccgtggcgacatgcatggatgcatatatagtgctgagctggtcccaaagatgagatatcgatctcacatgctagcgcgcattgcctgatgaagttgggaactggaggaggcaggacgcaggaggcatttggttcctagctgaccacaccccgatcgagctcggatctccctcctggtgactggtgagagagcctgagaatgcatatgcataggtcgccatcaatcctggacctggagattcccgggcgctagcttatgagttatgacttgtgacatgcatggcggtggtggtataggataactgaaaagctagctacctatgctgcatgatgagccggacagagcgaacactcagcagctcacacgcacacagttcacagctagctttcctttgccttcagctgtagcagctagtgccgcactaccaaaccctatataaaagcccgcgcgcgcctcgttcctcttcaaacccaagccatcatcatctatctagactagagcaagctaagctcggctagcattccagaagctgcatctattatcagctacctctcgattcatcgcttgcgatcga

SEQ ID NO: 6571 - DNA, 58 bp, Zea mays
gctcctcgacgtcggcgtcactacctcctgatgctggctgttggcgcgccgccaccgc

SEQ ID NO: 6572 - DNA, 842 bp, Zea mays
gactggcctaaaaaaaccacactaggcctccaactctatctatagtctacctcctgtaaatctcctccaattatattgccggattaccaaatcagctcagagaggagggagctcaccgggacagtggccgtgcatgcggatgcatatgcatagcataggacccccccaaccactctcctcgcacatggaaagggcatgctagggcggtcttgccgtgtccccccggtcctggatgggtgtgattaggccacgatggccaccaggcgccaactttttaataagtggccattctaacactgggggctggctgctacatattctttcatcacccccccgatccttcactttgattcttcctgtctacctaggttaaaataatgtactagtagctgtactctcctccctccacctctctctctctctctctcctcgagatcaaatgcacctgcaccaaagacctccctgggcagcaagaaagtctcctgctcatcatgcatgcatgtacatgaccttcctactcctagtctcctagctaccatggaaatatataattgtacaccaatggtacagtacatgtacaggcaggcctcgctgacgaccatctagagtctctactgctagtgctactgctagtctgctacttgggaggctggctataaatggctggccatgacatatgcaatgcatgcctccctcagctccctctacacagcacacctccaccactcaccacctctcctcgctgccgatctttcttcccttccttccactcggctggctagctagctagttagcttagcatcccaccacaccacaccaaggtcacgcggcggccggcaaga

SEQ ID NO: 6573 - DNA, 581 bp, Zea mays
atgtgtctttacatgtataccgaagaagatcatttggatagagatcatagtttacccccagatttggaaaagtttcatgagaatatggatgcgaagttgactttagtttggctacttcagaatgatggatagactgaaaggactaattaagtattggaagacatgttgagagcttgtcccttcagcatggtagtagttggaacaagagtctaccttatgctgagttctcatataataatagttaccaggctagtctaaaagatgtcaccgttcgagactctgtatgacaggaaatgcaggactcctctatattgggtcagactagaggaagacaattctttgggcctaaacttattcaagagacagaagaacaagttcgtataattcgagagaatttgagggtagctcggaccagacaaaagagctatgctgataatagaaggagaccattggagtttgaggaaggtgatcaagtgtaccccaaggtgtcaccacttcgtggaatgaggaggtttaaagtcaagggcagattgttccctcgctttattggaccattcagagtttctaggtgagttggagag

SEQ ID NO: 6574 - DNA, 237 bp, Zea mays
ctttccctatttgattcaaattcaaacaagccacaaattcaaaccaaaccttccaagcattatgcaccaagcaaaagtgaaatctagggttcaacatgatgcaacaattcatactcccttagggtttaacataataaactataattacaaataaaataagcacttagctcctatagaaatgagaaagaaaagaatgaggaaggatgagaaaaggaagtaacacctgaatttgtgaat

SEQ ID NO: 6575 - DNA, 363 bp, Zea mays
gcctcccgaataatcgtcatgaattgccacattgccatcttctagtacgaaagagcttgaaattccgggataaatctcagttctgtcagggcgtaaactcggttatcggagcacggcgcaaacccaagaaaatcaatgccttggccacatttcccgctcttttgtttccaatcttgatcccgaaacatcagtcgaatgaagcgaacaagggctactaggattgccgaaatcaacccttcagcttagagcgaggcaaacgcatatacgtacgtaagccatttgttctgtaggacgacagatcatcacataacacatattgggacgagaaaggacgtgtgcacgtaggggtccagcactccaacc

SEQ ID NO: 6576 - DNA, 396 bp, Zea mays
tatatgtaccgaatgggactgagccgaactgctctgcagtagcggccggcggcggtgttccccaccagagagaagggagcagagccgaggagaggaaatggataacacacaacatacctttcagagttttgatgagttttcccttgagacagcatgactgcaggcgggaaagaggaccttgcgttgcgtgggcctggtcttatgtggactgggccgtcattctctttgggcctaaaaatatagtcttggactcttggtccacttaagcgcgagcagatatgttagcacttagcagcattctttggtccaacaagtcgagagaagcgggccgtacgccaccacggcaacggagaagaggactttcagctgcggcggctggccggcgcggcgacgggg

SEQ ID NO: 6577 - DNA, 502 bp, Zea mays
gtacccctggtttcaagttttgtgttgagggctagatcagttacacacttcaattttattccttgtcgatgttccatttgactcaatctttggtccatctgatctgtaacagatcctgggtccaaacattctttgctggctttgccctactgcgacggggcatctgaacgatggcaccgagttccaaatcacgaacaactgatgaatgcgccagcagcatttccagttaccacgtgctaccgtgtagatttccctgttcattcttgtaaccaaattgctccggtaggcctacaatcctgttgcattggctttcttgcgtcttgctagctagggcacctgtagaaaccttcagttcttcccgatcttgtaacagcatgtaaagctttttctccctctcccagtctccatgtattttgttcattttttgttgttgtacgagtaaagttgttcttgaggccgaacctactctactgaaacattggatcgtgaagttaatgtgaat

SEQ ID NO: 6578 - DNA, 633 bp, Zea mays
tccccgtcgccgcgccggccagccgccgcagctgaaagtcctcttctccgttgccgtggtggcgtacggcccgcttctctcgacttgttggaccaaagaatgctgctaagtgctaacatatctgctcgcgcttaagtggaccaagagtccaagactatatttttaggcccaaagagaatgacggcccagtccacataagaccaggcccacgcaacgcaaggtcctctttcccgcctgcagtcatgctgtctcaagggaaaactcatcaaaactctgaaaggtatgttgtgtgttatccatttcctctcctcggctctgctcccttctctctggtggggaacaccgccgccggccgctactgcagagcagttcggctcagtcccattcggtacatatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactgacaccgcacgcaccgctgtgacgagcggagtcggatgccgcgggcggtggtgccggcgccggcgccggcgacgtt

SEQ ID NO: 6579 - DNA, 396 bp, Zea mays; identical to SEQ ID NO: 6576

SEQ ID NO: 6580 - DNA, 115 bp, Zea mays
ccgattgctgcccagatcagccataggaataaaatgccttcatgatccgcatgtgcatgcgctccgcccttgcaatctgactcttgccacccatcctcatcgatctcccaataaa

SEQ ID NO: 6581 - DNA, 69 bp, Zea mays
agtgcaaatttctgtacttttttttctggaaactggcatagcctgatgattttgtaggttgctcttaac

SEQ ID NO: 6582 - DNA, 191 bp, Zea mays
gtgtgcgtggccggacctgaaaagccggttcctcccccgaccccggcgccccaccgcagccgccggctcccaccgcccggcgcaccccgtcacctctccaccaaccggatacccggacggatccgctcccacctggatcctgatccggggaagtcaaaggggagatcgaagcttgagcagagggagccaaa

SEQ ID NO: 6583 - DNA, 837 bp, Zea mays
cccacgccgccggggtcgggctctgccatgagacggcgcatgcagctgacatgccccgcggccgcgtcagactacgctagaagcagtggcacggtcgcacggagatggctacaggcctacagcgagcgggcgaggtgtgtgtgtctgtcacggcgggcgcgccggtgttctggccgtggattcccagagttgcaggaggtcgggtcctgctaaaaattcagttagctgggttttagttttcgatggttattgcatatattttacattaaatttatagtatacatttgatatagtttttgaaatataatctgtaatttttagttctaaaaataagactcttattaaatccctacttatctattaagatgataacgtagaccgtcctccctcgtcgcgagagccacctccccgcacaagccgcgcaatgcgtcctacccgacactgtcgttccgcaaacaacctccgcgcagtcgtcgtccacacttgcccgcctggataaggatacgaagtccaaatcctcatccgaccggttccctacttccctcaaaccacgtcctctgcaacgagcgcgccctacgcgacggcgttccctcggctacctctacctcctggacatgccaccctcctcccggcctccttcgcctcaaccctaaccccgcaccttcgaacccattgctgctcccctctctccccggctctaatccgctcctaacttccgccttgtttgctgcaaggaggcgtgcgcgacctccagttccaatctgagcgactttggtggcatggacttcctgttcaycatcgccggcttcctcaccatcatcagctttggtggcggac

SEQ ID NO: 6584 - DNA, 1392 bp, Zea mays
tgacgaaattttacattggtagtagctcttggccaacttttttgcattttagccttttagggtattattttcacaaatacaccctttgcagtttcatttaaaaaaatggaccccggctcggcgccattataattggcgccgagacaacgcgtgacggcgccaaytttaatggcgcctgtttaggtgccgtggatggtgatgtggcaggggttggcgccatagatcttggcgctggcatctcgtgtcagggggtcagcaccatacatcttgacgccgatccctggtgtcggcatcacgtgtcaggcgccgaccccctttatatatcacacgaattctgtatttttctcaattttttttaaagtcgtcttcatcaattttaaagtagttcattgccaaataatattgctcgacactaaataatacagaataaaaaattatatattttcgttgcaacgcacgtgcactcacctagtccattaattaagcactaaaaaaaggacactttgcacggtgtagctgacaggtgggctggtcgtgccgggcccgtacgtcacagttgctgtgccgatactgggtcactgtagggtcaccagcaatggttcaggtcggccggctgcttgtgctattcttccagtcgtgcccgtgcgtgctctccccaccaccccagcaacacacgtaatacaccaccaaactcacttttttccgtgatgcgcacctaacatgcccactgacgcatgggccctcttcgatccctttagcgtgcgcgggccccacctgcccgaattgtttggcacgaacgcaagcaaagctygagttgtcacgtaggtgagacgttccagtcccacgacactgcttgctaaaccaaccaacacctgtacagcactaccactgaaacgtgggacggacgtgctagcaggtagtcgggccatggtgtcagtgtaaggcttttcgttgcgatcgtgtggcactaaaaaattgtagcttactgacaggtgggaccacccgaagtgcacctggaggtaactcgtggaaccaagtttatccattatcgaaactcaccggcggtaaaaagaagcaacatggaactgtgcaagggctgtcccgcacaaaacttttctaatctcactggtaatgggaccatgcgaccacattgcacatgtcgggcccacctggcggcgatagtacagcgagtctgggttgggtgcgcaacgttcgtgccgctacggctcggcgcctgtatgcgtctgcagtccattaaaccaccaccatctcttcgcgcaacgcagcggaaaagcgccatctcattcttcttcctccatcttgtctctacttgccccgcgccggggagccgcgagcgtcgcgccactcccatcgcctgcccacaactccgcc

SEQ ID NO: 6585 - DNA, 1500 bp, Zea mays
tcttttttcgttgtccactgcattttttctagaaatcagggtggtgtttctcaccacattgtttctgaatattttaattttctagggatgcagccccgatgtcgtccccgcgaccagcagttgcggcaagaaccttctttttttcgttgtccactgcattttttctagaaatcacaggtctggccgagtccgatgtcatcgctcatcacggttccatcggatggagcagcacttggattagttcatattctctgttatgcagtgagttccatgtcgttattcaatgaagatgtactaatgttattttatcaaatgatagactaggcacgagttttttgttgttcacagttcgaattagctcacttttttgctttcctcttggtacttctttttctaggttcactttgtgtctcctaggaatcatgctattcaacttaatcaaaagttctttccatatgtttagtgtctccttaatatattgtcatatgtcatatttttctgcttcatcttatctttcaactttttttatcatgtttgctgttctttgaagaagtttatttgttgtctcctgtcatctttttgttggttactttgttccatagttcttacaaagttgatccttgatgtactgcaactgtagtattcctttaataagcttaagaagttaagatgctatgtaaatgggcccttttctaaatctaacattcccccaaaaaaattatatgctctgcatattcagtgtgaaccttttctgttctttatgtgcaactaaagaacctttagttaattaggaaaccgacatttctagaaatgctatatattttacatttaatatgatgttaacattaatatacaatttttaacatatccatacctgtaatgtacaatggaaagtttgatgttcataatgtaaagttgaacgttggactgcacacctgcaaaaaggccatcagtatcaaataaatatgtaagctactaacacctacaatttttgctcttaggttatctgtggagtttactgaatagattttattgaaaatacagtcgcctatttgattgtcctctctatccttggatattatttggacataggaacggtgcatgttaatttgatagatgagcagttacaaaatctaatatacaatggatagcttgaaggaaaggaagcagataggtatatgacataaaaggaagacaacaagaatttcacataggtgagaactatttttgcatggcttagcaattgatgaatatcctgtcatagtggcacaaaactgtaatgttcaagcctatgcccgtcacaatttcctttgagtcaagccttgcatccctagaaaattaaaatgtttagaaacaacatggtgagaaacacggctctggtttctcaaaacaaatgcagttgacaacgaaaaaagaaggtatttgccgcagctgttggcggcggggacaacaccggggctgctccatccgatggaaccaagggggatactactgtacaag

SEQ ID NO: 6586 - DNA, 54 bp, Zea mays
cgagcccatggggcagttcgtggatgacgacatcagggacctgcctagatctcc

SEQ ID NO: 6587 - DNA, 100 bp, Zea mays
agtacagtcttttcccctacttcgtatagagctcagtaaagtatcgattgatttgcattcagattcagtctattcacatccatttcagcactaagaggtg

SEQ ID NO: 6588 - DNA, 317 bp, Zea mays
agtgagccttcgcgtcgcgcgcgtgtcatctgtcgctgtcacgtccacacctatcatacgcttgagctttgatagaataaaataaactatgcgcggcgcagaacatgaacaacagagtagagcgcggcgtgcgctaactccaggtttatttgcgtggcgtccagtgcagaggccagccggagccggcgctgtacaacggaggcattctcaagttcggcagcagcagcagcggcggcggcgatccggacgggtaccgcacgacggagaccggcgtcttctccccggcgttcgtggtgtacaacctcaacaagaccacc

SEQ ID NO: 6589 - DNA, 959 bp, Zea mays
gtacccctggtttcaagttttgtgttgagggctagatcagttacacacttcaattttattccttgtcgatgttccatttgactcaatctttggtccatctgatctgtaacagatcctgggtccaaacattctttgctggctttgccctactgcgacggggcatctgaacgatggcaccgagttccaaatcacgaacaactgatgaatgcgccagcagcatttccagttaccacgtgctaccgtgtagatttccctgttcattcttgtaaccaaattgctccggtaggcctacaatcctgttgcattggctttcttgcgtcttgctagctagggcacctgtagaaaccttcagttcttcccgatcttgtaacagcatgtaaagctttttctccctctcccagtctccatgtattttgttcattttttgttgttgtacgagtaaagttgttcttgaggccgaacctactctactgaaacattggatcgtgaagttaatgtgaatatgtgctgcaacttatcccaaattttaggccacacgaaagtgccgttccatctaactaaaaaaaagacaaccttagagctagtttggtaacctcatttttttaagtatttctatttttacaagtaaaattatttttttctttaaaaaatagaaattctttggaaaattagagtctcaaactagcttgtgtacgattgaagagaaatgtttctaatatacatattttatgtaacaaaatgtgggttaatgttcctgtattaatttaaatggtaggtaggcatttgcaaaattttcctgttctttcaggtagtgctgggcccacacgcagtgacacactgacactcaagtcggcgaataggagaaaacaagtacgcggctttcttcacagatcacagcagcatccagcatcgggtcaaaacgaaacgaagcatccacgtttgtcgctcccacgctggca

SEQ ID NO: 6590 - DNA, 850 bp, Zea mays
aggttcccgcaaggaagaagacgaccttacgccatcgctgaccgtccggtcttatgcacgaaccgtcggactcgacacatggaagaagtcgcttctgtcaccaggtagcataccgtccgcgtcgccgtaggaagcactgccagacggcccagtgactcgcggaccgtagtcgccgtccacctcgtagagccgaacgtaatgtattgctcatcacaagaggacctagggttcgttgtttagacttaaataggtggtggctatcatagagtgtttccatttgctgcaacttgcaagagcttctttttaggaatcagaaacttgttccagtcacggcctcacaagcttgcaagagcgaacgcactgtcaggggcctaaaacatccccatctcacagcgacatttttgagggcatcttctcccagtgagcagtctgcgcgtgagtgactatcgcttgaagttggtgggggagcacgatgatcgcgatatgatcgagcattcgagcttatcgctacgataaacggagagaaggaaaataaagataatggcgctcgttgctcgatcagtcggcagatgctatttctgcaataaaaaaaaaacagggcactgtcaatggatgttgaaacagtctgacaacgaagcatagcaagcaagaggctgtaagccgcatgatgctctaagctaaggcagccttcttatataccacatccacaccacaaggggtggtgcaagtgcaagaacaagatacaccttccttcggttaactagctacctaattaccagctgccagccatcttgtgtcagcacactgcagtgttcgtttctgtcgggaagagagagaagaggcagcgacg

SEQ ID NO: 6591 - DNA, 805 bp, Zea mays
ctatttgtgtcgcatttatttataacaccaacgcacgcaacctgacatttttcccatcccacgtgtaccaaccgtgtaagcagaacggtaggtaggtcgccgatcgctcagctactgcagttagctcgcacgtcggcttctcgttacaggttgctgaccatgcatacatgcatgggtcttcatccttgggtacctacaaaacggcgacacctgccaatacttacactacacagattaaactatttgattcaccatgatggtgaaggccagttaccagcagccagccgatgtgcatcgacatccagctcgcgcttgcatgtgacgaccttgggtccttggcagctaagtcaccgacggaacgtgcccagaacttgcagaggggctggcacttgtaagctgttataacccgatcaaagtccactcggagcgcgaggcagatgcgaatgcgatgcactcctgcaccacaccggcggcaccgacgagagatgagggatgccgcgccgccaccccgacccgaaacaggggcgctgcggcatgcatgtggtgccgcgccacgttaggtgcaccgccaggtgaagaacggtcgcgcctgcatccccgagtcgccgtcccctcttcaaactataagactcccgtcccgagcgagacggccgatcgcacaaagcccaccaacctagctaattcacccgctaccgcctaccgctacgcagcaggcagcagcagcgcagcgtagcgggcggcgccggcgataacatcgactgagcaagcaggacgtgctgcgcgcgcgcgtatccgattccgatcc

SEQ ID NO: 6592 - DNA, 613 bp, Zea mays
gtagttttatggagagctcttagagggccactgcaggcgagcgagttcagtgccgctaaagaaggttgtggcggtcgatcgattccgttcggtttttatccctagttggaaaactggaaatgacactcgatgactcaaagtcggttgcacttgcactctatggaagcattaacggccaactatttttaaatttaatccaatatatagaaacatattaatatttataatatataattattatcattagatttaaatttaaatctaattttcaatttaattacaaatttagtcaaatttgataaaattttgatcgccagatatggtagatccactattttaaggaggaggagagaatcttctttttgtcgtcatcaatggcgcggctagatagcacacgccgcgtgacgcctctcccggtcccagtccattaaaactattagcaataactcaccatcaccatgctcaaagcctcaaaatccctcaatataaaccctcaagacgcgcgcgcgagctcagacctcagagtgcgcctctctttacaaattacaaccaaaggaaagcacgcgcaggcgccgcgagtacaggttggcattattgaatccgcccacgaaca

SEQ ID NO: 6593 - DNA, 151 bp, Zea mays
gggttatggtaagcctgattccctggcgttctcctatttttgtactttacagaccacaacttcaaagggcaataggaatttctttgagaaaaatgtagtacagttcctccacaaacataatgatagtttgaggcaacagccatacaacaac

SEQ ID NO: 6594 - DNA, 295 bp, Zea mays
ggtagggctagaagtcggtaatggtgggactcctcaaagctagcttagcttttgcacccttggggtactaggctagatagagttgagtcttttgggccattgatgtaatcatgatacactcttttggaagcatggttgatggatgatgttcgtcttaatttgggaagaaaagtttatgccttgtgaaatcctttatgtttatgcaagaatctatcactttgccttttgactttttcttcgtgactgaaccttgaaacttgaagatgtgttattaagaaaatatgtgatttttcag

SEQ ID NO: 6595 - DNA, 505 bp, Zea mays
cgttgcagttgcagtgccattgcaggtaggacatcactctctggcaagttggcaagcctgactcgacgccacatgcggcagcccgcaagtacgtacgtgcaatcgtgcatacgcatacgagcagagtacaggcacgcctacctgtatggcgctaccaacgtgctgtcatggtagcttgctgagctgaagctccggtccggtggttggaggatcacatcgcggcgcacgtaaagagagaagagcgctggttggggtgccgtgacacctgacttgccacggtcgcaaagttcgccctataagggccagccaggctcgaacgtgccggtgccggtgctccccgcgcaaacacgcacgcacactctggacgcgcgctggctggctgcaactgcaaggcgtcgccaccaaccgcagctataataggtgtattgaacaggcaggcagagcagggcaggcagtgtaggctccatcagatccaacgccaccagctagcagcagcagcagcagc

SEQ ID NO: 6596 - DNA, 624 bp, Zea mays
tgtagtgcggcgcgcggctcttacgactgagctgaggccaaaataaagcagcaggttcgttgggggcgataatcccaggcggtgcactacaatttgaagtgtactaccctggcactctaaaagcatacacgcatgcaaaagcagctcccgctttttttgaatggagaagattatctcaatcgacaaatatatacgcgtaggacaatttatacactttagttatatatacatggccagaaaattgtcatctctaaagcaactacactgaaaaagatctttgcattttcacagtcccacaaaaaaaaaacaaaaaaaagttaaagagacatgtgcttgaagagcccctgcgcacttgtacacggtgacacaacatgcatgtacaccaaggcctgcctgcgcgccacctcgtcgtgctcgtgcctatataaagccactcgcatcccagcctatcattgcaagagtttgagacagcagaggacactcctcctcagaactctcccttccctcttgtaggggccaaaagggtcagagatctaggaagaagagaactagtccccaagcctaacaagaaagcaagctcttctgcaactgttggcattcgccttaatttgtatccatatccca

SEQ ID NO: 6597 - DNA, 1500 bp, Zea mays
tttccctgtttttcttggtttgctcctgcatatactatgttctcactcctatctaaataacattctggcctttttagatccactatgtttagaacttcagatatacactatgtatagatacataataaaaaacaatacattttaaaaaaactgaaacgtattataatttagattggagcaggtgtctgcctgcccgagatgataagaatatatatcttcttttttcttctcaaccacaagcaatgacaagtgccttttcttgcgccgtgttttcttaacaccatcgcagttcctcgccactttcttgtgttgggcgttactagtattttatcatcacaacgcactatgcaaagtcgcttattaggtcaagctccctcagatattatatcattattattgtcgtaatcctcatcctcgttttgacttgctcgtcaatcggagtagcagcagggatagacatggattttttttcaatggacccacctgtcagccacagctcggacaaaggaaggaaaacgacacaacactaccaattgcaacgcactcgtttttggacaagaaacagaacagggagagggagattaaaccatcgtttttttccagcggaaaaaaggaaaggaatgatttttaaaagattttatcgatttctaaaattgacgctgggttttccgagatgcgtactgctgcgtcatacacctcatctgcctttattacgacgactcatccgaaagagtaccacaagcgcaaggcggcgctttgagattcgcgctgggggagggaccggacggctggctggagcagttggggaggcgggctaccggtctccaggaagaaaaggccccacgtcgctttccgcctccgcctccgctcccttcctttcccattcgcctcacctcgtctcgctctcgcctgccgcctcacctcacctcgccccgctccggccgcagcagccgccccagccctccctccggaaaatcccccaaaaccctaaataaatcctcgatcggaatccacggatgggaccgcggccggcagctccgtagtggactggaggtgctcggtcaggctcggctgcccgtttgatgccgctgctacggagtctcctgcaagctaggtttccagtggcttagtgttttggtttggtctgtttcttctgtccgaggtaacttgatgcgccagctccctgtacttcccttttcttaaaggcgggacttgtaatcccggttctttttaatagaattaacggatgaacctggtattcaaacgatttcatgtggtctctaatcatgatttctcataaagatgcatcgatcattcttccagttcaattttcatgcataccttcggattacaactccactctatacaagttttttttttgggggggggggggggggtgggggcagaggcggtactgatcaccatcttcttactggtttaggattgaaggaaaccaagaaggaaggaagcacgttgaaacaaagacagagggctacggcg

SEQ ID NO: 6598 - DNA, 459 bp, Zea mays
gcttcgatgcccacaccatctccacccaggaccgtcgccctcatccaccgttagaacttgatggctatgtgaaaccgttatgtgcgaatttgatgtctttgtggaacttttatgtgtgaacttggtgactttgtgaaactgttatttgttaatttaatagtttctgatagttataaattgttcatgctcatttttaaacatatgcaaagtcaagagatccttgtttgtattctaattccgtgtgcaaagtatccaaacaatatctagaattcaattgattgtacaaccaaataaaaataattctagtcgattgaattctatataatttatttctttgaatttatttcttgaaaaaggttttatttctagtcatccgaaaaggctgtcagctaaattcttcggaacccccgttgccagccggcgatcgcgccgtgggatctcatcgaggcgacgacggcg

SEQ ID NO: 6599 - DNA, 1500 bp, Zea mays
atggttaatttttactgtgatattgtttagaatataatataatttaagtatgactttgaattttttatttttttgcaaaaaatgaataagacgagccggttaaacttatcaaaaaaaagtcaaatgaattatatattgggatgtagggattatttaagttggttgttttccatctctattatctctctattgtctatgtgatattaaactttccactatgccaccttgaaggatgagtctttgagctcaattcccattttattataaaataaatgaactttattctataaaatttaacgcgcccatatgtttgagctcagctccacgctcgaggccataatctcgtactagcactgtcagtctcctcttctaaacacacttcccctacactacagaaaaaacaggaaaaacgttgcccacattaaaaacgtcgctgaggttctcaatcccgttaagaatgacggtttctattgccgacgtacttaccaacatgctgacatgcacgtcggctaatccgtggccgacgttcttagttcttaagaacatcaaccatcggccaggatttgatcaacattcttaaataagtaagaacgtaggttttaacctagccgacgttattaataaatttaagtactcgcgcgctcatctcttctctttccttgtggtttcatccaatccgcacagtattctcacaagccgccgcctttttttcctggttttcctgtttagctaacatgtttccagttttaccatcatcacaacatataatgccgaacactaaaagtctgctggacgatcctcatgcctgtgtcttctgttcggtgttgtaaactggatcacgagtattttcgtcggtgtatgcggctgtccttttgttcctggcggtcgccatatgcttcgactgtttatggtgtgccactatcccaccttccccgttagctttttttccgtgcttctatgaatatgtttttttcgtaggatttacatctattaagttgttgcgcctacacattaaattcctcttaaaaacatatatcactcgtgttttttaccgaatgatatatgttgatatagttaaaccatgttgttttgtgattcttatttcgtatagaaatgtgtgatttacttacaccacaagttcgaaagtgtagctgcattcccaatacatccaaatatatctgtatttcctcttagatactcgtaaaattttctggacgagcagctgttccaaactcccaaacaggtgataatcttatcaatttctaataaattgttttgatgaaaccaattcacaaagggtatatttgctcacaatttataacgagcgcaacgtcccctaaatgcagtatacgatgatttgagggtgtgagctgaaaaatctccacatcaccagattacggccggcggcggcccgctctgttccatcgcccccaagcggcgggccttggctgcgccgcctaaatccaccggcgagagtaaagggcgcccctctctcacacg

SEQ ID NO: 6600 - DNA, 170 bp, Zea mays
ggtttttaatccaatcccaccttaataaactcattttgtggttcattctctatgtgttgaatattttgtggttcattctctatgtggttgaatatttcttgaatcgaattcgtttttatatttccctgttaggtttaattgagactgctaagtgraatctgcgaaggata

SEQ ID NO: 6601 - DNA, 1421 bp, Zea mays
gtccattccggaggcgcgtggagggtttttttatatatctttatggttttcttggttacagggaggaggaagaagaataggccggtgagggtgttcccgacggacaaggggacgctctggaagacacgatccgccgatggccacgctgagtcctggggtagattgatttcgcagtctagattggtgaagagatttgtatggtcaggttgggttgcagattacttgcttgttacagttttacttatacttaggaaccaagactagcttagttggtggagggcatagatattttcccatacaacctaagttcattgcggcaaatttggagacctatttcttcatcttaattcttagtgaaaagccaccaagtccctcctaggttggtcaagtattttttagagtttttacttattcttcagtttatggtggttgtagctaatttgtttattcgctatttggaagaaagggtgaaggttccatggccggtttcagagagagaggctattctacactattttgaactggaatatcttaaagaagatgtcgtaattgtgataatgaaaactgtgcgtacttcttcttctgcattttaagttcttttctgggaaactctccgtcattgtgataatgaattgttgctatattccctaatgttagatgaaagagctggtatgcttctgtgttgtattcccttagtagtgttttggacaccaaggaatgcagtgatatgagtaatgacatgatttgtttcttaaacgatctgctatttagctaaggaaaatctccatcttcccctatcaaatgcactttgtttgcttcagttgcaatggttctctatcacactaagttttttttacacagaaattgattatgtgaaggtatcgaatacaattcttccaagagatatacgtgtactgggttggtgtcatgttccagcatattttaatgcaaggttagctatgttccatgttttatatttttcttcttgcaaggataaatgcactattttgcaaacaggcaaatatatgatatatctattgacaagtgttaattctaaggagataaagtgctccatcgttttgtgatcagattattatgtccagttatatgatgatgatactttgtggttgctgattggcacttgatttttttctctcactgctattttgcaaattcacctgtttgagccgggaatatacttattttggaaaggggacttggatctattggtacttacactacctttgatttttatacttgcccagtgagttaagatttgtccatgtctattgagctaccaactttcatttgcaagtactttacatcaatatggaaagtagaaaccttatagcttgtgaaatcaaatgtgtaacacttggatttctattgtggtcaactgatcttgctgcatcaattttgag

SEQ ID NO: 6602 - DNA, 88 bp, Zea mays
ggtacctaaaacccaagcctaatttgccttgcaggtttatgcatccsggggctcaagctggattatcaacagcggatgcacaaaccac

SEQ ID NO: 6603 - DNA, 1500 bp, Zea mays
caggaatcatatctcgtggctttagagagaagactccatcaagtgtaagagttagaaaaaggaggcgactaacgatagatatgtgtagagagaaacttttttcaagtgaacgccaaatttaggccaagaatgcacatgatattattgtctgttgcggagaaaagacgaagccagtatcgtgtaaagaagagggcctgccattagcttctgtggacgggagagattgtatctatgggcttaaaaggaatacataactgcatggatgttaaagtaggagacacaacgatagatttatgttcaatgggtataaaggggaccaccttcacgcgaaaacacctaggtgaggagtgctaactggtcaaatcgtatattgcgacctgaaagggttgccattgtcacgcgaaaaggagggcttgtatggtacaagggactatatctatgggcttaaagaaaagatagtgtctatgatggttttgcgttcaataggtgtataggggccacaaaagttagatcaaggatgttcacggtaggattatgtgttatggacttgagcgaaagccaacgttgcgtggagagagaggatattataaaaaacttttaaggatataaaggatcgcatctatgagcttagaaggaatacaatatcacgtgaatgccaaatcatatatgttagagcaccaaatcatatgttccacacattttttgagtcttgctatgtgtgttgataggagcacaaaatcatatgttagaatatcaaattgcagcacaagtttctacacacgaaatataagggacaacctatgtaatcaagcatcctaattatagttttaactacatgcttaatatccaggaattatatgtttgtccatcttaaaaacttaaataatttattggtgtctgcgtgttagataactagatttttgtgacaacttgggggttcagcacttctcctctcattcaatctgggttttccaactcaaatacttactggggaagcggacgacaactgacaacagcgtctgattatatatttattcccccaaacagtggcttatctaagggattaatattttttactctaaatattttattggtaaggaagttgtttgtatttttttgtaggatttggtttcttttaggctgtttctggacaaactgccacgtccgacgagacagaagcgaagcgaagcaaagcaaagcaaagccgaaagtgacgatcccagtccagttcatcgggctggcggcctagcccattcagcatgcacggcccaacattcccttccttccccgggcggcggggtaggattccttgccgtctcccgctcttcaccacgcgcttcccgcgaaacgccaaccaattcctccgtcgatcaaaaactgcccctctcacaaggagaaatctttcccgcgggcggcggaggaattcgcggattaggttggtgggttcgaccgatccgcgtccccgggttcccaagttcccaggtaagccgagcccggagc

SEQ ID NO: 6604 - DNA, 491 bp, Zea mays
tgtaataagcccatatctcttcactgacattggaaatagcaataccattgaaatttgttgcgctgtgagatttccttggctgttgcgttggttgtaatacactaatacctgtgtaggaagtgcctcaagcgatgatacagacacaggttgagccaataataatatcatgaacaaaacaccaaagtcttcttgagcagaggaggatgaaagtgacgtggacggttgggttaggtgatgcttacctttctggtttcctagaggctctcaaggacaggttgtgatgtctctccatccttttagttccttgcttcgtctctactcccaaacccaaacctgattaatgcctcgcctccattccgtactctcctgctgaagcttttttctctgaaactagtatatcccccatctgtttggtcccgacgattttccgctttgggagcaccaccaagctcttccagcttgcagggctggagtctttgccagggacagca

SEQ ID NO: 6605 - DNA, 707 bp, Zea mays
tgcagccgacgtattttaggcccgatttggcatagctaagcttcaccattattgaagctattatgttttggaaaacagcttcacaagtagatttctcgatgaagacgaactgctttggaaaaactgttcggcgaaacagcttaataatgtgtggttgagagaagaaaatgagtgagaaagctatgaaaatctactttttttcatcttcacctcccttgatttctttgtgatagcataaaaaacaagcttcatccgtgaaacagcagttttgtaaaaaaattgtttggcaaaaaatagctcacaatatcgcatgaaattgttgctataactgcgctaacgtagctttactgttcccctccgatgtagctagcgcatctattgtttgctctccacatctctctcgtgcgtgtgtccatgaaaaggatcacacacgaatgatctacacagcctagggagctctctcctttgtctctttataaaagggacatgcctctcccttccgtgcatgatcgctacctcgctttccctcttgatccctggctgcaaattgccattccgacataataaccactgcaccagccgcttcggttcgcctcttcctactctccatatatctcatcctgatcttcactcatcacctaaccatacgagatctgcatatatagctccatcagatctttgagcgcaaattcctctcagtgcatccc

SEQ ID NO: 6606 - DNA, 939 bp, Zea mays
cacacgataagtgtcgagaatgattgaggaaatattggtcgttccacgtgattgagtaagaatgagagggaaataaaaggatttggtgcgttggttttgaaggcaggatttggttaggatgggtggacgtttgaagtgatgagtttttcaagcgtatagattttctatttgtcctttttaattaactttctcccagccgggatgcgcgtataaaaaccggcgaaacccttggctctcctcattcggcctatcacaaccacttactctcgtgcgctctccgtgggagcgaggactcgcggccggcggcagcggcaggttctcctagatctccgggtaagcggtgaaagaagaggaggtgttggaggaattagttccgaatctttctccattacgattttcgtggcgtcgaggttagtctgaagcacgcagttcaacccattcttgcgcacagtagatcagatccgatttgttactgcggcattccgattgctgagctctggttgccgattagttatcaacataagccgcggccaagcagttcttacggggtcacaagaagaagatgaacagtttgtccatcttgcctcgcaaggataaccgcccgctagtgcgtttgtatttgtttgatttctgaaatattcgatttggagtgtcattaactgccctcgtaacgtgttttgactgcagaaactgtgcctgttctgtagatttagatgaatcacagtgttgagacaagattcatctgaatccttttgttaaattagaaaatagagatgatccaaggtcctgtctcagtggatagtggtgtagtgtgtttttgccctgtttcctttgctgaaaatgcagctaataccaaacttgctgtttcctattgagatagatattctgttacttatcctttgtctcctcgtgtttttgttccagcatcatcagtaacaa

SEQ ID NO: 6607 - DNA, 746 bp, Zea mays
gtttaaattgatgtattatataatagtatagatatatctataaatacgtttaagactagaactttagtaaaaatttctaaaaattatcacaaaatctttagatctcgaacgcttgcttacataactttttatagtcgcgtgcgtatcacattaaaaaacggatgtaataatgaggtgtttagtttatctaactaaaatttaatctgtattacatatttaataaatctatcttatattatatttaatacttataattagtactcgctgtttcaaaataaatttcgtattatctttttagttaatttatacaacaattaatgtaattgttttatatatttgtctagatttattatttttatttaaatatagatatattattttggaatagaggcagtatttgacaagagataaaaaaaatccttgcgggctgatagggcaacgcgcagcgtaaaacacttgttccagcaaatttcatgtgccgagaacagtgcctgctggaaccaactaactgaatccaattttggaaaagctcgtcattgccgcgtgtctggcctgtgggcctcgcacggacatcagagacgattggaaccaagaaaatccgcaattttattgtcgtcctcgcccgctttctctgaccgaccggaaaggcgctgcccaaacaaacgcggaggaagaagggaactcgccgcctagggttccgccgccgcctactcttccgccgatcaaggagcgggaatcattgcgcg

SEQ ID NO: 6608 - DNA, 1500 bp, Zea mays
ttctgtcacggcaaaagcttgggaatatactagtatcaagaaacatctaggagcatgaagctgcgcacctggtccacgtgtcagcttacgaactgagaggacggtatggtagccccgggcgaggcacacgtgagctctcgtcgagacgatgccggtagcctcgtgtgggtcgccggctgcaaatgcgcagcaagtgttccacgccccagtcccagagagcagtgcacatttcgtttcgttggaccccagcacccaggaccaggagacctaatggttccggaaccatcgtggcctctcgtcccagttccgcccttccggtgagaactcgagggagcagcgatgtgaggtcacgagagcgccgtgagaactcggaactcgtctgggcggtctagactccacgcagcgtatagacgacgtggcccattgtgaggatatgactgcaagtctgcagaagccttgggagtccactcttgagccgcgatccagcacgtcgttcttgagttgagcatgaacgtactgcttcccggagctagttcgcggctgttaaaactatacgttccggtgctagaactataaatctgtgtttttttaaaggaaatgacaatcaaagatagaaattttgtcttagtattaaattaataaggtatttatgagagagagagagagaaaacagagagtaggaaggatagtagatgagggaaaaaaggatattctcatacaggtatggaatcatttgattgccgtgatcccgtcactaatttgtttcccgttttgaagctcagatgtcattgagatctaaggtggaacgtctcttcgtctcttgcaatgggacgtggactttggtccaccgacagggggaatatattatatgtaatatagtaatcaaatgcacaaccccccgggtaaaaagggtttatccattgccttcccctttatcgcattaaatctcgattcgactagtcccagtacgaatatgcaagttaaagcaggatccggcgaaaaaaatgaaagtaataaagaacatgatcaccggattggataattagtttcttaatcaggcgccaattagcgagcggaaattgcgaccataaatataaataaacgaggtggcagggcccgccactacagagagagcgtagaggcctgaacgtggtaaacaaatctccccacttctcgggccttcctcctggaattccccaaactgccccaccgagaaacttccgtccacggcgtccgggccgtccgatctgtctacgccgcgacacgtgcgcctcagatggaagagcggccgtgcccagcgaccgacgcagccggggaccattccgccctccggctatctatttaagccctcgccaacccacggcgaaaaccccaagcgaaagctcaagcaaatacaagctctcagttagaccacactcaaaccaaccgccaacaaacaggcctcctagtcccgaccagaacttgctcgtagccccgcccccgagaacccgacagcgcgag

SEQ ID NO: 6609 - DNA, 482 bp, Zea mays
cggtttctgtttttgatccctagttaaaaccacccgaacaacattcttgttctgttttccaccacttcgacttcgagatcagctggagcctggagcagcagctagaattgaacggttttctttcaaattcaacccgaattcgcggaattgttaaaactttgactagtaggcaaccaactagccgcacagttatccacgtcaccgcgaaatcagccaaccaataaagaatacgtccggcattatcctcttggtggccccagcagtatttcaacagcaacagcgcccatgttcccttcaatgcttccaatccttggtctccagctccgcctcgcgtcttcctttccgctgcaggaaagtgcaaacccccactcaactaaaaaaagccgcaaggcaaagagaaaaagcaacgcgaagcaaaccaccatttcggcctccccacccccatcccatctcatcccctccgaggctccagggacggcgtg

SEQ ID NO: 6610 - DNA, 1500 bp, Zea mays
tgatatattttgtcttttatacatcactatttagagttttaaaaaatactatcatatactaaaaaaattaattatgccattaaatagactaattagtggaagccccttgctcaccgggccccccgatccggatccattggagaacgccagggcattcgacatttcgacctcgagcaaacagggggagcggtccgggagacagccggaggtggtctaaggccggcagcactatcgactgtgctattgaccatagtcggttcttatctatcgtagcattctagtgcaatctttaccgtcactctacaggcatctcagtgtcacttaaactttttctcttgtagacttctatttgaaatgaaacacacgtttaattaraaataaaaatctatctagcacataccttccaaatgacgcgaaccaatttgaagttgccacattgggagttgtccactataaacaaattgtatattgtttaactatatctcttaaccattatatctattaaaaaactgatttggcatgtatgttcctgattttttacaaataaataaaattgttaatttcatttttaaaaatattaaaaatatttttatttcatttaatataacacttaattattttaatcctattttagttttaatttattgtgtatgtttattaatataacaaacttcgataagcaacaaaagtagagtcaaatatgcttttaaatttgtactatagaccatatttggcacaacttatttttagtttttttaaaaatttaagcagaagctctgtcaaacaggcagcttctgcaacagcttatcagttcagctaacaagcagaaactacttttcattagcttcttagataagctgctttttaacaaacattagctatgccaaacatgacataattgcttttttcaaagtagctatgaacaactaaacttccttttgattagcttctattttactaaagtagaaacaggttttaaaatcatatcaaacaccctgcaggattgaaggggattagagagaaaattagttaatttttacctcaatctccttcaaccttgaaggggatctaatgttttcaaagtagcccttagtaaggttgtagcgggttaaaatatcatgggctcttgatttgatcctgaaaaagtaccacctccaaatagtttctcgactaaaaaaactcgtaattcagcaaatgaagcacgaggagcaacagcaagaatacaaaaaacatataccggaatcaattattattatccaattaaacggcggggcagcatcgcgactaaatctaaccctccattatatatacaaatatccaagctattccggcagagaggagcgcatcgcatcagcgtcaccaataccacgcgagccgtccccccctccttgtccatccccggccggcacgacgaaccgcctgaggagggagcaatagctcggggctctcgctcttggctgcgtgtctgaagctgttgatgcgagtgaaggctcggtttcc

SEQ ID NO: 6611 - DNA, 246 bp, Zea mays
gcttgttcggttattcctatcccatgtggattggatgggattggaaaaaattatgaaagattttgacttgtttgggattgaaacccatccaatcccacacaatccacatggattgagagcaaaacgaacaagccctaaagagttgataatcccgacggttcgacttcgagccttcctttcatctcggccgcgccaacacggttctcagttaccagatcaagcccctttcctcttgagccaccgctg

SEQ ID NO: 6612 - DNA, 262 bp, Zea mays
taatctatggaagcagaaaacacttagggctggtttggtggacaagtaattgaaggagatctatgtaggaggaatccccttcctatttaattttgaatagcatggagatttcttcttcatacatcttctccaattctctagtcaccaaatcaaccatcagagctgatttggtgacctggaatccccttgtcaccaaatcaaccctcagcatccagagatgagagatgtctcttaattgagtatatataataataacagccac

SEQ ID NO: 6613 - DNA, 319 bp, Zea mays
atattatttctgccacaggtgtacagtacagaagtgtttgggagttgccagttgggacttgggagagtaaaatcacaatgtgccttcttttatctctaccaaaattcccatgttcataatgtcaaagaaagatatcaatcttaatggatcgcatccaactttgctatatgcatggttatggacgattcaacataagcataacaccttcattcagtgttggtggtgttgtgctatgcaaaacacaggcttcgttgtttgtatagtaaacattcggggtggtggagagtaggtggagtggcacaaagctggagcacttgca

SEQ ID NO: 6614 - DNA, 204 bp, Zea mays
cacatggcgcgcggggattagaagacccggattacacctcatcgccaccttatctgtgaccgctcgcaatccccgctgccatgtcgccacgcggcggccgcaggatatgagcatatacgcctcctccctgaactagagagcagctcactcccgctgcccagtcctcgccaccgcccagtccatcgccaaccaatggcctccgcc

SEQ ID NO: 6615 - DNA, 1500 bp, Zea mays
ttttttttcataaaaagtctctgcgcgcgaccgacccatctttttttttgtctaatacgcaggagagctgtgcatctttgttaatagaagaagagtgcgaacacaaatacaaaaacaagagctggccaaccagcttatcgctaatcccgagctgcggtgcgctgaggcctcggcccctcccccgggccccggcccggggacgagtgcgcggtgacgtgagcataagagacaacaaagctttgacacgcaaaagcacacgcgcacacagcacggcactacggcagaaggaaaaaaagaggcaggcggacgacacagagagaggctcggaacaaggaaagagtcgccggcggcggagaccccaaccgaaggcccccggtcgcttcgccgggcaaggcgtgtccgtgcccctcggacaccgggtaaagctcactcctttctgctgtagttttgccagcttaatttggttttgacacagtgattttgtcgtcgaggctggtttcggtgaatttggttgacgggttctcggtgctgccgtcgcatggatgcgttcggctccgcggcccggaggcttttgctggtgccgtgggagatcttggtcggggtttggagctttcctggttttggctgtggttcctgtttagcgtcgcctaacgcaaggattggtttctgtcgtttggtagatatataaatattcggttaagaggatttggtttgagctcgtctgctatacgagctggaactggaattaggaggtgacacgcctttcctggttatagcttcgatgctaagataagctcgagtgcttgaggcccagcggctgcgatccatggattagaggcgacggtagaacagcaacaactctgagctagctgacccaatctcagcatcatcttgtttgatcatgacgttcttgctttgtttgctttggattttatcaaaagtagaaaactgttgcctttttatgtgttgttggaaagaccatttggctacacgaacggaacggaaagaggttaggtggaagtgtggaacagctgctgagtagtgattgctgagctgagatgaattcatgacttcatgtcagttagtggcgacgtttcatgcttacagcactacatcacacttctcctgtgctggccgctatatcacctttactgcacacgaaagtgtttatggatgcttccgtaacatatgtacacatgcacatgaatgaaatggggtgattcataactggctgtagtttttaaattttccatactatatgcacgatagagacaataataaaactatctccgactacaaggaggtgtacggtatgagctcattctgcttagtttacccgtaataatatatgtgcagtttcttttctgtaagctgatcatttttttccatgaacttgtgtttataggagtaaaaaaaaactgtgaaagctaagctttgggaatggagttgacagcttcgactgaataacagaagaattttcactcgtcttctcctgatctc

SEQ ID NO: 6616 - DNA, 347 bp, Zea mays
ggacagaaaaatagtgagctagaaaaaaactatattttaggacggaggggtatattttagaatcttaaaatctgatagaactataattccttttattctgatttgtgagaatccaatcaaacggcacagtggacttctagcagcttccttgggtaaagagaacgccgagacaacattctgcggaccaaagggtcaccggaagtccggaacaccccgactcgagacgcgcgtcgataccgagacggcgaggggtcagtcctccatcaatcaatgggcgttggccaggaccggaaacttttggacgagaaaagccaaaagcgggcggctaattaatccgccatccacca

SEQ ID NO: 6617 - DNA, 244 bp, Zea mays
ggtgagtgatccgggtccgttactggttgatgagcttgtcatctgccgttcgatggcagcagctgatggcctgatgcttcctttaatttgctggcgcgcgcgcaggtgatggacgagccgagctttttccaccagtggcagtccgacacgctgctggagcagtacacggagcagcagatcgcggtggcgttcggccagggggagccggtggaccacgccgtggcggcggcccctggcgacggcg

SEQ ID NO: 6618 - DNA, 1500 bp, Zea mays
atgaccaaatcagaagaactgaaataaaagccaaatcagatgatgcgtactgattagacttactgattgttggcgcgcgccaggatcagctgagtcgacgatgtcagaagatcacgagcagtcgcgtgaagacgcttcccaaaaaccttattcgccctctcccggtgcaggatctagaagacgaagggttccggagacctgctctcctgatcgcagatgcacctctgcggtcgggacgaagggaactaaaaggcggctcagctatgaagagaggcgaaagcgaactgggatctgggatgaattggaggctggctgccgggctccttttatagggccgagtccgcgacccccgtgcttatccgcccacgaaaatctcgcaatcagttgagattttatagcgatcggttaggataagcgtaacagccaagaaaccaaaaaatcaaacggcaaaaggtagccgcgcccccgcaaggcgaggggccggatttcggcggaccattcacgcgcatgtcgtgcgcccgcgcccttcgccccgccccgccccgccccgccccggccaggccaggcgaggcgaggcgagcgagcgcgcgcgcgcgtgtggctctccacactctctcctctcatccatgacttggtgagtgagtgtggcttccatatttaagttagctctactccacaagagctagcaatatggtgctattggttccacctatccctttgccatccacttatatgggcttttgagattttcctgggatttatttgaataacttaattgggccaagcccataaatcctaacataaagaacaaaaacaatcgcggtccatcaacaatctgcgaagtttcgcgccattaagaaaagacagatcttgagtaagctgaaaagacatgtgaccaagaactgaaaagccatgaaaggtaacaaactagcacatttatttatttttatgcttgtgtgagagtaaacagcaacaactacacattgatcctgtgacaacaaagctcacatgtggaactataagcaaagggtccatcaagtggtggccaacctgtaggaccctcaaaaaaaaaaggaagtggcacccctacagtacttccaaatcaaggcttgcaaagtccccctcagagctgaaaaaaagatggcgccattttctccacaattgaagctttcctgggagcagtgtgatcaagattgagaggacggcaaaggtagggttttttttgtgtgtttgacaaacacaatcctctcatggaaaaacaaggtgaaagggcaaacatactggcaaaggggagagaggaaaattaggagctccccggcctatatagcaaagccctagaaaaaggctggtcactttttttgtttttttttacaatctgctccctcccaaaaacatggagtgacaggatcaaaccatgtaaaaaactggagggagagaaaataggatgttgggtaactaggtaataaacctctgcacccatgtagcaaaaacccagtggaa

SEQ ID NO: 6619 - DNA, 1500 bp, Zea mays
actctttatcttccttcaagccgaaggtacacttgtaataagttatcatttctattcattcataataataagataaaaataattcaataataataacatatttaattgttcatgttgtttattatacttcatacgaatccttcttcatttttatatgttgtgcttacgaaggtatgttcttcgtaaccttcgtccaagagtcgttatatcgtaaggggaaataatgcttcgaaggacgaaggacctttaaccattaacatttgtgttgccttgttcttaactcatagcatttgagaacaagtccccaacactacctatttcctatctgatgttctgctatagcatcgccattgttgtgttgttcagacttaagtaatgtgatgcctgttctttttagatgtaaatcctacaattttcgcctacaaagtcacccattacaataattttttactgaatctataacttttacttttgtgtcactctacatttttaaagattcaaaaaaacattccttattttatacgtggtaaaacaacaaccttcataattcatcggatcttcttagtattatctctaacaaaaaaaataaagtacgtccccacaaatgcaaattagtttcttgattttcaattggttgttaaatgtctaacatgagcaatcagtttggttagcataaaaggatggtgattttgacaactacacggtttgtaggaacaacaataaaaacacttcattatatattagggttttgtgatgttcaccattcatggcttcctaccagatcacacattgcataaatcaagttctacactattggttacttttcagagattcagacagaacatttatattctgtttcctggattgagcatattccgttatagaatgtctagatttttttttcaaacttatgcatctgatatgatctctcaagatatgagtactgacggaagaagtgtgatggtcaattccatctcgccaccatccaaggatcaatcctcaccacgaggaccaggggtgatgccaacagggtgtacgtgggaaaacctttcctggggtgttgataatttagctctcgcaaacctgttcactgagcggtaaggtattggagacaaggaccatctatgacagtgagaacaggtcaagagggtttggtttttgtcacgtatggttcacagaagagcctgagaatgcattatcgaatctcaatggagctgagttatgaatccctttttttcttccccttgctgctcgcgtcatagcatttggaaattgaagtacaatttgtctttcacgatatactgaattgatttatcattgtcctgcaggacttggatgatagattcgtgttacgataccagcatcaaagctgcctagaagcaatactgaattttcacttgagatgtgagtagttgtagtagtagcccaaactctggaatatagtatcatcattcctagttgtaaattctctgccaagaggtttgagctatcactcagatt

SEQ ID NO: 6620 - DNA, 163 bp, Zea mays
tttttatatgtgtccaaaactccaaaattgaaatgacttagtgcctgcactgaaaaaggaacattttgtatgctttttttctaaaattttgaacctaatttatgactgtaatagatatgtttgcaacatatgaatgacctttttaacaatttaatgaagcaga

SEQ ID NO: 6621 - DNA, 1500 bp, Zea mays
cactacattttctagtctcccaaatcttccaaatgatagtaccacggacgtccgcctgaatggactttggaacaaacaccggaggtaagaatggagcacagtagtatgcatcatctaccattatactctcttcgctccaatttataattcgtttgatttgttttgtaccaaattcaactggctcgtcatatttatattttacgaaaaatgaaaaattcaaagtcgttcttaaagtaaattctatactaaatgataccaaatcaaaagttaataataattatgatttttaataagacgaacggataaaaattatgtaaaaaattcaaacggattataaattagaaatgagagaatatatatgaatagctggttagactaattgcacgtgacatgccacgcctccccgttcccactgtcccacgcacacaacacgtacagaagaagatatccatacatgtacacggacggaccgaggtgtcagttggtcggagatttctgaattgaacacctcactgctcatgaacggccgtgaccgtggacacgagagagaaaaaagaggtaatccgatccacatccacccacgaacacgaagactgtcccacgcacacaacacgtacagaagaagatatccatacatgtacacggacggaccgaggtgtccgttggtcggagatttctgaattcaacacctcactgcacatgaacggccgtgaccgtggagagagagagagaaaaaaaaagaggcaaaccgatcctgcgatccacatccacccacgaagacagttctggtgcgtggacgactgtgcttgtgcgtgcccttaggccgcacatggcacatgcccgccgctggatagcactgctgcacgtactgggtactgctagcgtcagcgacatgcattgcaccgttgcacggcgtgcgtgacagcgtgatggtgatgtctggttgatgctcgacttgctcttggttggtgccaactgcccggcgacgggcgacatgggacctgccattggcgcggacgcgcggcgcagggcagcagactgagtactggtcgtgcgtgcctccactccacgaccacctgtagcccgctctataggcaccgcaccgccgtgcgcgctcggtgacctacctggagcctggaggacgctaccgtccacggccacgcagcgcccgccggattggccggtcagcaaggcctggacgctggccggggtcaggacacgacacactggccgaacaaacccatctctcgtcccttgccccctaccggcggataacgagcggcgcatgcagatgcagccagccggcaggaccaggacgcatgcagatgcaggcaccgtgacgcaattgcatcccgctctgcaggccagagctgcaggcaggcgtcggcggcggggcgcccacccaggacccagcggcccagcccaccatatataccgccccgtccccgtgcgagtgagcgcttcatttaacgctgtcgctttcgcttccactcgcactcc

SEQ ID NO: 6622 - DNA, 455 bp, Zea mays
ggtatagatgtccctttatgtactaataaaatagaaatagcatcgatccttgctgatttagtaaggtgttcagacgttgttaaccaaaagtatcgatatccatgtaatccatttgtgttacatttaggcaaaccaaacgccacctaatactccactcattccaatttataatttgttttacttttttactccaaatttgaccggcttgtcttattaacaaaatcataattatagttagttattactgtaatattgtttagcatataatatattttaaatatggttttggatttttcattttttcgcaaaaaagtgaataaaaagaaccggtcaaacttggacgaattagtcacatttggaagtttgaacaaggagggtattgtagactacttagggtgcttcagtttttttatctgaaggacgctaacctccgagcgtgctgctatttcttctag

SEQ ID NO: 6623 - DNA, 1175 bp, Zea mays
ggaaaaaatagttaaagaaaatagaggtgtaggagtagagagagaaaaatagatgctcatgcgccgatgcccaatagcatggcttctctgtacctttcatctttatataatctgcctccaaagcaaatcccgcagcccagtatctctttctctttctctctctctctctccggaaatctctctctcgctgacctgagagttatccaaatactctggtatggcgagatccccctcctcgggttcccactcaactgctgtatcgtagtagtcgactacttccctgcaatccgttggtcagctcacaatagcagatgagtccattggaggagttcgactagtctccaccgctgctgcgagattccgccaggtacaccgctgaatttccatttggtttgggcgtccaggtgtgatctgaggggggtggggatgctggattttggcctcctcctcacccttctccgttccaatcctgtctgaacctccgagaattgccgttctccggacgcggggagtgctgttcacggcattagtgctttgatctgtgaactttggcagacggaacctaccttttctctcttgcctttaccccgaaatctcgtgtcaactgtgggtcatagtgataccgctgcggttgtttagagttcttagacttatccacccctataccagccgttagctttgggtaatctgctgtactctccaatgagaagtcctatatttgaaccctaaaaattaatataaagtctaatttagagtgtttaggtctaaaaacatttggaactccaatatttaagttctatatcaagtcattggaaaataattcatatttgtgtggtacctatgaacatgcactcgaagtgaagattataaaacttctgcccgagcaaagcggccgaccaagttaccacagagcaagtcagcgaggcgaaataggcgaccaagtcccaaccgagtaagaaagggagacgaaactgccgaccaagtctctaggcccacaaggtagaaacctgaacccaatgatatcaatgatatgggcccacatccgccgcgatgatttggtgatttggtgatttccatctactaataatgctcttttcatgctaatcctgcatataatccaaatggtaatcgaaccctacttccactaggttccgcgcataccctgacggcaagcc

SEQ ID NO: 6624 - DNA, 517 bp, Zea mays
ggtatatgagtgtgggccatactgcagatgcccacctagttgccccaacagggttagtcagaaggggcttcaacataggcttgaggtattccggtcaagggagactgggtggggagttcggtctttggatctcattaaggctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgttgagtccagtttgtgctgtttgatcattacaatgtgtcttacccccacctcatgatctttgccatggaaaacattccaccgttgagggagctaagcattgactatgggatggttgacga

SEQ ID NO: 6625 - DNA, 781 bp, Zea mays
tgtcttgcattctaagctatattgatttgtcttgtcctccaagccatattggccctatatatatatggtcaccccacctaagagtttggtgtttcccatctatctttctacagatagaaaataagtcatgacaggaaattgtacaaatgtgtagtgactcaaatcttgaattgctgaagtcaatgccattacagttttctgtcattcctttgcattgcatgaatcaaggtcgaagatagaagtattttgtgtcctataatttttttctgtcccatttcaatttcctgtaggtaaggtacagttacaaatatcgcatatgatttagcattttagtggagactgaaatagtaaaaaaaaaacaagagcctaaacagtgaacaactgctgcaccattgaatatattattgaatatgcaagcccaagatgcaaaggttgtaagttgtttgtactgtcttatttgttatatttggaaacagagtttcagctctgtcctattttgtgttctaaccgaaccgcttaatacgaatttacaaatatctgcatatttgaaagctttaatgctatcctgcaaaaaaaattggacgggtccaaatgtgtggttttgacagccaagtgttcaaactatttgttattgtgatacagatggtggtagttttgcttgcacgcgtgatagcttttactgccattggcatgcgctgtttctgacccatctgaataaaaaaaagacagagcgcgcgtggattatgatgtcctttacctagtttgtttcgtgcatgcaggc

SEQ ID NO: 6626 - DNA, 686 bp, Zea mays
ctctgcccgcgaaaaccgaaaacccacagtttggttgcgttttccagacgtttctgagctccagtccaaccatcccttgctgtgcggcgggcaaaacgggcgcggctgaagcgtccacggaacctacccgacagaggaaagcaccgaagcggaagcgacgagccgacgatatcgtcgtgcggcacggcagacaaccccacctgcgaaaacgaggaacgcggccgcgtcaaccacgccgcccgtcacgaacgcgacgccgaggccgggtcaggtaaaagcgacgggctcgccgggtggactagctcgccggtcgtccttcatgttatctccagcaccagcagcacgcgcgatctcgtccggtggactggcgttcacgtaatcacggtccacaagtctcgccgatacgcgatacggcgataccggccgtcgccgtctcatgggctccggctccgactctcacggtctcactctcacctgctataagaaaaagggcccaacaactaccacgtcaaaacgttatgtttattcgatttcgtgtcccgtccgtttgacgaccgagccctccccctgccccccttttccagtttccttctcccttcctgccgctacggcggtggcggcaacgactcgcgcgggccggtcctaggttctcccggagcgggtgggcgggcgggcggttcggcggg

SEQ ID NO: 6627 - DNA, 1500 bp, Zea mays
cctcctccctgtctttctccccccctctctctccccctcttgacaaattttcctccacccattcccttcctcccctcttcttcttctccacccactccaccgatccccctctttctctctgaattctctctcgtcgtgcccacccttccatctgtctgctgcctctctctctcgcaatcagtcactcggctcttgtttcctccgtctgctgggttgattctctctctcttcctctccgtggagaggagaggatcgagaaacaggagacaggaaagaagagaaatcagaacggagcctgttctttttgcctggattgcggttctcgcgagttgttcagaaactctgggccagtttctggtacggtttgttgcatctctctgttaaactgcctttttttgtatttctagttatatctcttgattttgcatagcgaaacaatcccttgtttgttgtttcaatccatgattccgtcgcaaatatgtgtttttttctctcgctgtttccttcatgtttcaatccacagtagttgtccatggagcggcctggatatggctctcgttgaactatcaacaattcttgtttttttcagaagcaaaattcccaacttccatgtttgaaaaaaaacacttttttctttcgtttgctcgcggtacagagatagatggatgtactgggcgtgttcttggttcagttaaaaacctcttatctgctcccgtattccagacttttccagtttcgtgatcgcagagggaatcgatccttctcttggaaatagtggatggctactcccaccttttccctttatatttttgcttcttttactgcgtccttttcaccttttgcaaaaccgatagggaagggaaaaaataaatgcaaaagaaaaaggctgtatattttgagcgagcgtccacagaatcaatgggccccatcctgcatgcggtccatctgtttaggtcgcatgcattgtacattcaccgtgctttgctttcacccattaaaatgcatgcatcaccacagctttttgctcgcaacagcaacccgaaccatcaagtttggtgcacgcgtacgccacaccaaatgcgcctaatgccaagattcctacagtcggattagttgccaataccctgattagttgctgcctactacagtaatgtgtgagagcaaaacaggtgcagctgcttccatagagtaacaacccagagtagaattacaatatttttggagtgcagacaacagttccttgtatgtagagttgacatattttggtggcaaatgttgaaggaatagcctagataaagcgtagccccgttctatatcccgttcatttcagtccttttcttgtgttccaataaagttggagcacagctctgttgcccaaaatgtttgatgtgttacttacaactggcaggtcctttaaaatactggaacgaggaaccatcagagatgctaaggcaacagaccaattgatgttatctcgctaccctagtttggatcatcaca

SEQ ID NO: 6628 - DNA, 128 bp, Zea mays
taatttcttactggatgtagctgaattaaatggatatcactgcagattaacatgaaaaggaaggtgaatgacatacctgaaggtttcgccaatgagaattcttccatcgcagtggatctaagtcgcca

SEQ ID NO: 6629 - DNA, 319 bp, Zea mays
ggttttctgcctctatgtcggtttaaaacgccgaaactctatgaaaagggaccttcggccatctcttagaaacgactttagccgaagctgcttcttcgtgtgagaccttcggcgtaccgaagcacgaccccaacaactaattaataatcagcttactaaaaaagcagaaaaaagagagatctaataaaaccattcggagagccggacaggtcaatcactgctactcctacatcgatcagtgctgtgtagacaagaaaagcgggcagcttcgttcaaccccgagaaagcttggagccagagcagggggggcgaagagacg

SEQ ID NO: 6630 - DNA, 115 bp, Zea mays
aaactaagtttttccttgatgtactagtatgttgcgtgtatgatttgtaaaattgcaactgttctgatgacccttaaaaatgttttttcgtttgtagtttagttcttcccattgt

SEQ ID NO: 6631 - DNA, 286 bp, Zea mays
cgtggagacagcataggctgtgttttaaactttaaaaatttcattgttagattcataatggtttaactattgagattcaacatatttctgaagtttcaattgatatttcttctcagatgacaaggagaaaccaacacatttgagatttctagtgtctaatacggcagcagggtgcatcattggcaagggtggatcaaccattaatgattttcagtcccagtctggggctcgtattcagttatcacgtagcaatgagtttttccctggtacaaatgacagaatcatc

SEQ ID NO: 6632 - DNA, 775 bp, Zea mays
ccaaagacataggagcagcgacgtcgcagatccgcggtcggtgcagatttccggtgggagcagcggatctgcagccctgcgtgcaacgacagcagacggggatccgcggaacttgtcacaggcagtagaacggcgcaggcagagatagaaatccgcccctggcgcactgcccctggcagcatagggagccctgccccttggaatagcgcggacgacggacacccctggcgggtgatccaggcggcggacagccctggcggcagatcctgacggcggacagccaggcggtggatccaggcggcggacagccctggcggcagatccagatggcgaacagtcctggcggcggatccaggcggcggacggcgctgagatgagggagatccgccctggcggcagatcaatgaagagggaaggccgcacgcccctggcggcgaacaggaagctggtcggatctcctggcggtggatcgaggaagaggacgacgatggcggacaggaggttggccgcgattggcagcacagcgacggcgcgacggcgcccaaaaaaaatggatcagggccggatttagactaaaccctaaccctaacctcctctgataccatgtaactaaccttgattaggcgagatgattacccacgtgggtactgtagcatatatataggcagacaataatatatgggccttaatgggccttaacatccagaagtatgatgatgactttaatctgttgacgtgatggcaggatcacaagctgacctacccatctctttct

SEQ ID NO: 6633 - DNA, 1329 bp, Zea mays
ccaatgacatgtgggtcccccctatgccccattcatcttctctcctctatttcttccgtccacttgactcaggcagagtagcgccgccgcccctgctccttggtggccgccgccactgcttctccctccccaaacctctctctcccactcggcactctctctcctccccttgtttctctctccccgccagcccgcaggagccgcagccttgcagcaccgagcccagcaaccgcaccctgacgcccgactcgactgcgcagcgcccccgacgctccgtccgcatcccgcgcgtcacgctcgacgcgccagggacgaacctgcccgacgcgccccgccaggacccgaccctgctccagccgcgcaactcgccgcgacgcccgaaccgaccgaagccgaccccgcgcacgccaagccgacaccgcgctgcaaggaactgaccgtgcgacgccgcagactcgactccgagccgcgcacccagcccgacgaccgaagattccgcgactgttgctcctctgcattcatggagtttaatggagccgttactctctctcccatcactccctctcatcaatctctcatcaatggcgccttgaatcgactgtttctcccccacctgctttttctctccctccccattttcttggtccgtagtatgctcaggaaacgcagctgcgccgcctcctcaatctcccgagcagccggccagccgccgcatctcctcgcttctctctcgcgcgcccaagccacctgccccacgcccgctcagaccgatgccgagcagccctgccgaagactgagccgcgcgcgcccctgcccgaccgcatccagtacgacgcgacccgaagaccttaccgccaccacgcagcagcccaggagccgagcaaggaccccgccatcccgacgccccgtcgagcagcgcaccgaccgcgacccgagtccccaagccggaaacggctgccgtttcttctcccctttttccctccccacgtcctctctccttcaatggaggtaacagccgccattgatgtccattgatgaagaccggccaccgtttcttcttccccggctcgctccctcctcgcccctataaatcatcgttcctgcgccacgccgagcccatcccagccttccctctcccacgctactgccaactctatgtctgccacctgcgtcgcatgccagttcctcgtcggccgccggagcttcgtcgaaacgtgcccgtggagttcgcagcaccacacgctcgtcgccaaggcctgatcgttccatctgttgtctgcccctcaacgccagcaatcgtgtttgattacccgtcgtcgtcgtgccgag

SEQ ID NO: 6634 - DNA, 1405 bp, Zea mays
aattaccgttgcggatataaatataagtaagattttatacttgataatctgattatataaatttttaatagatatggttataaaatgctgctaccgacggatataaaccgttaccatccctagcttcccaagccccgactcttccatccctccctgcccttcccctgcccgccgatcgcttgccccactcccttgcttccgtggcgcacacgccgcgcacgcgtgctcgcctctcctggaaccgtctccgccgccctcccgcgtcggcgtcgcggcgcaagaggtaacgctctcgtcctattgttccgttgatggagggcaatcgcgattcgcgttcctcgcgctgcggtcgattacccggttccgccagatccgccgcggctgcgcttccgtttcatgtcgcgtgcgtaggcctcctcgtccctccctcccggtctgtggatatggggcgggaatcggagatccgaccgggccgggataggttttccgtttccctctcgctggcgaggaagggagcttcccccgatggatgtgccctcctccgtccgttccaaatcgaactcccccctccgatttcttgtgaattttggtttgccgtgcggtggcgtagctatcagcgttagctgtcgtttcgaactttggggattattattatggctttgtggctttggttacaaacctccagctacacatcattagggatggaaacggtaggtaaacactaaaacaattaccatcttcatattttttttatcagaaacgaaatcgaaacggaaacgatatcggtttttcgaagacatcgaaaaagtttggtatggaaaatacatcggtaacgatcgaaatctaagtgggcgggagcccggcagcttgggccagagtggaaatgtgggctttggcccgctttccttgtttttaattttcgtaaaattccgaatcctatattcggtaaattctggttaaattcggtaaccgaagaaaacggtcggtaaaacgccaaaccggtttccgatataaaattctaacaaccgattccgttttcgaaaataccgttaccgctgaattcggtcggacaaaaatcgaaagcggttcccagaaaaccgaaaatttccgaaaccgttttcatctctacgcatcatgccttttcccgtgctactgacaaattgggtrctaaaattttaccttatctataagctccggcaatctttaacctgatgctcctttgcttgtttagcagattacgcttcgtccatggttttcttttctttggctgctgttgatgctttttacttgctgtagggtaccctgaatttcgtcagtgccaagtgacgaccgcttttgcccatttgtgatagctgaatctctgtggttcaaaggcgattgattttggtttgctgacgcacgccta

SEQ ID NO: 6635 - DNA, 181 bp, Zea mays
ggtaaaagccttgcggcagggagcagcgtgccatatcctgacgtggaagcaataaaagtgcaagctaaggaagaggctgagaaggacagtgaggcagaactaaatgatctacttgtctaccttgggcaggagcaaacgaaggtcgagaagctgagcacaaggctgacagagctcggcgaag

SEQ ID NO: 6636 - DNA, 132 bp, Zea mays
caaagaagaagacccccaacaaggtcctttacatgtaatatttgtgttgccttgttttgtgattcagcaataaaaaacaagagaccaacattggcgcccacctccattgaactcacttccatgaccacggca

SEQ ID NO: 6637 - DNA, 428 bp, Zea mays
ccgtaagctcacagtgttgtctgcttytstctctccaagctcaagacaacggattcttgcatatgtatccgtagaccgcagggaaaacgtacacgtactcgccgtaatgtgcccgtgacctggcaatctggaacgcggaccccgcggatagagacgaacaaggcccgcaccagcgcgtagcatggacgggcgcggcaccctgagagtgagacgtgccgcccagctgccccgcggcgcccatacgtggcgcggcgccgcgcgcggctcggccacgttataagccgcgcgcgctggccgtcgccgcagctcctgactgactgcccgctcgtctgtttgaaacgaaggaggaggtacgcacgccgctactgcaagctagctagcaagaagaggccgctagcaggggtttggcttggtttttggcggacgac

SEQ ID NO: 6638 - DNA, 1500 bp, Zea mays
gcaccacgacaaaacccaggtgcacaacttcatgcccttcttcggacggccatgctgataaagtgataacgacaaaagatggatataaagttgagtgtacatatatctaggcgagcgtctacgtttgtactatgatctacaaagatatatgcaatttattaaaaaagatatgcatgtaataaatgcacataaacaaatatgcctctttgcttaatatgtaagtttcaaaaacaaagataaaaggcgtcatggcagcagtataaatgaatacctgcgcccttctcttttcctcctcactcgacaaaaacaaatctccctaatttcagtcatgaaggcccaggtcgcagcagcaactgtcttggtcttgctcctcctgacctttggtgagtaaattcatccaatccctgccaaagaaaaagaaattgaacatgaatataggcagtagcacttgttttatccatccaaatgtcctgactcgccattgttttgattatctggctgagcatgtagctgcggaggctcgtacgtgcatgtcgcgaagccaggaacagaaagggaggtgctttcacgatacggattgtgccgccgtctgcgtcaaacagagcttcaccggaggcttatgcaacgggcggccgccgttcaagcagtgcttctgcactaagccatgcaagagagagagagctgatgctacactccggtcgtcaggcctctgatcatgttgtgcttgatccgcatgacagcgcgactctcgcttgtatgcctaggttgatgtgtatgtaataaataaacaaaatagtaaatgacatgtttttcttacatgaaagtcaagcgattttgcttatctgaccggcatgtgtccgcgcgaatcgatttgctctgagatggttttattttctatacatcagagagaaggagacgctcgcgtcgccccccgcgcgggcgaccgagcggacacctaatcctagccgccgcggcgccgccatcctcacctcgcctcttctcgccgcaccgctgcccgagcaggatgccggctgctcgtgcggcctgcggggaaggcggcggcggggccctctcttctcttctccggtggattggggcggacgcggctgcctggtcccccggacctcctcgtcggcgatgacgggctggcggtggaggaggatagggccaccagatccgatattccctcggctggatccggtggccgtgcgacgagaggtgtgtgatgtgcgtggggcggcaggacgccgggcagcggcggcggccggctcgggcggcaccgacggtggtcgtggccagtgcaggtgtctggcgctaggggctacttgacttcgtgctgtggctgcaggccgtggccggctgtggctgccgtggcttggttggctggggcagcgcacggacggcaggctttgtggtgaggcagttcttgcttctcggcggtgatgctgatggtgccgtggtggtgctttgggctgtgacgggcttcttccggtggagtcg

SEQ ID NO: 6639 - DNA, 221 bp, Zea mays
gtggccccatgtttcagtacaataagctccaaccgtccaaggtgaaggtcttgctcccagtaccccccgtgccaccccaacgaagcgagacaccaacacgtaggccaacccctccgctgagtcgctgaccgcctcgcacccgtcgttcccctccttccggcacaaccagcacgcgagcggcacgagaagactagggttccggcgaggcgacggcgagaacc

SEQ ID NO: 6640 - DNA, 277 bp, Zea mays
agacgccaatgccaaataccggatcaccgcagaagaacgacggatggagattgcgaaacggcggtctctgattctttgattgttttttgtccagttgttactagtgtttcttactattcttttccggtttggggaaggaggatagttacagacatgtaagtgccttgatagccgtgatttacaggtgtaagtttttttagttggtttatgtgcattgtgtgtatagcgagcagtactcccgtagcttctaccacatgctttcagatcagatgaatga

SEQ ID NO: 6641 - DNA, 213 bp, Zea mays
ttcaagaactttctatctgaagttcagtaattctctcggcaactcagctcccgccagacaatagccaccacctccgacgccgcgtcctcgtcctctttcgcttgaaccctagcctcgcatcggccaccgccaccgctcttcgtcggcagcttcggtgcggctgaacggccgcgatggacaggcacggctcggctcggctggccacccccgagg

SEQ ID NO: 6642 - DNA, 1500 bp, Zea mays
cccacccaccgatcgccaactactcctactgctataaccatcctccccagcgccccgcccgccctccgtgcccctctccacttcgatcgcctgccttcctcgtcagttcattgccgtcggcagcgcgttgccgccgctcgactcgactccactccactcgaccccactacagtacaggtgatcaccatggttgctctgttctgtatatgattctagccgcagagttttttttttttgcgggagttttttccctgacttttttggggtcatcgatggatgtgtagggttttgctggagtcgagttcggtcggcattgttggattgagctttcggcttgggggaactattgtaaggggtaagtctgcttctctcttggtgccgtcgacaagttgagattacgattggtttgaggaattcgagacttcgcggagcgagagtacagtgtgaacaccgtcggcagtatgcttgtttattagtgctctcggttcgagattttgcttgctagtaatgcatatctgtcggcgtaaattgcacgggacggtgactgtaatctcgatgtgttgattttgaatatcacgtgccttaggggttaagtattctggatagacgatcgactgttctaacttctaattgtagcatgcaacaacgccaacagatgggacgggagacccaaacatgatatgtgaaatctgagatagtcttgtgaaatctgaagtgcgccttttaggcgctgcacctttctttttaggattaattttgatgacatggagtgacatctagttcattttgatgccatggagtgacatgaaaatgaaatagtttccattttttcaaaaatttcagtggcatgtttccaactaacccttctttttaacagtagacaagagaaaatttctttctgtcctttttggcacaaactgacaaagccgtacttttcaattctttgtcttctgggaacgctctcagatattccattctgtacttctctatgatgcagtcaacttcttgcaaatctcaatgcagaatttatttagtttaacatttttgctccagttctatacagaggatgaataatcttgcctttgatcttcagattctttatgtcttctgggaacactgtcagatattccattctgtacttttctacgatgcagtcaactttttgcaaatctcactgcagaatttatttaaacacatttgctctagttctatacagaggacgaaccatcttgcctttggtcaatgttacaactctttttctactgtgtttttaataaatcaatatcaatgattgcattatttcagaactaaaaaacactgaacttataaaagtaaaagtagttgtatatatatgtgaaattaacagttcattcctgtatgactcctatataagtgaaatgtcaactattactctgttcctgcaggtactgacataatcatgaagcttttcatatttcgatgacaggattgttggatctcatatacgtgttttagaaagag

SEQ ID NO: 6643 - DNA, 572 bp, Zea mays
caggccgcggaccgtccaactcctagctatggaccatccgcctctgcgcagagagcaacgccgctggttcatgttgagtgattgacgccttaaaaagatgtcaacaagaatataccggcatcggagggtagaccggggactgacgatggaaggcgtgccggggactgacatgggatgcgagaggaaacggttgaatgggtcgggttgcaaatgcagtcctagagtagtcaaacaggacggacgcacaggcgtcggcgcggcgcggcgcgtgagctcttttgcttgccgcggctgctcgccacgccacgcttcagaagatcacacggtgacggcgggcggacgcgctccccccaatttccctcccattttctactccctcccctttccttccttcaccggcatcggcataggcgtctctccctgatctacctggagtctctctcctcgtactccagcgccgcctgcccctccgaccaccgctgcggcagcgcaccgacttcccgcctgaaccccagatctcacccgcgccatacacgccgccagccccagcccagatctacggcgcgcccgcc

SEQ ID NO: 6644 - DNA, 169 bp, Zea mays
ttaggagtgcgctgaggcttgttaccccaaaaaggcagtttcgatctatagtttggcactgtatgctctataaccgttctgaatttgtctccagtcatgctgttcaagtttggtaactgtagtggcgctataggacatatgcccattttttgtcaatggtacatttttt

SEQ ID NO: 6645 - DNA, 1500 bp, Zea mays
agtaggttgactctcattcttttttctaaaaagaaaactctgcatgtgaggagaggagagggtccccttcttcttagcttattaaaagagaatttattttatagtgatctgtatcaataattcatacactctgtcacagaggacaaatacgatgcatgtgcttgttgctgatcaactttggatatccaggataaaatccatgagtggcattaagtttcttactaggattgtttcgatacggttcttagcgtcatgacccatgggagaagcgatacactgactgttcacatcaggcaaagcatattgtatacctcgatgttcatcagcgcgcgttgctcaatcgcagtaggtagcgttttgctgtccatggaccttcctagctacacccatagagggttctcttccaccgttgtcggaaagacgaccgagtgatccacccttctttgccctttattttgcttaggaagaaggccagtatgctcttcctttctatgctttcctagcccagcctaccagaccgcccggcgtccttttccacaccggtccttctccctgaaaatacaatgaaccactgatgtaaagatgcaaaaatgtcgacagattaataaactcatccaacaaaagctttgcttaggctgataatgtgctcactaaaggaggcgctagttaagaccagcttttgattctgcccaatagctggtcaaaatgtagtaccggtcgatttgcctactgcagtgctgggtgtagcattgctttggcctagactgtcagagagttcctgcacttttggttggagttccatcttcctacatcctttcagctgagaagatggcctggagttgcgttggtctcagatgttacactctggtgctaatatctcagagtacgaacatttgcacaggattggtctatttgaatcctcaaatgcttgtgtattattcatctaaatacagcagtgtgtgataaaaatgacaatagacctgtgatatagtatttcagctcattgttcatgtgactacaaactaaataaagtacagaatacacaagtaaatgaccggccttcttgatgaccttattcaacgaagagagagagagagagtactttgacagatggctaatcgtgactatgggaacaaaaattgtgacgccaactattcactatccactatccaccatatgatgattgcatccgctgcaacgacccatgatgtgcctccggaacaatcacaaggtgctgttctcttgttgctgccatagaacaatcagttgaagtttaacagcaaaactagagcatatcatggaagccatggccaaaaatctcactgtcaccaggaaactgggtggacgtactcccatgtcaaaatttggatggccggtgccagcaagcatgcagctgcctcaactatagtttctgtagatataagataccaaataacttttcatgcttagccaggatcatgattttgacttgattattagggctgcatgtgaacatctgtt

SEQ ID NO: 6646 - DNA, 70 bp, Zea mays
agcccgcaagctagaaaaaaaaagagctcgtcttgctactgttgttatactgctgttgcgttttctgtgt

SEQ ID NO: 6647 - DNA, 184 bp, Zea mays
agcccgcaagctagaaaaaaaaagagctcgtcttgctactgttgttatactgctgttgcgttttctgtgtatgtgcgtggatgtgttagctgtatgctcttgttccagtgaggtgaaccgtggacatgctggtgtggtgtccagaaagatatgctcaaagttcgctctgtaattttcgaagcag

SEQ ID NO: 6648 - DNA, 909 bp, Zea mays
ttgcatgcctgcagctgcggccttgtgcttgtgtttgtgtgtctgccatgcggtcaggtcatatatgcctgggcggctgggcctgctgcactctccctctcccagctggatgagaaagcagagaagtgaagtaaaggggaggcggattagcaaagaccgtggaaccggtccaaggttccccaatgcatgtttagcggtagcggatcccgggcccgaccctgacccggtcggtcggttcgttcaacggtcaaacaacatagcccactcgagtcaaaccgccaaagtgatggattggattggtgattagcgaccacaagaccgcctggatcgttccagcagaaggcaataaggcgtcacgagtcgtttttcgccatcaactctcccttattattattaattatattttttgtttttgcttaaacatatactacagtgcaaatgtacgaacgtatgagattggattcgatagttagtagctaatgctctcttccattttgagttaaaagttattttaacttctttaggtatcaatgtttttaaattcaaataccagcgagtgaagttgatcagatgctgagtactgagagcatagcagatgagaatcagaagccgtgacccccccgacccggcaaggcgggcagccaatcgcagcgcggtctccccgatctcggccggtcaaacaaatgatcggcttcctctgctcgcctcgcctcgcctcagctcacttgaaattcccccacgcggacgcgcttccccctccggcctccctccctcgctttcgcttgctataaaaacatcctcctcttcctccacgtcgagccaagccactcctgagtcctgatctccgatcgctcgccacctcacgaccggactcccctgctccagctctcacctatcctcgaagcagca

SEQ ID NO: 6649 - DNA, 903 bp, Zea mays
aatcgctacctagttgctctagtcgagtcggagaccctgattgagctcggactagcgataaggcagactaatcgtgattagtcggacgactttaaaaccttgctcctgcatgtttgatggaaaaacgcactactctggtttttaaatatatgatgtttaggacaaggcatgtcctaaacctcatttatttaaaaaccagatttcaatatgcgggaaagaactcctgaactttaagctaataacatgtgaaagtaacgtaaatagaaaaatgctgtccagccaagatgaattgcacttgttggaaacactgtacttgttgtatttgatgctttgcacttgtaacagtcgggcctagtggcgtcgctattctaaatttgtaatatcggatttatgtttactatcattttgcgtggatatggcagtgcactaggaactgcagcatatccagtatactgagtgctattaaacttctattattctgttttaactgttattttctttttattgtaatttcgcttgtcctcgtttgaccttttcttgcgcccctttagatcttgctggtttttgtgggttttatctctttttatttatgtgtttccccgtttcatcgtttttcggttctccctttgcctttatctcccttttcttttctttggggttgagctctgaggttttcatatgggatttcatctctaacctacccccaacgtgcttgggacaaaaaaactttgttgttgttgttgttgttctcttgcactcgtttggggtgtacatgtactgccaaaacagtgaagtgaccgccatggaacaacttctttctgctttggattgtgacaaccatccgtctgccatttgatagctctgacaaggtatctaatggctactgttttttttttcagacaa

SEQ ID NO: 6650 - DNA, 875 bp, Zea mays
atggtgtactggtacatgtatgtgggtgctcacaaagctaatagaaaagatgcatttacgagttctggccagtagtgaaacctgtaagttttaatgtcacatgtgaattatccagctctcatactagacatgtaatagactgactatcttagttgcccaaaacatggtcatgttccttgttctggggacatttatgttcccatagtacaaacacataataagtattgctccacgttcctttccctttcgagtttcgagaacatggttgctagtctaataagatgagggacttatggaattctaaacctagcttggttgttgctattataaaaatgaccacatagcattcaagctaacttgcatactaatatctatcagacgtgctgttgcttttatgttgaccgtgttttgaaatttggttgtaaagagataggagttgtggaaagagaaaaactaaaggaaaaaaatgaattgtaagaattacaaaatggagaacatacagtttacaaaatatggcaatccagttctattccaaatatgcgttaaaataaagcagagtggataatatatggcttgtttaaaaatggtggtcccatatgctgcatggttgatttgtgtcaaattacagctgaatggcaaataaagtagaacaatacctgaaactgaaaaaacgctcttctgacagacatcagagggcgttagctgagatctgatgactcagaaaccgtaaacacatacttttgccatccgatctctctgatttatgacaggagccttttcccctgaaattacatgacatgtagaaacaggttgtagcgggtatttggttgtctatatattgtaaaacatttgattttgtctcttgcaccattttt

SEQ ID NO: 6651 - DNA, 439 bp, Zea mays
gtttctctctccaaccttactgtgtgctttccttgtgatctctattgtaaggctgagagactccaaactgtggagattcctcgcacacgggaaaagactctaaaggaaaagactgtgatattcaagttgatcatcggatcacttgaaaggggttgagtgcaaccctcgtccattgggatgccacaacgtggaagtaggcaagtgttacttggccgaaccacgagataaaaatcacgtgtctcttgtgttgctttctttgtgattgttgtgttcacaaaaactcgcttcaaagctacttagtcacagtaacactttaataactaagttttgtggctatttagtgtttgattttacaggatcacctattgacccccctctaggtgctctcaattggtatcggagtcgtactcttcatctaagggactaaccgcccgaagag

SEQ ID NO: 6652 - DNA, 1500 bp, Zea mays
ttcactttcagccaagtgcatgcatgccaaaaggaacgcgcatgtcccaattaaattaagcgcgaaccaccgccgagcgaaaatgcacaccgccgcccccggccggcactgcatgcaagtgcgacgcgacccggcgaccgtcccatccgccggtccagctccattccatcggttggtggccgggggggggggaaggcgatcgcgggcggcccccgggtttggtacggggtcaaggcctcgtcgcaagcccgtgacgcgccggggccccctctctcgggcagccctcgggacctcgcgcagctacctgccacggtgccggaaccggaggacgtagctggtgcggcgtctccagtacgtactgcgctggactcagccccctcgtagaattgctgtcgtggttaggttggttggtgccatgtcgtgggtacgtacgtccgtgtccgtccgtcgacgacgtgcgtgcagtggatgcatgcgtagtagtgcagtacatgtaccaataaggcctactaacagccgcacctgcatggttgatcggtatcggatcctatgaagaaggcagaaaggtccgcgcactgctattggtggtggtgggttcgtctcttcggcgcccccggcaattaagggctatcagtggataagagacttcacttcactgtactcgtcctcgccagctcgacgacctgacagagggatagttagctaaagctagcgacttcactgggactgctacccaccccgctacagcgaagtgactttttatccggaccggagcgcatcaaagtcctccacgcaggacagacgccactgcatccccagtggccagtggtacgggtacggctgcatgcccccaccccttttccgcttcgacgaacggggggattcagatcaacggacagaccacaaagtgtcctggcgccgaacaaacagccgaggtttcagaacagaaagcgtgcgtttcccttccttttcatctgtcctccactggcctcaagtctggacaatgaacacgtacgcacggtgcaccagctgggtcgtcggagtcttcgtttggagtctcagtgttcggtctgcaagatcaatcaaccgagcgaactcaatcgtccaattctttacagtggagactggactggtccccggcccgttgaataggtctttatttctctcttgccgtatgttaaggaagcaatgcatgctgtgctgtcagttcatagcccgggccatcgatgcagtgactcgagtccatcgagtagagccgtttactcgttcaactctcaaaatatggaaggaaaccggcggttgctaaggatcattgaagaatctaattggccaattcataatcatgctacaacaccaagtggccaagctagtgaacatgcattcatggttaatttgaggcaggaaatagcaaatcagatgtgggaagatcgtcaaaaccactatgcttcctaatttgttattgtttttcttgctgtattttttatttatggacattaatat

SEQ ID NO: 6653 - DNA, 184 bp, Zea mays
tgtgggtttctctctcaaactcaagagcctgcagtaaacttggctttccgatccctgaccgagctagaccgtgctctgtttctgtttctgtttctgtttctgtttcttcttctctggaactgcacggagaacagggttcgatgtggacgagacttcactggacggccacgctgacatcgaaggc

SEQ ID NO: 6654 - DNA, 401 bp, Zea mays
tgtttggttgagttcgtgactggtgcaccaaattactaaggccctgttttgaccccaaggctaaaaattggcccatcttgtgataataggctaaatatcatcttgtgataataggctaaatatgggctgataaaggccaatgggttctacccaccaattaatcctgattagctcttattaactaaaaatttgctcatgtttagcccacttattggcatccaaaactaagggccgactgttagctccctggatccagataggctagttaagttgtgcagcaaccaaacactgtaagcttagttgtggcaaccttaggctgcaatctgaacatgcccgaactcttctattgtctacccatccccatgtgccacactggttaatttaaatatttggtaaccaaa

SEQ ID NO: 6655 - DNA, 321 bp, Zea mays
aatccatatgaattgaaaataactcgaacaagccttaaatgtggccttaacctagacaacaaaattaaacacatgccatcactgtctacatgatgagtgcctaaccctctccccgaccaaccaatcgaaaaaagacaaataaatccccggccatctatttgcagcaaatacatcgaattgatccaagtatcaaatcaaacctgcaatacaagaaccctcatctagatgctcaaaatttgtgccccaaatttcaaaccggcaggaaaagtaataaagaattattgttagccctcgtgtccacatcgaccaaaaaaaaagtcc

SEQ ID NO: 6656 - DNA, 1500 bp, Zea mays
ccctgtcaatcgggacccaagggggggagcaaccgaccaggtctatgccgagcaagtctgtgaagcggaacaaccgaacaggtctctatcgagcaagtccgcgaggcggagcgaccgaccaggtccctaccgaacaaatttgcgaggcggagcgatcggccatgtccctaccgagcaagttcgcgaggtagagcgagcgaccaggtccctaccgagcaagcccgcgaaatagagcgaccaatcatgtccccgccaaggaaaatcgcgaggcggaccggccaaccaggtccctaccaaggaagggagtaagatggaaacccaaccccaaataatcgcaaagtccacgcctacaaaggcaagacatgacatctcgagccatgaccagtcattcgaacggtaggccgcaggcacgacgaaggccgctaatgacatgaccgcacctccctgggtaccagaacacgctcccacaaccttgtgggacctgacccgacgaccctaatcataaaatacctcagcatcggagcttctatagtgacccaaatacatggtagtgcgctacagttacaccatactgggtgtatgcctacgcacgccaatgagtggcgcaggcacatgacaacaggcaagaccgtacgacgcgcgaccgctccatgtgactgacctgcgggaccccccgcgcactaccacgaggatgttggcggaagactgacaaagggaacccgtacgacgagcggacggaacggtacattatgatggcctgatggggtacagctatgcacaaccccacggataatacgagaggaaccacgctgcccaagggctaccggtggagctcctcccagcagaatacaagtcctcaatgtagagtccatcccttaaactataaaggagaaggacctcttcttttctgaagacataagcacactagcggtaacacgtttcaaagcaattttaccagtgatccaagcgtgaaccagtataaccaccgtctcaaaatctatcactctagacctgcgactcaccattctaagtgagtccatgttaatctcccagcgatcacaaatcttaatgtccctattttcgaaactacgatagatattttcgctctttaatattgtagtcttaaattgtaagctatttttatagataacttttgttatgtatctagatttatattatatctaaatacttaataataaatttatgtatctagaaaacctaaagccacttaaatttggaatgggacgagtgctaggtatagattatagatattggaaattgcataaggtatcaaggtggtatttatatccaccaacttgctacggccctctcattcgtcttgctcggtttcaccgccgggccttctcatctgttcacttggtacttggtagctctcccatttgtagtggcagcactggactagtcgtgttcaagcgcaccacaaaaggagagcgagctcgagagtaacaagggcttgcgtgtgcatggttgataggggaa

SEQ ID NO: 6657 - DNA, 237 bp, Zea mays
ctgagacagagaacaacggctctggatcacaagaacgtggagccacaaatgaatctgatccttcatcttcatcacttatgctgatgccgtgcagcctgttgatatttaaggatcaggcttatacaggttagatagatcttgcagttgttttctaatgggatagccaattaaccatttttattcaagtgttttcattgtcccttatattttctctctctctctttccagactacttgc

SEQ ID NO: 6658 - DNA, 452 bp, Zea mays
tacacctataccaccgggtgtaaaaaccgctggaatcggtcagaacccgacccgctgccaagcctagttctttcctctcctctctttttcagcccccggagccgcctgcgtcaccacatcgtcatcgtgcgtgtaggagtgtcctccagatccagagccggcgcgccgcccctgcctctcctggcctctccgccctccgagcgcgcgccgacgccgcccctagcgccgcccgtagctctagcgtcgacgccctgccgacgcccagaaagcgtcccggccttcacgtaagttgcagactgcttgctcttggtctggttctcctaggcattgccagtgagcagacgttcgtgtaaagagcagtagctggaagtcccgagtctcgagtggaggcggatccaaagccaaagccaaagccaacaaccgccgctgggacgcgagggatcgattcggag

SEQ ID NO: 6659 - DNA, 577 bp, Zea mays
agatagtttgtgaattttttgtttcccatgattaataaatattttgtgtgaaaaaatgaatttccgtaataatctgtatgggttacaaatatttatataatgcaaacaaactctaaatatgtattttgtctaacatgcgtggaattcctgaagaataatatgaacaaaattaatgcattttgttggacagccctgatcaccctcaaaattttaatgaatacaaagtgtggacgttagtgggagcctttgcaagttcaaattttccttctttaaacagtttgttaccctcagaaagtcctccagctcagaactagatgttaatcaactcaaaataacaaaccagtcaatgcacaaggagaagtatttgacagaagatacacaatcaacatgtgtcatgtaactaagtactggttgaaacacaggacagaaaccaccgacaaattcagaatcagctgtcagactatgcttcaatgctttcacatattcactactgacatcttaaacaaaattgaccatcttcagaaacatggttgtatttctatcaagcactcaaaaaggcagttaacagtttgctcaa

SEQ ID NO: 6660 - DNA, 54 bp, Zea mays
acacactctgagaacaaacttgtcatccagtatagagcccgttcaaggccctga

SEQ ID NO: 6661 - DNA, 429 bp, Zea mays
ttacatgggtattgttgtaaaccgtcgcaacgcacgggcaactgactagtgctgcttaacaagatagagagatgaattaattaattatatttatggtttatgtaatttttatttttatttaaattattttattttatattattttatgaattatacaattttatttgtttaattatataactgtatgtatttttattttaataaaatagcgtctttcatgttaataaaaatctatcacgctctgacacgcggcggcaacgaagagaacgctgcgaccatccctcttctctttcggtcgccttctctctctttatttctccctcgcttccggcctcccctattcctccggtcgacgtgagagagcggaaggttggtctgtaggcagggttagatcctcgcgacgctcgatcctgacggtggtgggcgaag

SEQ ID NO: 6662 - DNA, 1182 bp, Zea mays
tcaggccgacacgacccagtggcccagtccttatcaccgacacgtgtctcgtgacgtggctcaagcctttggcgcgcctctccctctcccctcccctcgtcccattcctcctctgtcctcccccactcgctcccgttctcccctgcctcgccgcctctctccctgtcgtacccacctgccccctcgcggtctctctctccttcctgattggatcaatctggcctcgcggctccgactgatccgtggcgcctcgctcccgagcggaaccaccacctgatttgacgaggtgagaattgagatggctcccagtttcaattctgcgggcaatgcgttgatttctcccgcctctctgcgcggattcatgcagcatccagttgcatccagttatttggcttagcctcgtcgtttatattagagtagttcgtgggcgatgattattattacgatggctaaattcgagttatgcacatattcatcacggagaccccgagagttggtgcatgatgcactgaatcccagctgcacatgtttaaaacagcgacacagttatgtcccagtaggaggtattattttctattgatctttcgagtgcagcatcgtcgcgtcagcagcggcgcaagctctatactggtcagacccattatgtgtattccattcccacctacagtcgttgaatcactcgtctgcatctcatcgaagctggtgatgcaagcttcgtctgaagctttgcatgcatccttagcttattaactggtgaagtggtttctttcgccctgtaactctttgggtgtaacttatggagagcgattagcaaattattaccgttttagatagttctgcgtcaagattttaaaccatttttttctttaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtc

SEQ ID NO: 6663 - DNA, 1500 bp, Zea mays
ttaaattaagcgcgaaccaccgccgagcgaaaatgcacaccgccgcccccggccggcactgcatgcaagtgcgacgcgacccggcgaccgtcccatccgccggtccagctccattccatcggttggtggccgggggggggggaaggcgatcgcgggcggcccccgggtttggtacggggtcaaggcctcgtcgcaagcccgtgacgcgccggggccccctctctcgggcagccctcgggacctcgcgcagctacctgccacggtgccggaaccggaggacgtagctggtgcggcgtctccagtacgtactgcgctggactcagccccctcgtagaattgctgtcgtggttaggttggttggtgccatgtcgtgggtacgtacgtccgtgtccgtccgtcgacgacgtgcgtgcagtggatgcatgcgtagtagtgcagtacatgtaccaataaggcctactaacagccgcacctgcatggttgatcggtatcggatcctatgaagaaggcagaaaggtccgcgcactgctattggtggtggtgggttcgtctcttcggcgcccccggcaattaagggctatcagtggataagagacttcacttcactgtactcgtcctcgccagctcgacgacctgacagagggatagttagctaaagctagcgacttcactgggactgctacccaccccgctacagcgaagtgactttttatccggaccggagcgcatcaaagtcctccacgcaggacagacgccactgcatccccagtggccagtggtacgggtacggctgcatgcccccaccccttttccgcttcgacgaacggggggattcagatcaacggacagaccacaaagtgtcctggcgccgaacaaacagccgaggtttcagaacagaaagcgtgcgtttcccttccttttcatctgtcctccactggcctcaagtctggacaatgaacacgtacgcacggtgcaccagctgggtcgtcggagtcttcgtttggagtctcagtgttcggtctgcaagatcaatcaaccgagcgaactcaatcgtccaattctttacagtggagactggactggtccccggcccgttgaataggtctttatttctctcttgccgtatgttaaggaagcaatgcatgctgtgctgtcagttcatagcccgggccatcgatgcagtgactcgagtccatcgagtagagccgtttactcgttcaactctcaaaatatggaaggaaaccggcggttgctaaggatcattgaagaatctaattggccaattcataatcatgctacaacaccaagtggccaagctagtgaacatgcattcatggttaatttgaggcaggaaatagcaaatcagatgtgggaagatcgtcaaaaccactatgcttcctaatttgttattgtttttcttgctgtattttttatttatggacattaatatatggacttaattaatgtattcatatattgtgtgagattacttcttgctat

SEQ ID NO: 6664 - DNA, 121 bp, Zea mays
acaagccagctgaaaagttcaagaaacgaggtaaaagagagaagtgtaatgaagttagttagagatactggggtgcaacaaagaaatagccttttgggcgatcttggtacctcaaagaagc

SEQ ID NO: 6665 - DNA, 1144 bp, Zea mays
cgccaaatgtaacgtaacgcagggtaatgaataacgatactttttttggctgagctctttctagtagcactatctaatctaattataactagtaatcattaccgccgatgagatcccattacccattcgcttaataacgtctcaaccaaacaacaccctatttctatgttatggctgatgcgaggaaatgttgttgtttgtcttattttatcatgtcccgttttattattcctattttcaaatggctacgaatctgtcaccttaaacaaatagaaatatacaacacagattcatagaaagaaacttaaatatacatcacatattcacaaaaacgctgaaacgtgccatgtattgttttgaacacaatttcacatacaaaaggatgacaaaggatctacctactgctaactggcacactacttcctccttgacttccaaattcctacatgaaacctatcatcacttccaaattagggcagcaaatacgccaattagatcatgcattatctgaccttgtcgcagcttcacgttacaaacttcagttacaacactctccacaatttgcttgacctggttcacttcgtgcctgaaatcggcaaaccctttaccagataattgcatcgtcgctactattggacccacattgcgcactcggttcatcctgccttccattccaccggttgcacttgtgctcaggtgtgttgttctgcggccgctagctgctccgcaccacgttgcaaatgcttcaagcgaggtactagttctgtccgagtcgtgaggtggatcggagggaggagacgtccactccaagtccaagcgacgtacgggatgccgtgccgagctcaacgccgcgccctgccgccggtacggtctacgcaccgcaagtcggcacggcaatgcttgaagcgaaagcctgcgcgacggcagcacaggccgcgcgtcccatcacgccattcccattccttgacgccatcgaatgcacccgcccagcccaatgcgcagcgacccccattgtccgcaccaccgctctagcagctactacatgcctatatgggcaggcacatgcatggtcctccgacgatccatccgcatgctgaacgatcaacatctcaggttgcccgaacttgtccgctcataaagaaga

SEQ ID NO: 6666 - DNA, 1500 bp, Zea mays
cgtggggaggcctaggatgctcgcgcgggagtgcattgacgcacgaagaaatcgacaaatctcatgtattatataatagtaaagataaatatttttctgttaaggagcggcgatcgtagaaccagcggctagcagggctgttacgccccgcatgggtaggggcgggcgcgatatcgagggaaagggcatgcatggttggatgacatggggcgatagaacggacgctgcagatgtgtggatggcagaacgttgagttcattccaaaagatataagggatttttttttgcaaaaaaacgacacgtgacgaccgttgaaactgatgctttaatatagtagagatagagacagagaatttaggctagtttcattacgcagatatgcttaaatataaagcatgggtacccttagtatatactacctccattttttatttgacgttggatagtttaattttatactaacgacgacaaataaaaaaatcggagggagtatatccttaccagctattttatttatggattttgtagaaaagataaactattcttaattaattttgtataaaaacatttaaataggcaaaaaaattataaacacaaatactgagatatatgtatgggatctaagagaatatgtttccaagtctaatacttatttttcatgaattaaatcaatatactcactaccacaaccaactttcagtaactattatttattacttccgccccgaaagaatgtcgtttgatttttttagaacaagtttgaccagtttgtcttattcaaaatatttgtaaaaatatagaaaaattagtttgtagttatagtaaatgatatgataaaataaaccagaatgaaaataaacaataattataattttcttgaataaaatgagccgttcaaacttgcttttagaaaagtcaaacgacattctttttgaagatgtagtaacaacttaattattaagtaaagaatctaaatgagagacatagatagattatagtcctctaagctgaagaatgcatatttacgtatgttataattgatattgctaaaaatatatcacgactaatttaccaaataccgtgtctatgaagataacaatattattaataactatagcaaaaaaaaaacaatagcacaacagttgaccttttgaaaaactatacatcaaagytataaaaagctattggtgcatcaggagttatgaaacacttaggcctcctttggaattgtagggaatttcaacaaaaactagttcatttttataaaaaaaatgcagaaaataggggaaaatgcattccaaagggagctttaaccgctttcacgaaagaaggaaagcccagtcataatttgtgcaacaaatgggccattacggcgagaattacggcccattagggttcacttccaaactcggcatctataaacacttctctcacgccccgccgccgcctccgctcgccaccgtcgtctaagttaggctagggttcgaccagctagcggaa

SEQ ID NO: 6667 - DNA, 981 bp, Zea mays
atcatgggtcattttcactatcctggaaaattcggatctgtgttcgcctcatttcctggacccatctttccagctctatatctgtttcagactacgttatattattatgtgtttccgttgcaacgcacgggcatccacctagttttaattataattagttttgtaattagattatattttatgcttataattattataaaaacattgacacgcagaagagaaaagttcggggcgtagtggtcggggacgcaaaagaccgacacgggcacacggcaccgtgactaatctttcttgcacgcctcgacgtctgcctctcgaggccaggcctctggctcagccatgctcatgcagcatgcatgcttcggttgcctcgtcggcggcggtcaacggctgcatgcgtgtctgagcctcctcgttgtcctgacggaaatgctaatctctactatttattaaggcagtaagagtagcctgctgttctgccttcgatcgatctggagcgtccacgttctaccttcgatcgatctgaaccatccatgtcccgctcgctcgtctcttcctcccatctgctcaaccgtccgcccgcacggactcgtcggttcctcacctcattctcgatgcccaccttgcttccacgccctcgcaaaattcacggaggccattgtcgccgccgcccttccgcctcatcctttccacgcccgctactcttgccccctcccacgacctcaactctgccatggcacctcttcatgaagtattcctcctccatgacgcccttgccctcctgtggtcgacgcctccacctcgagcatactcgcctcatgcccgcggcctaatctgctcaactgagggagagcgaggtggtggtagcacgtcgataattcggtcgggaatcgacactcgggctcggggtatcgtctcgcttgcccgcagccccttcgcttctttccatccggcttctcgacgctggagaagaggaggggg

SEQ ID NO: 6668 - DNA, 146 bp, Zea mays
tcgtctgcgagtcatgcctcgacgacaaaccctacgtccggatgtaacacatcaaaccctagcccttcctgaatgatttgtgtgattctctttggtgttgttatgtgattgaaggcgtgccagttctcttgatttggttttcgtct

SEQ ID NO: 6669 - DNA, 709 bp, Zea mays
tatctgcagctgttgactgtataaactacataagctgcaatacatatatagataaaatagtgtagaaaacacagtcacagctatactaaagccgcaacgaacgtggttaccgactgcaccgtctccgcaaggaaatagacggacggatcgcccagagaaatccctttctctctctactccctccaatctccatcccctgcctattcgccgtccctctctcctgcccgtccccgtccgccgccagcccgccaccccacggctcacccggccgacgcgccacctccttctctctgttccccgccgacgtggccggcggattgccggatccgcgcgggagagggagatctagacccgtctgatcttgacccgacccgtcccagcggcgcagttcggggaggttccgtgcgggggatttcgactcgggtggtggagctctgggtccttgtgccagacggttacctttgcgtaatctagtaggagtcgccgtgctcagcagttataagggatcgggggctccagattgagtcctgggagaggtcgtgtcgcgttctatctccgtgtaaaagttgctgtttttgtggcggcgtggccttgagttaccgggattttcgggttttccggcggccgatccgtgctaattacgctatctgttccttcagggcggcctcgtgttgggagagggattttgtgttctcttgccgttggttcc

SEQ ID NO: 6670 - DNA, 59 bp, Zea mays
ggtacacagacagaaatggaagagagtataccacccgtttgcaagggtagaaaattttg

SEQ ID NO: 6671 - DNA, 402 bp, Zea mays
tgttcttttaaacaatgcagtaatgcacaattgttgtgtatttctttttcttctggatgaagttgcatccgctaaggttcatgctaacagcctagcacctcataagacctaatgctggtccagagtgtctttaggcacaccatggtttactactgaaaaaggggcactcggcactcacacattcttctcatcttttaccaagataagctttatcttatgttaatggaaaccttgctttgctcttcatacatggttatgccaatgtttaatatgctttatgtgaatcacattccaggcttatcgaagatgaaacattttttaaatgaatgattttgcagggattttgcatgcaagaactgccggagacctgggcacttcgctaaggagtgtccatctgcgcct

SEQ ID NO: 6672 - DNA, 1500 bp, Zea mays
aggaaaatcttttgggttctcgcggaactagcagtaaaagcacggttccttttccgggtgcgcttttcgtttgagtggtttataatgaaaagcaactccacgttcactggacgagctgttcagtagttcactcgaagcaggaatccgttccaccattgccgtccattcaggtttaggataacaaacaactggataggcggccttactgtatgtggctgctgcttttagcttcttccgccattccagcacagaagaaggtattggctggcccatttacagactgggcgcacagccaggcacagctcccaatgaacggataggacttgacttgtatatgtttccatccagctcgagctgtattggcagaaatgaagagaaccctatggattctgaaaatcgctgaacccgtcggtctggccagatgtgatgttcgtgacccctgaaaggaaataccaaactgtaagggctagtctggattagagaggattaagataaaaatgaactaatttccacaagcgaatttgagtttacaaactaattacaactgtctcctaagttgagaggatgatggacactatctttttaatgtgcagtagtgaaggtttctagtggaaatctttcggaggttcagcagagctcgagaggctagtctcgaacaaatggaagtgggaagtggtgcgtacaggccctaatctttttagacacattttccgtctcgagaggagttagcccatatgatagagtgcggagtagtgcaaacaaaatgcaacgctgcaatgaaaattgaggaggtaacaggtaaattgcttgccaaagctgagttaaaaaaagtgtgggtccaattcatcgggattccaccagagatgaagaaatttcaggtgatctggactgtcggttcaatcctaggtgtgacaaaggcagtggacatgaagtttacaaataagttcgcaagtccttgtgcttgatccgtgcatcattccacaatttgtagatgttgtcactggataaattctattatgacatgaggtcacgtagggatccaaatcaatgaccaaataggagaaaatttacagacccataaaggtttgagacatgaggatcccctcttcccgattctttttaatattgtagtcgacatgttggctattctgataaataaggcaaaagtagaagaccaatttaaagaatgaaaatttctcgagaaaataaggttgtcaaatttgccctaaaaaatctttttaaaccgctgggggcaggggtcggtgtagattatggagggaactggaaaagaaactgcattttatctctaaacgaaaatgatgcacgccctgccctgcgtccgtctcctccctctctgtcttcgcatcgcagacaaaagcttcgctctataaataaccctttycgcctcacggcttctgaccatccattgcgatacttgagacgcttcgctctctctctctctctctctctctcgtgttcttctcgtcttctgcccgagtg

SEQ ID NO: 6673 - DNA, 420 bp, Zea mays
gcttaaatacaaatagatcatgacaatagatataacccagaagtgctgaaccggcctaggcatagagtgagagagtgtttggtttctctaactaaagtttaatgtattacattaaatatttaaatatcaattatgaccattaagtataattttattataaaaataattaacactgggatggatttattaaatctaattaattcataattagcaaatgtttactcacataaattaatcataaatttattagacttatcttgccttttttttcaatgtgtaattgttttataattagactatatttaatagttctaacttctatataaaacatctaatctaatatgacgaaagtataaattagtcccttcacccgaacacgcctagagtgactaacgtgtagaagaaaatgaaagtggacta

SEQ ID NO: 6674 - DNA, 281 bp, Zea mays
tggcaatggtcaggacgaaaccgcgtgccgcgcgcgaggtcagctggtcaggtcagcagagtcgctagaattccacgagagcccagcccggtcagtcgggcaatattgacggacggacgcctcggtgaattgtatatatgcagaataagtgtagccgtatctaccacggcttattatataataataatggttagcatatagttgcagcaaaatattgtcccgagatgccgtagtattcagtctgagcagtcgggcttgcgtgctagctgcaactgaagaag

SEQ ID NO: 6675 - DNA, 92 bp, Zea mays
gtcgtgtagacacttcgcatgccttaagatcttcaccctagttcagatttccttatccattgcagtggggaactccagttttttcctggaaa

SEQ ID NO: 6676 - DNA, 389 bp, Zea mays
cgtaagtgcacgcagacgaaaagttatcaagccatgcatctgttaatctcacaactcactctcggttcagatcatgatggccacgctactcttcataattccaagccggaagaacaagggcgagaaactgatggactgggacaagtgtaggaagctccagtgggacattatcctcctcctgggggcaggattcgccatcgctgaaggcttcaggtcaagcggcctgaccgacatcctctctgacgggctccggttcctgaagggcgcagagacggtggtcattgtacctgtggcctgcatcgtcagcggtgtcgtcacagagttcacgtcggacgacgcgaccacgacgctgctgctccctctgtttgctgaattggccaaggcgatcc

SEQ ID NO: 6677 - DNA, 505 bp, Zea mays
taatttaaaatcaaaagtcaatttaagtcaaaacaaatttaggaaccgtaaatttgtgagaaggtgaaccctgcctcctgcccgcctcgttactgttcaagatttgttcttacgtgtcggccccggtcagtggtctgtggtctcccaggagaactgtcgaacgtgagcctcgccgagtcacaggtcgccgtcgcgcgtgaacaccaccgccaggctcggcgcctcggcgggcaacacgccaggcaaacagcagcgtagagctgggcagacggcagagtcccgagtcgagcagttggtttttgtttggtggtgcgccattactaatttactgccgcccgcccagcacaacactttcccagggagcgtttaattgcctccgcctgcctcgctctcgcttccttcggatgccgctctgcctctgccgcgcccgccagctgcactgaccggcaggccgagcgaccgagtcacgcagttcagcaacgcgcgcgccacggcccgcgacgcg

SEQ ID NO: 6678 - DNA, 450 bp, Zea mays
ggggattacaagcgtccacgcggagagggagcgagcggcttcaagcgagcgcctgtctcgtcctcgtccccgcgcggccaaccctctctaagagggccctggtccttccttttataggcgtaaggagaggatccaggtgtacaatgggggtgtagtagagtgctacgtgtccagcggaggagagctagcgctctaagtacacgccatcgtggcggccgaagaggttttggcgcccagttcgtgtgatgtcgtggccgtcggagcctggcagagggacagctgtcggggctgtcgagtccttgctgacgtccttttgcttccgtaagggggcggagagctgccgtcgtcagggagcgtgcggggcgccatcattgcctatctggcggagcgagccagatgggacaccggtctcgtttcccgtagcctgagtcagcttggggtagggtaatg

SEQ ID NO: 6679 - DNA, 1500 bp, Zea mays
accgtaaaagatggcccgtcagagttatggtgacatagaagaaagagaaatagggagaattaaagcggaggtcccattagtagccaattataagtaagatactcacaaactctaagaaaatttgtgagagtaagaaatatagtaagtattaaatatataacttatatcaccatagagttattatataagtaacattttagttagacatatgatatactgcaatgtgcaaggagaagtgatatggcggcatgccgctcccgctcaatcaaccacctgttttcgaggagaaagaacctctgtcgttttctgatcagtagccractgcccggttactgctcagtcgcctagcagagcactgatagcagcatgataggctgatagcacgttaacaatcatatcatttcctaagcggaatctcgagacggacctcatgagtgtgttctatcatctcagtaaggccttgttcgtttccgtcggattgcatccggaatcgttccagctaatcaaagtttatataaattagagaagcaatccggtcaggaatcgttccgactcaccaatccgacagaaacgaacaaggcctaacagagaacaatgtaggtcctggactggaactaacaattcagaaacaatcttttagatgtttacacctgcacctgatgaattttattcggatcgacgattacgaccattcgtgggctaaaaactgcagctattttagcagccgcagcgctgccgctgctgatttttgttgattaaacagcacacgtatttaaaaaccgcacgtgatcctcccatgatctcagaagaaaccactcgcaaaattccgcagcaaagtgagcctgctttcaggtgacggtgtgcacgatatgctgaaccctgtgtgattttgtccgtctcttggagcccagcaaaaagggcgcctgaaattccacgggatgaagagaaaacggcaacaaaagggtccatctctttccgacatgcggtgcagaaagtgaaaacgcgagaaaggcgccgtcttccaccccccttttctctttgtcctcgtccgtgccgttgccactgttgccacgccacgcaggcggcagcgagcgcaataatgcgcacgcagaggagcacagcggcgtcactgctgcggcagtaatggccgcctggttctcccacggcgtctactagcgatacaccgagaccacttttctcttgcttccttcgaccccgccccctccggcctccggatcgcgcaccgcgcctgccctccacccaaaaccgctccggagcctttgcgaagcggcgccgcttactggccggcaaggcgaccccgtctctcggcggcctgcgttgatctggtgatgcgcttttcacgggtttttttttttcactccctttcccccctccgtcctttgagattgtgctgcagttctgtgccgatgctgacggaaaccggggggaaaaatgcgttttcaggttgctgctgttgaggtgggcagagcggcggccgcg

SEQ ID NO: 6680 - DNA, 1213 bp, Zea mays
ggtactggtagtatttcaagtcatgaggtacacacatggattgactgatcttcattgtttaggatgttggataattaatcaggtgttttgttgtttgtgttggtcttgccttggtttcttgtacgggacacaaatttataatgttgtcttgtacaatatgtttacatttatatcttctttcatctatgcagtaggatatttctctagatcatctgctatctttgttgccaaattcatactgcacaatgagctcatttaggaatttgtcctggtgggctgtctttttatatttattatgctaattgttggactgggttgtgttcaattgatctctgtaggagattttatacccttggagaaattgaaatacttaggtctcaatactttgttttggatatcatgtatgatgatatgttttattggtacatgcaaacatgtcgtagatggtgttcatgaccaaaacttagaccaaactgggagaaaattaaaaaaaatatcttctacagatcctttaaactgatatttttagcgttctagcaacgatgtgcatctgtccttccattttgtattttgggataaaatctgaattaaacaaatactttcagccatatcatgtacttgtaagatttaaggtgttgccccttcctagcatcatcaggaagcagcgccttatgggcaccaatgaattgagtttggattgttgtctgtgtagaaaacggtaatatttagagctttttgtggcacatggattttatttgttgtaataaaagcaactcaattcccatagtaacaactcaattctaagtcacatctgggaacctggtatgtggtagcctggtaggagatacaatgttgctgattgtttatgtgtgtgtgactatgtgcggccctgtttccactggcctatgtgtagtcagatgggaactctttatcatgctacaaaacctgtagagtaatcttgctatttcttaatgccaacaagcacaaacagttagcctaggttctgaactttatcgccctcyagtgcatgcagtgcgccaccatgcatgcaggtgtgcaactttgtgctgctgtcgccttctctgctcaaaaccccattccaactgatatggttttgttactcgattgtgctttggtcccaggtgaagcggcagaagaagagcttttacaataaaccctaaacccttacaatgctaattttgatggagatgaa

SEQ ID NO: 6681 - DNA, 1500 bp, Zea mays
cagtacggcttttaccgacggcgacgaggcagcccaaacccatgttcgccacagctcattattcttattcattaatgatgtcgcggcgcccggcctgacggttctgaattttgcgcccaattattagcggccgggactagatgattgattggcacgtatcagcagtccttgatgatcgttcttgaaaggaaccagttgttgatcaagcttgcaaatggcgacagtgacacgagcagagcagacgaggcgatgggattgcgggacgtcctcatgacctcatctcgcgtagtagaatacaactcttgtaatgcatgatgaagcgagtatgccgagttcattgacgactgtgctagtttggcagtgagggcctgtggcagaggcgcagagcagagaagaggagaggagagcggagcaggggcttctggctgtgtcctgtccctctccggcgccggccgggaatagaaggaccttgccccggaacaacgggaaccgttcgaagcatccgcattcgcggcagattccccaaatcttgccccgctgtagcggagccggagcgggctcagattctggtcccaagaagcatccatggcagaagcacccggcaagcagtggcaccagcgtgacagttcaggctccggcagcctgtagtgtagggtttctctgaaaaaaggaaggggcctcagaatgaggggagaaactgtgggagaggacgcggcgtgctgcgcatgcagtagcagcggatggcaagcgctgcatggcgttgggatgggatgggcggcgaagccatggaggggcgggctggaggtggagcagctagcaggtaggtagacgagcagggacaagatgatgagcgagcgcgacggtgcgtggcatttggcattggcatggggccgccgaggcatttggtggcctggtggggggtgggggcggcaaccgcaggcacagcacggccgcgtgggacggacatgtggactgctcgcctcttttggtgccgcgccagaatgccagatggacgggaacaagccgtagagcggctggccggctggcctgggactgggaaagtcccacgcaccgtcccggcgtccccggcctcaggctcaggtcacactgccaacgagaaggcaggcactgccggtgccctccgggatccaggctcgatctgagctgctgatccagagtcaagctgcagctgcgtacgtgcctgctacaggagcacggagtggtaccgctccacagcaggcagtgtgtgtgtgtcacagctgagaggtggagacctgtcacccgccgccactagctactccggtagtctgccctgcttctgtagcacagtcggccactgctcactccgcttcgcaccaacgctacctccgcgctctgcatctcctctgagtcctctccactcctgctatttagcgccgccctgcgcctcccactcccgaattcccctgcgcctctcacctccctgctcgaatccagcgctcacccgcgccgcgtcgagac

SEQ ID NO: 6682 - DNA, 78 bp, Zea mays
cccaccgccggggccgccggcaaggagaagcacacctcgactttggcggcggcggcggtggtggtggccgccaaggtg

SEQ ID NO: 6683 - DNA, 180 bp, Zea mays
gtgtcgcggcccgcgcgggaagtcgcgcacggtgcgctggcgcggctgcgcgagcggttgaatgcgctggtccacgacggctggcgcaccgtctgacgcggctttcatccgacggatggcgtccatccgtcccttttccatgcccggcgagacccatgggttttcggtaaatcacggccc

SEQ ID NO: 6684 - DNA, 334 bp, Zea mays
agatcacgcgtacctcgccatggcgccgcattgtgagtgagcgagtgaaggtaacggacggagtggcgaatcttggcagtggaattgagcgtgtgagagaggtagatcggggcagtggttttatagaatcgagaacggggcctcgaatgattgcaacaggacaaaggggaacagatggaccgctgcttcagcggcatcgatcggacgggaaggcgtgactgcgtgagtgaggagccgggtggagagagagagagatagacattagaccgggccgcagcccgcagtgcacatggctggccgcttttaacttttggttttttggcatcaccgccac

SEQ ID NO: 6685 - DNA, 376 bp, Zea mays
ggtgagagttatggattttttagataatgacagaaccactctttcaaaagaaagaaagaaaccatatactttttctcgaagacgcatgagagctgtgtaccatttcactaagataaaaggaaacaaatgagtgtgtgtgtgtgtgtatgtgtggtgggggactaaaccatatactagtacactaggtttgacaacagaggcatacaatacgcgtaaaatgatctgtgtaacatttaatgctcattaacttaggaacttacaatctttttgttgttgcaggcaaaggaactttttgaacttgcagccgagaataaggaagctgggggacattataaccttggtgtgttgtatcttaagggtataggtgtgaagaggg

SEQ ID NO: 6686 - DNA, 1500 bp, Zea mays
gggttattttacttttttttaataacatatgtgggtaatttatatacaactatagtatgttatttgaattatcttttgtaatgatatagatgggtaatttatacgagattagaggactaacggtgtatatgagtattatcaacgatgctgttattgtctattaaattaaagactactccctccggttttctattagttgtcgtttaggacaacgacacggtctccaaaatataactttatccaatatttttctgttaaaatacaaatgaactcttactatatttatacttttataaaagtactttttatgacaaattgacgcatataaatattaggttccaaaactaaataacaaaatagttatttgtagtcaaaattttataagtttgactcgaaccttatccaaaacgacaactaatagtaaaccggagggagtatgcatgtaaagataacctttacgagcatattcaaacatggagcaaatatatttaacaacaaaattactaacaatatatagagcgtgtttggtttttagagactaatttttagtctctcaattttattctattttagtccctaaattgctaaatatgcccgtatttagcaatttagagactaaaatggaataaaatggtaggacaaaaaattagtccttaaacatctcctaagtcaaactatattaagtcaaactatattcagtagcttcaactttgtaaagaagacaataatatttatagcaccagataaatatattataaaaatgttttattacgtgcatacatacatataatgatatcaaatttaatgccacaaatatagtcccttttcttataataaatccaatagaaataatttaatttttagcgactttagaagtaaaagactactttccacgcgggaaccataaagtcacgtgcacgtttgacgcttggaccggccgcgcgtcaataacggaacccgtcttcgccgccgcgacggactctctcactagccggcactgcaccaatctctaccggaattcacacgctggaggactacccgcgaccgtgacgtcaggcccggcccccaacggaacaccagccgaaccccgaccgacgaccctggcgttgcacgggagacttggtgcggccggctggtgcgtcacgcgtgacatcgcggaaaattcatcagtgtttcagcatgcggagttgcggacgagggcgatagcttccgcgcggcccaagtaaccgagattctccgccgctctggcagtttcctagcctttttttttctctgctcgcgtgccaaaaagtctacggcccatgctccgctcaccgccctatatcgtgccggctataaattagaagcagcgcaacgcaagctcaacccagctcgaaacgtcacgggtcacggagagaccgcgcagcagcagagctagttcgttcaggcagctttatttgagcagacatatataggagaagatccgaggagaaagatattagcttgctaagagatctcgcc

SEQ ID NO: 6687 - DNA, 1177 bp, Zea mays
tggcgagatctcttagcaagctaatatctttctcctcggatcttctcctatatatgtctgctcaaataaagctgcctgaacgaactagctctgctgctgcgcggtctctccgtgacccgtgacgtttcgagctgggttgagcttgcgttgcgctgcttctaatttatagccggcacgatatagggcggtgagcggagcatgggccgtagactttttggcacgcgagcagagaaaaaaaaaggctaggaaactgccagagcggcggagaatctcggttacttgggccgcgcggaagctatcgccctcgtccgcaactccgcatgctgaaacactgatgaattttccgcgatgtcacgcgtgacgcaccagccggccgcaccaagtctcccgtgcaacgccagggtcgtcggtcggggttcggctggtgttccgttgggggccgggcctgacgtcacggtcgcgggtagtcctccagcgtgtgaattccggtagagattggtgcagtgccggctagtgagagagtccgtcgcggcggcgaagacgggttccgttattgacgcgcggccggtccaagcgtcaaacgtgcacgtgactttatggttcccgcgtggaaagtagtcttttacttctaaagtcgctaaaaattaaattatttctattggatttattataagaaaagggactatatttgtggcattaaatttgatatcattatatgtatgtatgcacgtaataaaacatttttataatatatttatctggtgctataaatattattgtcttctttacaaagttgaagctactgaatatagtttgacttaatatagtttgacttaggagatgtttaaggactaattttttgtcctaccattttattccattttagtctctaaattgctaaatacgggcatatttagcaatttagggactaaaatagaataaaattgagagactaaaaattagtctctaaaaaccaaacacgctctatatattgttagtaattttgttgttaaatatatttgctccatgtttgaatatgctcgtaaaggttatctttacatgcatactccctccggtttactattagttgtcgttttggataaggttcgagtcaaacttataaaattttgactacaaataactattttgttatttagttttggaacctaatatttat

SEQ ID NO: 6688 - DNA, 1500 bp, Zea mays
caattctgatggccctgatctgatttgacccctcgggctctctcgtccacaaactgcatgattggttccgcgctcgcgtccatccacgctctccgcatgcgttgaccgagccacgaatagtgtttggtttcatgtatatacaaggtcagagactgcacccgcagctgcaggataaactagaaatagcacatctaactgcatgcacagatacgcacaaaaatcctgtttccggtgggccaagcgcacatcagccatgctacgctcgtccagctatccaattaggtgcatagagtttggtcggattcgggtcggattaaagtcaagttgtgggccatcwagcacaggctgcacgactcttactcaacccgtgactagtattaggtctggtgggttggtctgtgtcgtgtctctctgtttaatgtattgattttttaggttgcattttattttaaataaaaaatcataacttgtacatgatctatgaattattgtgggttaaaatttatagttcatatccgtccgttatatacttatattgatcgtgtctagtcgagtgaatcatgatcaggtataactaggtggaggtggacggcgacagctacacatgatgccataatttcatcttatctgtttttttttttctttgagcatgttgcaatgttgcatgcatgatgcatgcagcaggagtacgcttacttttgccgaaacgtgaaaaggcccgcgcggctctgaacaatatgggcacgaggtattgcaacggcagtacaacatgataaaattgtggaaaccaattcaggtatttgtgattttcggatagacagatcatgacactctcgcacacgttttattagtttctaaggtcccgttcggttactcaccggatcattaaaattcgatggtagttagggattccgagaagcaggacgatattgaatagtagtaatctagtttatttgaatctttagactgtattcttgacaatagttgcatagacaagcaaaatgtcgaaaatacccatggtccattgacatattgcatgcactttgtttggtaggatttggtacatgcatgcggatgtgcggtcttttctcgacctgaaaacaaaaggatgcccacgtggctccagccaagactggcacatccgatgaacccgtgcacatgttttgtttgcaccgaacgaaaaaggttcagaagatgttagacacattttgatcttattggatttcagtattgaatagaaaaaaaattagaatctcacattcgatccaaataaaataaattgtaggagataaatttgtggagctagaatccttgtcaaattttttttgaaggaaatggcgggagctctgcctaatcattaaaaggagatagttcagaaaatacactgtacaggtccgaggaccgagataagacagactagcaaacacaatgtgaggagcgctcccaacagacccgcacaaatccgcgaaaccactgcagcaaccctaatactggaggaac

SEQ ID NO: 6689 - DNA, 550 bp, Zea mays
ggtacgggtcccccttctcagacttcagtgcacaaaattgttttttttttgtctgtaacggtgaaacatgtacggtccctgactgaagctgaccaagcggacgcgggtatgcttccgggacgcttttttcaggctggccgagagttcgagtgccaagtgcggcgctgcgaacgggacgccgccgccttcctctgcaactgcaattgaacgggagacgaacgccatcgacaggacggtggcggacctcaccatgcgccccgctgtcgtcgcgactcaggggcggaggcgcagtccgcaaccaccgaccggcacgacgacggcgtagaaagggcaccgcgcgactgatccgtctttttttgccggctactcctacgattcgttcggccatgttgggcgcagagagagatgtacatacttgcgtacgtactgctattgcatcttttattttttttatttttttttactagctcgcgagcatatatatgatgaagagaaccggctgtcgtttatgcatttctacggaacttcgatatagtgaagtcactgtccg

SEQ ID NO: 6690 - DNA, 141 bp, Zea mays
agtcaacatgcatgtatacgtaccaacatgcataacataagggattaagggtcatgagatctactttgaattaagtagcttcagtctggatttaggatcccaataataatgctgagaaaatagaatcgagcgctatttttt

SEQ ID NO: 6691 - DNA, 1500 bp, Zea mays
aaagctttgaccagggtggacctgtttatgggatcgaagcggccgttgccccaactggcgactggcgagccaccattgcgcggacccgagattaactatactacaggagtactgtcgggttggtaccaatacgtggcttgggcaaaaagtctggcaggcgccgctgcttgtctgcggtttctatgtgccgatgccatcgcaccggaccggatcgggatgggatcagcggaacatgcgagagcgagcctgcactgcactgcatggccgcgaccgcgtcgtccatcgagccgcctatcattagttggttccactgtctcgccgccgaagcaaggcagcacagcacacatcagcattgcttcccagttcccaatgccccgtcgtcctagccgaggcgggctcagtaccaacccagctgaaactacgagagatgcgctgtgggcaggacagtggtcgagcgaggagtgtacctgtagttaacgaggattttattttactagtgcgtacgtacgtactgtacgtactatgatctctcacgtgctctggtcttatcactcgcttgattatactatgatctttttttccctccacctgctctggtcttatcgctggcacgtgcttttacacggccacttaggactactcacctcgtctcgtcatgcttatctacttcagagcgtcacggacacagcaaggaggagtacgcacacgcagcatggactgcctggagcggggtgtggtgcactaacgcccgcctaattcccggagctgcctgtgccttggacgcccatctctggtttcgcggggagaataataataatttaggcgaaacacgggaacgggtcgtgaggaaaagcctgacatgctgcattacggccggtgccgttcggaccccagttattgatgagccgagtcaccgacctgccaagaaaaggatgccggatcaagggcaggttcacctcatcttagcgcatgcaagcgtcgtccctaaccaaaacatcatcttcatgtctggccgcccgcgcagcggtcccagtgccggcgtggttaacgggagggactgggactggcagggccggctaatggccgacgtgcagtcgcctcgtatgcgtttcccgttgagccatgcatgcagcagagcagcgcgggcggccggtcctgccaccggtggatcgcggccgggcacgtcacggcccggtccccgactgctctggctccatcgccgccaccatgcacccaaagcgatccacccccgatgcatcccttttctctccctgtcagctgggcccatctcgcgtcaccgtagccaggtgccgccccgtcgccccgccccccgatctatatatgctgcccacgggctctcccacttctcccccacatgcacttgctgcagcagccgtaggacacacgcacaccgcctcgacctcgagtccaccactgactccaccacctccccctgttttttttcgacctcgctctgctcatccgcacggccagacagcc

SEQ ID NO: 6692 - DNA, 274 bp, Zea mays
agctagctgcttagctagcactctagcagggcggcccccggccggtcaagcacacaccagctttacaggacgacaacagcaacaaccatgacgaacgaggacgagcgagtctgcttgcgagaaatgatggcgaagaagaagaagaagaacaaggtagagacgagacgatgatgatgtgtacagctggggagcgaccactctagtagctagatttttttttgtggtggtggtgggtagctgggtgcagggagcagggtttccgcaagttgctaat

SEQ ID NO: 6693 - DNA, 316 bp, Zea mays
tggcggggttgctggcgatggcgaccggctggcacttggtttgaacggcgtggctgctggatggcacctaccaatcggtggcaacggcgggtggaggctggtggtgctaccacgcgggccagcagccagcggagggggtccgactgggggagtggccgactgccagctgggggctccggacatcgaggggcggggttgccggctcggttttggtttggttcgacgtacggttcagtttccgattttaaagtgcccagtcctagaaacgaagaagcgcacgaacccatcgtttgaccgaccaactgcccaacaaacg

SEQ ID NO: 6694 - DNA, 430 bp, Zea mays
atatatggcgccgagctcggatgtctaacgataaagtttgtctagctcagtcggtagagtgcaaagactatagcgccgaggtacgtgctgcgctggcacaacccggacgacgtggcgccgacgtgtcaccaagctcggcgccaagatatatggcgccgaggttggatgtctaacgataaagtttgtctagcttagtcggtagagtgcaagacttttaaccatgaagttgtgggttcgagccccatcgtgggtgttcaatattttttatttttgtcactaattttttgtttccttattagttcaggacacaaactaaatgtgcgttgctttgttttgtttactgaaccacaacaattcactgtctgatttccttctttttctttaggctgcaggcctttatttctgaggtcaacgcatttggcaggccgct

SEQ ID NO: 6695 - DNA, 139 bp, Zea mays
atttactcggcatatgcatgcatccgtgcatgtatcccgtttcttgtcgtcgtgttgtggttcactcgtatacctcatcttttttctcttatgaaattcttgtagagtaaaacccttctctctctgatgtctcggttga

SEQ ID NO: 6696 - DNA, 1500 bp, Zea mays
gaaccgaaactgaccaaaccgaagtattttactgttactattcttcaaaaatcgaactaaattctggttttcggtttttagttcggtttaaatcgattaaccgaaatattgccccactacactatccaccgtggttcgtggcccattgcgggatgcccctgttggccgttggcccattccttttccagcgaagggcaatcaaccggcagcaatcagccaacactagccaccgccaccgcgtcatgctgtcctcgctcctcgctacgagccacgtcctgtcgcctttaatcgctagatgtccaaccccgtcggccgtcacatgcagtgacaaacacaacttgttgttcgcccagaaccgaatcttgaagcttcaacggatggggtgctagggtagcgatgcaatcacgtgtatgagaggtagaatgcaatcacgtgcatgagaggtagaatgcaatcatgtgcatgggggtgatgtcatgttcggttttttggttttaccgaaaaccgaaccgaactttccggttaaccgagaggttggtttttccttttttatatagaattttggttgtcatttttcaaaaaacgaacttaaaaaaacacgaaaaatgaaccgaaaaatttgattaaccgagtgcccaggcctattcccagtcacctctccctctctcccgctggcatctcttcctctctccccgctggggtttctctctctccacgttcgctccctctcttttgtgtcggggccgccgctgtgctggagccgccgcgagccgctgctggaggagccgccgccggcctccccaactcgccttaggtgccagagtaaggcgagcaggatgccttacattgctgggacgccttagcgcctagacgacgccttaacaactatgctcattcgataaataaaatataataaaagctataattatatataagtgggtatttaaaccatagttgttgactgcaaaggcatgactcgtgagtcaccagctaaacgatacggctgacctagttcgtgccagctcgttatcctaaccagttaggccttgttcggttacgtttggatcgaagtggattgagggggattaaatctctttctattcaattttgactggggagggatttaatcccctccaatccagacgcaaccgaataaggccttactgagccgaggttcgataggagtattctgtcgtaatyctgccattcatttccatccagacgaccagaggccagagggcgttgctgcgctgcgttccgctctcccttttctgctgcgacgacggctggtcgagcgccgccacactttgcagcttccttggctcttcgcaggtgacgagcgcccaccaggtatgcccgacgcttatcttaccttcctgctgcgcaaaccctaagtaataatttgtattgcatctgacacaattagtgtaaatatggtattagtaacttcatttttttgttaaaaaatatcggctgcattgcttgctactgaagtcagac

SEQ ID NO: 6697 - DNA, 63 bp, Zea mays
atcctgtatagtcgacctgcaggagcttgagcaggccgccgcagcgcaaccggttaaggaggc

SEQ ID NO: 6698 - DNA, 228 bp, Zea mays
ggctccaagccctagatgtccccttcccactcctcctgcctccgcagcgccgccgctgccgcctgcgccccgagccgatcaccccagatctcgcgcgaatcagaggtcccgcgcctccccgtggcccgattcgccgtccgtgcgcccgggaacggcgccgatttgagacggttttggaggtgaggcggggtgcgatttaggtggtcctgggccttgcgggcccggtgg

SEQ ID NO: 6699 - DNA, 246 bp, Zea mays
ggtaagccaagaagcaattcaagtagacccccattcatcatcgctcctgcaggacctcgtgcactcatttgctcgctgtaggtaccggtcgctgcacaccgtcgtcatgggcgaaggtgtccacccgttgcaggtccagatccgcacgaaggagatgcacctgcaggccgagtacggattcgccgcgcactggaggtacaaggaaggccgcacctgcaggcactcgttcgtgctccagatggtgga

SEQ ID NO: 6700 - DNA, 901 bp, Zea mays
accaatcttactaaggattgtatgtcctagtttataacacatatattttagaaagagtgcagaagagttttgcccacacgaaactctctccgctcttataaaacttttatcatctattttttttatcaatataacgttatgtcatcatatgtaatacccatgaaactttcgtaaaacactaactgagattgatattgtaatagcaaataaatattattagattaattatgaaatatagtttcattgtaaattaatctaacatgttaaatgtgaatagtatttaattgaattttggttgaacacgaaccactttaactagcacgtgacctataattacatccttcttggacagaagtatggtcagaaatcacgaataatatggcgaatggagacctagcaatgcttcgtcagaatgcttagagtatccttctataacgcccgaagaccggattgagcaatgaaccgaggcaggaggcacccactatacagtcgcaagcaaaaaagcatctaaaatgcagggttttaggtacctttctatcatgttccgaaccttcccactgcacgcaaagacggcaggcaggaaagagagcgcaaagcaaccgcggttccagggtcaccctcccgctttgttcccccaaagccaggaccgacccagcctgatgcgcccgctccgtcgccggccggtgctggatgcctcatgcctggcacggtggtgcgccgcgcacaaccgcaaccaaggccaccatgagcgtccagccgtccaccaatcactgccgtcaatagcggcgtacaccacgagcaacagattgtagcgtgtacgggcggtccagcgctataaatccacaaaaatgggcagtgtcacttcctgctctgcttcagtacgtagtgggctgagccagaa

SEQ ID NO: 6701 - DNA, 222 bp, Zea mays
ggtccttctgcaagggaaagaaaaaaaactcagaaaaatgtctaaatattcaattcctcatctactccgaacttaaagctaaagaaaattgtactcaggacagtgttactaataacaagtatgcatacacattaaaacaagagcagcaaaagaaacagaggagccaatcaagagagagtatgctttaagcttatggcaaactcataagtacacttgacatat

SEQ ID NO: 6702 - DNA, 62 bp, Zea mays
ggtaaaagtcgacacagagcatcatttttctgtcagtaatgcaaacctaaagatatcttttg

SEQ ID NO: 6703 - DNA, 542 bp, Zea mays
ggtgtgcgggttgactgcccgtcccactggcagccctactattttagattcaagaatggattatgggtagcccttccagaaatattatcagctagcctgaatcaaaccttaagccttaatatgtagctgaattagataacaaaattgaaaatttccaagtttctcgacatgtgggtaacgtatgggtgtctaaatgttttgaaccttttggttaaacatttgttccttgaaccaacatgaactggctattgttatactaatatattggttaacatttgatccagagccacttgttgattgagtcatcatgtcattgatcgttacctcgttgggcattttgtacgagttcatgtcattttgttctaagcaatcttttttctgatctctataaccagcacaaactaagttcatgttgctataggtgcattgtgaacatgttatttgactatagagaaatagttgcattgttgcaaaaaaatacatggtgaattacatattttctccatgtaggccttttcattacgtatcttgcgctgttcttg

SEQ ID NO: 6704 - DNA, 612 bp, Zea mays
caaatacaagcaatcaacgactcaaatcgctgatcatgtggattgtgccgtcccagcagtaatcacaaacagtggcattgtcaggtcggtggagcagtacagccgcccgtgctctggatccgtagcatatatgccacgtactgcacagacatccatcgaggcgtgcacgatgcgccacctctgcatgggccgcataataccatttttcttttgtgcaaccgtactctgtgcagttcaattgttgtactcgtgccgagaggcccgagacgagactgtcgggacaaggacaaggacagggacagggacacgtcgagcaaaatctccagccttgcagtaaaaaaatgtgcatgctgactcagcttttcgattcgatccatttgtatcggcgaaaattaagcaaatactaccggccggacttggatttcgaacaaacaagcccttgctagctaggcctaaagcactactatataaagcaaccactctcgccccccgtcgtcgcgccggtcattccaggtgtgtctagtctctagtctagctaggcactactctagctcccaagtggccaagtatactcgccagagtacgtagagtgtagttgagcgtcgtccaagg

SEQ ID NO: 6705 - DNA, 65 bp, Zea mays
tcccaccttccgagaggctcgagccctgatcccacgctgagggcggcggtgttaggagtttagcg

SEQ ID NO: 6706 - DNA, 1500 bp, Zea mays
gggagggaggggccgtacgtaccagtggataattacgaggcctcagggagtccacacccgatgtcagcttcattgatcgtcccaggataggtcaccgttccgtgacttgagaaaacgtcacaaaccgtatagcatgtgtgacggtgccagtaccatctcgacacgaacacgtcatctccaaaaatacccaaaacaatatataaaagctcgtcaccactaacttcagaaacttataaatattgttttttttttgaagttgttcggttctgatttcagatatttgatttgagaaactttcgttagcaattcggtacagttttttattttcgaatataaaatcagttgccagtacatatactacgagtgtcaaatagtaaacctcgtaaacagcggatgggcggtgctgctgtctctgtctgggcctgactctctgagccccagaccaggacagtagccaaacaagttcacgcccccgttattattttttttggccggttggcagcttcctcgcagccgtttagatcgagtcctcaggagcattcgtagtcggcacgcagccgtaccctcgggcctcgacctgaccgccatagtagccatggcgggcgtcatcctcggtgcttcaccacctgtcgacgtgcccgaccccacccacgtggcccccacccccgcctcacatggcgtgtggggcccacatcacatcaaagcacagctgcctccgtaaccaccgccgtttcttcttcccctccccggtcccgggtgtcgtcttcaattcatcatcctgatcctaccgactgccgtctgcattgcaacgactccacgagctgagcttgcattgtagtactagtagtaacagtaggtctctatctgacggacagtcttgtacaagttatatggaacagttttataagctttcgctcgagatagctaagatcttctatatgatagtgtaaaactatttgtatgatagactatactgttagagctagtttggaaatctattttaacaaggggtttttattttactaaaaaaattagttaatttttctttgaaaaaaatagaaatcactttaaaaaaggtttcacactagcctttagtgagtgaaatttcactgcgtcctaaacaggcgcgtacatgcctgcagaggcccccgtccgttcacaccagttgggaaagatcagtcctccgcggggcgaggcgtcctaatttttttttttgaaagatcgacgcggcctcgcgcacccacgtgtcggggcggcactggacgcgggcggtgccgaagatgcctatatttatcgatcggtctgggtgcgtgggaagaaggcaccaccaccagctagctctctctgtctgctgctcctctcaaaagagtcgcagttcactttgttgtactagagcgctgagcagatctttccttgtttctccattccggtacgaaggggtggggtccaagtgaagggaagggaagggaagggaagggaagagaaggcctgctgcgagcg

SEQ ID NO: 6707 - DNA, 70 bp, Zea mays
atgcataagtgaaaaggaaaattagttctaaagcactgaaagatcccaacaatcataaaataccaccaaa

SEQ ID NO: 6708 - DNA, 375 bp, Zea mays
ggtttgtttcaataaaaaatatgctgcattacaatcaccatatggctgtttttggtttttttgtgtattgtgtgaccaataatgacagttcattcatatgaaaatatgtatgtctatggacctttttttgcatgaaatatctggaggtgtagagcatatttttcttcatcctttacatgtaattgttagtacaaccagttagctcgtatttagtgtttttcgttctttgttgtttggtgaaaccagaacatttttcagacagcatcaaactgtaggttatatttagctttaagaattttgaaggccttctacttaacacaggcataggatgacaggagtgcgcaggagatccaaaagaagccagaaaaggaggga

SEQ ID NO: 6709 - DNA, 139 bp, Zea mays
ggtgtgtttatgtttttggtttgttaatggcaggaagcggatggaaagaagattcagatccagctgacagggttcatggaaaagaacacagtgaagttcatgaaggagctctggagccttctcctcagtgcgcagcaga

SEQ ID NO: 6710 - DNA, 1500 bp, Zea mays
ccccgacacatctactattcacgcactatgtgtatacagtattcacaagagcttcttttcttttttcctcctttcaaatagctaacgaaaccagtcgttctttttttaatcactccttcgttctggctcttagtatgtgctacagggccagcgcaggcaagagcccgagcagcagataattcgatcatttatggcatttctaatttataaggtcaaactgccgaagcaagtaactcttttgatttccatcgcacgctacgtcctcctgccattttaaattgcaaattgtttactgttatttgtagatgagtattattatgttattatatacgcaatacgcagtactctgttcagatatataataaaagttgtatattcataaaaaaatagaagtgacggattagggctccgtttggaagcaaccgaggttttaaggtaaaaaaattaattttttagctagcagagaccagtttcttggtttttaagaaactgagaatctaatttttataaactaaattataaactggtatgtttagaaccatcttaatttatataaaccagtttcttaaaaatcagggcttaagtaatttagaatggaacgaggtggctgcaaatgcttggtttgaagttgtgagcgtgcatgttacgtaccagattacattaatctggatctgccctgacatgcaacatattttaagcgcaccaattatatatgcccccaggcgggcaggacagccacccggattgcctcctcttccccccatatacatacgcctcaaccccctcccttgcgacacagccttgagcctcccctcccctccaaaaaaatctccatcggcatgggctggcacatacagtaacagtagcctagcctccagtccacctctctctctctctttctctggagagagacgcgcaagagaaagaggggggaggacggagggaaaagaagcagaaaaaaaagtaacaaacaagtagcagtagtgaagaagcagaaccgaagggatcggatcggaggaggaagtggtggtgagtggtgacagacagccagacagaagagaagaagaagaagaaggagctgatgacgcaaagagatggggaggaaggatgcagcgcaggcggcggctcgagtttgagcagctgcgtctgcgtgcagcaggaccacagctgatcgagccaagaaagcagctgctgcgtcggtggcagtcgccgaagcagcaggtgccaaagcgatcgagctgctctctgtccgtgctggtccccgtccccctcgcctctctagtctccactccacctcctctcatccatccatccacccacccaattcggcagcagcctccgccgccacactagctagcactagcagtaccacccgcgccgctagtcgctaccagctagcgactgaatcccagcaaggggggaccgggccaggatcggaggcgggagatcgaccgacccgagtagagtcaggcagcagctgcttggcgcggccgcccgccc

SEQ ID NO: 6711 - DNA, 1440 bp, Zea mays
cactccctctttagcatcgtgatcctttcaaccataaagagtaaaatttaaactatgtcaaacacgtggtaatatacagtgcccttaattggattgtcaaatattcttgtaactttaattttaatccaactttttaaatacaattaaatatgagttatgtgactctctttaaggatgcataaatatctacgattctaatctatgatataattaaagtcgccaaaagagttgtagtggtatgctcgctaatgagtatgactgaaaacctctgtcagattttttctatgtgacttgagcaggattagagtggtgtatgacttccacgtaggggtgacaataggctctcaattttacactataagatttaaggatcagatcggattagaatcgggtcctatttctattaatttttgaactaaaatttatttagggctctaccattttatgaagaagtatttggatcacgatttgattagttagatcatcggctaaaccaatttctgatatggtagattttgtttataatcaaaactgcatacaatttagtactagttggtatcattgttttcttttaaagcaggttcaaagatttaaagacatataatgtcatatttattcttcattttttatattcatggaaaaatataagaaactgagtttttactaaaactcacagaacctagaaaaggaaataaattaaagaagaaacggacgagcagagacagacaaaattgaaagaaaagagacgggcgaaaaaaaaagacttgaagaaaaatggaaccacggaaaaaaaagaaaaaaaactagggacacaagatggtctaagattttttttttgtgttttaatgttattaaagataacaaaattcagttgtatcttattcatggtagacctaacgtcatttttttcgtttttctgattaatcttgtaatctttctaggccctctcgacaacacgtaggactctttttaaattctgttgcgtcaatctaatagacagatttgtcaaggtttgttttattcgtacatttctaagtttctaaaactcaagtgaaaatcggactcccacctctccacggttagtctacagtccggacccgaagtgttgacactatctggacggcagacgccgccggctaaccggagccccgctaaacagcgggctctagtcctaaattcctagcatagcagttgaacccatctataatttgaaagaaaaaagaatctaatttgaacacattggcccaggtgtcagatataccatgtactatatactttttggcacattcttcctcgtccgactataaagatgagcacctcggttgccgccttccttccctcccaagttgcaacggccagaaagccacgttagcctagccgagctcctctgctcctctcgtggccgaacaggcagagcgaccagtctccagagcgctcccc

SEQ ID NO: 6712 - DNA, 897 bp, Zea mays
ttgtagtaagttatatgataggtcacgacatagggaactgaccatagatttggatccagcaggatggagccaaagacacagatgagagaacagaccatgacgagggcaatcttcactggccaccacccgcagtgccatgaatttctcaactcattcaccttgccggtgcgtacagtggagaagaacatggccataaaaaagatctggacgatttgttaaggtcagagcaatcataatacagaaaattgttagataaaaaacaatgttgtttaaactgtttagtagtatatataggatacaaagaaggcatggctcgcagctgttttttattgtggttaactgagcaaacaaggggagaagttgacggcttgtgagcactgtggcacacagctgctgtgctcgccggataaaaaaatctggacgaataaacaaatcagtcacaaaaaaaactagatgagaaataaatcaggacagacaaatcagcgacataaacgaaaaatatggataacaaaaaaaaacaaataagtgacaaagacaaaaagtattaaaaaacgtccaccatggggtttgaacccacaaccacaaggttaagatttttgtattttaccaactgagctagacaagttatctgtatagaatagagctcggcgccaagatctatggcgccgagctcggtaccacgtcggcgccacgacgtccgtttgtgccaacgcaacacgtacctcggcgccatagcctatggcgccgagctgtgttacctcggcgccataggctacggcgccgagtaaagagtctaaaaatgacattaaaattttttagggtccaaacgtgaatttttttttcaatgaaggaccaaaatgcaaaaaattcggtcgtggcggccctcccctttgtatc

SEQ ID NO: 6713 - DNA, 1420 bp, Zea mays
taaatgtcatattctatgccctgaaggcatcagcttgatgatcaatatgtgaacctttatggaagtttctatcaaatataaagatctagtcgatcgaacaccatcagtcaaagtggcttatttatgttgatacgtgtacttacctcgtatatcctagaagtgagtagaggtgaagttcctgaaataatccttgcaacagtatgcaatccgtttgctaaatctctatgtgtgtatacttccagaagaagatgttgtgccatattgatacgtttttccaaggatcagggggagcacatttctaaatttagcccttgtagaagattcgatggaatcctaatccagaagatcgaaatttgttctgatgacatttgttgtactcttttttccttagtgagttttttgaagtttcttacataaggtttttaatgaggcaacaaagtgcaaatacaatttgcgtcaccatgtactctttctccatatttttcccactgggtttttgggagttttaaagaggcatgtgttggtcgcggtattcgcccaagggggagtattaagtaaccctagttagggttatgtgggcaaataccggctttgcccctgaggggtctcacatctctatataaggaacctgtacaccccttcatgtaacagagatgagaaagaggccagaggcccaaccctatatcctgtgtctcgtgtgtttcctctgtcgtgcttatgggaagggagacgagttctctatagcttctcgcgcctctactgctgacgggagggaagggagcggatctggtgatccgtggtaacgtagttctcaatagttattgccggcgtttcgagaccggggggtccctaagccgacgagtgaatgtcgccacgtgccccagcccagatgggtcgacgcgaggccgagcgcgaaggggggaagcgaggtggccggagaccggcgtgagagaggtgggaatcccgcggccttcgtgttcgtcccgcgcccaggtcgggtgcgcttgcagtagggggttacaagcgtccacgcgggagagggagcgagcggcttcaagcaagcgcctgtctcgtcctcgtccccgcgcggccgaccctctctaagagggccctggtccttccttttataagcgtaaggagaggatccaggtgtacaatgggggtgtagcagagtgctacgtgtctagcgaaggagagctagcgccctaagtacatgccattgtgtcagccggagagattttggcacccagctggtgtgatgtcgtggccgtcggaggagtgccggagcctggcggagggacagctgtcggagctgttgagtccttgctgacgtcctcttgcttccgtaagggggctgagagccgccgtcgtcacagagtatgcggggcgccatcattgcctatctggcggagcgagccag

SEQ ID NO: 6714 - DNA, 1474 bp, Zea mays
taaatgtcatattctatgccctgaaggcatcagcttgatgatcaatatgtgaacctttatggaagtttctatcaaatataaagatctagtcgatcgaacaccatcagtcaaagtggcttatttatgttgatacgtgtacttacctcgtatatcctagaagtgagtagaggtgaagttcctgaaataatccttgcaacagtatgcaatccgtttgctaaatctctatgtgtgtatacttccagaagaagatgttgtgccatattgatacgtttttccaaggatcagggggagcacatttctaaatttagcccttgtagaagattcgatggaatcctaatccagaagatcgaaatttgttctgatgacatttgttgtactcttttttccttagtgagttttttgaagtttcttacataaggtttttaatgaggcaacaaagtgcaaatacaatttgcgtcaccatgtactctttctccatatttttcccactgggtttttgggagttttaaagaggcatgtgttggtcgcggtattcgcccaagggggagtattaagtaaccctagttagggttatgtgggcaaataccggctttgcccctgaggggtctcacatctctatataaggaacctgtacaccccttcatgtaacagagatgagaaagaggccagaggcccaaccctatatcctgtgtctcgtgtgtttcctctgtcgtgcttatgggaagggagacgagttctctatagcttctcgcgcctctactgctgacgggagggaagggagcggatctggtgatccgtggtaacgtagttctcaatagttattgccggcgtttcgagaccggggggtccctaagccgacgagtgaatgtcgccacgtgccccagcccagatgggtcgacgcgaggccgagcgcgaaggggggaagcgaggtggccggagaccggcgtgagagaggtgggaatcccgcggccttcgtgttcgtcccgcgcccaggtcgggtgcgcttgcagtagggggttacaagcgtccacgcgggagagggagcgagcggcttcaagcaagcgcctgtctcgtcctcgtccccgcgcggccgaccctctctaagagggccctggtccttccttttataagcgtaaggagaggatccaggtgtacaatgggggtgtagcagagtgctacgtgtctagcgaaggagagctagcgccctaagtacatgccattgtgtcagccggagagattttggcacccagctggtgtgatgtcgtggccgtcggaggagtgccggagcctggcggagggacagctgtcggagctgttgagtccttgctgacgtcctcttgcttccgtaagggggctgagagccgccgtcgtcacagagtatgcggggcgccatcattgcctatctggcggagcgagccagatgggacgccggtcttgttccccgtggcccgagtcagctcggggtagggtgatg

SEQ ID NO: 6715 - DNA, 1500 bp, Zea mays
gatcatctatgttttttccataatgacaatgcagctrtgctttaagaaaacaaatatatatttcatagaacgatatatgttattatcaatgctgagtagtagtgtacatcaaattaatatactagatctttgtaattttctgaaaaatagaatctatttttatatcacgtcttataatttttttagctattagctaactaatagttaatgactttttagctattagcagacccttaaatatatattaatgttgtaatgtagaggcttcactaatctcaccaattagtaaaatattaccttattttttaaaattgtaataaatacttttagcttgtatatagatacatatagagccggttttataggctcacacctagaaattatagattttgatatatctagatatataggaataattgaaaaacaaagatattttatagcttaaaacaaaaggaatatacctacaaacagaaacaatcaaacaagcaaccactgaagtatgtcaagaccagtacctacgtactagcgtagttagcattcaggcatggtggttctcagcgccgatcgccgatcaatggatggttccagtagcaaatttgttattaagagcaagtttaataatagagttcattgttaactctaactccttatcatatcgtttagagttaataataaacatacttatataataaagctggctataagattgactcttatattattgttttgtctgttttcctttcattcttttatcttgtcacatgagagtctgggtcctctattttttatgtctcttttcttcgcataagaaaaatgctatataaatattaaacttattgtctatttgatctaagaaaaaaaaagttgatggtgccaattcacgtctcgccatctcccaagatatttgcagttgaaactagagtcgtagacacgtcacacaagcggtcaatagaccaaggacacgtcaggcccactccctccacgttttcactcctacgtggcagccacccagggaccaccccgtggatcacgcacccgatcacgcacgccctggcccacgcggacggccctggctccgccactgtggcggaaacggacggcatcggctaatggacaaacaaacggccggtagcgcgacacgtctcccctcgatgcgttttatccccacgatgcatccgtcgcgacgagcgctgcgccggtgcccccattctccactcggactccgctctcctgccccgctctccctcggtccctcccaggcccagcttccagctcgctctccgccgccgctgctatcccgctctctctcctctacctcctatcctcccagtcccagccagagctgtcctgctggttctctgcgtctgctgcgctcccgccgctgctgctcgtgaagttattccttcggagaggcagtgtgtttggatcgttttggtcagcctcctcggagttgtttgacttgaccggatcggacactgtttggtggctcaatcggccgcg

SEQ ID NO: 6716 - DNA, 514 bp, Zea mays
tggttgacggatgaagatggggagctcgctccggcggcggaggcgagcaggcgagagctctagggttttgagctagtgggttgggaggggagcggcggcgcgacaggaagcggcgaaggggagcggaggaatttatagctggggcgccgggtagggtttggatatgcgccttcaggctgggagaggcgagcagagagcggttagtgggcctttcatgcacattttacggatacttggtctcactgcaggccttgggccttctagccgatagttatgaattttagcccaattagcgggctccttatgaatcaatcctgatttgcaactaaacgcatgcgagtatgcgacgaccctttcgtcgaattttgaaagggatcggtaggaaaattaaaatttggggaactatcaaacacatctcgttaccatctagctcgttggtcagtcgccgtcagcccaatacccaccatccccaccaacggccggccgccgcggcggagcggagcagagagcaacc

SEQ ID NO: 6717 - DNA, 101 bp, Zea mays
caagtctccatgcctcgtccgcatctacacacgcccttcccaagtcccaaccgaacacacagagcacagcaacagcggccacctgccgctcagtgcgtgcc

SEQ ID NO: 6718 - DNA, 1500 bp, Zea mays
tgtctctttttcttaactaaagggtaatgaggtaacaccgcgctgaaaaaaaaatcattacattgagcatataggttttgtactatacttccctgttctggacttctggtggtataaagtataaactacctagttgtttatggcagccgttacattttcacgtactcctttattaaaagggaaaattacaaattaagtttcttaaaatctgaacgcctttctcttcacgcctgcattttaaattatccagcctgcggccgtggcttcacgcgtgttggctgatgtatctctgaatattactgttcaccgatcgctgttgaacgacttatcactttacctgttctttcacgcacttcgaaactggcgcagcggagcgccccgtccggtctagtgtagtaaatagtaatgggaagttgaatgcagatgcctcttttattgaaatctgaaccaacccaacttaatcttgtagtaatgaactatatttttggtcactgcattacatttccgagtattctttaaaaggggaaattacactgtagtaatgggagatttgaatgcagatgcataacctctgttgaaatttgagccatcctaactgtgttagttgtgttcgagaaaaataaaaggttggctgagttcgagaggaaaaaatgttgattgatttagttcatcagacatttttgtgattgggttatctcttgtattctgacctagatgttgaattctttcaggtccattgttaatggcgctgcgaagtggctgaacgacaacctgtaggctgtaaatatttactgcaggatagaagattgtcttacatggtgctgtagtccaatcaaagttcttagattcattgggggtccccacgagctcgtatattcgttttattggagagctgcaagattttcaggctgagtggcaaccgagggagtgaaagttgtcaactaatatcgtcgcggcgttggtcccttgtcattcttgccaagcaattatttttatgtagttggagtccttttcagtctggcaagcggcgtagaagtctgaagctgtgggatgctgatcccaaaccccgggactagacaaacactgtacttgaggttttggattaatcaaattcaccgatatcgaattgcaaacttatccaacttacaagatgcgatggaactatttattagaaatacgtttcggtgatatcgaattctcagtttcgagaaagggctatcacgccggcagttcacgcggctggatccgggcacggcgaccgcgcagggctcccgccatggacgcagcgcgacaggcgagagaagctgtgaaacgggctctacggagccgtgacattatccattccagatcgattgggccgccgccgccgctttctcatttccgggcccaaaccattatttaggcctctcgcgaagtcagtggatggataagaaaggaaagcggtgcgagcggaggaggcgaccgaagcgccacttgcttgagtagcgaagcgcgagagca

SEQ ID NO: 6719 - DNA, 1037 bp, Zea mays
cgcgatgattaacttattagcattgctaatatttgccaaggtgagatcaatgtacagtgcactaactcttcattgttcatggaatactagttttttttaaaaccttttaggagtactcaccttggcaaataactagcacggtgtatacagaatactagtttttttttaaaaaaaacgtttttctttatacaggatgacacgtgtctaattttctgcatcatgtgcttggatacgctcaagaacagatctctcgtgctcgtgtctcagtaggggtcacatgcatggttcctgataacccgactcagtgttgtcctaggcaaggtgttatgttattgtgaaattcatttttttaattaaataccagtgaaatataagcagaatgttccggaattgtacccagccgagcagaggcatcagcaggcaggcgaaagcaacacgactcgtggttggctccttgcaccttgctccgtcgatccggtgggcggtggccccgttcccaacttcccatatctttcccgaccaagagcacccgtccgtcgcgcaacgatggccccacactcctttgtatcgcggtcgcgcggcagcgagcagggtccccgagtctgtagccgcattggatccatctctctgcacgtggggcctgcgcgtcccccgtggcggcagcaccccaacgccgtccacacatttcccagcgaaaaatcctttcccaccaaaaaataaaaatggagccatggaggctgcagtcacacacagtcactcacacatgtgcgcgggcacgggaaaagcacgagtctacttttccctttcgatatgcggccgaggagagcctctctggcgaatggcgagtggcgagcgattcgtctagactctagacaagcccggctgcgcatttcgatgcaaatacgtggaggatggagtaaaatactaagtaagtgagagagaggatagaggaaggagagggtcttttcttttcttgacccaaggtccaaggaggggatcaggggggagtgagcgagggggaggttttgccgccggca

SEQ ID NO: 6720 - DNA, 210 bp, Zea mays
tctgaaccagaagaagccgagagaacaaactctcgcgctgtcacgacaggtcgcgcgggcagagcagagttcgggccgtgtgagcccaggttgggtgggtggactgggctgcgtatattacctgggcttgggttattgtgcgcgtgcctatcttcctgcttcggacagttgtgagagagaggggaagggatcgagagcgcggcggaggcg

SEQ ID NO: 6721 - DNA, 782 bp, Zea mays
tgacgaaggtcacagcatgccgaaggtggtcgaatgagttcaccataggtgggcaccaatgttggggacttattcttaattgctatgagttaagaacaaggcaacacagaatgttaatggttaaagaaattcgtcctttgaagcattatctcccttagggtataatgatcttcagacgaaggttatgaaggacaaatcttcatcatctcagtatataataatgaaagtagaagcatatgaaacgtggaaaataacatgaataatcatttaacatcattaggatatttytattatatcatcatgaataaacatgaacaatatcgaattacagttataccttcggcttgacagaaggtaaaaatccaggtgtgacgtgcgagtgaatacaagtcagcctcaacaatactgtgttactgttcatctatttataggcactggacgcagcctatgtaaaattatatccatgccctttatgtttactattgacttaaggacaatccatcgaggactagatagccttttcctctttaagccggtttcattttccgccgctaagccgaagcttctctacgcgtagcttcggaactggttcaaccttctcccagaccatgcttttcatatcgtgtacagcttcatttcgaggccgaaggtccctgtgattgtattatacttggaaaacatattagttgtgtttttgaggaccttcggaagacgaaggaccgcaacacctatattaatggagtgtttttcctaaattgtgatatcttcgttgcgtctgggag

SEQ ID NO: 6722 - DNA, 1500 bp, Zea mays
attccacacatcaccaaatgtggcgaggtcttatacagatttctagccatttaaccgtggaacattgctagagcataactatgaaaaagttttgttcatgccgaattcatttcacattgaattttaagtgaaaccaactatgcaattggaaatgagtacaaggctctataaaagcggaaaatgtttttattgtttgatatgatactctaaaggcaagagcaagtatgtatttcagtaagcatgttaagcattagaggataaacttgttgtatttggtatttcaggaatgatcttattggcgtacttgtgcttttctatgtcttgctaaacttgagagaaaattgttaagccatcaccataaatgaatttgcatgtgttacctatggaatctcaatgatgattttggttagggcatcagatctacaccatcttctcgctcccaagtcctaagccaaaacattggctataatttaattcgagcataggggctccttttcaactcattttttcggtcttttggctaagatcaagtgtaatatttttttaccagttcaatcaatatctggtatgtgaacaatatgttcactttgatattaaattcacttattatgtgtatttttatgtggagggtctattaaaactctcaagtgtcgcttagtcacccaatcaatatcatcaaatatggttgagtactgtcacaacgcatgggtattagactagtttgatattcaagtgtgactttgaactttttatttttctggaaataaattgaataaaacaagtcgctcaaattttatataaaaaagtcaaactgattatatattgggactgagggggaactatttttatttctgtatcttggccgttaaatagtacttttctattttaaagtataagaattttgatttttaaataagtatattatttgtgttatatatatacacaatcatatatctataaaagtcaaaatatctataatttagaatggaaagagtaaaagaaattgaagtttggaaccttatttagttaaagaattattaatgtttaccgccatttcaagtatgccccctcgttaacaatattacaagaggttttccagtaatcgtgctaggattcatctgaacaaattgaaattgccttgttcctttatttgcaagtcgctgctgggctgacactgatagagaccagctgatgagtaagcgagcactgatgttaggccaactcctctacttgccaccccacttcccaggttggtaggtgcatcaaaccacatccatatacctcaagacaatgcttcaaaacccaagaactgatcaccatcccgaacctccaaacctgctcacgcggatccagtcaaaccctgacaaaccattagaagcaccggcagatcgtcggctgctaataagaggcctcctttctcgaccggctacctcgtcgtgacagagagcctcgctcgctcgccctcgcgtctcgtttcctaggagagaaccggacaacacg

SEQ ID NO: 6723 - DNA, 1141 bp, Zea mays
atgaattaatatggaggcttgtgtggaacttactatcattgcgttttgtatggactttaacttgtttcagatggatttgaacttctttcttatggacttaaacttgtatgaatattgaatatggtgcttgtgttatgatatgttgaatatggtgcttgtgttgtgatatattgaatgttgtgcttgtattgtgctgttatggaggcttcccatccagggagggagaaaaataaaattgggtattaaaaaaatttattcactaagaagtggtcggcccccacattcttatatgcacccaggtaggttgctgaccgcgcgcgcagtaagagtgtccgccacgtcactggccgacactcttaacataagagtatcggttgcgtgtggaaccgacactcttaacttaagagtgtcggtccccatacttctatacgaataagagcgtccattttagagtgtcggctaagagtgttggcttatttcagtaagagtgtggggttttggccgacactctttgccttttttcttgtagtgatagttttcttgcccaattcctgttaggtgttacatatgctcaagggtggtatgccttagagtttggttacattcccccttttaattgcatggtatggttaacataggtcttctaagatgattattactaaattaggatcttgtccctcaagtttggtgtattttctcaagctaacccacgtgagataatgaggttttggtgaaagtgctgagtagaaaccatcagtaacacatgggatgaatttcagactatgtatggtcgggataggtgttcagggattttctccacgtgtgtgggaagattgttttcttaatataatgttatgcggacggtcttatccctgcatgtcaagtttttcttaattagctttgactctaaatctaagctaaagctccgccactaatataaatagctggtgcggttgtagatacacatataccatacaataacgggtggagcagctccgttgcatgatggtatccttgtgtataaataaacagggttccatggtctctctcactcaaagaacagtgatttgaaataattgggaataaatagttcgtgaatccctgaagcgtgcatatatatattcctgccaagataaaggta

SEQ ID NO: 6724 - DNA, 76 bp, Zea mays
gacgaatcaggctgtgaacgcgttccggttccatgggaattggaatttgtcatctgcatgctgatgccgccgccgt

SEQ ID NO: 6725 - DNA, 759 bp, Zea mays
ctcgctctcgcaggcggtgaggcggcgctatcagagcggacttcgccctccccccacccccacccccacgtccccctacaggtagccctgcaaccatggccgcggcggccgggctcagccgccggtgcaccgtccgctgacaagtcgacctttctcctacgacagcaaccgtcttcgtccggtcctggtaatcgcctacccctgcccctttgctggcacgctgctagtgcttgagcgtctctggtttaccggagagaggtcgacatgtttcctggtgcttactgatgtggtcctggtggccatattggttgttaggtttggggatttggtttggctttgcacgacacagatctgttaactaggaattcccgggtaggcggatggttacgagcattgcaatttgcagtgaccagctgtgggctccgggtggtgatagatttggactaatcggttgttctccagtagtatcgacgtgctaaccactgccctaattacgtttgtaattgattgtccactggagttcatgccttgccttctcctccaccacctgctgcctgctccctgcacagccttgccctgcactcaaactcaaggagacaggactgattcgtgcgtttcagctgtctagcttctctggtcgctcttcgtctgggttttatatgctttgcttgctacttgtgtcttatgatgtcgtgattttggcaggctgtttaaaaggagaggaaaggcaggaggaggggaggagttagtgttaagcca

SEQ ID NO: 6726 - DNA, 499 bp, Zea mays
actgtgtttatcccatgttactaccgagatagccagctttgggtgagttctttgttctttgatagcaatgtaatgcccaacagtgagcttgtgggcaccctaagggctttgctcggttaggagtggattgaaggggattaaatcccttgctagtcaaaattgattagaaagggattcaatccccatgtaactgaacaagacctaaaatgggaattgctgtacaattgtcatattctcatctcagtagagaaaatagtaaaagagattttggctggaatatgcaagttcagagctttctagctgccagcttggcattattagtggagggacattatgacttcttattaaactatcttagaatcaagacttgagtggtttctcacaaagtgttcccttgcagcaatcttttgatccaatccgtgaagctctcactggtagagatctgattcctgagatggttaacgggtaagataaccgaacaacactttgtttaggaggt

SEQ ID NO: 6727 - DNA, 50 bp, Zea mays
ttgtctggccagcatatataccgtcaaaattgggaagaacatggcgcatt

SEQ ID NO: 6728 - DNA, 56 bp, Zea mays
tgatgagtagtgttatccttgcgcgttcaacgcacaggtaacacacaggcacaatg

SEQ ID NO: 6729 - DNA, 1082 bp, Zea mays
cgtgcgactatcagggtgtagccaccagggtggggcctctagggaggggtacacgactatagacatgtcgcggaggccatgggtgccgagcgcaagggcggggagggcgtctgcgatgtacaaggtagaaaggctagaagggcatctgccaagcgaccgtaaaggaataagcatataaaaagaagaaacaggagaggagaaaaaagagaagggtattatagtcttctaatctcttttgccaaccatgataagctgctttgccgaacacaatatcaaaatgactctagctccaccaagagagttgtcccacatgggcctaaatctccatcgtgacattttggaacttgtatagactatttttctttcaaagctttaaaattcatttagaacattgatattatttgcagttaatgcaatggaacgagatcaaaacatgaaccaatttccttttttttttaaaaaaaatgttytaatctcaaaatagaacattgtacttagtttttgctcgagacatttattattcccataatatatagtcacacatttaagcaataggcaataaaaaacataatatgagttcatggctcaactaggaataatcttagtaacttacataaacaatttattaatgaaatatatgaggttttattaaattgaactattgcaacgcgggacatccatgcgtggataccaaaatccaaagctaacactctcaccagcgagtagtgtaaaacataggacgcgaagctgtatatgagaggatgagatagagaattagtataggagatctgaacctaataagtttctgatccccaaacttgaaaaccataaaaaaatctaaatttgatagagcctgacctgaaaccgctgcactccgatctaatccaaacacaaagcggcaaagcccaactaccgaaagtcgccggttgttgtcagctaagcgaacgtctcgattcgtcaaagtctgaaattaagctggacaccgctcccgcaccaaaccaaactaattacctcttcccgcgacctcctcccccggcgtacctccggagatccaccccgacccaccaccgcgtgcctcggca

SEQ ID NO: 6730 - DNA, 997 bp, Zea mays
ccttccatggcacgcatgacgcatatatggaccggcaggcagagcagcgccttcattccctacccctctctctctctctctctctctcttcatggagagacattcctgaagcaatcgtgcggtgcagaacacgcttgcaacaagaaacacacagcgacttgaaccgtttgttgcgtgatgtacgtatcgtgctgttagttctggttggggaaagaactgacgtcacatctaaaatatcgtcgcatatactagccaaacgcccgtatatatatgtaggttgttctatgcagaaatgggtgctggtgccaattctcaaaaacagaatggaaaagggagagagagaaaatcacggccaaaagagtccgcgagccactcgctctcccctttcgggatttttctctctcacggttcgcttcagagtcttcttccaccgcctcatgtttcccaaaggaaaatgtcgccgtcgtgctcctactttgaagcagtcttgtatatagactcacatcgcgcgcacccgctagcagttggctgctccctctcagtctcacgtctcaccggcaccttcctcttcctcctcctctccctgtcaccttctcttgtacgtcacatgttgacaccaatgccccggaccaaacaccgttctgtaccattcaagcaacctcctcctcctctctctctcgtcatcccgccgtcccaacgtcaagtcttctcttcatccttctctctcacccatccacccctctcctctcgctctcgctctcccgcgcytgcaccgatcagttgccatatattcctccaccctccctatctcaagcacctaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaa

SEQ ID NO: 6731 - DNA, 399 bp, Zea mays
ctagtatttttggctttacggttctattaaaaatgggggaagtgtttttgagacaaagctattttaaaaaaaaacatcgtttgatattgtttcgttaagaaaaagaaagatagagtagaagtcgtttcatagaaacgctgccaaagagaccttaatattactttacttgtttttgtttagctaaattttttaaaacccgttgcaatcaactgatgccctagttttcgcggatctcagttccccttgcacctttttctgggtttctcccccatcacggaaagcgcaaagccgcggccacaccgcaacaaagccaacgagcccaacccggacgggtgagcgagcggctcgtgcggaggtacacagagacgcggaccgggtcgccggacgacgagacgcacc

SEQ ID NO: 6732 - DNA, 409 bp, Zea mays
tgcttatttcgctgtgtatctgggaaacccgtaagctgaagaaggtgcttgccgtggctgtcaccattctgatggtgctgtactatctctactacaacaccgtatcgagcaagcagtcgattgtcggctatgaggtgtcacgcaccttccagctgttccgttaggtccagaaataacgctagccaactggttagcgttttttcattaataagccctttatcatcgtcatccagggaaaatccgaatattttactggtcctgaacattgcttgctttttatgaggattaaaattctaatagattgcatctgctcacgcagaacacctgtgataagaatattccgaagcaaccatgcaaagtctttcatggcttttcctggcacgtcgtcactcaatgaaagaatgctgac

SEQ ID NO: 6733 - DNA, 469 bp, Zea mays
ttaatatagtacagattcctgcaggcatacactgatctatgacgataaaattgataattttagatgccgatgtgatgtcggagctatgggccgackccgaccctattctatggttgcaaaatgggctggcccgttttctcagcccggtagggaagaccaagacctggtcacggaggaactccagcttctggaaccttccttccgctcacgacctcagtcccctcccaggcccaggcagccgccgcccgtctctctctcctccgagtcccttctcccaccgctgcaagcgctcgcccgagccacctccctctctccctgtgtcctgaccgtgatttgggcgtggcatcctaaggcggtcaagattcgagaggctggaagaaccaagcgtagggcctccgccaccacgtcgtcgtccgcgcgcgccgcccgccggcgcaaggaggcgccacagcctccgacgcctagggag

SEQ ID NO: 6734 - DNA, 85 bp, Zea mays
aatatgtgccatctttggtcatagttactattactaacttgatattgttgctcaagaatattcatgtctatattgacatgatttt

SEQ ID NO: 6735 - DNA, 1109 bp, Zea mays
gttttagttgggatctgtacgctggcatcagtttttacattctgatggagtagcttaaagttagtgtttcccggtgatgtagtagtctctatttatgctatgaatcgtggtcctcggaactctatggaattttttgtaagaatatcacagatgttgtgccacagagcacagaaaattttatcatcatggacatctccgcaaacgatctcaattgtagccatatgaatgatctattgagttatatactatatactggattatgacctaacaccagaggaacttgcagtgacatggtatgcaattctaaatgtcagccaagttgaatatttcccagtggaaaacatccaaacaaaattcctgtgttagcagtaggggttggacgaaagcaagttacacaacccagacactttatttgtcttagtgaactaagaatgttcatgacattaccattttcgatatcaatcatgagcttattttgattccatctatgtgacctatctatttgtacatgagcatgcatctggtacaaatctgcgtaattagaagaacccagttcatcacagatacttttacacaggttagtttttatactgcagagtgcagatgtatgcatgtgcagagttctgaatggttttagccaattagggtacaaatttcataattaattttgagcgtcgcatttactcatagttccaaacggttctgacctttgattgctttgctttatgataaggtgttggagatcaggaacattcccactgtgcgatggatcccatgtgaagcacaacaaagcaaccggtgataatgtgggccccctgctcgttaagaagtagatgcagtttctttcgacttttgccctagcgtcatgttgagcgctgagctgaacactatctgtatgtcatgatatatgtttttttagccaagctaaactatcacgacgcaacgatccttcatttagaataaagtaagctgctcatgtcaataagtcttagtttcatgattgtagggagcgttagtgacaggtgatacatgcagtgggatgtatgaaaatcggaaaaatattttgttctctgtgttgaacaatcaagtcatgagcttatgatctgcta

SEQ ID NO: 6736 - DNA, 1044 bp, Zea mays
tccgatctcctccaccgcgtctccgtcgttggttggccggcggcgtcgttggctggccgggaaaaagggcaaagcgcactctccgccctccctatcccttttggtctgtgacggttgctgttggctttttgggcgatgtttctctcgctgttgtagtagctaggtaggctgctttctttctgtctccctgacctcacaggcaaagagatatatagccgtacgccagcgccaggacacacggggcaggtttctgatctgctctgcttggtttgaatgccgtgttttgttcaagcctcgtctctaaagtctcactccaaaatttcattatttaaccgaacagctcctagattttattttggaatccatgctagaattccataagatgattgctcgtcttggtttatatatttattacgtggcacgaaacgagagcggcgttgggaatgattaggcgaggcactgctacagcaataatgctgaggggtgtttgggaataaagtttttctgcagttttggaagaatactgcagtattctcaaatactgcagtattatatacataatggtgtttggcaagctgggtaaaatctctgttttcaaaactgaagtattgtaaatactatagttgttttaaggcattctaaacttagctctggacctcagttttcaaaactgcggtattataaactacgatattgttataactaaaatatagtatagtatttcaaaaactatagttttcaaaaactttgttcccaaacagggccttacttccaaacacaggcacacagccgtgtcctccggactctcggggtctcccgacgtcgactcgtcctcggtttccctccatgccctcaaggcctcaatctatcctcgggctgtccgctgtccccttcccgcgtcgaaaccctagctcgtcacctcgccgccgtgctgtccgctgtcctagtccgcggctccgcgccccatctctcttgccgtcgcatctgatgttcttctcccgcaacgcattccgcgacctggaccccatcgactcgccggcctcc

SEQ ID NO: 6737 - DNA, 114 bp, Zea mays
ggttacaggaaatttaatttaatctgtcactactttgttgtattgcttgagattaatttagccagtgtgtttgttgattcagggaataggacaacagagattcggagtgctcat

SEQ ID NO: 6738 - DNA, 1120 bp, Zea mays
tagttgggctagcatggtgagattgaacgactgggccggccggtttcagcccatagaaccgagggaaagccttatttttattttcttttccaatttctttttctactatttctatttgctaaattcaaattggaatgcgatttgtgtttcaacattcaattaatgtgcaacactcaaaaagtgcatcatgagatgcaaggttcatatttattattactccgtttatttaagtaaatgcattgaaatatataaatttaatgagacaatggttattaaataattaagcgataactttatttaaaatgtttattacctattcacaaataaccatgaaatcgttattaggtagcacttttatgaaactcttctgtgatcatttcaaagtattgagttccaaggttaatgaaaaggatgatttaactccttgaaggctctatctcatttagtcccttacttcaaatcataagtattttaaaatcttggacgaggccttcccttttgatagtttatagagggattaataaattgaaagtttctcctattttgaataccaaattcttacttatcattatttatttaatttcgagaaatacactttatcacggatgatatcattattggtagttattttatctcaatctcttttgggaattctttaattcatcacaatgtgattttgagggttacatcaatagtgcggattttctagcattgagggaggaaaaaaggtcatacatgagtaacaactagcaaggcatgcaagcaacggctgacactacagaaagaatcagctttgctttatctcatcgataaactcgcgaagtcgcggctgtccccggcgaaggggaggttgagagctggttccgctgcggcggcagcagttcctccgatagcggagacgcgaaacagatagcgaggaaagctgggttgttcagattctgtggcaggccagcaacaccgatttaaatgttttggataaacacgtagcatgtcccgccgatacgaactcgaacaacctttttcctccctataaattaattcacagcaatttgaccgtggttcttcgaaaaccacaatctccagatagcaattgatcgcaacgcgttgcttcccttcgctg

SEQ ID NO: 6739 - DNA, 89 bp, Zea mays
tgtcagcgacgccatctccatgggcacccggggcatgtgctacaggcctccagtcccgcgacctcatcgccgacagcatcgagaccgtc

SEQ ID NO: 6740 - DNA, 524 bp, Zea mays
tcgaggtcgttatcgtagtatactcgtattatatattcccgttgcaacgcacggctggtcataaaaaatagtttgaaaaaaaaacgttagcatcggagagaaccgtgtccggagggaagattgagagaaggactgcagggcgtcggatttgatttgggtacccgaatctcgaggaaatatctctggggcgggcgagtcggtggtccacgtggagtctaaaatcctgtcctgatgtgcgcttttgccctttattcccaaatacttacacgcagctcctctgctctgcctcccaatacccaccaacacgccacacaacacaaatatctccgtccttgtcccccatctctctcgcccgccgccgccggttgaatcgacggagggaggcgttgatggattgctcgattcctggtgggaattgattgatttcagctgcatgtgcttgtgcttgtgctgctcaatcgaattcgagtccgaattggattaggcaggtgggttgggtaggtgcgggatccagcgagcggagg

SEQ ID NO: 6741 - DNA, 239 bp, Zea mays
ggtggcgcggctgcggcgcgccgccgccgtcgtcgccgggcacctcctcctccccccacggccaccaggaggcgagggggggcgaaggggcggactcgtcggcggcgggcggcggggcggcggcgactaccacgaacagcaacagacggccccggctggtttggacgccgcagctgcacaagcggttcgtggacgtggtggcgcacctggggatcaagaaggcggtgcccaagaccatc

SEQ ID NO: 6742 - DNA, 407 bp, Zea mays
caaagcagtcttgtataaagcttacctctgcgttaagataccaagtaaccaaggatttatatgagtattctactcaattctgtcatattcacacacccttggactcgtcccagcaatgtttaaacctaattctgtcatattctactcaattcgcagatgggacaacaccacagccgcatcattcacgatccgtggcagtagaatccacaccgtctctgcactaattcgtccgttggctccagccattcaagacgacgtaacccgtgacggaatcgctttggcgcggatctccagactaataaccatcgccaatctcctctgtgttcttgcgtgcgcgttgacctgctggcgactctgcgctggtccctctcttcttctgtgaggagccaccagagtacgtacgtaca

SEQ ID NO: 6743 - DNA, 640 bp, Zea mays
gcattcaatcctctgcaagtttcaaaatcaagtcaagtgatcaaaagtgtttagtgactgagacagggtgactgtgttttcttttgttgctcttgttgcttggttgctttcttcttctccttctaatctttcctagtgttttctaaaggaagcaagatacacctaattgtgtgggtgatccttgtggggtcttagtgactcgtgtgattaagaagaagcactcgaccggtctaggtgacccattgagagagggaaagggttgaaatagacctggcctttgtgacctcctcaacggggactaggttctttggaaccgaacctcgggaaacaattcaccttctccatttatgttgatcttcactattttatttgtttcttccctctcccctctcactagaagtgtcttgctcacatttgtttgagttagctcccaaagttatctgcattgattgagcaactcatagcaagaaaaactatcttccacactctgaattcactattatttatttctaaccctaaccccaggtgaagtgcgtgttcaaagtttataattttcaggtttcttctattcactcccctctaggcgacttcaattggtatcagagcccgatgcttcattagagtttaacaactcaaagtg

SEQ ID NO: 6744 - DNA, 274 bp, Zea mays
ggtatgcaaacaaggaagtgtctgactctgttttgtgtacttctgtgttatcaggtatgttattctatatataaagytgtgattccgtgcttagtaaatttgttttgatgatcttgctctgtctgaaaatcccacattacagtaaccttttcatacaactaaccaatcataataattctgcattttgaatgcttaggactacactacctggatattggtaagcactactagaaatattcagagacaacatgaatggcttccaaagggctgggtg

SEQ ID NO: 6745 - DNA, 1500 bp, Zea mays
aaatgataaaatatattgtagttggtgtatagtaaacatgactgtaaaaagtttgtaataaaaggtagattttgctgaccagaaaagaatttttttagagtaaaaatttagagtattatgagtgttagcctcaacaactgagacgagccccgagcaacacgtggatattggatcacgtgctgccagggcatggtccggcaggcaggcagcgacgatggggggcggggcacacgaaacaggccaggaacaggagtcccagtcaaatgtgcggcacaccggcggtgagtattcccgtctggctgggcacaggaagcgcgcaggtgggaaccgatgggatcggtccggaggcgaacttggccaacgaagcgacggccggaaaggcacgttcttgctcccccgctttcgtgggatgtcgcttttgtttcccccaccggcggccgaaagaggcgagggaaggcaccggcgcaccgcccagcgcccaccgagtcgagagcggggccggccgacgagctggccaagccacccaccgcttgtgcttccattggatgacgatgaaagttccgaaaagatacactaggagctgataatttctgccagttcgaaacaggcgacctatgtctcctggaaagttttgtagtacatgtattaggtcaaaacgctatctataatttcctagctagttttgtttctcaaataatatactactcttcaccgaccacatttccttcctgccgtctccaggtcagcatgtctattggagcacaagcaagttccgatccgtgacggtaaccgcgcatcttaaattaataagtagaatttttttaaaaaaaaaaatcctcaggctatttattttaccgactttctcccggaaacagtgaaagcgagcgcccgaaaaccaaaagaagtttatctacacacataaaagcgttttggagaacatgcagaatgtcattttgcgccggattgcacgtgctggtaattcatgtgtgttcgttgcgtagcaattccgatccggccttgatcttctctctccctcctgcctgttccctctaggctctagtagcaaaagggagaggcgaaccagctcagagccggcgaccgccaccccacaccgcatctcccgactcccgctgctgtagtgctgtgcactagccaagccagcttgcatattccttctcccccacgctttcccgtgcttccattccaccaccagggccgcggaacgccccgccccgcccggcccccgcgcctcccctttccacctgttcgtcgcgtgcgcattcgttcgcgcagccagcgagccagccaccaccggcccccaccatcgatcgatatcctcctcctgtctctcttgctgctagctctcgcagttccgtccgatcgactatactgatccagctcctgctatgcgcggcggcggctagctcctcgacgacgagctgatcaatccgacaatccgagtccgccggcgcggatcgtcgatcgatcggccaccagacc

SEQ ID NO: 6746 - DNA, 124 bp, Zea mays
cttgttgcctgcggtgcaccgcgccgcgtgattccggcggcttgatttggaatttgtgatctttcggggcattcgtcggtttgtctgtcggtgccggtggtgctgcgtttcgagggcagcgaag

SEQ ID NO: 6747 - DNA, 1412 bp, Zea mays
accatgatattatatgttcatgtaattctatgttgattctttagaaataatatatatgatattgtaatgtgtgttcgatatcaatttattttatttgagttatgtatttataatattagtgttacggtaatattttgtcacacaaattttatcatattgatgtttgttatttcatatctatgtttcacactattttttaactttcgtggcaagtatgaataattaaaagattaacataggtctgattgaatgtcgtcgcacttttgtggcaagtatgaataattgaaagattaacatagacctgattggatgtcgtcgcaacgcaygggcacctacctagtatggtcattaaaccttcggattttgtcattagtaagatctaggacgatatgactactttttataatcgttaaaaaggcgtgatgcttaaacacagtaatataaacgacagctgggcctagagagtggagacgccgctggatcagaccatctgttccaggcccatgtaaatttgcactgtgtccggtcccggatgccgatccgcttctatccctgcggccctccctgcccatctcccgatttccccgcgtgcgctctctctctccgtcggcgacgagcctgggcgaccagcgccgccgcccctagcccaggtctccatcggacgcttcgccaggtcttgtttagacccaccgccggcaacgagcaactcttggtacgtccactctttctttcctgctgtgcgaaaccgagcacacccaaaccctaaactaaacaaatttgtttggatgcaatcctctttttcatcattcatcgttttgcttgattcctatgttataccagatgcatgatttagcagcgacaaacttggagtagtcaaaaccgcaaaaggttcctcccttatgattagttttatgtaagatttaaagtatagctcttggcttatgtgcatccatagtttcacacccatggaacttctccatttttgtattccaataatttgcccaaagcgtgattaaaccattaatctttctgaactgatgcactatcattgaagtgtaaaaaaacgtttgttactgaaaattaaaaatggttggatattttgcaatgccttctcagtttgatattttgcacagagattagcatgagttggatattttgcaatgccttctcagtttgattatgtattgggtttagttgtagaattttgctctcctgcagatgtatttttgctgcagcttggcagaacaaatattttattttctttacatgtctgcgtacgaatttgtagctgttatatttttatgttattgtcatatcaccaaatgagatagcctcacctgatttttagattataataaataattttttcatagcactcttttgatttcagttatcggatcccgcatcgtgga

SEQ ID NO: 6748 - DNA, 932 bp, Zea mays
gttttatggtaagattgtatcgagtgatatcctcctctatacccatattctccatatgtaccatttatagacttttatgagattttctcctctataccacattcgtctctactagcgtacgtcttttatatctcgccctgtatgtgtcgaagatctcatattaaggacatattttcctctaaatttttatacgtacgtatttgtagtacccttaaatgtctcgtacatattttagtttagttcaattcgttgtctaaaatataataaaatagtttgagaagaatagagagagcgtgtacagagagaataaagaaacatcatcttatatgatgctttaaaggatgtgtcttctctaaacatttggctcagttgttttacttggcgagtgggattacatagtttgtcgtctttatataaagaccacggtgattaatataacgaacttattcttcacttgatctaagtgagtaaccaaagtatccagaaaagttgatcatttcctacccaacacactttatcccacctaatacactttttcgccgagatctcgaacaggctaacggtatacgagaactcgtgataactctcgacataactctacttttttttagcaaacttcatggatccaccaaactgtccctttcatcgtccagacatcactatctggacgaggagaaagaatctttgtctcgtcagaggagaaaaaaatctttgtctctcgaatcaacctgatcttggtctcgagtcagaagagaaagaatctttatctatcgagtcaacctgactcgagaccttgacccacacggtccgcgcccatggtccggttcgccgcagccggagatgcaccgtgggacgcgggcgccggccgtgctcgaacggcctctgcctagcttgctccatcgacctccggcgtggcactcgcgtacgtgtcg

SEQ ID NO: 6749 - DNA, 1202 bp, Zea mays
tgcaggtccaagggctgaagaaggacctacaatatataaaagagacggtgcagtcctcatctgtactggaaatgaaggtatattctgttgtttaggtttaatctcaggaaaatattgttctttagtggtgcccacagataatcattgtacaagtaatgtgtccatgctttacttaccctcatcatgggagcagcaaaaattctggtgcactgtcctgctgtacttaattccctttggtttgtgctttcaaatttgtgacatgccatcttggagacacgggtaggaatttgtggtttgacattttatgcctgaacctgaatgacttggacctttgagatctgaaatttagtgtgcttatataggtcgctgtgtgtttgttaatgcaggataataaaatcaggaagcacggagactgggagaaatgggtgatccctcgcgagagcaatcctgatgccccgtcaagattagcatctgtatcaagacctaatgtcaataacctgacatcacatctaggaggcatgggtctgcatgaatccgctagctctactggcgcagaggagctgaaccatcatgatgtcgtccagaacggatcgccttctggtaaggaaccggcagctgaagacagttctggtcagcaggagttgcaataagacagtggctcgccttcacaccatgactgcaggggttttgtgccagagcacaaatgatagtttcttcttttttttcgggtttttggggttggttgggggggggggggtttggacgaggtgtgataatgactcatgaggggcgtgttagactgacaggcgaatgtgtttaccgggggtcaggtagataagattttgctttaccttgtggtattcaggcggaggggtagggcagctggtgaagcagcagagaaggaaggcggtggttacatctggaggcgcctcagatgacatggaagactgaaaaaacaagtctattgaagactgaaaaagaagtcaattgaagactagcgtagcggccctgggcggctttgttttcacaggatggtattctggtgttgcgatgaactagtcttcatcgggatggatgttgtaggaccttcaggttttttttttattttttttatggaggagctgaaagtttctgacttgggagagtgagggagtttgacttgttttgtttttgtggtggcgttaagttaaagtaagaagaag

SEQ ID NO: 6750 - DNA, 461 bp, Zea mays
ggtataaactctggtcctcataaatcttgtgatttcttatcttgctaaaggtcagcagagacaaatccttactgctagaagcacataggcaagaataggctgcaagtttttttttgggaaaatactgcttttgcttgtagctcatgggcagtaaataaatgcatgtcctcataaatcttgaatgatgatttcttgtcttgctagagttcagcagagccagttctttactgttgcaagcatataaacargaataggctgcatttttttggaaaatactgctccttgcagctcatgagcagtaaagcaatgcatgttctttcaagaaacctatttctattctttgcaaaaaaagtatgtagtctcattactcccaatttcttgctttttcatgactatgaatagcactgccactatgatgtgtatgcttgcgtcaggacaggagacccaaaagtacttcatag

SEQ ID NO: 6751 - DNA, 102 bp, Zea mays
atgtgtgcacggcccaccagaccgcgtgcgccggcctagcaatgcatatgacaaattgaatttagttccataagttaatcatcagagagtcctgagctgctc

SEQ ID NO: 6752 - DNA, 1500 bp, Zea mays
tagtttgtaatcaatataatttgcatattattcttcgcacacctttataaccatagcacaacaggacaatagctcatcgactctttaacaacaactgatgttcacctttttctgcacaggtaattgttttgcatgtctatgacgagcatcgtcacttttggaccacgaatctttttgtgtactgaaaccttttcagttctttattacttcttgttaaaagacactagaaattggaggctcctccgcgttcgacgcgtcttcgaccaatcgcgtgctgacgcgtgtcctgcagctcggacccaagatttccgctagccgcgcgtgttgagcttgagcttcgtcacgtccgcctctcttttctggctcgcggctcgccccctcgcactctccagtccccacttgtcctccacccccaccgcgcctgaaatcccccacctacaacggagtactccccacaacgtcctctgcctcaccctcctcctcctcggccgcgggaggcagccacatctcaggctacggcatcgcggcggaccagacgggactgggcaggacaggacccttcacgcgccgtgcctgtaaccttcttcccctcatcccgccgccgctagggttcgcgaggcggtgcggtgcatcggttttatcgacgagggagggcgaggggaagatgaatccaaccgagcggaatggaatatataagattgagctgccttgaatcgatgcggacgcgagggttggggaagctgctgggcgagcaagtagatgcgagggagaggggtgctgtcggattgattcttctcttgttcttgggcagctgctgggcgagcaagtagatgcgagggagaggggtgctgtcggattgattcttctcttgttcttgcgatttgctggtggttgatcttgccgccctgcctgcaccggtgcaccttggggcaggaaaggccaacgaacagccgaacgagattgctcgatgtggagttgtattttatttagaaaggagtttaatttttaaacttttagagaagacgttggattttggaggcaaggtctgtttcttgattcttggtcaatgtttgcaccattagttttccttctgatcttgcatgcccttctcaagataaagatggttgctgttcttgttgatttgcatgcttcctttactttccttgattgctctacattccttgcttcctgacctgcaatctattcctgaagatgggaaactgtttgcaaagagcagcataaacccaacccaaaaagggcttcaaatgtgttcttttttctgaaacagttcttgcccattcacaaaacttgaaccttttttttagattcaggaacaaaacttgaacttggtgtccattcttccttggcacatgcagattggaccgcagactgtgagatccatccaatccaacaaccgaatccaatccaatccaatcagagaaaaagaaaaaaggcgaaaggctcgtgtctgtgtggcaccacatcttgccatcagggaaa

SEQ ID NO: 6753 - DNA, 1500 bp, Zea mays
caacaaacactaagagggatgtccaagatatggaagtgctgacattctcaagacgctgatcatagaggaagacctggtaacctgcgcaaaatcaaatagaaataaggcaccgcgagtgctcgagtgccccaaccagacttcgctatcgtcgtcgcacaaccactgtgcaccgctcgctgcacaacacccgcgcaccgcccgctggacagcccacgagcactgtccacagctcgctcttgcgtaggtcgtaggcgcgtcctcgcccttgcgtcctcgcctgctccgccaattcgctctcgcgcgcaactcgctcctgccatcacgctcaacatcaccctcgctcgtgccatcgtgcgtagcctcgcccctgcgcccatcccgtgacgcactgcccacccctccgaccctctctatctcactctctattcattttccccaccacacgctcgtttgtcgtatagaactctcgcaactgttcagcgaggcagatcattttgtgaccgtccaaagatgatagagtggttgaaaatttaaaagaggacgtggacgaacgtcgtgccgactagcgcctagctttaatatatagaaatataggtaaaccatacataaattaaatatttattcaaatatcattatgttgtattgtttttaaattattagtatatgtatatatttacaatatatctcgtttgtataatataaacaaacatgagtcgtagtagtggaagccttttttttgaatattttctatgatggagggagaactcgttggaggggcgacgtacgaaaaaagctcatacataggatgtttgggactgcttttcagctctaaaaatttggtggaatagatcattagatactccaggaaatcatggaaatggagttataaacctcgttttgctaattatttaaattaaaaataattaaaaaaaataaatttatattataaactacagctccacactggagctgaaacctgaaccaatcctagacacccccttaaaaatatagtagagattttgtcgctgccatacaattcaaagcatttattatgttattttgtccccttttttttgagttctttgattttaggcacgctcctttctagatgtatttttaagaggctttgtacatatcttttgagtgaaacaggtagctctcctatcctgtttgttttagaaaaaaaaaacaaatacaaagaaaaaaggctaatcgagtcgtactagtgtttctatcaagaaagtaattgtgccgtaacctccggggccgaatacacatacatgtagtgcaccaaggggactatcagttggcagttgccacaggcaactggcaactccctcttctcccaggcttcagcccaaccaccagccgccacgaaatcgagaccccagccaatcagtgtacttctggtttggagcaaattaatgaccacatgttcttatataagctcacttctgttctgttctgttgcgttattaaagggcacttgcatgcagcaat

SEQ ID NO: 6754 - DNA, 1244 bp, Zea mays
gaactaaaataatttcatgagaaagattatatattaacatagcctaagtaaatataactaaagaggattatctatcttaagtgtgcattcaaagataatatttctctaaaataaatactatgtgtacattccatcattaaatcatttatctaaatggttaaaaataaataaagaaaataataattaaattaggcatcatgcttgacctatgggtgtgaattcttgtattcaaaactgaatcaaaaattgaaatatgaaaattgaaaactaaaacagaaaacagaagaaaacagaaaatagagaagtaataataaaaaaaatagaaaaggtgaaacctcgacatgttcagcccatatgctttccagcccaactttccctttttatttttttctcttttacgctgtgtctatggcatgcgggccccacttgtcaatcaatacacccagccatcttcatccctaagccacatcgtagctacctggcgacaaacgcgggatctgttgccgtgcatgccaacgaacaacccgatgccatgcttcgctgggggctataaaaccaaatcgcatgcacctctccttccaaaccgttctcgttgactatcgccgctgagggctacgccaccgtccacaagatcgagagtgtgagatgagctcgtcatcgttgcaatagaagcccagcaagctcgcggcctggcyctcagtatggagcatcgccggggcacaccgcgcgtgggggttaacttcccgggcgaatggatcgactatggaggccagaactgctcgccgtctattcgtctttcactctcccctgcaccaacaccaccaatcaggtcccccaccacttccgtcgccctcgctcgcttcgccatggccgagtaccacctcggacttcagctgcacggccacaccgacgacgttcgtggcatctgtgtatgcggcaagcttggatcgcgacatcaccgggggaccgtactgtgaagctctagacccggaacccagaattggagagcgaatatgttctctccaagtcaatcgcaggacactcaagttttgttggccgattggcttggatgcctccttcagaccattttcctgaaggttgaatcgtctcaggtggaatggacacattcgttttttcctctaggatctgcaaaaaaaggagaagttgccgagacaatgaaggggcacagttcgcaagtcacttgacttgctgtggacactaacagtgacctaatctcttcgtcc

SEQ ID NO: 6755 - DNA, 719 bp, Zea mays
tcaagtactaccgttgctatttatgtttcatttcgagaactaaacaacacctaaaagactagtttaaaactccattttcacaagattaagatcaataatagagtaccaaacaaagcctaaaggaaaatagactaatttcccttaaaaataaaaaattttaagacttcggttattcctatacctcatagagtgaaaacaattgaaaaattataaaagattttaatttaaaatcgaattaatctcacttaaaccccttcgatctatataaattgagagtaaccgaaactgggttttcaactagccctaaatagctcctttcaccatgcaagccctgagatttttcccccctgttgtttgttcaggggtcacgagtggtcacggtccccgtctctgaacagcctagcaaagctcggccgtcatctttaccccttgtccccttacctcccgcttcgccgtcgccgtcgccgtcgccgcgatctatccgcagctagtgcgcacgcactcgtccctatccccttgcaccggcgtgtgtcgcgcagagagcggagcttatccatcacattaccaggacatgatgatttaccggtcgcactctcaccaaccgctcttgttcgctaccagatccacagcgcgcacttgtgcctatttatttattgtggaggcgtgggttggcgagggactcggatcagccgcagttgatctggaggcgcgggccggcc

SEQ ID NO: 6756 - DNA, 1500 bp, Zea mays
aatgtctatacatttgttcctaaaccatattgattacatcagttgctcctaatttattttttattggcgcacgagaagggtagtgtggaagaatagtgtattttggtcttattatgttgtgaccaacatgtgatttatatggccgtgcaaaaatactttatactagtttgtaatggagattacattgttcataagtataatttaaaatatgaaatagaataaaaaagtgttggagatagccttacaactcatttaatgagttttaaacactttgtagcctctgaaccaaatatgatttagtccctgctttagtttctaaactaaagtaaccaaacaggttctaaatacatttccgaagtttaaaatttatcacaaaaatgttgttctcaataacgttaatttttccctttaaagtggtgttttgtttcaccgaaatggtaacgcaaacgggtttacatggggtaatggataccaatatttttgtttgattgaactatttcccgtagtactaggtattactatccaattcaattataactagtaactattaccgccggtaggagatctcattaccattcccttagaggcttagagcatctctaaaaactctctagaaaatgactcttcaaaatcagttttaatgggcatctaaaaaattagtggaggtagattttaattctttctctaacagatctttaaagcggcagattatttctagggagccccaaaaccccctcatttgtagctataaatgagagagttttaagggctatgaaaaagttgagagcgttttagggaactgttgcagacacgtttttgtgtttttctcaaaaaatcttaatttaattgagacttctgagaaactcttagagatgctcttattaataacgtctgaaccaaacgtcacctaaatattatttattttagggctgatataggataaagttggttctgcagggactgcactgtaaaactccaccaagataattttttcctctgtgtgcgcgcgggaggcgttgaacattccacgtcccgcccggacccgtcacgaggaggactgaaggcatcacttagcagtgggcccacggaaccgcagggtccattgatcagtgaattcgcaccatctccacgagagctaaaaccctccagaaacgcagggaccaaccgttgcggatgatttcctctcgtctcgtctcgtcccatactcccgtcctgtccgtcttcacctgcgttccccgggtcccgacacgccgctgtaccagtcccgcccgcctgcgcacttctcccacccccgcgccgcctccggcgccggcgagccctcccgacgctcctcgaacgatccgtccctgtcgcggcccttctctctgccgcttccagcccaaggtaagactcattttcaccgcctatttatcgcgcacacgggggatgttccgcccctttctgcggcggagttttacgcgggtggatccgattctacgcgcaggggaggagagggagagg

SEQ ID NO: 6757 - DNA, 645 bp, Zea mays
tgactcccaggaggtacaagttttgcatgtgtctttcgttgggccatcagcccatcacacttgcatttttactacgtggttgccatttttttattactcatagccattacatatcacttaatatttgaaatttccgaacttaatcatgctgtaatcaatttatatacttcagttagctagattcttctctacttttttttctctcaatatgaaggagagctacgtatcattgcattaagaagaaaagccgaatacaaatggcctgcgaggctgcaaccccgggcaaaggagtccgaagaggaaacccaaagaaaatataaagaaactactaaaaaagagaaggccaggtcacaaccactaactacaacttcctaagaatttcctgatccaagagcacgcaaaccagctgctccaacaaaacaccaaagatttcgctcatccataagggaccggagatttgcataaactttttttttagctttcattaggtcattttttaaatattccgtattccaatgattcaccctaattacttacattgatggccgcacaacatcccacctgtccctttttagaataatctttaaaacagacttcactgaatttgcccttcctcctgtacaagtgttttaatgctcctttgta

SEQ ID NO: 6758 - DNA, 782 bp, Zea mays
gttatagatgcgtactgcttactagcttgttaggaaacaacttgctagtttttttattgttgttcatgatttatattcagaatttaatctagaatatgtatatttattcatcaggttgatccaagtaatattgtccattgaatttgagtaagagagaggtgttatccaacgatatgaactattggttttgatggtgtgttaagtttagatgtaatttctttggtggatttagtagatgttattagtgtggggatgatttggttgagtgtgttttgttaccacctcttgttactgttgtgcattcagatatatggacacgtacaacacatgagccccttgatctttacataatctacatgtgagctccgatcattagagaatgcacatgacgatgctctacctttgtgctcatgtgggaactattgacaaatggtcatgacatggaaagctctcgacaaccacatcatgcatgataggacgatgatccttatcgtggctagctagctatccgtttgttttcggtgctgactggtatatatatctctctctgtgggcatcgtcgtcatcttcgtagatagggcatttggcgcatatggaaggccatggctgcagcaagttaacgacgaaagacatgtcgacatgctgatcattgcactctctcctagctctctctgcccggccggatgggtccataaatacgcactagtacatactcagctagtagtctcacatagcatagccatcttcttcgtcgacaagcaggggagttaggtctcacatgc

SEQ ID NO: 6759 - DNA, 841 bp, Zea mays
  unsure (1)..(841): unsure at all n locations
gggggggggnggaattttgggtctcaattccatttccatcccccatgccaaggccgccgtgactcgtgttgttggctcctggcacaggggactcatctggaatcgagatttttgccccgggggcataatttctggaaactaaattgtgttcggtgtgagagctatgtgcttagctttctcctgagaggtaaaattggactttggcgtgggcccaaaatggaggcactgcagaacatgacactgtatggcggtaacccacttgactttttggataactagcattctacctcactggagctagatagatagataggtccgggtgccaggcaatccaatgtttctgcgtcagagcattctatatttcgttgataaatcaatattgctgagccgctgtaatgttctttccttttcatcatgattttgttgccatcttttatgatgtacttagttaaccactcttcagtagcgtttatgttatattatttaattattgttgtgagatgtcctatttggtatttttttggttatatttccagctgcctagcgcagatacacatcctacttatccagttattggaatcttatgttgccattggctggttatctggccgtgagacacttttagtcttttaccaaaccataccaactttcagatccaatgaaggctgccaacttgacgcaaggtgttcaagaaatttaaaccatgcactcttcatcgtaggttcaaggcaatatctgtgttaatcttggggaccttcagtagattgctgagagttctccttgatacaggggaataaagatccaaataagtttttgacattgatctgtagccagtactgca

SEQ ID NO: 6760 - DNA, 1500 bp, Zea mays
ggtgcaagcgtggtccaaaatgttaaaattaaagaaacaatccatgcatatcttatgagtagtcatattggctcaattccaagcaacctttgcacttacattatgcaaactagttcaattatacacttccatatttgctttggtttgtgttggcatcaatcaccaaaaagggggagattgaaagggaattaggcttacacctattttcctaattgattttggtggttaaattgcccaacataaataattggactaactagtttgctctagtctataagttccacatgtgcaaaaggttcacaataagtcaataaaaagaccaagaatgggttctatcaaagagagcaagggataaccgaaggcaccctggtctggcgcaccggactgtgtccggtgcactaggggacttcaagtcaaactcttcaccttcgggaatacttagaggcgctccgctataattcaccggactgtccggcgtacactggacagtgtccggtgctccaaggaagagcgactctgaactcgccagcttcgggaatccgctccgctataattcaccggacatgtccggtgcacaccggactgtccggtgagcccagcggagcaatggctacttcacgcgcaacggtcgactgccacgcattaaatgcgcgccagcgcgcgcagaggagtagagcacgcgcgagtggcacaccggacagtctacaggacttgcccggtgcaccaccggacagccaggcgggcccacaagtcagagctccaacggtcggaacccaacgactaggtgacgtggctggcgcaccggatagtgtccggtggcgcaccggactgtccggtgcgccatgcgacaacagcctccaccaaacggctagtttggtggttggggttataaatacccccaaccaccccacattcaagtcatccaagtcttcccacttcaactacttacaagagctctagcattcaattctagacacacccaagtgatcaaatcctctcccaattccacacaaggctttagcgattagtgagagagatttgttgtgttctttcgagctcttgcgcttggattgcttctttctttcgttcttacttgcaaacaactcaattataaccgaggcaagagacaccaattgtgtggtggtccttgcggggaagtttgttcccgtttgattgagaagaagaagctcactcggtccgagggaccgtttgagagagggaaagggttgaaagagacccggtctttgtgaccacctcaacggggagtaggtttgcgagaaccgaacctcggtaaaacaaatccacgtgtcacactccttatttgcttgagatttgttttgcaccctctctcgtggactcgtttttatttctaacgctaacccggcttgtagttgtgtttatatttgtaaatttcagttttgccctattcaccccccctctaggcgactatcaatcggtatcggagctgggtgcttcattagagcctaaccgctcgaagtg

SEQ ID NO: 6761 - DNA, 642 bp, Zea mays
tttgatgtcacgcttacaattgccacgacggcggtgctaaatatttgaatccctcccacggcggtgtcatgtttgcaaaattctctagcggagaggaggtggggtcaacgcagttaacaaactctcatggcactatgggccaagccgggcctggaagtccagcacaggatgagaaaaaggccctgtccagtccaggagctggctctcgactgtcgagggacattttaggaacgccacccactaggccactagggcagcgtgcggtgcagactgcagggtgcagtgctgccagtgcagtgtgcagacgggtggggtctaggggaatgggatggactatggaccgagctcaaatgacgccatgccggcgccaccgagggcgaaagctgtccagatcgtgtgattttgcatcccatccgcgagcgcgacacgcgctgacctactcgacggcctccacctccgtcttgaggcgaagcgtaggtgagccaaactgccaaagcccatcgggcaaccactagcaattcaactgctttcgcttcatcgctccatggctcaattcaatgcggtttcgtattttttgctgcgaagtgcgaaggaccaactctttcgaagggaaattatatctcaggtgcttaggagtctgcc

SEQ ID NO: 6762 - DNA, 304 bp, Zea mays
ggtaattccttccgtttcctcttcgattgcaaaggttttagggcctaaggaaagcttacgacgctacctctcttcgatgataaggttttgtggagaataattgatggtaggcttggtttcttgcagcagttggactgaatcagttgtgctggcacttagctcaaatcagatttgttcatttgcagaaactaacctggcatactaccaaagatgttttggattgtcaaatatcagttgtagttattcatgagtgggcgactcaattcaggtccagaaaccaccttttagatctactccatgtcca

SEQ ID NO: 6763 - DNA, 316 bp, Zea mays
gttaaatttgttaaatttgaagagtgtatcgctgttttaaaagataactaatagaaaactagagcgagtacaaataagaccacctccgctttacctggtccttcaacaaacgaatattgtccgacccacaaagtcacagcaaaaaaataagtcattaagcaagcagtagcatcaaagctcaccagcttacacagatttccccctatatatagagtgagagcactagagaagtggccgcgcggttggccagttgctctgttgctgcagcctgcaagtaaagtaggtaggtagccaggtaggccgaccggcaacgacg

SEQ ID NO: 6764 - DNA, 1233 bp, Zea mays
ggtgtgtcaaggtggagatccgacgagtctagtgaagacgaagaagagagaacaaacagggagagcggagcttctcttgttactagaaggcgacctagattttcgagaagatgatatatccacgtcctcatggatctttattaattgtttgcagggcgaggattttttttgaatatctccacagttattaccctaatgtaacaaaaaaaacgtttcatcggaaaagtgtatgtgataatcatgcataattttacactgccaaggccgagatgtgtagttcagrtgtcacacaggatgctataaaacaaaaatgagatggcataggcatgttgtattcagatagttcagttcgcgtagttgtaaaccggtgcaatagtagttgtaaaccggtgcagtagcaaaatactaccttctgtggacatgagtttgagtttgtctttttagatttgcttttaagttaatcactattgactttgatctgttatacctgatattttataagattttacaatacaaatgtaaaattactagatttatcgtgacttgaactatcataatatatatatactaggtgagtgcccgtgcgttgcaacggaaacatataatatcataataatttatatataaaatgtgtcttatattgttatagtaagatgtccatcctaacgatacaacgaacccaactacaactatataatatcattttcctatatctatttctaattcatcatcattttttcgcagctaacaaacaaccgtatgcatggaatccggtccttaatagtgtctaggggacacgcatgggatacgccatatgcagcgtgagagagaaagaagctgctacctaggggctacggagggggcagcgctgcagtgacaagaggagcattgtcgcctctacaacggctacagtgttaacggagggagactccagtggtatgcgctgcaaatagcctaagtgcttcctcactgtgacttctgcagatgatggccacatgtgcttggctgcttgcaaataagcaaatggcaycgtgctttctgctgggctgaacacaccatatttcttcataagcatgattagttraatactgagttacttttcatgttgtaatttcagtttcaaggtttagtactaacctttccgttttcattgcagacatcttgatcatttctgagattaaactgatgatgctgatgctcgtttagttatcttggtttggagatatatcagat

SEQ ID NO: 6765 - DNA, 963 bp, Zea mays
ttcgtccgtgctgtatatatactccagaattacatttaaaattatgctctctattgtgcataattttagaataataaattatgcataagtttttagcactcttttagtcatagaagaaatcaattttaaaggtataaccacgtgttatcttattaaatgtcaaaagggttcaagtaaagctctctattgtccatggtttagtagaaaaacgtgtgccatcatttactgaaccaatcgacaaaagagatcacatggacgagtccaaagcttcacccaataacgatggacgtggatatgatgtgtactgtttacagggacaatgcttccgaatacagcgtcctattttttgatttagtgtgcccaaatgttttacaagaaacgatgcagaaacaagacattgatggatcagaattctggcttgggatcctttctccgcggagaaggcatcgcaattgcgcacagtgtaatcgtagtcgatcagctggggaaagggtcatcatttccatcgtcaaagagaccaaaaaaattttccaagatccaaagtcaagaacatgcggaaggaatgatgtgttgaagaggaaactgagtgttgttgtttcgatcagaacatctggcttaagatcccatctccgaggagacggaactcgaaaaatcgcacagtataatcaaagtcggtaatttggggaaaggatcatcacatcaaaaaacaacacccaataacgatgaagagctggacaataagagaaattttggctcagacatccaaggaaggattcaacagcacaagctctcgagcctggcaaggcgaaagctcttaggcggctactgcgaatgttgagaaacaagccttatctttcatcatcattgccataatatgaatgaagtatagatttaaaaaataagtacagatatcaaaaataagtaaaaataggcaaagcactaatcatatcatagtattgatga

SEQ ID NO: 6766 - DNA, 1225 bp, Zea mays
aaaatatatagaaagtgatttttatgttaataaccctctaaatgataatttagagagttaaatttaaaaatgatcttagatatactattaaggttacatcatgctcattgaatcaggttttttgtaacagtaagacaactcaaattactatagaattagtttggtcccgttagtagtatacaaaattgtaaaaatggacttagaaagtttgtgtggaaagcttcaaaagatacctcgtagacccgcttgactatcgcgaggagactactgactccctttgataggctctgttagctttaactttatctctgactgctctaggaaaataaattttttcttacttagctttaaaaagaacatcttgtttagttgaaaatgtggctcctgttacaactcctcatgcgatatgagctcaataaacagaaaaacatagaagaatagcccgtagaagccttttctttgctctaggctcctgttggttttttagatattctctccttttctagaaagagcctatcaaccattgttggtgtaattatgtttttctatgtcttgctaaacttggagaaaattgttaagccatcatcataaatgaatttgcatgtgttacctataaaatctcaatgatgattttggttagggcatcaattctaaatcatcttctcgctctcaagtcctaagacaaaacaataactataatttaattcgagcatatgagctcattttcaactcatattttagtattttggctaagatccagcataatatttgttttactagttcaatattttttatatgaatatatattcactttgacattaaatttatttattataggtatttttatatggatggtccattaagatttttaagtgtcgtttaatcactcaattaatattttcaaatgtagttaggtaccgtcataacgcataaatattagattagtatagacgtatagttcatttaaaatactgttttttattgttctacgttataaactgtaatgttagtagagttagagtttaaataagacgagctggagatagttttacacattggaacgcgaacgctctcggatccatccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggt

SEQ ID NO: 6767 - DNA, 1500 bp, Zea mays
agtcatgtatcccatgtcgccagggttagctagacccttagacactaccgaggtgaatggctagagatccactacgaggcctttacaaagttccactagcttccgaaaacccgctacagtttatgggaagagcacttgcaagagtcccccgtctgaccaccatcgcagcaaaatcaacccgagaacctccttgcttgcaataccctactgccctttgaaagggaaatgtgcctttgggccatttctaagtattttggtgattaagtgtcaacacaagtgcttaaatgtgaatctatgcccatggatgaacaaagtgcacatcacaagtaaaggtatgtttctaagccttagtacattggttttgtgtactaatatatttatctaagtgttagaaacagagagaagaagaaaaggagattgttggctgtgtacagccaacaggctgtttcggtctggggcaccggactgtccggtggtgcaccggacagtgtccggtgcgccaggctgcctcgacctgaagacgccgctctcaggaatttgccgacggcgtacggctaaaattcaccggactgtccggtgtgcaccggactgtccggtgagccaacggtcggccgcggaatctgcgcgcgacacgtggtctggccaacggtcggaaggaggcaccggactgtccggtgtgcaccggactgtccggtgcgccagatctgcaacggtcggcaacggtcggctgcgctgtttaaggaaataaatcgggcaccggacagtgtccggtgtgcaccggactgtccggtgcgcccgacgacagaaggcaaggatggccttccagatttgctctcaacggctcctagctgccttggggctataaaagggacccctaggcgcatggaggagaacaccaagcaaccttagagcattcttgatcatccacactcagtctttgcgcattcgtttgtcattctaagtgattcgagctccgttctagtgagaactttgagatagtcttttgagctcgattcttggccgtgtgtgtgcgcatttttgctgtggatttgtgtgtgttgcttccctcccttactccgtatttctttgtgaatctcaagtgtaagggcgagagactccaagttgtggagattcctcgcaaacgggatattgaaaggaaaagcataacactgtggtattcaagttgatcattggatcacttgagaggagttgagtgcaactctcgtccgttgggacgccacaacgtggagtaggcaagttttgtacttggccgaaccacgggataaatcactgtgtcttctctgtgttgaactccttgtgattatcatattgtgcaagatcttctctctagccacttggcattaactgtgctaacacttaatcaaagttttgtggcttaagttttgaagtttacaggatcacctattcaccccccctctaggtgctctcaattggtatcagagccgttctcttcaagaaagggactaaccgcccgaagag

SEQ ID NO: 6768 - DNA, 1500 bp, Zea mays
tccagggagaagttctccaaatctgttgcctattatttgctgaatgttgttggtgaatagcagaaataacatagaaaagaggttttgaatgttgacggtgaatctgctacctaggtttgagtggaactctttaattgttttcgtgcattttcyatcttctgttttgattatgcaccatcataaaagaacagaaccttgtgatctaactagatagaagaaatcctataatcttagtcacttcactagatagaagaaatcgtgtaatcttagtcacttcaggaatgtatgttgttattctccattactcctcccagggtccagcctctggccctcttctagatccttcgaacgatcagtgtgacacggcgttctctataaaccaagcaagatcaatcaggtatttctgttgattttgcatcattyctatcctatgcactttagatgccctcgctcacatatagtgcatgcttcaaccattgtgctatttcagatggaatgttacagctagcggctctccagtgatttaaatatattccactacccatgttttctttttaaaattcagacctaactactataaaatagaccttcctttttatgttataaaaatagccagaaaatgtattttagcctcttctgagtttgatattcggcatgtctggtctcactttgtaacccaaggscaaactgattagatgggctatcggagactgaatttttagttattttagtattttgaaggcgatccaatattgcgataactgacactttttccttgttcaaaaatagttttgttgtgggtacctaatggcctcgtctcgctcttcttgtttcggttgtgttatgctactagggaaggtgaccttcctctcatcatcgcgattgacttgcaaccaatggccctggtaggtgttatgcaggtgtagggcaacatcactaatgctcggacaacggatgtggtgagacggacgcaaaagaagtataggtttttgttgctgcagttagctggctgtgacttattagtatggatttggtgtcatgttattaggcatttcgatggatgcaaagcagaacttggttgtttgcgatggaggcttcggatagtaagatatcatatgagtgcaagagaactactctcaccattaactataacaaattttgtcaccagtgaggattacatgattactgctcttttgggtgactatagttactggccaccctgatatttgatacaattgatctttttttatctcatgctaaagaaatttggtggctggtggatctacttaagaatcaaaagtcagacaaggtggacatcaccatccaaccggaggagcaggaagccatgaatgatgttctagcagccaggtgacgcctgatgtctttgttcagttgatatagttgtctgattttttccttcttccaagttagaacggtctttcttgtacgtgtatttctacttcaccctcaacgaccgggtgctccgcgcgttcggcagcc

SEQ ID NO: 6769 - DNA, 98 bp, Zea mays
ggtatgcattacatactgctattcaagtgttcaatgaagaacctgctttagttctaatagtaaaaatttgttctatgctttcaagtgttgactaatac

SEQ ID NO: 6770 - DNA, 465 bp, Zea mays
tcataacggcattatctcaaatggatgggtccatcatatgacatatataaagtaaataatacagatggtgtagtcaatccagatgttagatctgtggctatgaatttgtgatcggaggcaaagaaagtgaaacgctgcaatgggtgcctctgtgtgtggcagctgctcactgattgagctgggggaagcctggaacttgacggtagcacaaccggctgctttgtgcatccgactggagaatgaaccgatttttgcatggcgcaatttttaaattgccgccgttttgcatggcggaatttttgcctctccgtttttttggtagcccgcgacccgcgttgctgagccgctcttttttttccccagtcacgcacgctgttgtcgtttctttttaaagcccccgttcagtatcttctgctctgcaggtttccggttgcaaactaaaccggcagcataacacactcacac

SEQ ID NO: 6771 - DNA, 508 bp, Zea mays
ggtacacagcaattatctatacaaacgactcaatttgtttgagttgtattgaggttgctgataatatatatgttgttcatttccatgtaatagttgtgcactaatagttgcaacgcactagcattgtactattatatataaactaccactataagttagtgtagcatatgtgtgggtgcttgttttcttagtagtggcaattagtttttcttttttgctaccatgttagtattttgtagttgattgtcaagtataaacctatctcttttgtttgtctaatcgttgtgaaataaacttgcgaccaaagtagatccacaagatcaaggacttccttctcatggcgaggaggaatgatgcccatttcgtgaagatcaagaggagcaaggatgttgtcaagttcaaggtgcgcccattgcaagtccaacctgttccccccaattcagcaccagcctttacgcatcgcaacagcgatatcgggaagaggaaactcgaaagcccggcgagcggt

SEQ ID NO: 6772 - DNA, 753 bp, Zea mays
ctgatattctgatgaagaaaaaatgactttactgactacgaaagaagaagaaaggagctatagagagagagaaaaagaggggtcgtgtagtgcttaaactgtacatgaacagcagtagtgttacagaagctaaactcaaccagagctccaccaaagacaaagagggtctacttccatcaccgtcttgctcggtcacttggagctctgtccataaattaaacccatcttggatcccaaggttcgtggcatatctgtaggcatctaccccgtcttcgtcgtccgctcctcactagctaccaagaggtcgccattattgccaacatagagtgtacgtggatgtctatatatatgcctacttgcacccatatggcataggcgttcgatccccttagcgcggaggagagctcctccggttcttctctacccttcgcatggaagttcttgcattgcttcgttgcttctctagtttcttccttctacgtctttccagcatacgcatgcccctcgtccgccggttcacgaggcatcgtctgatgatcagtagataataagcaatataatactgatctagaatcgagttgttgtactcttcgcagataggttcgttccttcacatagaagcgagtacagactacagaccacacagtatcagctggcacaaaacgaaaatggttacttgcaaattgcatgcacgagctagaattatattcttctaatcttcttcgttgactttctggcttcagcaggcgcgtg

SEQ ID NO: 6773 - DNA, 1500 bp, Zea mays
caagttatatattttttgttaattaattaatttatttatttaggcaatatttcaagtattaaatgcatacacatatatcatttatgttggggactttgtcattcttaaatgtatatctaaattttaaagtacattcaaaatttaatattaagtacttatctagtttaggagaagttaatataaaatctttattaaggttgaatttctcataaaagaatgttttatatagttcttgaaggggataatctaatctaataaatgaaattctttatttatttcatgaaacgcacaaacgaaatttatgtttctattttattttaactaatcattgttttaatattactatttattttaaaaagtgtgaattctaaagtataattattcatcagggacactttgctttgctttcttttactaatcccaaaatcaggattttggattactaatttatagctatcgttgagatctacatctttgtaattttgagattttttatttaagatagttaatatgctcaaaaaataatataaatattaataattgtatatgagagctgtcttttaagagaaaaatcatgcatttcttatatgacgtcagataaaggtataagcttataatttgcgctggaggcagaactatgcaatcttggtgagttaatagatgatatgtatagttgtcattttttttaaaaaaagttggcatttgaaggcttgtagtaacttaaaagttttttaatttatgcatataacaaaaggaatgtgttgagttacatgataataacttatacaatgacagtggtacaatagctatttagtctttagtttatggagcaatacaataagtttttctctcaacattactcttttccctttgcatcaataacattcctctacatgacagggtacgggacgacctatggtacagctgaaatgttataataatacacttgtcctggttttgtccaaagtcaaattgttttaactttgaccaagtttatacaatcagcacctgcaatatcaattaatacacttacaattatattccatagtgtacctgataaatcttatttggtattgtagatgtctatactttgctaactagatgagttcgacttcaaacaaaatttaaacaacttacagtttagaatgaacatatcagttataggcagacaagaactcaattatcaaatttcaatcatgatgccagtcttcataacaatacatatccacttccaaaattgtttacagacttgactgaaaccttgcagtctcatccagtgcttttgttgcttttgccgactaacccaactatttaccttctttcaatgactagaacagtaatagaaccctctatgcgtaccgctgaatctgagagttgtatcacatttttttagttgttatcttctgcacaataaatcatgaaaccgatagagatacggcagccgaacgtaacttcacgccatcatcaccccatttcatctctggagcggtagcgccggca

SEQ ID NO: 6774 - DNA, 821 bp, Zea mays
atgccgttcccagctccgtccgtccgctaggtaactggtaactgttgctgcgctggaaatggatggatcgtggtcgtggatgcgtcactcgggatttgctttcttttctttttttttcttgttcatctggattattggcatttactttcttcggtcgaaaatgaaaaatattcaggccgtgcttgttcgggtgcaaaaaacaaaaaaaccttgctgccatgcgaatggaaactgccttgagtatctccgcacctagatgtatatacagtatacggtatacatatgtacgtatttatgtgtatacggctagcaagctgtccaaaacacaacgcacaataatccagatcagactggagaagagtggatggggcgatgggcacatcacatggaccgcgcgcgtgggcggcacgtctggctgagcacgcaccggcacgggacaaacaacggcccgccggcccctctcctcggtattccgcgtcaggcgccgacacgccgtgccgccccgcttgcagacatcatggcaagcaatgcgacatgcgagactggagctcgcttgttcgtcttgccatcgtctcttttctttgggttttctacccgctacgcgtgtattggtcttggtcggaatcggaatacagctgctccagctcttcttcagtcccccaagcagtgatgagctgaggagccaggagtttgtcagtttcgcgcctaccaaccggtccagcctccgcgtccaagatctctccccctctcccatccactagtgtctcccacagcccgttcgatcccccggccgggtcggtggtcgccaaagtcgaggagca

SEQ ID NO: 6775 - DNA, 184 bp, Zea mays
cgtgaggagtcaaggtttggaaccaagtgcaaaatgtttctacagcatgcacgaacttttacatgagacgaagccctcgggtaaggaacaatatcataacaattttggttgctacagcttcgttgctcgttcaggctcaagctgcccagtgccaactttttggaagagatggcctggagactag

SEQ ID NO: 6776 - DNA, 356 bp, Zea mays
tctccgccccttgccggcgatggcaccggcgccggcagcggcctcttgatcctgctgcttctcctcgcctcctactggccccacagggcggattcgtctccctcgacgagctcaccgcctggaacctccagcagaccaaggctgaccagcatcgctcgcgccgtgacgaggattgtggccggctgtccggtctcgtgaatctgtgcctcgtcgtggatggatggctggatgagggcaggcaaatccggatccgttgcgctactcgcaaagtgcgtggaggcctcgccggccaccgtccgtggtcgtacgacagctgcgactcgccggccatcctgcttctcttctatctcgtcgcg

SEQ ID NO: 6777 - DNA, 947 bp, Zea mays
tgcagtgaggtggcgtgcaaggtgcctctcgtgcgacagttggggtggggccccggtggtccaagctggcacgctcgtgactcggtactcggtcgctggtagttagtggttacagcagttgccgtctttgtcgtcccgtggctcggcttcgcacggccgatcgagcgcccgagccgaacacccacggcttggcttgcctgccgttcggctcgagtggtgcagcgcagttaggcttctctgtctactgtggtagcgattagacagggtcacagggatgatatccaaagcatgatatcgaattgtttacaaattttcgagagcgttgttgttgttgggagtacgtgtgtgtacgtcagaggtgtcttcttcgtgcactagacgtacggacgggacacaatgatatatgcacgccactagtgatcagcttacacgtgtcgtctgttgccgggttaacatcaccgcattagtccattttttttcatcatcacccgccataaccactagtttcccccactaatcaccgaaccagcctcgggttaggcagcaaatcagctcgaaaccgagccgaaccaccacaaacttacgacgtggccccaccggtcatcctccttacctaaccctcgtggggctgggccgcctccgagtggaggagcagctgctgcaacggcagccatctcagagaagaaccatcaccactcaccactctcctgcttcgccgtcaccagcggagagaattgtctatttatagaacgtttgaaatggtaaataggcgcttcatccaaccacccggcggctcgtctcgtctcgctctcaccaactccggctccaggcgcctataagtaccctcgcccccgctctcgttcgtcccaggacaaacaccgcgcacgcaccgcctcctccactacttacccgaatcctaacgctattccactgcattctgctccgaa

SEQ ID NO: 6778 - DNA, 1500 bp, Zea mays
cagcccaacaatgaaggtcccagtcaagatcctggaggaatgctacagaactcagtccagtgtgccaacccagagcaggtttttgggtggcaagttcaacaactatgtggaggcttggtgctataaatagacccccatttggacctccacaacacatcaagcataccaagatcaagtactttactcctaagtatttgtgatacaccctaaagtgattcgagtgtctattctagtgagatagggttgtgcttctactatacgctcttgttgttggctttgtggtgttgttcttgtgatcttgtgtgtgttctcattctcccacttgttattctaagttgtaactctcaaactatgtacgatcataagagactccaagttgtggagatccttacaaaaggaaaaaagtaaaggaagatcgtgacactcaagttaatcattggatcacttgagaggagttgagtgcaacccttgtgtgttgggacactacaatgtggaataggcaagaatttgaggcttgatcgaaccacgagataaaatcgccttatcttgtgtgctttattgcgatttattcttcctctatctaagttgttaagttcacttgcgatattgctctaagtaattccatagacttgtgagagcaatcaagagaaagaacttttcttcttctcactctcttggatctagttttacactaacctttattttgtgatccaagtttgtgtttcagttgtgattttttagacgtcacctattcaccccctctaggtgactatcatccaccccaacaatcgtggtgggctccgacaagtgtggtaagtagaagcttgtactgttgtacaccaaagtcccctaccaaatcttatcagtggtatatccatgtaccaaaaaatacggcttaaagcaaatgatctattaatcctaactatcaatgttctcgttgttctaaactagttaggacttgatggcaaccgctacctcaacactacgaggtgtaacgttgcggcctgctatcttctcttatgacatgtttaattgacgagctaaaatttagctgggtgctaaaaaagctgactagctattagctgattttagcgaggctgaatcagctaataaactaatgggtatttgagggtgtagctaatagtttaactattagctacaggtgtttrgacatctacaactaatagttgaactgtttagatgtatctcttagctcttgtattaaacatggtctcattgtctcgtagcactgataaccggctattatataaataagaagaccgctcgttttagattaaagacaaccattcaaactgctacaactttaatttagaaagaaaaagtattatagaaatagtagaagacgtcacatatttttatgtagaatgtgaatctaaaaatccgaccgcaagataaacctatgccttctactactttgcctagtactgcctcacgcctacaactacgaccagtccatccaagccgcaccaagaccgagcc

SEQ ID NO: 6779 - DNA, 518 bp, Zea mays
ctagatatgctatatgtaaaatatgatatgattgtccgtgttagatttgtatttatataacaataccaacaagtcgtctacaagaacaataataaaaaactaggctagaaaggcatttagcttatatatatataatcaccatcataggattttctgtgaagagccggaccataacaaaaccaggaggagagccgagcgcgtggaaaatgatatccgtacgaaaagtgcacgtgctgccccacacgtcagcttgcgtaacagatcgggacccatcctccgcatgatatttgcatacaacccctctccaatttcgcaccgaccgaccgaagccccccgtcccccaacaaccaaaaaaagcccgcacgagacgagagacgagacccagacgtctcgccctcggcttcttcctcccctccctgaccgctgccgcgacctctcggcgaaaccctaacctaccttagaccccgccgccgccgccgcccaagggagagagagacttgcacatcaaagggcgtccg

SEQ ID NO: 6780 - DNA, 753 bp, Zea mays
gtttggaagcaacccagtttttaagaaaccaatttttatcttttagctaggagaggtcagattcttggtttttaataaactgataatctaatttctataaactgagtaataaattggtatatctggaaccacatcaatatctataaactagtttcttaaaaaccgagtgcttccaaaccgggcctgaatgtactagagctaatagttagctgctaaaattagttggatacatccaaacagtctagctaatagtttagctattaactacctttagtaaattagctaatatgtagctaatattttgttagctagttaattttactaacaattttttaaccaactagctattacctctagtgcattcaaacacccctaatagttagctagttatttgttagctagctaattttactagaatttttctagccaactaattattagctctagtgcattcaaacacccccttaataaactctgtttagttattatctgtgtaattacttatgtaactaaaatttatttaatatttttaacaagtgtcattagcttgttggtccaaaaaaaaaggtgtccatagcttgcccgtcgtggtcggtgtaatctggcccgaacttggccaggcgcccaggcccatacatcccttgcctctttctcctcccccgcatctgcttctttctctccacgccaacccgacaccgcgcggtcggctcggctcggccatccccgccagctcccgctcgagatcccagcgcc

SEQ ID NO: 6781 - DNA, 1285 bp, Zea mays
ggtacgtcatacgcgacgcgcgtgtcgtcgtcatcgcttgccggcgttaaatttgtttgtattatgtagtaatactctcgctcgctacgctaccctacgctaggtgcggctacggcgtgtcaagctcatgttcgagttcgactcgatcgttgccgagccaaataaataaatgaattatttgctaaaatccaactgtctgaattttagttttgattcaaacgatggttggttagtgatcatgctcgattcgatcgttgtcgagccgttgtagtcaggcaggcagtgtgtgtaaagatttgctaacgaatattgcttgaattcatcttaaaaaaagtttagacacctcccagttttcttagaaaatccaggggaaggaccgagcgaaagtgacgtgacatgagaaagtgattactagacatatatatacaccataagtatccagcaataagttaagatcctcctccatcaaatcaacaacaacaaaccaaccaacaagtacacttcaaatccagtctaaaggtctgaattgaatgttatctgcaaccagctgaactctgctttcctcctgccagtctgcctctgctccatctctcaagcagtgaccacatactattccatcaactggcatcaatgcatgcatcaacatccgcctatattaaacaagcaaactaaaaagaagcctttaagggactaatagtatctagtactacagaagataggtaggttgttctcagccacttctaaacaaatctgccatcagcatcctcaccggcatcacacacgcctacggcaaacacacatcgcaatcacaatcagctagataccacgacatcggcatcctcaccggcatcacacacgcctacggcatgccattccagcctcacaagtcacagctgcatcatccacctactacaaaactagacttctttgacaccttcattcaaggagcagcatgagaaatatatgacatataagacacaaatttgaatcacagagtttaacatcacaacatcacgctgccgttacagactatatatatccgcagatgcatgatcaaaccatatatatacacaacagcccccctttcaagcacatttattagaccttgaaagtaaaaaagaaaaaagaaagatgcactgccttgtagtcgtacaatgcattttatatcatacaggactcgatatacaaatcaaatcctgtggttttcagtaggcaacctctatcagaacacaacctgtcttcactcttgacagactgattgcaaacactatcgtcaaatagtcaa

SEQ ID NO: 6782 - DNA, 1114 bp, Zea mays
gaccgctagggcaccttcgatatacagcttgcttgccacatcaagcacggcgaccacctgccagagagagagaagatcatctccatccttcatcgtcatcgaccccgtaacccaaccgaaggcacgctgcccgggcacaggccaggtgttcggggcttcgggcgcccctccactccattctcaacacgcccccacgccgtacccaccacaatgtgacgggcgacctttccagagcgacgccgctgctcgctgttagccaaggaagccagacacccggccataccaattaccaaaaccactcatcaggtcgcgttgccagccgcacaaaccaagacagacccccctaatctctctggcatcgcggctcgtgctaagctaatcgaggcgcccccaaccacctctggccaagatctcgataaggactagcccatggtgagctgcgccgattttttaatacctgctagcttctgagattgttttgttgttattctacagctagctggtagcagaacaggtacttacctgacggaactgggttttgttttgtttagcttagcctttcatttgtcctcttcgcttctctggatcaacctgccaatggtgagcaccgctgtctctccctcttctcttcttcgcctcctcatttttcttttcctgcgaagcgtgcgcggttcttgctgaactatccggcctccttacgaatctatggccgccgatcatgatgagctgttttaccggactcttgatacagttctccatttctgtcgcttcatttttggccgtggccagggagcgggtagcaggccgtgattagctgctacaattcagttagtttgcctctttcctttagtagtccgctgatttgactgtagacgacgaatctgggttagttctaatgttggtgagaaacccatttcttttccggagaaatttcagggccccattcatgctgctccactccaatcgcatctttcttgattcggcgcgccaatcagcctcttcttttcataaattccaaccgctgtttctttccagcctaattttgtgcagtttttgagctcaactcctccacttttgctgcagcgcgtgtcaactggagtagttaagcggcgcc

SEQ ID NO: 6783 - DNA, 1500 bp, Zea mays
gacggaccgcgagccggagctctgcccggcaggtctcgcgcgctcaacaggcactcagggcagttcctccggcctactgcccggccgacacatgacatgagcgagccccgtagaaaaaagaacacgagtagccagccagccagcagtggccctcccgtgaaggaatgggcgggccagaccggccggcgacgttacgtgacaactggacctcgcaacgcgtggggccccattcgacgtagagtcgtagacgacagcgcgtacggcctgatagtgataggtcaacctgtacatgcatgctcctctcctcacatgtcccatactggcatatgccatgtggcagcaatcaagcaagctgcatcgtccagacgtccactcgcgcgtcgtcggagctccgatccggcggtctatctggcccgagatgccggccggcggatcggatggagcatgggacagcggcgccgcgcgcgccaggaggacgcgaggcttgacggcgtccgccctgcgacctggagcatgggcgcaggaggacgaggcgaggccgtgtgtggctggcgtgggaagcggcgcagctgatggcccgccccggaagcaacaccttccttcctctttccctcacgcaagcgcggcctgcgcctgcctacgtgccgctcccgctcccgctccgctttacccgacccgcccggggggccggggatcctctgcggccgtggtggccggccggcgtcaacgtccgctagtacacgcacgagtcgtgaaggccatcacgctacgctacgctacgcattgctcggtgacgttcttctcggcgactaactgcgagtcgtccacgaaagccacgtacttgctcgtggtacggttagttaccggcttcatttaagctaagcaccggcttcatcagcagtggtactatacgctgtatgtgcgcgctatccctctcattgctaggtcagtcgcacctactatctctctgctctcgcatacatatgtgctgcatgctgacgtaccatgacaccaccatagtccatagccatggccggccggcggtccctcgaccgtattcgtacggggtacgtacgtgcctacttctacctacgtacgcgcgcccagctgggccagtgtcgtcgtcgcagcgacggaagaggagcacgggggatagctaggctaggggccggaaaagacgcgtgatgcagcacatcaagcacgcgtacgacgccgcgcagtcgcgggtccgtcgtggtctcgctctcgcgtcctagcagccacagcccacaggtggcacggacacggtaataaagcgacgactgcgacgatccgtccaggtccaggtccaggtccaggtccggtacccatccatccgtcgcgggccggccgatccctttggcttttaatgcagcctttttgtcccttaaaaagcaaccaccagccgctcgatcccgccttggatcgatcggtcacgcttcctttccttgctcagctagcttgtgctcctaaagctttgtc

SEQ ID NO: 6784 - DNA, 302 bp, Zea mays
ctgcaggtggtgtggtggccgagtaggggagggtgagcgtggtgggcccgatctgattattttacgtggttttattccgccgtttaaaagcggggccgcggaccgccagtccgccacgccgtggctttcgctcgtctcgcctcgtctccacgcccctctcattcgcaccgctcccacccacatcctctttcgcctcccctcccactctctctctctctctctctctctctccgcacgcctccgcgtgggcttccgctcgggcggtggtccacctcgcccaggcacaggcagcgggacgcgac

SEQ ID NO: 6785 - DNA, 997 bp, Zea mays
tgttttttaaatgtttttgcttgctcatcgttatgtcacttaggactaaatgcaaatccatatagatcaaacacctagtagcactagataaccatattcgctaattagagctccggaagcactatgtttgtttttggtaattgagacaattagtagactaacctctactgtagtgttgtgattgagacaggttaagtccacaccaaggttgagtaaggatgccactcgtggaggttatgatggtgttcacaagtgatgatcaagtgctcaactatcgaaaaagaagaaaaaaccaaatacaaaatgtttgggatcaaagcaaaggtataaacttgggcattttgtttttctggacaagacacactagattgcgtgatcaggtttaggataaatagccatactcgttaatgcctcttgttgtcctggacccccaaatcatgcatcagatgggcatgaccggcacatggcctagtcaatgttgtcatgcagttttctagcgctgccacttcctgaaggtttctacgtacaagcaaagggccgatcgatgtattcatgacttggcatccaaagagaaatcacacggtatgatatgaactggactgacgcagatgaggagccagggacggggggtaaaaaatgaacggctgagatagcatatatgacgatgatccagacgagatgtttcaagtgtcaagtcaatcctgccgagccagacaaacggattgaccgagtcatagtttcaaattctcctcaaaagtcctgatcaaacaaggcatgcagctcgatggccactcttttccagcatccactataaatacgtgtagccaccgattcatctgcatcgccacaagctagcatcagagagcacattcttcactagtagctattcaaggatcagagttgagaagctgcgactgcgatacacatctctcactctttcaggcagccgcttcagaaactctagctaattaatacacagggatatatatagaattag

SEQ ID NO: 6786 - DNA, 1373 bp, Zea mays
ttttcatatggatatggatatgaaaaaatattcttaccatcatttggggatgagtggcacataaaatgccatgtcagttacaaatgtwaaattgacatcagtaaaactaacaaaaagttaaatgcccctatggatatccatacatgtatgaaaaatgatatgtgtaagtgaatggtggtagaggagtgtcgacagtaagagcttttggtgatggaaggagcattggtggttggattttcactgggaggatcatattttgtcaagatgaattaggcttttctaaaacgtcttgccacaattataaccctccattgaactcgcccttctacttgaattaggagaggggtgagaggggtattcacacagagcagaaagcttccatgcacttcggacccccaacccaggcttgaatggggcggaaaattcggtggatcagttgtccgctggcgcctacaacgctgacacgctgagccgtggtgctaaccagcggtgcccacactgatttcagtcgtttacgccgcatggaatggaatggcctggagcgggcgcagatccatgattgcggcgtgatgaacggcacgggacacatcggacaagaccccggacaaagctgatgcccgcgcggacagggaaaggcaccgtccggacctttacttgcccggatgaatgcgccggccagtttaaccatgcagttagtacaccaaccagtgttcttactgcgagagacagcgttacttgaagagtgaccatggccagggctctactctctatccatcctgtttccttgtgctgtcagaaaattcaaaaccaccaaagatctcatccccatcgcgattcgcgtcgtattggggaattaataaaactcctcaccaacgccaccacagacacacagtccccaaatgtacaacctgtaggggttgcagcgcggcgccggcgcgtcgggtcgtgcccatcacgttgcctccactccgtcgcctctcctctcctctccgtccctgcgccacgcgggggagattaaagcgaagcgcctccccgctcacctctcctctcgtcgtgcgttggatcaaagtatcaaaccaatctcccctcgccgtccggccggcgtgcgcgcggggcctctttttttggagccttgcgccgcggcccgttcctcctgtccgaaataatccgcctcgacgtgttcgcctccccctccccctccctctctcccctcccctcgcgactcgtctcgtgcgtgactgcgtgctcgctctccttttcgctgcgctcatctcggtatctgtgccagcgctcgcctctccccgccggcccgccctccttcctttccttgtctagccgaaggccgaagccactgcgcgcgcgtgcgtgcgacg

SEQ ID NO: 6787 - DNA, 609 bp, Zea mays
gaagtctgcagccaccgccccccgatcaggatgcactggaggctgactcgcgggcccctttggatttgtcaaaaggggcggcgccctatccaaaatttctgaactgctacctctactctttctcttctccaaaaggagcttggaagttggaacaacgaacggataagcagataagtatttttcttctttttgatttgaaaagtcaccgcgcctttcagcctttgcgctgcgcggccgctgcaggggcatgcccgcctttggaatcaggcccgtgggccgtaacgtgcgtggagccgtcgttgactagcctagtagccaggcacggcaagacccgggggagccggactcttggttgggcccgggccgactgccagcgccgacgtggcggcatccggccggtcggatcggtttgaaatttccccgaggagccgggcttcgctctctatataataccgacgagaggccgggcgtcttctacccatctccctctgctccgggcgcaccgtcaccggggtgaggctgtattgcgtcgacagcaacacctgctttcgctacgacgggagcaccagaggctaggatatattgcttcatcagtgacagggagccaag

SEQ ID NO: 6788 - DNA, 1500 bp, Zea mays
ttatctctaaaagatagaggcctttaatgtgattgcaaaaatggattgtgtttatgttgtttaccatttctctactgattctatcatgttttaagttctttatgccccatagtgtcttctgtgtttaatagatacattatgaaatgttcttcatggaacattaatgatggccaattgaagctagaggaaacatctcttacaaaatccatgcttgaaagtaccaaatctttcttacttgactgtggggctaaaatatatgtatgggttggatgtgattgatcattattctgtaagtaatgttattgtcaaactgtttccgtcgtcatgttcattatactggatattattgtttagcaacaaagttctcaattgagtaacggactactttatggttgtgaattgatttttttagttctagaacgacttacctcatcaagcacgacaacaagtcttccacccccaaaccctcacgccaccgccgcagctgtcttcgatctcccgtgcttcccttcaagagatcaaggtgtgtgtcctctccttctccaagcagtctccatccccacgcagtcgctgatctgttgcttatccatcctcgcgcatctgcctgattattcggcaagggctcccgtcgttttgtttgttgctacctgaggacacatcgttttgtttgctgctacctgctaacatatcaactagcatgattttgagcctatctaaatgcccttcagattcttgaaattatatttaaaaaatccttatcatcgcctccaaacttgactgacccacgccagtgacgcttgctgtcaaagggtgactgacccatttttactacacartcaggtgctttctctaatcaaaatagactcacttgcatcaaagttggctccatatgaggctaatacatcagcaactaaattagaagccctatggcatttagagattttacagcaagagaaatcaaagttgattcttgatgtttgctaatagctctattttatgtatccaactattacttaaatggaaaatcttcagccaaataaataaattttccctacaatcacctgtccgagaacaattggcattttacgctaaataggtcaaaacttaatcaataagaagtatgtgaatcataatgtaactctgttatatgtagcatagattgtttagaaaaagtttcaggcaacggcatatctgtatctctttttgtaaagcaaatgttttttatggcaaaaaatgcgaagcacaatgtttggaatcctaaatatgcaattgtctcttgtttctccgcctcgttgttaatccatcaattgttctcagcctagaatatcttcatcggtatttaccaatttactcacgatactctgaagcgtatacatatgccatatgggaaatgacttcatagctgtgggttgtcttatggctccttgaatttgcagtagtctgcctgtacctattggctgaagcagagctgacccccactttatcaagagttgctcaaca

SEQ ID NO: 6789 - DNA, 1168 bp, Zea mays
agtaaacatggttgttagtgagaccgtagaagtaacattggggtatgctaatcttttacctactgttgtttcagtgtgtcaaccagtgtcatcttatacatcaaagcaccatatactggacatgcatccaaattcttgcacttctggccatggtatatattgacgcaagtattaattaggatacttctggccatggtatatactgcatccaatcaccaaacggccgggattaaaaggcctctctagactttgcctgtggagctaacctttagatttgggactaagggggtgtttggttagagggactaaagattagtctctagtttttagtcccatttagtcttttttttttgccaaacactaggactaaaatatggactaaaatgatttagtctttagtccttcacataggtgctaaaagggactaaaccatattaattccacatttatccctcgtttagttcaattgtactaatagcaggataatgttaaaggtcattttagtcttcttatgagtcatttagtatattcttactatttttagcctctagaaccaaacatgttagagactaaactttagtcccctaactaaactttagtccctagactaaagaaaccaaatatggccttagtttggtatgctactcatattaggaaactatcatttacttgtctgattttggatactaagtttgttgcttagtttggtatattactcatattagaaaattagtctttacgtgtttggttgattgtaggacccgtaaattattttgaatgtaatcttttatttaagcaaaagaatataacttacaaaaggttgttaaactttgcagcaccatgttcgttttgttctcccaacgccccaacccaagcacccatcgtcgtgcgcggcgcggcgctgcagggcaagccagtccgccagtaggccacgtcgcgttcgcccgcgcgcctctcgtgagtcgtgacaggcagcccgcgcaccgcgccgcgcgtctctcgtcttctctctcatgaaagggcaagtgtcgagcagcggccgggcgcacgcacgcaccccacgaaaccacaggcttgtcacgggagatcgatgccaaagcaatagctagccggagcgaaagaaagcggacaccgcgattatattactgcggagcggcagggcagcagc

SEQ ID NO: 6790 - DNA, 1500 bp, Zea mays
ccagtcccgaccgcccgcctggcccttggccgcgccccctgcgcatggccggttcaaccgcccccctctgttttttttattttttttattttattttatttactttctgtgatcataattaccttattttgggtagactaatcatggttcatgctatggaaatgagaagtttaatttagaatttcgttgcgctagttgattcatttagttaattgtttatcccgtgcaatgttaatcaacttaaaatgattaggttcccactagtgcatataacagaattcttttgttaggaacctattgaaactagagtgcataatttaactaatcattagtgcataaactttaacccccctgcgagacccttttcccgtttctttctaaccataacaaatgcaatgtcaaatgtcatacttgatgcatattcgctttatttgttcccttgtatggtgtactgttcttttgtattaaatatgtggatggatgtatgtatgtttgcgctcgcatagagaacgatccggtcgaagagcccgaggaattcgcaggagaagcccctgagcagcagtcggttggtggaggcaagtgtcctttgacctatctctgtcctaatcattctttaattcacctcccgcatcacacatttatacctaaggattgactagctttttgttatccatgtccttgtttacctatttgggtcggattattactgcttagtttgatgctattgctcaactttaatcaatgaacatgatgtggttatctatgatacgctgttttcccgttcttatttatgattatacttgtggcatttaaggggactcgagcggtttctcgagtgcctctccgtaaggacctgttcaatggatgaccgcccgggaaaacagtgcaaccatgagggtggagtgggacgcccttagctgaataattagaggaaccggggtgtagttcgcttagccgttgtgccgtcaatggggctcggtgtatgcggctcgctctgccaaggttgatttgtcccttggggaggagtgcggtgcatttaggaaacctaacgggtggctacagccccggggaatctttgtaaaggcttcgtagtgaatccttggccattcacctcgggagtgaataagggtcttgcaagcccgggccagagagggaatcacggcttgtgggtaaagtgcacaacctctgcagagtgttatgaaactgatatatcagccgtgctcgcggttatgagcggccaagggagctccagagattagtgatacttgatcagagatattttggtacaggtggcaatgagattgatggttctggttatgactatggtgctggtaagtggtattctttccgtttggaaagggtacatcgggttaataacttgggtaatgctaaaacttggctttctactagtaaataataatctgaccaactaaaagcaactgcttgacttatccccacataaagctagtccactacagccaaacaggatacttgctgagt

SEQ ID NO: 6791 - DNA, 222 bp, Zea mays
ggtacggtaaatgattatgacagtgtgccagtgtgccacaccactccttaattttagttcccacacaatgctgcagatcaatgccagttcttagatcttcttcttttttttttaaaaaaaagcaagaacacaaaggttgttccttttccggattcactcactgttccatgcattggaagttcaaggacaacatggcgtaggtaggttctagctctgaatggc

SEQ ID NO: 6792 - DNA, 685 bp, Zea mays
gcctatatcgttgatttgtgtccttttggagatttttggacacagttaatcatagttcagggatagggatggttccattgtggtaccagagttgcattttgagaaggaattctcaagtttgaattgtcaaaaccatgtgaagcattttttattcatgatcccagctccaacgatcatgcacaaatgtttttttctcaatcgtaaaggctttatcttgagaacttggtattgcctatagctagtcattgtagatatatttacccttccagtaaaacatgaataatgcatagttatcacacactatctaaaattcaagtcttcatccattttccaccaattgtgatgcactagaaggctagaaccatgaaaatggctcctatcatgttgactcagtcatcatttatcctagcttcatgcccaatgtattgtttaatccactgatatgcaccagtttgcctctttttttcttttccttttcattttgcaagggatgatgacatgatggattgatggtcttgttactaatctggctactgaattcttttatcctataaaattatgttttgttatgcttttgcatgtaactatatgtatgctggtatatttgcatcgtttgcataatgccctgatatgttaaaaatgtagataagggtgcatctaaagcaagctggttatccaatagcta

SEQ ID NO: 6793 - DNA, 962 bp, Zea mays
gttagaggtgaccttcggttgcacaatgcttcccaagtgcttttgttgaaggtgattgcctgtgtgttctgcagtaaagttccacgcgctcccagctcatctcttacagtcttatgatcagagcccaaaccctagatgactacttagactctgtttgatcctcgcggctaacaattagccaacaaataattagttagcaacaattagtaaaagtatgtttagagtctttgctaatagatgtactttctctttacacgatctattcgcaatataaatgattaatggataaacagtttgacaaccgtttggctagctatttattagcgagtgtttcgaagccaaaatgctaaaattagtcagtaaagtgttttaggtgggactatagtataggagcgaccgagcagcatcgatgtggtcaaaggtagtagccgcatagaggcatacagacgaatggaaattgatctatttttcttaatcgcaagcctgatggtacccctcgttgtctttaccggagtggtttggagtatattagctagagcccagagtctgggagttccgtgtggcgtggcgtggggtaggcgaagcagaacaggcggcacaaaaaagcgcaggcccgaccccaacgcagcgggatcgcacgggcaccagagtaccagaccgccacctacccaagcggccggcggggcgctgcatgcacagtgcagaccattgttttttttttctccttttaatttcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatcc

SEQ ID NO: 6794 - DNA, 1423 bp, Zea mays
tactaagtctggaaacataccttgttatatgatttgcacttcttgcttgtttggcacatagcaacttacttactatgtgttggacacttaatcaccaaaacattatagaaatggcccacgtgcacattttcctttcactaatcgttgtcctgtagaacttgcctttcaacttctgtggcactctcttgtcacataggactcccgatgcttgacgccatttcatccaccccgctttgattctatggctaacataactctctctcatagcttcatagtgtggttcatgagcttaatccctcgatagttggtataactttgaatatctcccttgttcatgagctaaataaaatcatagtaaaaaattacaaggagacgaataagaaattagggatcaaggtccaaggaagaagactagataagataggcacaaagctagcgatacatatcagcttgtcaacctccttggaggcttggccttggctggccatctaggcgatcacgacttactccataaggggtgtcctatatgcataagatgataatgtccaagatagcatcataactccctgcaagaagacgagatatgggataatggaaatgatgagtgtatgttgcacactaaatttggactagccacaaggtagtttggattggtgagagggccttccggttgtggggggcctaagcggccgtatatgctacacaccctcatggctagccctgactgagatcagctgacgtttgcaacgtagtcagtgactttgctctccatggtggtgaaggcccccacctccgacgtgatggagcagttataaaactgtgtgcatagatgttgcacaagaacaaaattaaaggagtcatttcatatagtaagaggtatatatatgaaggcttaagttacaacatcgatatttcaaaagaaattggtgaagatatggatgtattttagagccagtatagtatttctcacaaatcatcaaggtaaaagaaccattttgatgaataaaatgatcaaaacgaagaaaaggcgccatcaattatagagtcattcagatcaagttaattattttcttgtatgattgataggtcacttgcttcattgaatagtcgatttgaacgattatagaatccttgagagtttcttgcatgattgatatgtcacttgcttcattgaatagtcgaatggtgatgtgtgaaatcctatttgattccttaataaactaagaatgactatctatcgggattcccgtgcaagtgccggagcaggatgacgatcgggtaggtaggactcgtggaccgaaatgaagccatctctgagtgtgtcgtggtaggctgagcaggcagccggcactcccgttgcatgcgatgcgtcggtatcaaaagcaaagcgcccaacattcacaagctcacaaggaaactgcaa

SEQ ID NO: 6795 - DNA, 793 bp, Zea mays
ggatgactaatttaccatgcttgtgaagaactaaccctaatttgaatgaacaacagccctgtacccaatgcagcaaaataagagagaacgaaaatcagttacttgtgattcgaccgtggagtcatcttcaacaaatcttcgatacttcacagcagagacggccaggttaaccttatctgctgcaatagtggcagattcaacagccgcacgtgcctccttctcagcaaccaacgccgcacatctggcctccgcagctgcaacaaccgcagcacgagtagcatcaacagcttctgcaacagcgacgaccggagcagttcaatccatctctgggatttgagtgaggcacctagggtgccgcggttagggttgcgcagcaagaggaaagaacggcggcggctagggtgcgtgtctggtagcgagaatagggagaagggtaatagatgtagagacgacgtgagtatcattagtttaatcctcgatgttacctgataatagagtagtcatgtctattttagagtgtgagttgtcctatagttttttataacggagaatctctctcctaatcctccaattcgtcgaagccggacttgcaaatttctcccggttcgtcgggtgctgtccgtccctttgtcggtggtcgttgttcccaaccaaaatttccaccccttcgtcagccccttgaccaccgttccaaccctctcccatcgcgtcgcctcgaaggaagcgcggctgatcctgctccaagcctccaaccctagcttccccgctccccaccttcctccgtccggggctc

SEQ ID NO: 6796 - DNA, 819 bp, Zea mays
gctcgcattgggtttacgttattgctcgtcctgtccaacatttctcagtctactggaccttttggggttgatatttcaaaaaaaaaattgaacgaactgcataagatagtgcacattactattaaaacagaagagtatgaacaaaggttcctagggtgctccacaaaaagggcaaacaaaaggttgatatttcacatttgagttctttgttggaaaagaagatactagtgtttttttcctggcttccagttgcctggggaaactctgtcttttcaggatctactagtatccggcatttccatgagttcttcagtttgtcgtttgggtttcaaagctttgcgttattcttcctagcttcaaaaaaaaacgaaaaacctaacatcgtcggctagttttgtcacacagttcattggcatcacgtggcggctcatcctatatttttgtctatctctaatttcgacaccactgtatccgyactgagaatttgtcgccattaggaccattaaagctgtgctttctaaaaaaaattactacagtacatactatgtgtaaataacatggtagggtactacccctgcaataatgaagccgtgcaatgcttaaatgcagttttttaagtcagaattaccgagcctacaggcaaacgattattaatcttggagccctcaagttaattgttttcctgtttcttacttttcattcattttgtttactccaaatcacaacattgctaagctaaaatcgtactgactcactgcattttcttttcaggacaaagggagcaaaaaaaaacgaacaccttcctgagcttaagacagc

SEQ ID NO: 6797 - DNA, 1500 bp, Zea mays
aacaattgccaaaatcaaacaatatccttttagtggatccaaacaactcatactaataataactttttaggccatctaaacgtatgaactaaatttagatcggcacaactagtcgttatatctaaataatctagtactaaactttagtcgtctaaattttaataacttgttgtttagtaaaacaaatagttggttcagatgatgcaaatatgctcttatagtatgtagattacctatcatcctcagagtttatacaggtggtcttctaatgtcgctagtatagttttttccttctccacttaaatgcctacatttgagggggagatgaactagttttcgacgataggatgagtaagttattggagcaaccgcaatccctcgtatgacaactttttattagtgacatgataagtaatatgttaaagatgctcttagcttcctagagcatgtcaagtctttttctaaactcaacctccttctagaccattatttgaagagtcattcaaaaaatgttctttatatctttctaacaacttttttataccaatgtgctagagtatcctcgcccctctttatctttatttatgaaataaattgttaggagccttttttaaattattttttgtattttctatcattatggaaggccctctttgtttccttctagaattatatggattatataagcaccaaatgacatgtctatgaattatcataatctaggtatctagattatatttaatccacttaataatatgtgttgtttatttatctcttaacttatttaagctggattatataatttagagggtaaaaaaatggagccgaagaatagttgtttttagctaggtaactttattactggtattggtggattcgaatagaaccttagcacagtcaaacaaattgatttatagcattcttaatcaaaactaggcaaagacttatacatgtagtcgaaatagtctcgtatgagaggtaccgtggcttggtgcgcctagcaaatccatctttattgtttcgaatgcgcatagtcgcgctgcggcctgcggaactcgtcgccgacaacaccttcactagtagagccgcgtccccgcccgcgtccggtcctccgccgccaccactcacctcccttctgacccaaccggcgccctccccctcggccctcgcgttccacgaccacgagccgtgctctcgcgtgcgcgtcgcgtcgcactcgcatcacgaattcacgattcagccagcaacgcatcaccccttcccacccccacagggaccaggcctccaccacccaccttacccaggccataccccccgccccgaccgggggtctcctatcctcctgccctcaccgcgggtgcccgcaccgcgcggcgacgcctccccttcaaatctcccaggagctaggggcctcggccaccaccaccgcaccgcaccgtctcggacgcggctgcagctccgagcattggattccgaccaactgaccgagcggcgtgtcag

SEQ ID NO: 6798 - DNA, 50 bp, Zea mays
ggtgcgtatcgatcttcttcactcaactcgagtcgagcgccgcaaacttg

SEQ ID NO: 6799 - DNA, 693 bp, Zea mays
gaggatgagatggagcaagcggtgaatagcctctcttatttctccctctccagtcccgctgcaaagagccacagactgctgagtcggtgagctgtctatgttgtatccttctggtacaggtgaggagggtgagagttctgggggtggtgaagtaccctcagtgtcaccactaccacaatcacctgtgacccctcaaaattcaagaactcaacctatactttcaggatcttcatcagaaattacattttgttcagcaaagtggtgactgatcattgttgtgtacaggtgcgggagatgccaaatgttttaattcttccgcggagtgcagactacagtgaagaagtgtggatggaaataagagagaaagcaataactatgttacagtcctttttcttcgatggtgttcttccaagtagtgcaatttctgatgaagatgaggaaataagtgaagctaaaaatgaagatgactatctaggcccacaagcaaaggccagtcacagatttttgatgctgaaatagatgaaagccacataacgctggagtctgaaaagaaaagagccatatcccaccataaagagcctcaggcgtctggaaagtctgtaaacattggctcccgatctgaagggaggcgtagtcgttctggaaagaaagggaaaaagaggcctgcccatcgcagacctcaacagaaaccag

SEQ ID NO: 6800 - DNA, 100 bp, Zea mays
ggtcaggacggcatgcccaagctgccccccggcttcgagaaccttctcaagaagaaataacagaacactgtaactgcattaaaacgaaggactaactacc

SEQ ID NO: 6801 - DNA, 166 bp, Zea mays
tttcagatcagggttttgtttcgatctgtagtagatcgagaagctagcttgcatgatccgagcaagaaatgatgcttattcttcttcctcgtgttgtgttgccttgctaatgagtgagagtcacatatagcagggagcgcagctggaaccaagcggctaaggatcg

SEQ ID NO: 6802 - DNA, 159 bp, Zea mays
ttaacgacgagaaatgatgaaagaatcttataattctatggttatgcccaattcgtcggttccagggaaaagtgccctaagctaagatcgaaagagtatttaacgaatggtttttagaactttaagctcgacgctatttcgttgaagatcgagctcgcc

SEQ ID NO: 6803 - DNA, 310 bp, Zea mays
gtactataattgatgaaaatwggagtatctgcgcagctcatgtgatccccacgtgctgccacctcagcggcaccccttccgaattccgatcgtctccgcgaacaaaaccgctcgcacctgtgtccggccagccatcgtcattggtttcgcgcactctcgctcctgctcccggttttgtcgctccccactctctcctccagacctctaccaccaccccacaccgccgcacgcccacacgcaaccacgaaacggaagttttcctcgccttgcctgccctctcgatccgatcgggacccaaccctagcccgga

SEQ ID NO: 6804 - DNA, 1500 bp, Zea mays
gcatccagactcagttcaccccccaaccaagccaagaacccaacgatagatgcatgcacctgcagctccccgctcatgctggcaaatccttcttgttcctgcgccgtactaccgcatgtatgtacagtacaggcggcggggtgaccgaaggcgcgcagaggacgaagacaacgtggcacgcgcggcggtgtgggatctcgagggcagacgagggggggagggaggaccggaggaggaagcagaggcacactcggctctgtcgctaggcttttaaatagcaaatgtatgtcccgggtagggtagggtagggatggggcgcggtggcggccacaagcgagatggcgacgaggagaccgaagaagaggaaggtttggctgggaccggaccgaagaagatggtgacgataaggcggtcggctcacggcgtggaatccctgaggccttgttcgtttctgtcggattggtgggtcggaacgattcctgaccggattacttctctaatttatataaactttgattagctgaaacgattccgggtgcaatccgacggaaacgaacaaggcctaaatagggagatgcaagcaagccggcggtgtcaccgaactatccaagaaagacatgtcccttggtcgtgagatgcgcttccgttccgtaccacgcgttttcaatccggagaggagaggtgccgcagctcaacccctctacggcaggaccgttcagaatttttctccaaggaagggagcacaaaggcagcaagcagactaggagagaacaagtttaaaaaacaccgcaattaaccagctcaccctggctaacccaccaccaccaccaccataccaggagagagaaaagagagaggcgcctccactcgtgactcgtgagtcgtgagtagtgactcgtctggtctcccctctctcgtccgtctggtcctcccgtccagaggcgttctctctccctccccctttcctctggtcatcgcacccgtctccccgctctgactccgcccgcgccgccgactcccggcacggccccaggcttcatctccgccgccgcgccgcctcgctccgatcgacccccgaaacgccggaaaccgtgggcttcgcraggtgcaatttcttgggccgcgtctgagcttgattcagtttctggaagcggcctgagcttgggatttgatccgggtagggttctggtgtaggtttttggttggtaccttgcgattgatttggtttctaggttcctctggcgaagaaagatggtccgattttgcgcgtttttttttttttcgttttccccctttgtttctctggggcggaccggggcttgatgatttgttggagagcgtgcagctttcgtgttacagctgcttgcagttcctagaatttagctcttaattctgacgcactcttgctgtgcaggttgcctctcttcgtccaagcggtagataacataacagtgcgacaggtgaattgcagagagaaggggggcatttggtcgctgtatg

SEQ ID NO: 6805 - DNA, 1500 bp, Zea mays
tcgtggccagccaaccagcaaccgcaaccggcggtgctggtgcaggcccgggcggggccccccaacgactcccgctcggcggctcgggtcagtcagtcagcaacgaacaacacatctttgcactgggcagcgtgggaactgccgttctccgccccgcccgcattatcttatcaaaccgacgctggacttgcaggaaaggaaaggcgctacaactttcctctgggcagtttgtttgaccggggaatggaatggggatggatggacgtggacggacggacgcagagtgggaaaacggatgaagaaggacgaggacacgcaggaggaggaagaccacgactgcactggccgctggcggtggaggtgggaccggtcgagcaacggcaggccgcgcgtgaatgatgagttgcttgcgtcagagcaccaccaaccatcgtaccctgccaccacggcccaccgggcccctggcgtgagtgggaaccgggtgggtgttgggcccgccgcgtcagaagcaccaaccgagccatggttcacgggctgcgggctgcgggctgcgggctgcggcggccgacgggaccggtgtgagcaggcgaccacgaaggggcccacccgtcggtggctgcctgcccccgctcgtcaacaactaccccgaaagccgccaagcggctgctgcgcaaggtgcgaaaggcaccttccctgcccgattggcgatttaagtggtgggggagggaaggccgatggtcagtgaaagagaggtaggtggccggacggtggtggcatcgccaattcaactccgcatctgaatcggcactcggcagcgcgccagctccataggtgaggcttcggatcccgatctccgcaccctgtccgattccagctccgtcctccccggatttcagttccaccgcgttgaggttttctttttttgtctcctttgggtcctcttgttcccgaagcatggggactgggggttgaattcgtgtagagatccagatgattgcgctgctagctccgatcgccgattttactctgctgcctgccggtccagatccatggaagcaagtcgatgaacttagagggcttccgctctggattttctttgaaaataagttagagtcctgtcaaacacctcttttctctgccaaacgatctacaaaatggctttagcttagaaaactgtttagttagaaaactgtttagcttagaaaactgtttactcggccaggggacagagagacgcattaccttgccttcttgctcttttcgcctctagcggtgctgtgtattcagttacttcgtctcaaagaaattcagttggtttcatcctatacacctatatgtagccggccctgtgactcgcagggcagcgtatgatctttgatcctcggcttatgtattcacctcatcggccgcttaaccttggtacatgaaaatagattttgtttccagggtcctgctcggcttatgtatgaaatagatttttttttctcagtgtaggaggag

SEQ ID NO: 6806 - DNA, 552 bp, Zea mays
ggtaaggaagagcaaaaagccaacaacttagctaatgtcatagatgaaggaccacttgtaccacctataactgtaggtcccaaaccatcatcttacctccttgtcagctatattttcctatattgatgaacatcgggttgtccagaaatgttagagagaagaacaagaactgataattactgcaaaaactgagggtttgtccggttgtccctgggtctcacttgtgactggcctttgtgtgcagtcttatgattttatctctgtaaaagtggcagaaccagtttatggtttagctctttcaccctaccttttcttggaggtgtttccctattattttacagcgaatggaagttctgtttcgtcatcttctatgttgctgtatatttacagaatagtttcataataatttagtgaatttcgttctaactgttttctttccctaagtgcaggcaagtcagctgaattattggttccgagggctctgtagttgcttctccacactttcctatgcttttgcattaatcttgacaactgagtactcaaagctgggat

SEQ ID NO: 6807 - DNA, 775 bp, Zea mays
ccttaggtgcattgataaaggttcaacctccctctgtgcctgcctgataggtactagccctgcttctaatttgggctccactggtttgccatcatgcatgcttgtgaatttgtgatttgtaaatgtgtgcctctgttaatggttgtttaaggtgagtatgggtacgatggctataatgggttcatgtgacacagatagtcgcacataaaccacttggctttgcatttactgattgtgacgacaggagggatgttgaggatgctattcatgatcatctagatcattttttggcagtgtctttcggttgaacttgtttgaagccctgcccaacctggacattttttagtttaggtctaaaaagagaaaccctagggttgtttgaaagggcttgtttctaggcttggcatttttgggtcagtgaagcagttagtatggttgtggatttgcatttgctactcggcattaggtcttattttttgccagcactaactcaaattgtattgctgaaacttaagtgttgcttatatattccgttggtaacggatactattctgcttcaattcccttctacattgcagattcgctacaggcttggctcttggctagccaagcctgcagtttaggactttgccaaaactgcatttgccatttaacaggcttctctaattctttttttctaattacttggtacaaagcagttttaaattaactaatctgcctgaaggagctgtaaccctcgtcacctctccaagacacagtagtccttcaccagctc

SEQ ID NO: 6808 - DNA, 219 bp, Zea mays
ggtataagcagaagtgcgtagtttcagaagctatccttcatccctactaaatatttactgcatacttaccttcaggaaggtcaaggaagcctgggaaactaaacgtgaagcgcttgagcggacgggaaatcttgttatcgaacaattaagggacgcattatctgctaaggctagctctcaagatgtgccaaatgacctagcagttgtctctgttgatca

SEQ ID NO: 6809 - DNA, 1500 bp, Zea mays
gtgtatgtttctcatctagattatttaggctagatcataaatttaaaataagttattggacatattataatccaaacaaattaacatgtccataatatgacacgttagaaacaaattcttcccctagaagagcctctgtaggggccgggttcttatcgaaaaaaaaggcccgtcgatttagctagcagtccctatttgctcgtaagctgtaaaaaacagaagccaaaatggctggcgcgcgcggcgccatcaagttcatatcaaattcactgatccgattgaggtctctcgataaataagaaacaaaacgaaagcattcataatccatgtgtttggttgtcttccctatagatgcaactgtatctgcatatacaaaatatagtgtttgtttggttggctgtattgcaagagacaggctagcacgaactttaaagcgccgcgagccaggcccggcgggaacgctccgcgcggtcgcacgcgcgcggccaggcttgggcgagtctgctgtttactcgtgcacgcaaatcgagatgttggttttattggtttttttgttatatcctgtaattaaaagatttaattaccgaaccgattacatatctgtgtttctgatatttttacgaacgaaactagaccacacatgctatgtatattttaaataaaaaaattacgtgattaagattagtatataattagtgtttattaacatgtagttagtgtctattaaataattttaacatataattactgtctactaatataattttcatttatttaataacatttttaactcatacaacaaatattcataccagcaaccaaacaacatctctcataaaacagactgattgcatgcagacaaccaaacacaagaagttgaatgtgtctagtcagagccaggctcactagatacgaaacaggctcagccaaccagtcaaccaaacaggcccaatatgtgcaaacacacgaacacggctgtgtagagtttgttgccggaaaacaaacatgtacaacagcacaaatggttaattcaaaataaacatgctagatcattaaacaaattatcattaaagagaccagtccataaacaaagatgctcgtaacctgctaggttatttaggctagatcattaattcaaaataaacatgtccatgcaaacaaacatgtacaacagcacaaatggtttgttacccatcccgtcggtttagctagtagtctctctatttgctcgtaaaccgtaaaaaaaaacacaagacaaaatcaaaatggctggcgcgcgcgcggcgccatcaaattcatatcaaattacttgtgctaataagcattattcgaatcaaattactcgtgccatcattattttagtatatatatatgtatgtacgtatgagatccatccatctatcgcttgtgttaattatattgtatcctccctgcctccgtcccaatcttcctccctccctccgcttcgccaaaccctagttactcgcaagtcgcaagaca

SEQ ID NO: 6810 - DNA, 1500 bp, Zea mays
cattacaagcctgacgtcccactaacaccagcccttccctctgtcagagaggcgagtgacacagggccggacaaggcgcacaaccaaactactgggattacattttttttaaatgttggacagcagacagacttcaaaaaagagggcttgactttcccaagaattgtgtcctttgtgataagaagaaactgtgcagcatatcttaactaactatgtctttgcaaggcggttatggcatgctaccttatcccaaattggccttactgctgtggtacctaagagaagagatgtctactttgttgactggtggaggaaagcttctttaaaaattcccaaaggcaaaataaaaggattccatagtgctgtcatccttggagcgtggagctttggaagcttagaaataggtgtgctttttatgagactcgaccttgccttcaatccctagaggaggggttcagagaagagtggcagctatgggttttgagggttcaatagtgctatcatccttggagcgtggagcctttggaagcataaaaataggtgtggagaaaaatacttggattacattgagcaggaatagtcatacatacatatacttagggtggtaatgggctctaaattttagagtatataaaacttatggatcaaatcagattagaagagtcgggctctattcctatttatttttaaactaataaaatttattaaaagtcataagaaacatttggatcgtgccacccctacgcatacttgacgcactatcataagcatagattggtgaatggtgcgtgataattactaagcaagcaaagcaatcttacgtatatatgaagctgcaatagataccaacacagtcatagtacttgaaaagtcatatgaagccgagatacacgggttatatacgagaaattatatatatatatatatatataagtttataatatgctatatactattgaaagcacatagcgatgaagcaacaaaaatctacagctacatgtgagaacgcaagaaagtagtgctctttttatacacgtcagttgccctcgcagagcatgaagaatcttggggaaagagaggagggaagtaccaacctccgaagtcctatttttccaaggaaaaatgaactaattttccttggaaaaatgaaaatcatttggaaaatggggttcccaaactagcgctaagagtagtaggatttttctgccctttataagagaaaaaactaaatttgcatcccttaactctatcatggacatatttactaaacataaataaagtgggaaaactctctatgaagcaacataactatttcattagatgcttacagattcatggaagtgtgagtgtacatggaaagtaaggaggagatgttcaagcatcatgccatgagaaaaccaaaacctgattctgtcccatggaaaaagagaagacaaaatatatcttctgaggatcaagcacttatctcatcagcggtagcaagcttaaataatttctctg

SEQ ID NO: 6811 - DNA, 1500 bp, Zea mays
aacagaagcctcgcacaccagctgccagcggcaaggacgaaactttgcgataaaacaatgaccgcccaatgccttcccggcgaatcatgcgtgggcggcaccaaacggccgatggcaacaggggagagggaatgatgccctgaactgaaactgaaagccatggctacttgtcaacggcgaccaatcgtcccccatcacggcacccctccgcgcaaactaattatattagtgccacgactcgaccacttccaatcaaaacttcacaagcaacttaataagggtacgtacactgcagcagaagaagatgaaaaatgctgtctttttttttgttgggcacgcggcaacactcggattataaaatgcttctaagaaaacaacattcaagtttactggtacatgtattactttttttatttattttgaaagcagccactgacagattgccatttacaattttagtgtagagaggctttaaaaaaagcatcaattttagtgcagtagtggaggtaaaaaagcgatggaggggagggaagccgagaacaactccaagtgtgcatgcgcgtagcagtcagtatgtgatgtgcgctgcgcacgcacatacatgcggcctagctacagacacgggtatcattcccagcggagtagcggtagtatataaagcgctgcaaaagtgcggccacaagctccaagccacggcccaatcgccggctgacactcacaagaacctgcctccctcggtctggatcgctatctcttttctagcggctccagagggagggaaagctagcgcacagccgagagaagaaagcagagagggagggagaacaaagagagagagaaaaaaaaaaccagagaggttgagcaagaaccgaggcggatccgccttttgtccctcctgcccgagggctagcctgccgccgcccccgcgagagatcgagaggaggcgctgttcagttcaggtgaaattttgccttgttctgggtggggtctctcgggctctctgtggtgtttggtggtgtaaattggagtgggatttagaggtagttaggtctcgtctgctaggataggtgcggtggtctcgttaatttgtgggctccggaggtcaatttgttcacgatcccggtcctgttcgcggttcagttcaggagcgagtgttcctgagcccaatctaattcgtccataaagtcgatcccttaggtcgaggacaataacctgtttgcagctggttccaggtttcacttgcaaaagatgcgccttgatatctcctccaatcccatgttcatcttatatgatttgatttctagcgacgacaagaatttgtgttcagagagagagagggggcgggggagagagagagaaatcctttaataattgttacagtgctctcggaatctttatcttgttctgagtgagatgcccaaaaaggcaaagggaaatctaacctttcttccagtcctgtgattccttcctacaggggggtgagaagccgtgggggaagag

SEQ ID NO: 6812 - DNA, 888 bp, Zea mays
gatggttcatgttttaatgattatgatctcgtgcatgagtgatatctccctcaagatactatattattgtgtttcctctttattcacatgtcacataagctttctattctacatgtcatatattaaatgagtagggcaacatgcatcagaaatagccttaacagcaaaagcaaacaaaattgttggcagtaaagacgaaagataaaactggtgttaaataagattagagttttcatgtcaaataaagaaacacaggtttccaatgttaatggctagtttgacgaccttatttttttcaagagatttttattttttaagaaaaattagttcattttctcaagcgaaaatgaaatttccttaataaaatggagttcccaaactagacctaaatagagaattttgtcttagtttagtttagcttcactttgaaatacaggagttttaaagaaagtatacataattttcaaaaaaatagtttattttcgcataaaaacacacacaaaattatgtatggcaaaggaggccagggtcagctaatacaccctcgtggaacaatctggaagggttgagatatttcctcgttggatcaggcagatgagatagcagtatcacgagcgtcgaggtcgagcgaacccaacgcatctccgcaattagcagcacgcacccagagcaagcccaagtgccaatcaacaaacccagaccgccagacggcaaccgttgtcatctctcactccacggcgccggccatcgtcactcacacgcccagcaccgcagcacgacaccatcgcgccctggccatcctcccgttcacgtgcacctaccgcacgcaccaccgcggaaagtaaccccgagatccagcgccgtcggcacgaccaggcctgtccaggg

SEQ ID NO: 6813 - DNA, 662 bp, Zea mays
tgctcctaaacatgcccgaagggtttatttcacacccttgtgaaaacttagaggaaaaaacatcatattttgcttgagagttttaaattaatattatttatagagaaacataatccttcctctatcctataaaataagacagatatttttttaaaagtcatcatattaaaaatttagactaataatttgccaaagcacatattttattgtagacatgttatatactttgatttgtattcgaaagtatcattttttatttattgatggtatatttttaaaaataaatggtcaaagttatgttttaaagaccgtgttaaaaaattgtacgcctaaggtaaggtggaagtattcactaaagtcaaaatgcaccgtttgatgttatattataaaaatagaaaacccacgtaagccaccattgtcgtgacctactttgtttttcttaaataaaaagagatggtaaaacgaaactaattcttgtttctcttcccttgggaagacagtctgggtaaacctaacgaaattgaaccgatacccctccctccggctcaaaatccaaacaaatcggctcgcaattctccccgtcccttccccctctcatcgctcgccgctcgctcctctccctgtccacgccgccgtctgtcgaatcgaaatccctctccgcc

SEQ ID NO: 6814 - DNA, 1500 bp, Zea mays
ttttgagtttttgtaggcgctatgcatgtattcattgcacgtgcatgtgatttggttgtgtatatctactctaagatgcgatttggtcgtgtatatctactctaggatgcgccaaaccttgcttggcattccatggagacaacttgtattagaatctcttgtgaaatggaggtcataaggaagttaaggacttgctgctcggtgagtagtttggattagcctatttgacttctttatcaccgaccttgatgacgatctctgcgacaaggcaacattagtctcgtcaataaagccgatgagctgcacaccattgagcgcaagcaagacttgtgccctccatagaggataatcgaatctggagaggttcttggtgatgatgaagccaacaagagaagatatggtagcttatggtgttggtaggatggatctagatgtgttgttgtagagaggtggcttcgataccaagtagaaaattatcaaagataagaagcgttttacctcgtataaaaaggccgtgtatttctatttgtgagatatgaatagacaaaaatgtccataatggatttggtctctatctataaaccataattaatttggtttgtatagatcatggtccctctattcttttttgtttgtcgtgttttagtttaaaaataaactaaccgacgataaatattcgatgacggaagtagtagttgtttaataattcaaaatatagaatcacaaactagattaatcacgtgtagatagtacattcaactgggaagacgggaacgaccagccgccggcgcacaacgatatatggcccaagtggagctaatcctgtgcaaataaattagaaagagtgaatggaaattctgactcaaattggttgcttaggccacaggaagtcaagatcgcccattatatttctggtgtttgcttttggtcagaggaataaagcggattcagtccgaacaagacctgccatatgtatgttggtacccaaagtttgcgatagaaaccgaatcagacggtcaattttaccaagtctaaacccaccagctggtggacacgttcaaactatttgatttttgtaatcagaaaattataacgttcggatggttcctcccactagcacagaagaaaataacacctctttctatattccgtggcaattttatatgtgcccaaaaaaattatacataagcacccaatgcgtgcattcacagaccacaaactctcggtccgcaatgattgcaacgttgcaattgcttatcgttcatctgtcttgcattcgccgtctacccaatgccaatgttctaagccagaggcctgaggtccatgataagaatggaagccattgacgggttgcttgcaagtcttctcttgcttgcgcgtaaacacaacacagcatacatgcgttccacaaacctactctttccataacacatcatccaccaaagaacttatatactctctccacaaggatccaatccatcttggttattcgtccccacg

SEQ ID NO: 6815 - DNA, 111 bp, Zea mays
ggtatgtaggttacttgctcgtttttttttgctgtaaatatcttgccatagtttgtgtatcacagtcttttgtctgctactccgctatgtttttggtaacgaacatatgct

SEQ ID NO: 6816 - DNA, 447 bp, Zea mays
cgacctgcagtcaacccgtcagcggcctcggcatcggcgtgattgggccgacgcccgagcccgacggccccctgtaggtatccaagtcagcggaaggttccaatcagcgtccagaaccgctcgtcgacagtgagaagttaacggaaggtcctcccgcgatcgcatccagccgtccggcccataccgcgaatgtccacgaccgctgcaaaagtttcttcttcaggttcttaatcagtaatcacgcacggacgataaatccaagtaaggaaatccccgatgatctcctgcgcgtcgcagcgccagccactcgattagtggagtccaccaccaaccaagcacgcgtccctccccgtcccagatcccatcccgcggcagccggtcagttcgatccatctccactacccaagcccgtcacccgccttccccgttcgctctcgtcggcgcgcg

SEQ ID NO: 6817 - DNA, 1497 bp, Zea mays
aaacttaaaagtacaaatgaggtgccggattgatggagtgatatataagttgatgtgttttcacataagtgacaagtattatgaaagagaacatttgcattgctactgtttgcatatgggaaaattgagaattgtatcatgccatggccgatcagttctttacttagctcgatgtaatgcacaatgttgatagtatgtcgaggatctagcgatgtaatggtgttaggacacgtggttagctactaatataaatgtaaggtcattcgatggtttttctattttcaattacctagcattatctcatttctaattgtgataacaaatgcattagaccataattctgtaaatatgtacatttaagcacacagtctatattttaaaattcttctttttgtgtggatatcccaacccaaatccacctctctcttcaatccgtgcatgttcaccgctgccaagtgccaacaacacatcgcatcgtgcatatctttgttggcttgtgcacggtcggcgccaatggaggagacacctgtacggtgcccttggtagaacaacatccttatccctatatgtatggtgcccttcgtagaatgacaccccttatccctacaatagccatgtatgcataccaagaattaaatatactttttcttgaaccacaataatttattatagcggcacttcttgttcaggttgaacacttatttggaacaataaaatgccgagttcctaaccacaggttcacttttttttttccttatcctcctaggaaactaaattttaaaatcataaatttaatttaaatgttaatggaaacaaaaaattatctacaaagacgactcttagccacagccgcctcactgcaccctcaaccacatcctgcaaacagacaccctcgccacatccctccagattcttcactccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaaggagcctcagccgcagccggttccgttgcggttaccgccgatcacatgcccaaggccgcgcctttccgaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccatctcgcttccgtgcttagcttcccgccgcgcc

SEQ ID NO: 6818 - DNA, 253 bp, Zea mays
gccatccctcaaccatgggacagacgcccctttttcccctagtcctagctgtccataggctttgatcagggcattccatgcaaccacgtcacatctaaccaatcatcgaactccaagtcacagaatccttcatctccatctgctggaacaccaacaatgcctcactcaaacaacccaactctgcatacatctctgggagagcattggaaacgaagaggctgtgctgaaaaagccagacttaaccacagcgcgc

SEQ ID NO: 6819 - DNA, 673 bp, Zea mays
tgtgtacacaagcaaaccctgggctttcgttcgctaggggtctgacgacctggcgcatgcaactcaagccccttacacgcgtcagaccaggacctgtcttggtagggttaaccgttccttaaggtagtggtgtgaataccccagttacagggtatcaacagtctttaatataaatatttaatatataaagataagatataaataacatacttagagagaaataagatattaaaaataaatattttttaaaaatctgtaaataagagatatagagatgtaaaatacggttgaaaatagtcctagctaatgccaactaataagtcaagactagcctcggtcgcctttgccccgtcggatttcgcgcatacggtgggaaccgaactgcgctctgccccccatggttttgaccgcaaaaggttttggttgcccgtccctagcagacacgcggtcaggcgggcccacttgtccctctcttctctgcctataacttcccatccctctctcggtccctcccttaattccgtccacagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcg

SEQ ID NO: 6820 - DNA, 280 bp, Zea mays
tgtatgtctttagcttgtaaaactagaggttcttgataccacggttttagaaaactacatttaaactggccaacgtttttgcagttctagtaactccatgcaagcatgcagcccctgttctttttcctctaaaacaagattttgcatgtctcgtgtttccaaaaactacagtttcttgataccatggttttctaaaacaatgacatctaaaggtttccgatttttttgttcttgaactttgaacaggtaccaggttttagctggagtgattgaacagcgg

SEQ ID NO: 6821 - DNA, 1146 bp, Zea mays
cctcgatggtccacgagtgcacagtagcggtggcgttcgccaacagcacctgggtctcacccccaggagggaccctgtcagggaggtgagaccctagatcttgggtcggcagaccacccaagatgcctccagacggcatagagtcgaagagaggtgaagatgagatgaggaaggtcacattactgctactcctagggcacagaagtaaaggaacaaaagatagattgatttggttcgattgttgatatagagggaggtttggacccgtttctagatgttttccaacataattcacgagtttagatggataaacacacatggaaaagaggcttaatcgtttgatctagtcttaacgtggaccgtttgctcctacaggcggatcggatcgttcggccaaagagccggaccgtccgccctctcccatgtggcacatatggtgctcaatacatgtccctgtttttttttgaaaagatgagtgaaacaaaagcacctggtacaagacatttagcaccatgatatgtaaatatcggttctctaaacatcttatcataaaaattaatgaatgtatgtttagtttaaaacaaattatattttgggacggatgtgtacttaccaagttagtatacagctatatacacataattatgttagaataatttttgaatgctaagtatacttagagcagatgacccggtgtactgtgtacatgtactgccaaacaccattgttgcgtgttcgcaaaaaaaacaccatcgttgcggaatgcgggtcaaatactcaaatcagggtatcgacaagcaccacctccgtcgcacgtgtcacgacacacgaggtcaaactcgaaccaaactaaccgacaccgtcggagaaattaaacgtttcataagggacctaagcgtcaataaactatttatttatttataatttatcgataaaaaccccagaagatccaccgaactaccgaaacttccgcctcgcagcgcgcccgcgcgtcgccgttgcctctagcggtctagccctctactactcacccgacctcccgcgcgacgccgaacctgcgagccataacgccacccaccgcctcgccgcgcagatctctggggcttatccctacccccgggctgtgattctcccgcctcctcaccg

SEQ ID NO: 6822 - DNA, 546 bp, Zea mays
acggttggatccccaacaaacggcacagatcgcgtgacttcagaggcaggtcgtatttgctgactgcagacgatctcgttccaccacacggggtccaactatcgtgtcggcgatcgggaatccgagcaagtaggcaacgtcctgtaaggccttgttcggttaatcccgttacccatggattggatgggattggaaaaaattaagaaagagtttgacttagttgggatttaaacccatccaatcccactcaatccatgtggattgggagctaaccgaacaagccctaaaagtgaccggaccgggcgctttcaaattttataaccacacccccatcgcacttgccacccccgcgaccgtgatcgctcaggccgcgcccggtcgccagcctcggcgaaccacacgccaccgcccgcctagcttgaccacacacgagcgagcgagtagctaccgatcgacgacgctccttctgcttctccccgtcgtcgtcgtcgtcccatgcacctctgccacatattgtgagcgagcggcagcggtgtgtgccgaaca

SEQ ID NO: 6823 - DNA, 62 bp, Zea mays
aagcgggcccagctaccagcgtccctcgacacccgcgggcttttaaatcagcgcactagtta

SEQ ID NO: 6824 - DNA, 358 bp, Zea mays
gttggtgtggttgcacttgcacgcagattcgcctggtgctgaactagtttgtctgtccgcgtccagtggaagtttggtgccctttagccatggaatacgattgctatcatttgggcccgggccgagttggaggagtctcaggtgttcggtctggtttggtccgggcttgattttgctaaaaacttgggagtccatgggggttgggaacgtttgatatgtgagtcgctagtatttaactgcatggatcgttgtggattgcggtaaattcataaagtggaccctatatattttttatttcgttcaatacacattcatatcatcaatgatttataatggcagtgcctgtggggagacttga

SEQ ID NO: 6825 - DNA, 1500 bp, Zea mays
cattgatgcatgtatctgcttgtttatattgcaggtgtgtgttgtgccgaaagagggtagaccttctcgccgtgaaacaggttcctggctgatttctcacactgttcttctgtagccacttcaaggtttgtcgtttcttactttgccagttgctgatgtgcagtaacaaaatttgaaatactttccactttgcttaatgcataaggtgctttaccaactttcctttcggacaattcatgccgctatgtcatccctgtaaacatacaacaaagacttatcaatatcgtaaaaaggattagattaatgtacggttgtcgacatatttgcctattattaaaaattctatattgactctttaaaatagtttatgcgatattgataatgtttgtcacacggattctgtatattattgtgaatagatggtgagagactatgcacgaggtatgcaaattaacaagactcatacaagcgcggaacagtgtgctgatggggcacaagggaaacacatgatcaggtcttaacatgtttggctttcgagcaaactttctccagacccccaatgaaatataagattcaatcagatatgtgtcgatgctcatcccagcgtattcccgttgcaacgcacgggcacacacctagtttcaatttaaggcatccgtttaaagcattgttggatgctcttagagactcctcaaaaccccatattaaatgtgttgtactttatgtaagacatatgtcgacggtgaacctatgtgcattatgcgccaaggcacctccttttttctcgaatcccaactcgtttccacctcgtcttcgaattcatccggggttggtgggctgtcgtagatgattttgtctcctgtgccgcgctgtgccgacggagacagtcagacagagatagaaaaccacacaggacacgggagaggggtgcgacagcgtgggcgtaaccgcgtaaggctgtccgcagccgcgtccgacggaaaaaaattctttacattccgcatgtaaagaatctcttttacagctacttatatatataagttgctgatctatatgaatagaagaaaaataaattattaaaaaattattttgtaaattttaatatatgtttgtgaacttctaagtggcggatgtgagggactataaaagataacgtttacgtccattatgtacggcttcagcggcccagccgtgcgaaggtgaatagaattccgccaggttttccttggttcgatgctttaatattaggtttttrtttttctctctcctgcgtkgctgcggcaatttcctatccctgcagtcggagtcaagcatacagttctaaactagatcgttgatatttattgccgtttcaatcttcacgttaggtgccttcgttaaaatatcaactcccccaggccccagaccattaattctcttctttcttatcaactcccgccctatactccacctaacactctcctctagtcctcttcctctgcttgctgagtgctcgctcca

SEQ ID NO: 6826 - DNA, 1212 bp, Zea mays
ctgcagtaacgagagggagaaagaaagagatgagcagcgaatggacatgacagcgattgatgaatggatgatatccgtaggtgatattgatgacggcgagggttcgcacgcgctgatgtggctagtttaaaagtataggggaatgtatttttgggatctgctgtagagcaacgtacatgattttgggaaatatttttttttgcaaaagccccaataaattgatttagggaaagatttttttggaaaactcttgaagttgctcacctatgaagttaatactttaatctgttgaaacaattaacactttagataatctatagctaaaatatcaactattttaaggaggaagtatacataaggccacacctgcaaaattattttctaattttacggtccttttgacagggctatggcttatccaaaaatagctttagctctggctttttctaaaaaaacggctttgttgttagagctaaagctattttgtaaatcctttggcagaaacagctttttttggagcccagagccatttccatatattaaaataccagagctatagctaaagccggtgaagctactaatgtgggtttcctctacgtagtataaaaacggctctggtttttaggtgcttttcgagatgtttgaagaaaggtgtttggtagggctctggctttttccggacaaaagccagagccaaagcctaccaaacaagctcttaatttcacgacacaacacacatgtgggatcgaattgatgatgaaaatttgcttggatttcaaaagatgtaatattcaatcaaatttaaattatacagcatataaaagcaggcatacagctggaaaacgaaacaaagaatgtatacagcataaaggcagatattaggggagatcaggggaatgtatgtaaaggcaaaacttaggaaattggaagcccgccggtacgccatctgatcaggacctgctgttgaccttgcggcatgtcttcctgatctctccgttggcggcggttttgatctcgacgccggccatcttcaccatggctttggcgaacttctgctgccacagatagggcacgaagtccgcgtaggcgcgcaccaggttgttggacgtgaagttggtggtgagcgcggcgtccgacgtgaagagaaccttgtgggccagcacgttcttgtagtactggttgtccaggacgtcgggggtcttgaagtcctgc

SEQ ID NO: 6827 - DNA, 1500 bp, Zea mays
gattgtagataggcttggaacatggagaaaaggctaggtcaagtagggtttgtctcactgcctgaattagagacaaaatctatgccaactcgtgtcaaccggttttggcatgccttgaaattttaccaggatgttcttagggtattttggtgtcactttgtccattgagccatgtgttttgggttttggaactaggtgaacacgtgtgctctttgtaaagtgctgaaaaatgaacttagagaaattctgatttccttttgtgctccctacttgagtaaccatcttgggggttttgtggatcctttttggggtatccttcttactattttttgtagggtattaagtgggttacaacttgtataaatggttcaagccatgataatgcaatttatctaacttttccacttagtttctttagggtgctctatttgcttaaagtgggaaatttaaggtttgagcatttttcccactttgaggtgcatgacatggctcaggtatgacttctaggatgattaatacttagggcccgtttggcaaagctccagctcctgcttctttagctccagatcctgatcctcgtgaggagctgatcctcctgattctcctagagaatcagaatcatttttaaaaccgtttggcaagtaaactgattcttgtctgctgagagttggtggtctgtggcgattgtctgttttaccctttgcagttcaactttgttacaaaccaataagtaggatgcatatacggaaaaaaattatgaaacaataacatataaaatattcccatcatagtagtgcataaaatggtctcaaatgtttaatccataaattggctcgttatgtttttgtccaatggcaattgcgggtaatttcgatcaaactttaaggggaggtccatatttggttggttgaggagctgttttaagggagggtggagcaggtttttttagatcccacaattcttcacaaaaacgactcccaatctttcggctccacacgagaatcagtttagaaaaatacccgtttggcacggctcctccagatcctcgcttagaatcaggagctggagctgtgccaaacgggccctaaatattaaatatagagtcggtcaaatttgagataaaaaataaaacaaattacaaattgaaacgagaaaatatattatactgctaccgccaactggatgtgagtaatcaccaaatcattagaaatcaagtagggtagagacagagacagagacagagcctcgtcgttgacatgaagcaagtcagcgaataacgaacgaatatcccacgcgaaacccctagcaataatcaaacgcacatgatttggtcgtcgttttcggctcgccctcgccgtctgatccccacctccacccttccctctcctcaaacaacagcggcacagcgctcgattcggcttcgcctcgactcgcgggctcccctcgcaaagctctaaacccctctgagagaacctatccgggccaccacaaccgccaccc

SEQ ID NO: 6828 - DNA, 1500 bp, Zea mays
tttcagctaaccctgtctggctggcggtcaactttggcaaccagcttgtaacctaacgtaattacactaccctaattgcttaggtaaatgatgcttctctttggctgtagtaactgtaatgcatgtgctagccagtgtgctatcctaaaccaaagggccccaccgcttggcagcttgcctgctttgctttgtttaccctttgctaacattatccgtaacgcgcttcacatgaccattaccgcgtacagtgggaaggaaacacgtcaacgtgcagggcttgtatctgtcggtatggccgtacttgccgtccacgcccgtctgctgcccccgtctgatgacgtacatgtgtctctctctctctctctctccgtctctctgtttgtgctatcatttgacttggtggcttcacgtgcccgtctcaccaacccgtgtgtccagtggtgaccggaatcacaaatcagtgcaagtactcgtgacgactggcgtggcctttttggcattccgtggcatggcagcggctcctctgtgtagtgtagcgtaggcaaagcggtgcgaagcatgcggaccggcgaagacgacgatcaggcggtggcaaaaggcggccagggccggatgcccgtcgcataccaagacgacgatggctgcgcggcctgcaggtcggatatgtggattccacggagagaaaaaagaaaagaaaagaaaaggtagacacgagtggtgggcgacacgtttcgatccaaaagcagacaagttaaggcgagggacgggtcgcgtttttttagtggggtagatttgtctttgcggagaatgaaaatgtgacacttttgtcgttacgtggccagcgattaggctaccactggtatggccgccacccccgagcggcacaccgtggtgcaattgggcttctcggataattgttcgcttaaccatacgagcaagagcaacagagcaaagcaagcgaaaggcggccacaggcgcagcgtagttgtccctgtccgtcgcttgcgccaacctgctgcccaccgttaatcagttttctttaaccccagctgctgcccgtttactaatcaaatcatcgtccccctccggcccctcctttcccttccgcgcctccctcgtcttcttctcgtctccactccccctctcccaagtcccacccgccgctcccgcccccgtgcgctcgccgacacggtcagtagttccactcggagaaaggaacgcttccccctgcctgtctcgccggatccgttgccccgctgcagtttcgcccgccgctttcactttcgctttcactcgatttagattccatttccgttcgttcgttcctgtttcccttgctcgttcgttcgattggagctagccgccgcctggatctggcctagccgagccccggctgctctgaatcccgattcggttcggctcccttgctctgcggtcgcttccgaggcgtgctcggatctcgtcggagtagagggcctcgcggctcgcttcgggggcgag

SEQ ID NO: 6829 - DNA, 1500 bp, Zea mays
ttaataaagatgaatttaaaatgaatcgtcgcgcgacgaagcgtgcgacacagcacatcgactaaactaaaattgaaaaagggattatctgaaagttgaacgtcgctgaaagggaaatgtgcccttgggccatttctaagtattttggtgatttagtgtccaacacaagtgcctaagtgtaaaaaggtggacaaagtacaaatcaagaataaaggtatgtttctcagacttagtacattgttttatggactaatgtattgtgtctaagtgctggaaacaggaaaaatccaattgaaaatgccttggctcgagcagccaagaatctgctcagtctgggagcaccggactgtccggtggtgcaccggacagtgtccggtgcgccaggctggctcgagcaaagtggctgctctcgggacttcgacggcggtgtacggctataattcaccggactgtccggtggtgcaccagactgtccggtgggccgttcacaggcgaactcgtcgctctcgggaattcatcaacggcgtacggctataattcaccggactgtccggtgtgcaccggactgtccggtgagccaacggtcggccgggccaacggtcggccgcgcgatctgcgcgggacacgtggccgagccaacggctagaagggggcaccggactgtccggtgtgcaccggacatgtccggtgcgccaacggctctcaggctgccaacggtcgactgcgccatttatggaaggaaatcgggcaccggacagtgtccggtgtgcaccggactgtccggtgctccagtcgacagaaggcaagatcagccttcctagattgctctcaacggctcctagctgccttggggctataaaagggacccctaggcgcatggaggagcacaccaagcattcctacaacattcctaagcaccaagacatcgattccgcgcctttgattctttgcgatagcaattagagctctagttgagtggtgaactcattgagttgtgttgtgagctctcgttgcgacttgtgtgcgtggtgttgctgtgatttcttgtcttgagtgcgttgctaatccctcccttgctctgtgtttctttgtgaatttcaagtgtaagggcgagaggctccaagttgtggagattcctcgcaaacgggattgagaaaagcaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatcttgttggttattgtgttttgttgagactcctctctagccacttggcaattattgtgctaacgattaaccaagttttgtggcttaagttttcaagtttcacaggatcacctattcaccccccccctctaggtgctctcaattggtatcagaaccgttctcttcacaaagggactaaccgcccgaagag

SEQ ID NO: 6830 - DNA, 1500 bp, Zea mays
ggggcgagcaacaggcaaggcaatgcaatgcagcaagttgctggcgctctgggctagtagcgagctagtgcgtctggcactctcacgcctcggcggccatgaccccccagacacttttataggggacgaatggcaggagcatgtaggtagatagatgggcaatgacgaccgagcgagttggctaccgaggatttttaggtcacgcacgatcgatatgattcttaggtgtgtgcgcgcgcgcggcgcgaacatggccgagagtgctctgctgtgcgcggggtcacgacgtcagcgcgggcgagtagtggccgccacatgcgtgtgcatctttgtcagcgcggtggccgccgggtcctcgaccgcctagtaggattgtagtgtargaaggatcgatctagcccccgccggccggcgaggtgtaattttcctcctttttttttgtacgtccggctacggctaggacagtggcagtaaaaagctaggttgcgagcggctgtggtttcctggscagacactttccgcgtgacgcgcgacgtcgacgagggagaaaaaaaggctacggctacgcggggctaaagctagctgccagcgctacagctagtatggcgatctgggagagctagggtcctactcctagtgcctctgctccgactccggctccgactccgacccggcacagactacatgcacacacaaaaaaatggatccaacgtacgtaaccgacgtcggagtcacggaacatgtttgacacggtcgcttgacaccaccacacacaaaaggggtagtactacgggkgtgtttggttttatggactaatgtttagttcctatattttattccattttagttccaaaattaccaaatatagaaactaaaactttattttagtttatatatttagcaatttatatactaaaaatgaataaaatgaagggactaaacattagtccctagaaaacatcgcccccgcctgacacttctctcaaaagtttaagggcccctcgctttgttctgcggcgccgcaacggaaaacgggaaaattacgcagggactatctatccctacctacctaccatgcacctgtcacgtttcgtacacaatcatctaacgagccgtgattttttcaactaatcttcttccgtgcatggacatgtggcatgagttcagctggatgaccacccgtacatggtggggatagtgctcacctttctttttagaaaaaaaggaaggcgtcttgttttcggtgcctggccacccttccctcttcgcacgcagtcgcagactcgcagccccccttctgatcctcttcctctcccacgcggccgcggccacgcccccgccccccgctgactcacgcagcgcgcgcgacgacgcggaggagaaaaccaggaatcccataaaggtttcagtttcggaagccaagccactccgacaccccccacgctcgagcgaagggagccagcaatggcgcgtcgcgggccgtgagagacgggaacaaga

SEQ ID NO: 6831 - DNA, 606 bp, Zea mays
ggtgcagcagcagttcagtgatgaactcgcttattggcttttggcgggcgccaggggtttgggtcagcttggccttcctaacttcatgagtagtgttggatctagtccttttactcttctgtaatctctttcttttgtttgggtgtgtatcccggttgtaagtcttttctctctctctctctctctaatataaagatgtgcagctttcctgcgcgtttaagaaaaaaaatggacttaatcctttattctatattattcactaaagtactcttagtccttgcggattgcgctactaagtttttttttgtataactaaattgtaaattttcagatgatggggactcgatcttgcaagcatgctaaattatgtaatgaagcatgtacttgtaactgcaaaacacatttcagacatgaataggaacttttaatgcagtataatattgatactgtaaaaaattaaacaatcacaaggagtgccactatttttatatcatattccaatcttattgatttggaacatgctgtcacactagtttgaattaacaactttggacattattatggtgttctttgtaatgtcttgctgcgaacctttgcgtatttttt

SEQ ID NO: 6832 - DNA, 1371 bp, Zea mays
ggggctcgtttcaaaaaaaaatgataaatgtctgatctgcactctctaactcttcaagtcatagtctgcattgttgtctcctcgtaaaggacaaaatcaatgtttcagttaagaaagcttccaatgcttacttcttcttatctacattttagaccacacatcctgttgagtacaaggaacactcgtctttcaagttcatgtaatagtataggatgtttgtcatcttttcatgtatgatgcttatagatgactgctaaaactgaatgggcttctttatctgaaactgtaattttgttctcactgtttgcataaccaacagcatctaaaccttaccaacaatctactgtaataggtatgtactgcatgatactaaatatgctaaatcaataattattttaggaaaaacggcagaccacaacatgtctgtgagtctgtccatgcatcaagtgctgaaagtgagtagcgtctgacgaccgttgggttctagagtcaggtgaagtgttgattcgccttcgacattgagagcgttgcttcgaagacaacagaccatagctcgacgaattggatgatcttctctgtgctagactggtagtcgttcaccgcatgccttccatccagcttgtaagaattcccgggttttcctccacgctatgtggagtgatctgtcatgctagaaggagattttgttgcctcttgcggtcttgccgtttcctaccttgatcgaggccagttatgaacagatgttaagtcaccaagccggcgtgttgtttgaagaatgctataaactctgcttcaatcataagggagaatgtgattcagtcgagtaagagtgtgcattgtttgacctctctactgaattgttctatttttgttggctgggctccagtgattcattcggatggatacgaagagaaatggtcaaatttgtagttcagcgcgccaagctcagacttgtatgatggtgtgtagtatcttgtaacttaaagaaatgtaagaaaaatgtccagttattttggaggattctcaggactttcttaagttaaaatttgtatttttctttctcatactagttagctagctcagcatgtacatgagaagagaaatagggcatagctaaatccaaaattctggagcgacaatcttaacttcgtttgtcacaaaagaaatgcaggggtggcaatatggactttgtcaaatgggacgcactcttgccaacgaagtcaaatagagtccgcccgtctctatagaagccgcatgcctatatagatgtgcagcttcttctccgatcacacaaacatttcatcgcctcctaaagcagcatcggccactaccaccgtctcttcctcacctagctagcgaacgagaacgacc

SEQ ID NO: 6833 - DNA, 758 bp, Zea mays
ggtttgtgacatagacacattgttctacttgcacattccctacattttattttcgtgtatcattcactaataatgatttcaaaatgctacattggagacaatactaagtcatgtagaactattgcttatttagacacatcacagatctccaaagaactttttgtaatatgttttgcaaaatctggtaaaaaattcagacaactggcattatgctagtcaaggttaaaaaaaaaggattgcatctagagatgttgcttcgtattcaggcaatgattgtagacttctttttttaccctaaatacctgtttggaagaggaggattgctgattgctcttgaaacttaaggaatcaattcattattgatcccagtgtctcctaactgaagttgtttagctttcttttcctgttgccttttctctccatgttaaaagcatctgactgaaaatattgctgttactgttaggggaatgaaaaccctaactctaatgtgggttgagaatatattaatatagctgagtatgtgggccaaggcccattacaggagagaaatagaaatacacagttacgctaacagttacaaatacaacgattggaacatgtagatgcatagcaaaatgttaccagtaacttggtggttaagcattgtcaaagaactctttttggcccttttctaactgctagatgtgatggcatattaaactagtaacacgaacttctcttttcaagcacatgcattttcacaataatttttctgtttc

SEQ ID NO: 6834 - DNA, 1014 bp, Zea mays
gccgtgggccaactcagcctgcccgcggcccattctggctgggtgacgcctgacgcgtccaagccgcgccaacggaatatgccgtgcgcgttgcggccagcccgcttgtcccccgggcgggtcccgcctgtcgcgcgaaccagggaaatatctacatctcgtctgcgccgccgctgggatttattagggttctacttctagcccgggccgactccactccaatccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcaggtacctacgtcctgttcttcatcgcttatggatttctttacgcgtagtaggtagtagatctctctttgctcgatctgttttcgttttgtaagattcattcacgtctgcgctgtggctctattcagatttggtcgtgatttctgggtttgaccagcgtaagcatcggccccgatctggattctggagcttgactatatctccttttattttttttttattttgtactatctaacatagattttgcgtctaacaatcattaagttacacgcacgcatgattatatttgaagtttaaccttgccgtgttgtggttatgtgcacttctgagcacattatgtactgaattctgcaaattagtaaaggactataaactgtagagtcaacttcggttagggtacgctaataacatgcccgagaacgtgtatttccttaagaggaagttcttttgcttataaatactctttgtgcctttgtttctcggaggtgctgcttttctaaaataaatatcacagctttagtgatcagtgattattgactaggttacctgtaaccaccacagaatctgcagtgatctctcttggtagctctagctctggcttcctgcaaccctacttacttataaggtgtatatatttgtttatctgttctagtg

SEQ ID NO: 6835 - DNA, 538 bp, Zea mays
gtatcttggtctctaacaggattggctaataaattgactaattattaacaagatgactgacaaattatttgtccatttggtatttgacattgctaataagtgctaatatattatatatagagaaaaggatgatccctatctctatctttttttccttttttttctagctaattgtttgccatatagggtaaaacatactattcaatatgttttagatatctattagtcatgactctaaatatatcttgactaattgtttatcagttaattatttagcgactaattgttggccggcggcaaacaggataaagaaacatggattaaaacgatgttgtactaccgacgaataaggacaaccattcaaatcccctaagtattatacgttcaccgaacctgtacaccatgggttgcattactccaaagctaccctatataaaaccctaatagctcctgtgtcctggaccaaactgcacacctacccatcacattagcactaactatttcagtgagtgccgtctaattcactgacttctcgagc

SEQ ID NO: 6836 - DNA, 809 bp, Zea mays
gtccttttctacatcctagccgtctgtatagataaaatatgtagtagtgagcaggagtagtggtcaatgagaatgagaagaaggtagacccagattttttataaaataaaaacggatataggtaaccaagattggagggtcgaacgggcaaccgtcgcgtcggccaccattattcctgtgggtttaaaatgtaagcgtggctgagtgaatctcaagctatgacgtgtgtacttcccggcgtcgcactcaagcaaaggtgaaaggtggacacgaatctcaaagcgcacatgcacacgcacaacccgacgtccccgtggctgacccggtggcccagtactggatgaattatgtgccggattagcagatggaggaatcttcttcggttgggacgttgctttccggccgccgctctctgcttgtctgctctactcaggctcaaccctgccgcgagggttaaccaatcgtgctgtgctagcaagggaagggaacccttttgagtggcacatgcatgcgctgtgttttgtgttgtgtagtgtagtgtagtgtaggggtagcccgcttggtgtgccactacagttttttttttaaaaaaagccattacgctttcctagaccgcacggctcagtcaccaacccactcatcactcctcactcactcactcaaaacgaaagccagctcagctcatctgctcacacctcacaggctcacacccacaggccggccgccacagcaccgcggatagcagagcagagcggtgagctgcagagcagggtagccgaggtcgtcgtcgtcgtcgtcactcgtcagcc

SEQ ID NO: 6837 - DNA, 893 bp, Zea mays
ggtgagaaaccgaaaaacccgaaggtaacgggttcggaaaaacgaattatagcggcctcacggaccgtccgcgactggctttatctgacatctgacgacgcattaaatgcaatatagccgttgatatagccgttactgctgaccgttgcgttttcagccattgatctacaggcgcggaccgtccggaccaggcgggcggaccgtccgcgatcggcagaatggagcacggctaggaaagtggttggtggctataaatacaaccccaaccacctccattcacttcacccaagcattccaaccttcaacattcaaatacagagctagcaatccattccaagacacattcaaagccctcatctctccaagtttcacaattgagaaaagagatcattagtgattagtgacttgtgagagaaagtgatccgtgtgttatttgtcgctcttgtcgcttggctttttgcaatcgtgctttctttcaatctttcttgtgatcaactcaattgtaaccaaggcaagagacaccaattgtgtggtggtccttgcggggaagtttgttcccgtttgattgagaagaagaagctcactcggtctgagggaccgtttgagagagggaaggggttgaaaaagacccggcctttgtggcctcctcaacggggagtaggtttgcaagaaccgaacctcggtaaaacaaatccttgtgtctcacttccatattcgcttgcgatttgttttgcaccccctctcgcggactctattatatttctaacgctaacccggcttgtagttgtgattaattttgtaaatttcagtttcgccctattcaccccccctctaggcgactttcaattggtatcagagcccggtgcttcattagagcctaaccgctcgaagtg

SEQ ID NO: 6838 - DNA, 163 bp, Zea mays
ggtgtggtaatcttaattactgtattcagtattgttcttatgtgaatttatcatcctcctccctgatattagacttgcaaattttcttttacagactgatcttgctgaacatcacaaattggggcttgatatatctgaaccggagaagaaaatcatttatgag

SEQ ID NO: 6839 - DNA, 272 bp, Zea mays
taatttttttagatgttttaaacaatgtaaatatataatattttattttttgaggtattattttgagttaccttgttagagattctatgaggtagagaatgcaaaaggcagaaaccattcgaattcaaaaatggcattatgttgtggtatactggtataggaaaaagggagacccaaacaatgagttccattcagcagcaccggcggcacggcaccccgcagtcccgggctcccggcgtcccgcacccacgccctacaggcagaccaagcaa

SEQ ID NO: 6840 - DNA, 701 bp, Zea mays
tgcagtattaaaactgacgtattatacacataacaatatttggtaaaccatcaaaaatctatattttaaaactgaagcattgtaaatactatagttgttttaaagtattttaaatttaagtctggatctcagttattaatattgtggtatttaaagtgtgatattatcatgactaaagtatattgtagtatttcaaaaactatgattttcaaactttgtttctaaacaggacccaaaaaaccagttaccccaactaaaatcagttttggttggttagtgattgtttatggaaaaaaggctattggatctaaacactcctattcatttttttcttcttctaaaagtgagttttcagaaatcaagtgtagaaacaagtttttaagaaatcggagtaaattcaaacggggtagatcctaaaaaaactaaaattcgtcgttcctctctcacccacacgcccctcgcaccaggcttcctctctcttacctaagccaccctttaaatggcaacaccaacacccgtcccgacctcttctctcctaattattcccgggcttcctcctgtgtacaccgctcccgccccgcctaccatttaacccccgcttcccctggcctctgccgccccgccgcacagaatcgcttggtgcacccggcgactcggcgagggcctccctgaaaccctagcttgcccagccccgccgggcc

SEQ ID NO: 6841 - DNA, 1392 bp, Zea mays
aggatcgcaggagtggggcatggcatacttgtggacacccacgttacatccttatagagtagtagagaagtgactaatctttagtcacttttattttagctcattagatgcaaacatgcccttatcgacgagtatatatactggaaagttttaaacatgatagtataaataaaataagtataaattaattatttttctataaaaagctgtgaaaacaatccaaacctgatggaaagcatgcacatccccattagggcacgaccgagcatatctgggagactgatgcggcaacacacatgacaggagtggctaggagcggtgcggyttcacatgcgacgtgcatgacttgcggggtgacgcgtgaccatgaaatcctatgactatgagaatttaatttataacatacatctgactccaacaatttaatctagaacttccatctaattgtaagaaatcaatctagattgaacatatttattaaaccatgagtttagagcagataaaaaaaatgacgtaccatgtttcttgattgagcgaacagagacaaaacctgccatataggacaattcacaaggtttagggtttagactttgaattctcctattagtaacaaaggcgctagtaagatatagaacgcttattatacattcacttctcacggtggcataaacacaaagagacaatattagtttttatggtttycactgtcatcgttatcccccaatttaaatggtaaaattaagcccaaatagatattagaatcatgtttattggctacaaacctacattcacactcaactaaccaacaaaacatacatatctttgtattttatattctatattaagtataaatggaaaccatagcaatgtatggatactttgctatttggtattaaccccacaatcctctgtagggtttaacaagtagtaggaactcattggatgaaaatatataaagaaacgttttaaatatggtaatataagtacaataagtaaaaggaaaactaaatcgggtatccaattgtctcattcctacgttccctacacagctgcactgtcacttatgggtccgaagccgcggaacgctcaataacaagcataagccggggccgcacctaatccttagggttagggttttagaaaacccccatgggagtggacagtcccgcaccgatccgacggcccggcccacccgaagccgacccaatactccacgagcgcgaatctcagcacctccctatataatagagctcgcgcgggcaccactgccttctcccagctccgcctccctttcctaccttcttccctccgtctcccagctcgcgcaggcaggcgacacagcgacgctaaaaaccctagagcgaggaggcgtgccaggccagcggctttgcg

SEQ ID NO: 6842 - DNA, 1032 bp, Zea mays
tcggacaacgacacaatctctaaaatataactttgaccaatgtttttttgctaaaataaaaataaactcttaatatatttatacttttataaaagtactttttaatgataaatattaggatttaaaactaaataataaaaaaattatttatagttaaaattttataagtttaactcggaccttgtcgagaatatattatagatgtacttttatagatcttatcgtaataaacgcaatggtgcaaacacaataaaaaataggtatttttttaaataaaataatatacagcttggtgagactccaatgaaaaaacacatcaaaccatggtgcgggtaccttttacagccacacacaccacagaaacgttgaaaaggcgaggcagctcacgcgggtgcatgcacatccctcggttccgttaggccaagccaagtgccyttatcctcttctcgtttccagtagcctccccttatcacgccttgcctttcctgccttaaacaaaatcgtttttttctctatttagtactagtaataactgttagtacgtgtaaaaaataaaaggctgcaagttatatatgttgcccacctcgctcctctaattatccactgatccgcgaggcccaccgggcagccgtgagagattctcccgaaaatacccccccgtcgcgaacgggttatatatagcggggcgccgcacacccggcggagcacggcagtccgcaccgcacacacacgcacaggcagcagcacagcgatctgccttctgctgtgccccgcccccatccagcccagagcagcagcgcgcggtgccggccggcaaccgcagctggtcggtcatcaggtctctgggcctccacctcctccttccccctctcaaccctccccgtgtcgcctcctcccgaatcctcacacgtagccccgcgcgccacctcgctgccggccgccggcacacagatatagagagagagagagagagagagagagactgagagagagagagggaggggaagcgaagagaccagaacaagagcgaag

SEQ ID NO: 6843 - DNA, 85 bp, Zea mays
ctctcccccccgcgccgctgccgcaaccaaaaccctaaaagtcgctttctatccacttgctccgccgcctccaccaccgggcgcc

SEQ ID NO: 6844 - DNA, 101 bp, Zea mays
gaaagagtcttgcctgcttgactagagaatgaaatggcacaatttggtacctaaaatggtcctgatttttaagataacattcctttcaggagagagataat

SEQ ID NO: 6845 - DNA, 1500 bp, Zea mays
agacgacaacatgtaacatggccgatttggtcggactataaagtgtttgcctcgggaacaaaagctaagaataccaacaatgacatatggtgaaggtccagttgatgagcatttctccttcaccaaagcagcatgtttttacgctagatctgcacccacaggaagatgtttcacatggtaggttaaaaagtacataaacatggataaatcacacagtaagttgcatcgaaaaccagaaccagtctcacaattttgcttcatcaggacacgagccaataaaaaagaaagaaagaaaccagatgggagagaaagagtgtgcattgcattgcaccgagggagggaggagagatagacggttggcgtggctgtgacaaccgttctctttgtgtttgctttgcttccgttgcagatagaggaggcaaagcgttgtggcggccgagcatgtgttagggaagagaatctttaaagccacacacgacagtggagctcgttcgctcgaccatctggtgcgtgcagtgccatcatgttccaaacccacagcatcgaattctcctcgctcttggcctctctcggctctccggtctgcgctctgggcctctgcctcttggctctttgatagatagttcagattgagatcaaatctgaatatctggatgatctcctggatggccggatgagaatgaggatgactggatgagtctatttgggggctaccaactgtttcccttccagtccacttggaggctaccaacgacctgtctgcctccttgagatcttgaggattagagagacatggttagaaaacttttcgtacctgggtgagcagacgaataatgggtattcgaactcatggagcaggagggtcacgacgcagcgaccgtcagcactgttgctctcgccgacggggacctctcaccggaagaatcacgtggcgtggagaagagcggggacgttcggggaaggagggccaatgggacagggaccgctaccaggccgccgccgccgacggagaagacaaccgctaacagaatcaccttttttgattgtgtgttttttcaactcgtctctggaagggaccagagtctcccgtgatgtcgtgctagctgctgagcctgaggagatgtttcatggccgtgcttgtcgaatccaacggctaagaagaattcaggagacgtggacacatgtggtgtgagctttgcgtcgcgctctgtaatatagaattgagtcggttctttgacccaccgcggagaatttttttggtcagctcaaacggtatccatccatcagttttttctctcatttccttatcctctgtccctacccacgcgcggcgcccacgactccccgctccgctgagcgcccgcggccggcgccctcacgcccacgcggctgggcctggcgcccgcgcccgtggccgtggccgccacttccaagctcatagcttggctcgagcaaagaggtgagtgatacgccctgcgtcagtgcgtggtaggcagcacg

SEQ ID NO: 6846 - DNA, 911 bp, Zea mays
gcctatgttgttcaatgagtgttaggtcactttctttttgaacttattccgagagcaacttataagcaagtgtggtgtgactatcagtccaatacattgcatcacagtgaccatgattttctagaacattttcatcacttaaaacaagattttccaacaacatacattgcatgaaaaaaaattaaagactagtttgggaaccttatttttgtaagagatttttatttttccaaaaaaatcagtttatttttctttgaaaaaaataaaaatcctttaaaaatgaggttcccaaactagctctaagtccggaggaagcgraaaagaaacaaaagaaagaaaacataaaaatgaaacggcattaattgtgtaattggacgaggatgtataaaataagattttgtgtagcattccttaagaaatcataaaaaaactgaattcagcttccaaattcaccttttggagcgtttgataaggtaaagcacatgctgatgaagttggaacgttttataaactttttatgcaccgaaattaaggttaaagaatgtcccatctgagaagccgatttggaacttggaagttggaatgcgtccacaccccacgtccacggcttctgaagaaaaaatgtacaacagccagcagtgggaaagaatcaaacctgggctacttgattcgaagcaagcaacagtcctcaaaactcaaaagaactcctgtgtcccgcgccaccgaacaaaatcttccttgttgcagcagatcaagcgcatcggcatctgctcagacctcatccatctccctccttaactttccctccaaaggaaaagcatctctcgcgcctaggccatcatcgtagccctcgactaaactaaactaaactaaaagcaagacagtgagcgccctttttcttccgttgctcc

SEQ ID NO: 6847 - DNA, 179 bp, Zea mays
ggtaagtacttctatattatagtttcaactatggcaatgactcagtttgcatgaatccattagacacactcctttctaattttcactccctatttacgtttaaacagtaaacatgtgaattgttgttgaattgtagtgtccacttggtggagttgcttggcacaggtgaatactttgcc

SEQ ID NO: 6848 - DNA, 1500 bp, Zea mays
gacgtggtgtaacttcgtgcaaggaatccctatggggttttaagaagagagatacactcatcacaaaggatacaagaagtcaatagaaattacacaacaccacgtgagtacaatgatgtgggatacaactgtatcaagattataggctttccctggctagatcaatgcactcaataccatgtaccctgtttgtaattgtggtcggtgaagcgttggtgaagacaaacacttccttttcatgtctaaagaaagaggggagagagatccgtagggaggctcccttctcatcttttgagactgtccgcagtagaccttgtaaaatagatgatttgtattgtaggagacactttttatagagtgaaatttgaaataagggatgagatatgcgatgtgttagagacagtataatctgaatcgaggcgtcaggaggtaactaattaaggccctgtttggtagggctctttctttgccagcttcaaccctggttttggcttctctaagaaaacaactctcgccttatttttgagaataacttttaaaagagcaccatgtttgttgaaaatatagctccttaggtagcttctcatacgatgtagcgccaacgaagagaaaaacgtggaagatgagttgatagaagctcttttttctggctcctgtattctgctgtttttttagaaagtcctccatatttttataaagagttcataaaaaacttttcatttggtagattttttttagaaatcgttgaatgagtccttgaaggagccctacggaagagagcctaacagtcaagttattttaggcatgtccgctgyttggacccatacgtcagatgtaacaaaatccaggtggggcgacagattttacaacagggaaccagattttttttagagcggcaacgaggagacccattttgacaaattctctcctcgccctcgcctccacttttgagccacagacccgagcgatcgtgccccggcccccgatcctgattcccacaaatttccgccatggcgatccgcccggactgatgcccgattctccatctgacgatcctcggtaagccttcgccccccgctggtttgatcctgcgtgattgacatggcttgtcaggttcttgcgggttcttttgcgtctttttgttgtggttgcagattcgtcttgcgtatgagtgttccgcggattccctcgttgcctggtcgagtatttgtattttccattggcccattcgcgacgattcttaagactccttcggttctatagggttctgttaccaatccgtgggttttctattgcagaattgatcttttttcttgcgaagtcttcgaccactctagtgcgctcctttgattctcttctacccctgcgaatttcgttgctgaacgtcatctgtccgcccgcatggtcttcttctggaggaagattggggggaattctggtggggttcgtgtgggcgcgtagggcccctgacgacctggcctgacgcatcagcggcgagcc

SEQ ID NO: 6849 - DNA, 629 bp, Zea mays
aaatttatccatgaagttatatcccaaaacctgatttagctcttcaaatgcatatatggttcaacatgagcattgcacacctaatctgagtcctcacatgtaaaagatttgtcatgggactcgcaggccgggagcacactgccaaacaacttctacattgatttgtgaagaagaaaaaagaaaccaagactgagatatgaagatcttaatcctttttctctgacattacactcatcagtgatgagtcaccaccatattgaatgaaattgccaccatgaagcgctttctagaaaatgattttgattttatttatgttggcacttgtagtggatcagaaccatatattctttgctgtagctgtatttaatgctctttcatagagggttaacaactattcaatcgcttagtcggtagggatcccctgtatcacttcctggattagtgagcacaagatcctatattttaactgacacagtgttctaaaaaagggctaagtggcctcctggtgctgtctaccaccagattgtgtttctgttatccttttttggtcttttgctgtgaagcctacatgtataatcggatagctccacttttctattttctttaatgtttcaggtaaaggtttggtt

SEQ ID NO: 6850 - DNA, 1500 bp, Zea mays
caactgtgcaagtgcaccaaaaacatgtagctacatccccacgggcacggaccgtcccctgtcgcacaggaatctcgtggagcggtcaactactgtaccactcataaatagttcagatgacacatggaacatgtggtcgatcggtattgcccggttgtgccgtcggcctccgatcggtctagctggccggtagtacgaacggtgccgtctggccgtggttaacagtcgcgccacacgacgagtgcatgtgcatcgcagagtcatttcatggggccgcgcctgggccggcgattgcgaacgcgcgcgcgtattccactagaattcagtagcacgacatgtactacgaccatctcgtagtatatattcgtattccataatccatactctctccgcttccgtttcgttttagttgtcgccgctagtgcaaaacaaaacgagttataatagttgtccctctagttgaagtaaaatgtaaactaaactaccatttttgccttttgcagcaggtgtttaccgactaaggttaggcgaaatatcaaggtctaagccgaggcttgtgggagagtaaaatcgtccattcataggttccttaatctagacgaagctgttaaaaacgacttataaaatgaaaccgagagagtatatactcagctaccgagacctaggcagtacgtactgctgcagcatgacgcaatgtattgaaccagattttgcaacgacaccagcaaataaacgcatggcgcgcgcataagatggcttggctacaactgaaagttgggacatgttggaacggcacaaccctaaatcatcgtgctttggactaatcattttttggttagtatagcaaaaaataattttagattagatagggtccaaataccaaaaaaaaggtacggcacagcttaggggctttttgagatagttttttttccttttctggagagcttttctaagaatctagatttttaaataatctagctaaattataagaatctagatgtaacggagcttgtgtgagaaggaagatggagtatgtagtatttagagtttaggaagtggtatattctttatttatgactcattttgtatggtgtcgatctaaacatagtctatctagtccagttatacactatatatatatatatatatatatagcattacactcgggcccaaatatggcccgatctagcccagctggtggggccaccagcagccactgactcggcactacaaataaggccgcgaggacgacacgctacaccacacctgcagagcagcaagactagcttgtggctaccagcctagctagccaccgccgcgatccactatcatcgcttgctcgccgagtttcctgcggcggccggcgggcacctacatctcctctacctgactggctagtcattagcacagccagtacgtacgtagctcgcccggccggtgctcgacgacacagtgaattggcgacgcacgtagctaggaggccagcagctggggtcggag

SEQ ID NO: 6851 - DNA, 416 bp, Zea mays
taactctggtggtaaaagcatcaacgttaggttgctatgatatggccggactaaggagtgggccgatcaacggtgtgggcttgtgtacaatttatttggctcaggagtaactcatgagccagttcgagtttgacctgttaagaactgagttaagttgttaggtcagctcgtcactcattttcaacgatacgggaatgagtcgagcgagccgaaccacgagtttttttaaagccctagatctggccgcccacttccaaacagaccctgacgatcgctttaagattcgcgcaagcacgatcaccgcccgtcaagaggcgattccttaactgacgctgcgactccgatcacccatcaccgctgccctctctcctctgcctacgccggcgccgacgccggggctagaccgtcggggagtc

SEQ ID NO: 6852 - DNA, 329 bp, Zea mays
cgttccgtacccgtgtgccgtaaaggcgtaaaccacgtattgcgaaaacggctcacagtttcgatgcgatcgaagccggaagcacaggtccgtcagacccgatccgagccccagattccagccgaagccgaccccacacatctctcccggtccaggtagttacgcgtcctcttcctcctcgtcgcctcgcctcccagtcggccagtcgccaccgcccgagaagccgagcccgcagccaccggatcccagcgggcatcgccacccaccccgctctccatggtggcacgcgagagcgagacctaaccctaccttaaccttactacctcaca

SEQ ID NO: 6853 - DNA, 58 bp, Zea mays
gcgctaacttttcgcaggcgcgcgtgcgcctgtaccttcatgtaacagggatatgact

SEQ ID NO: 6854 - DNA, 509 bp, Zea mays
tgtcgatcgcggatccactgtactgtaccggacggacggacgccgcgccacagcctgcaggagcagacgggcagtccgggatccagccgtatccgatccgcggcgcgggctgcgtatccaccagattttactagctgtccctcccgcccgcctgcctgcctacgcgcggagagccaggcggcgaagacccctggtgtcgcgcgcggtatctctcggtcgccgcaccgccgctgcttccctgatctcctccgggccggtcctcctctccgtctctctatctctctcggtctctccagccccgtagcccgcccgcccgcccgcctcccaaccgtcccgcgtgagtgcagaaaggcgccgcgtgacgagtgttctaccacctggtggcctggcctctacctatatataacccyaccccgcaccacaccacagagatccatttcgaggactcgtactaggttcggcgttcgtagctcgtgtcgtttctgaagctagatagctagcgacaggcg

SEQ ID NO: 6855 - DNA, 1500 bp, Zea mays
cataatatattcatctcctttaatactagtattaagttttagtagtcgactagtcgggctttatgcttgtgttattggtggtattttggtccgatggtttttttttgcctagttttcactcaaaaaaatggattgacatttttttatatacaaaattcatgtaagtcttctgacgtcctttgaaaggaattatcgtgatcttttttctatctgttggcagctatctgggtgccaaacacgggaacggatcgcctggcgggactctctgtggaggcacggacggtccacgacacaggtccggacggtccgcgacctgacgcaggagcggctccttctctgtacacttccggaaggttcgcgatagcgtagagagtctttttctccgcgaagaaccctagaactcgtcccaggagagatcccgtcgaggaggagagttccaaggggttgctctgggtcgacagaccgcccggtgctcctctaatcggcatagatttaartagagattgttgtggaagactaaactatatcttatcctaaggctaaattactcctactcctaggaattggaagaacgaaaaggtaaaactgataaatagatttgatttgatcgattgtgggggttcgcccttcatctatataaagagasaggtctgaacccgttacaaaccaaactctcgagttaattccgcgaatttagctaacaaccgtagcaagaaactcggaatattaattgattctttacgcgcgcggaccgtcggtctcagagtcagactgtctgtcctacctattttggtgctcaaaactatctagcttaagaatttatttgatccgatgaacggtagagacatagggctaattaggcctgctctatttttctcgtgttcttttttagttttcatctctcatttgtatagtaacataaacatttattttagttggtatacatatgtatttcgtcatcatgaaccatcgataggaaggcacaatcagagacatgttttggtcggttcatgtacttccagaatagaatagcacaaaatccaaatccatataccttagcagtctagcacacagcaagaacacagggcaaaatcccctaggatatgacgctgacgcgtcacctcgactcgtcggtgcaattacgaacgcacctgcaactgcaagtctgcaacctaagcgtagtgctgcagcaaccgctcggcctccctcacaccgctcaggtacgcggcgtgcgtcgtcgagtagtgcgtccggtgcgtcgcctcgccggcgaacagaacgcggggcggcggcgcgcgggcaacgtcgacgtcggcgtccaaccggcgtggcagcggctcggccatccggtcgaggtcctcgccgctggacccgacgggcacgtaggtgtaggatcccaggaagagctggtccgtggcccacccgctcctcttgatccgcttcaccctccaccgtgacggggccgggaggaaggagtccagcgtggagtgtaccccgcgg

SEQ ID NO: 6856 - DNA, 509 bp, Zea mays
ctgcagagtagtgtgtagtgtagcttgttcactgtgtagtgtgtagtgcagccactagggctataaatatgtgtctacaacccttagatgcgtatggcattgtgtagtgtttgagaaaataaacagaaaatcgactcaactcatagtgtcatcctctcgatgagagtagagtcccgttgcttacattgtcaagattggtcaatggccatgctgttattcatacccctatcaaatccttacatcttaataatgtccttcatgttcctcaagcccaaaagaatttagtctctgttcatcgtttttcttctgacaataatgcctcatttgagtattttcttgatcactttttaattaaagatctggtcacagggaaggtactacttcaaggtagatgtgaagatgggctctatcctttgcctatgtccagtccatggtgagtagggatgaaaatgggtatccgaatggttaggacaaatttaatactttaaactagatatgtatgaaatttg

SEQ ID NO: 6857 - DNA, 419 bp, Zea mays
ctgcagagtagtgtgtagtgtagcttgttcactgtgtagtgtgtagtgcagccactagggctataaatatgtgtctacaacccttagatgcgtatggcattgtgtagtgtttgagaaaataaacagaaaatcgactcaactcatagtgtcatcctctcgatgagagtagagtcccgttgcttacattgtcaagattggtcaatggccatgctgttattcatacccctatcaaatccttacatcttaataatgtccttcatgttcctcaagcccaaaagaatttagtctctgttcatcgtttttcttctgacaataatgcctcatttgagtattttcttgatcactttttaattaaagatctggtcacagggaaggtactacttcaaggtagatgtgaagatgggctctatcctttgcct

SEQ ID NO: 6858 - DNA, 1500 bp, Zea mays
tattagtctactaatggattttgccttctcttggtggtagctttaactgcgatttcggttgtttgtttcgtttctatcagatattaataatctaaaatggtgtgcagcttaggttaaaatcaaaaaaatttgtcgggcggataatacaaggcctacaccagaaggaacaccctttgtgcgacaggcgaacagctgtctctatctctctctgcagtgttatttggtttattatatgcagttgcaggggagaaaactaaggcatgttcactgcagctagaagcacagccgcagcagatgcagcaggcttcttatagtatttgcagcttaggtcaaactttatctgttattctagsccctccactgatctagtttgatagtgttaggagtctagatagtctagatagagatctgaccttgatcattccttttggattgttggtcgcgtgagtgcagttgtttcaaactttcctatttcttaatgaaatagggggcttcgccccttcataaaaaaacttgaaattgacaatccaaaaacgcgcaaaatctataatagaaattggcattcctgtctgttcttaaaaaatatattaactcatcatgcatccagaactttgagcccgtaaacacgtttcggcactggtgatggataaaagaagtattaatttatcatgcatctagcacgtttgggtcgtgaacgaaaggtaaggtcaacgatttaaggtgatgagtcgtagacgagaggcgattgttgctgaagaagagcagaggcgtgacagtgaaaagttgtagaggttgaggtggtgtggtagtgtaacgaccggatcgaagtagagtttggctaactgtggaagatggtcgagcgagacgtataagcggcggtgctgtggacaacaatattatctacaacgtaaatcacatattttacacgatctactgtggttaacataaggttcttaaaatctttgagacagccctgatgctaactatggtaagatggacaaattatcgatattgttgcatttgctctaagcaaacttatagacacgctttaatctaatttccaataaaacgacctggcaagttctacgtaaaaacaggtcaaaaactctccgtgatcgtgaaataaattactgacgttgacgaagttactttaagaaaacttttagatatatatatttagatcatattttttcaatcgaataatatgacgagttatatttaggtgccgtttacattccaaaagttttgataattaaggaaaaaaaaacaataactttattagattttaagatgcaaaaaatctgtgttaaaatttctatgaaatatagtccctttaatctagggatgtacgtttttttagctaggttttcaaaatcgataacggcgtcttacatacagaaacagaatcaaaaacctcaaataggcaacagtccaaaccctggtcaccaagtcaagcgaagcgaaaccatcccacgccgacgccatcacgcggcggcggta

SEQ ID NO: 6859 - DNA, 1032 bp, Zea mays
gtggcacagcatggcattgaccgacgaacgcttcctagtcgacctttagcttcgccttgatgaaccgtatgtgaggtggaatacggtgaaaagcaatttctttccgtcgtttggttctagaacccgattgattctcataattaaattttagtctctatctgcttggttaagaactaaacattttagaacaatattaaatatactatagaaagactgaaatagccttgtatatttaagacgtcatagagtgatcaataaatgaagggtggggagaggaataaatctatttaaatccattttagctacctttttgacaaatttaaaactaaaaccaattattatctactttaagttttttcgtttggtgaaaaatagactagaagagactaaaactaatgactagatattagtccttggaataaaacgtagtcttagtctgtctttggtcgaccgtataaaataaagaatataataatatatataataatgtttgatacttttttaggtaaagtttgaaataggatgagacagtgattatatacgtgcggtctgcggacggagagggaacggccggtcaagatggatggcgattggctccgtgttcaatggagacggcatgggctcggttgggaatcgggacagagaaaaaacgccaccatggccgcgtccattggagcccagtgggacaggcatcatttggcgtcgggccggtacggtattggcggcgggccagctgacgagaaggaacggccgcagcccatcctgattcctgtcctcccagcaccggtgtctcatcaggaacaggaagcgaacaccggcggttgtcccgttccaattccaaccaacctacctaggctccgcgcgcacctaccccgtctctgctccggggagcgtcaccagtcagtcacggcggctctaaaatctcagataccaccagaccagaccagatccgtcccgcgaatctaaggtcaaaccaaccgcgatccgcgaatccgcggagaggaggggaggggaggggaagggcgcgggggc

SEQ ID NO: 6860 - DNA, 393 bp, Zea mays
tctgcaacacacgtacggtacattttagagaagagagctggtactacacacaccaccgcgcagataaagaaaaggaaagatgatgacttggcgcacacccgcaaaccaaggcgatgtcggcgaagacatgtctgtcggttgccgctgttgtcacacactcttctgagaaatggaagacgctttgctgtgcaccagtcccggagcagaggaatatatatacacctgcagtggtgatccgattccgaccgacgcaacgtcgctgcttccttcctcccttcccttccctttcctatccttcccttatcatcggtgctacgttaccagtatatagctctgtcgtgttgtcccatgtgagccggtggatgttcggaagcaagctttgtcgacagacag

SEQ ID NO: 6861 - DNA, 265 bp, Zea mays
tctgtctgtcgacaaagcttgcttccgaacatccaccggctcacatgggacaacacgacagagctatatactggtaacgtagcaccgatgataagggaaggataggaaagggaagggaagggaggaaggaagcagcgacgttgcgtcggtcggaatcggatcaccactgcaggtgtatatatattcctctgctccgggactggtgcacagcaaagcgtcttccatttctcagaagagtgtgtgacaacagcggcaaccgacagac

SEQ ID NO: 6862 - DNA, 138 bp, Zea mays
gccgggcaataggccatcgccagtacgatggcagccctgagtcagcccagcatatcatgagctatcaggttgcgcttgcatcatcagtagacgcctaggcctctatgagcgtagtcattggtgtgtgccctcgaaggc

SEQ ID NO: 6863 - DNA, 214 bp, Zea mays
ggtaagattttgtgggaacaacatgacatttcacttgttacataacttgttaatatttctagagtctatcttcaggaattttcttttacttcatctaatttatgagcaatggccagagcttttgaagaagttattctacttttcctctttgttgcatgtattgtggaaccttttcatttgctactaattaggaagctctgctccttgattagat

SEQ ID NO: 6864 - DNA, 106 bp, Zea mays
ggtacctaagaacaaggcctaaatttgttttgtaggtttatgcatccgggggctcaagttggatcattgatagcgggtgcacaaaccacatgactgggagaaaagg

SEQ ID NO: 6865 - DNA, 1414 bp, Zea mays
ttgtggccccttcccctgccacaagttgttcgcggcgctcgagtccctcaagaagaagggcaacaagggcgcggacatgccctcgcccgagcccccgtcccgtgcccctgcccctctcccacacgtgttctgaggcccctttgaaagggaaatgtgcccttgggccatttctaagtattttggtgattaagtgtccaacacaagtgcctaagtgttaaattgtgccaaggactcaagaagtgcaaatcaagattaaaggtatgtttctagacttagtacattgatttggagactaatgtattgtgtctaagtgttagaaacaggagaagtcaagttggaaaagacagctcggtctgggtgcaccggactgtccgatggtgcaccggacagtgtccggtgcgccaggccggtgtctgtcaactggcttctctcgggaagtaattaacggcgtacggctataaatcaccggactgtccggtggtgcaccggactgtccggtggtgcaccggactgtccggtgagccaacagtcggtcgggccaacggtcggtcgcataatacgcgcgcgacgcgtggaaagagccaacagtcagaaggggcaccggactgtccggtgtgcaccggacagtgtccggtgcgccaacggctccaaagcgccaacggtcggcttcgccaaagaaggaaagaaatccgcaccggacagtccggtgtgccaggcgacagaaggcaagaattgccttcttgaaatgctctcaatggctcctagctgccttggggctataaaagggacccctaagcgcatggaggagaacaccaagcattccttgagcattgttgatcactcacacttcattcttgcgcactagttcgacattcttagtgatttgagctccgttctagtgagaaccttgagatattgtgttgagctcaagtcttggtcttgtgtgtgcgtatttgctgtggctttgagtgtgttgcttccctcccttactcttgtgcttcatattgattcttattgtaagggcgagagactccaagttatggagattcctcgcaaacgggaaagagtaaagtaaagaagaacgccgtggtattcaagttgatcattggatcacttgagaggagttgagtgcaactctcgtccgttgggacgccacaatgtggagtaggcaagttttgtacttggccgaaccacgggataaatcctcgtgtctcttgtgcttgttcttactatgtctatcgtgcttcacaagagctcttctctctaatcacttgatctcattgttctaactcctaatcaagtttgtggtgttaagatttaagtttttacaggatcacctattcacccccctctaggtgctctcaattggtatcagagtcgttctcttcacgtaagggaataatcgcccgaagag

SEQ ID NO: 6866 - DNA, 473 bp, Zea mays
atagaagagtgtattataagttgtatgtcgaaaaatatcatgtaaatctataaaatcaatttccattttttatctctatgaatttgagatagatttatataataacttcggaaagtagtggaatgtcatattctaaaaaaataaactattttattagtaagattttaatttctcaaaacgaaataaaacaacggaaccttatggatagccatatcataaactggcgatttcggcggataccggcgttatggataggcacgagcggtgccgacgtaccatgtcgtgacgaggaaaattctagcgatccgcgcgcggcaggcctgaagagtcacgctagtcccaaagaaacaagcgagtacccagagcagccgaccctggctagctctagcttgtgtagttgagttcttgtatttgcttgaatctgcaaaaaaaaactagagacaaaaggaggacgggaaacggagagaaggatc

SEQ ID NO: 6867 - DNA, 400 bp, Zea mays
ctggcgttaggcttcaattaattatataattaattaattagtttccttaggcatccatgatccatcgatcactccatgggtgttcgcatgcatgcagctaggatagcgtagccattttgaacacgcatgtatatgcccacacagtgccgcttgcagagaactcaaaatactacttgcaagctgtctgccaagctgtgactgcgattgtgaaaacccgtgttgcgttcaattcgtgctcgtttgcttgcttggttgaatctgcagcctacaattatttaattgagctctttggtctacggcatttatatactgtggagtttgaaatagacaggggggaggggacagcctttgaaaagaaaacccaccccaccgccgcgggggaccaggcggacgagcagga

SEQ ID NO: 6868 - DNA, 531 bp, Zea mays
attctatgttaatatttacatgtttatttcatgatttatgtgaatgctttattcttcatttgttatgcttacgaaggtatgttctttgtaaccttcgtccgagatgctatatatcccgaagggatatatcgttatgaaggacgaaggaccttaatacttaacattttccgtgttgccttgttcttaattcgaagcatttgagaacaagtccccaacaatgaccgagatcatggcttcccgactcaaagccaggccacccggactgagtcggcaacagcttcaactggtggtaccacccggggacggtcgaggaaccaccaccgccactcccctccccgggacaggcgtcatccccgacgacaggaggatacgtgcggagtatccgctcttactccgcgccttagggccatccagtggcctcccaacttcaaggtatccaatgtcgacaaatatgaacctaagcaggatccagggggttggttagccgtctacaccaccgctgctcgggctgccggagcatccgaagacgtc

SEQ ID NO: 6869 - DNA, 1500 bp, Zea mays
cccacgcgtcgccgtcgagccaggctatgggcatcgcatggcgcggctggctgggccgtggttgtgactatagatcgaaccttggtctgattacctctaaacgatcgagcagttttggctggattaacgtctgtccgtttttgttcattacaacacttgaatggaataatgacagcagagcatcccgtctctccaaaaacgcagtgcagacaacatatccttgttccatcttctgcgagcatagaatgagcgggagaatagtcctccgaaatcaccgtcggcagagatacactttcatgcgtgtgcgggcgatcagatttttgggcagcgtcttcgtgactgctcatgtggtgtgtttatccacgtctttgtcccgttgtttcgtctacatcctgttgttcgtcgtcttcttgacgacgatgcgtgctgttgttcttcttcccggtgatcgttcgagggactacactgtgtacatcttcctgtatcgagtttgaatagctacagcgaacgaacacacgagatgtctggtgtgaatggagccactgatgctttgaccattggtccctctgcaggatacattctgttctttgtatttgtgcatgtttcattgttgtttactactaatgcgagtagttgtacgcacatgcacatacatgacatcacataaatcacattgttgttctggattaaattaatagtgaaaatgactaaatttctaacaaccgccacactaggtggcacaactaggcctgtatgtgtctgttgtccatgatcacacgaatttctactcctttaaggcaccagttttgtgcattgtatgtcacgtgcaaagcgcttaggtctattacatttactcgcttctcgcctatcaatgaactattacattatagatgagttgtgagaaatcatataagcctaacatgatatgaagcaacgcaacactttcacataataccatcttactagttaaagaaggacggacgagcaagggagctataaaaaaagagatcgagacccttctcaactcgtaactttcttggtcttttggctaaaacaaaatataatatttgttcttattaatttaatatctaacgtgtacatatgtttagtttgatatagtattgtattagttaaaaaagtaaaagatgtgtgtagggaaaaacacaaggcatacagcttcgcatgttcattgaccggaataccggatacatgttttgtcgtttcaagatatatataaccgagacctattttcgcatatttttgtggggtaaaggcctactttctgattattccatcttgttatatggatcgtgagcggaacttactttccgtaccattcttagggtttgtttagaatttggagcggtgcctcagttctcatgagattccacaaaaaatctgtttaaatttttacaggtgacaagaaaaaaatccttgtatttatatataaaaaaaccgccgtgcagtgcactttattttcacagtagtatattgcgttac

SEQ ID NO: 6870 - DNA, 646 bp, Zea mays
tgttctgtgtttggtaagaccttgttcgtttgtgccggattggtgggtcagaacgattactaaccggattgcttctctaatttatataaactttgattagctgacttgattccgggtgcaatccgacgcaaacgaacatggcctaagttggaacggagcgactatgttttttgtttggttgcagagtgaactggaacagagcggctctgttttttgtttggttgcagagggaggcgcgcgagctgctgcacacagatgggagggcgagctgtgcgagcgggctgggaacggagcgactccgtcccattgatttttcggagtggaatggttccggatctgaggagaatattccctaattggagtcactccgttctagttactttgtaaccaaacaacaacaaaactgggacagaacggctccgttctacttggctcttcaaccaaacactaccttagagaaccattggagttgctcttaccagacatgcactgctgcttcttttgccttcgaaaccatcccgaaccctaaattcgaatgcggaactcaaatttcggtttccctcgcgtcctgcccacatcgtccgcatccgccgagcctagccccaagcggaggagaataggagaggccaccgatccgccgccggag

SEQ ID NO: 6871 - DNA, 801 bp, Zea mays
aaaaggtttccatttgggaggtaataaagtgcggaggaaaaagatacaaaaataatacgaagcttgagaaaacgtacgacgttatttttgtagtagtcgtttatatatataagagaaaaaagggagggttagaacttagaagaatgtgtaggtagccgatcgaagctgggaacagtgcaggccatcatagatattctcgtccgacaggcgctccgtacgacacactgatgacacggcacatcgatcacccgcacaccggcgggggacctataaaagctagccacatctgacgacgacgcgctcgaatgataccagcggggccgccggcgactcgatcggcagagagagagaccgtcgtatacactgctcacccatacgcgcgtgatcccatgaatccgccaacctacgtacccacgtccgtccccgtcctcgcctacgcccgccgaggacgcggaaggaacggaattgtgttctgggagtggccggggccaccaccacgtgaatggccgcctccccccaccctctctctccacacgcctccgcctatcgccatcacgcctccgtcctggccccttcacggcttcacttcactcgactcgtatcgtatagcaggctagcagcagcagcgtccttcagttcacctccctttctccactccccccggcccgtcgctctcccccgcatcccatcgcgaaccaaccccgcgcccgccccggacggtgcgcgtctccactgacccgcacgatcgcgctctcgcccgcgccccggccccggccggccgggtgagcagcagctgcgtgc

SEQ ID NO: 6872 - DNA, 977 bp, Zea mays
tcgccgaggtgagctgggtgggggtttgccttgcgcaaaggggttcttttctattcatatggagagcgtaaagggtttctcgtgctccctaaaaactcaggtgggctgaaaaccagacccggcccatctaacattgcacgcttccccgtcctctatgccgtgattttagcacttttgagtcgacttcgttcttttcgtgttgagtttggccacgagttagaaatcatgccctaaacctaatytgatccaccgacgaattagattaaatcagaattatttttttaatgattattagatcagctgattcacaaatatatttacaacaagtaaaaaccacttgatccgtgcctatttgctggtgtttgagttcaatggacacagccccaatgaacccatatcgaatggtggcctcccctaatccgtgtcgagcaggttacgccaatggaatcctgacctgtaatcatgtaatactgtttcattttgaggtgacaaacatggacttacgcatacgaacaaatttttagaccgtgtctagtagaatgtgaaaataaagggacataataaaattgtaaatgacattatttaacgagaaaagtttgaaaatagacgataagacatggatgttagagatagagtctgtttagttcgtgactacctgtgtcacactttatctaaaattagtcgttaaaattgaaaaactaacattagccaaaaaaaaattaggtaaattgtaagtcttagcccggctggaaaccacgagagatccaacggccacaaagcaaaagcggagggaccgacggttcggatgggctaaacgcagcgagtccgtcccctttcttctctcacaagtagatctcgcggtgttaatcctcccgagtcgcctccccctcaatttccacaaacgcaagccccaatctcgccgtcaccacccccaatccagcaaacgcaaaccccatctcgccgccgccgccgccgcg

SEQ ID NO: 6873 - DNA, 151 bp, Zea mays
ggaaatcggggtcagggaccacggagccaaacgaacagaaccaaccacaagaaccctatatagatgagtattattgtttcatcttaccatatagcgcacatatgtaacttttgataagtacgaagataggatcaaattacgttgtataatt

SEQ ID NO: 6874 - DNA, 517 bp, Zea mays
cgcgggctttcattgctagtgttgcttgttagtcaattgtttatatgagatttataacacatcacatttattttgctatgttatgttatgtttatcgcaccgacagtgggtttcttttggtgacctcacaccggtgagctacttactggctgtggtagttgagggtgtgttgtttcctgttactgttaatgattgcgtggattattgattcaatgcttgtgttgagactgtttcaaaatcatcatctacctgctaacaccttaacaaacgccgctgccaggatctccagcaccaacaaagatacgaacgggaaaccatcttgagccagatcgaccgaagccggaggtccctgcttgccaagctcagagagtacaaagggcaggactgcgaggtgatccacgaggctgccgccttcgctggcgagagaatagagcgcgacgacagcctcgtcctgcctccttactcggaccatgtcaccaactcgttcgcgctcgacgacctgtaccctctgagctac

SEQ ID NO: 6875 - DNA, 571 bp, Zea mays
agtgcatatacctgcaggttttgtatgttttctgtatgcttaaatgaaatggacacttctggcagtattattattatttttttcatcctccaattttcacattttgcatctattaatgtctaaatgagaatgtgggacgcagaaaagtaggcttgggttcacctgacctgttggccatctgtcatatagctgtttaatcatgccttaaggataaacaacacaattatatgattcataatcttcactttctgattatgtaattttgtaataggaaatgattgaatcaagtgcaaataacagacattccacaccaaatgtaaaaaagccaccatcaaatggatgtgttaccgagtttcttgagtaaaactcagtttcaagatggtgctgagtatgagaattataaagatcggtctaaatttcttgttgtcttaaattttgaatgcagcattgcaatggctgtgttcagctgcacttgctgtggctgcagctctataactacaaaatactgtagcgtgaactaaagaagctgcagccgcagtcagaaatgatgtgctcttgacatgtacaggaa

SEQ ID NO: 6876 - DNA, 697 bp, Zea mays
gtcgtcgaacattctgttggatggaagtttctcaggctgccgaaccgagagagaaactggacaggtttcagctgaaataattctctgatagaaactggactgatcaagtgaaagacctggatcaactaaaacctggctgttactgttcctggcctggaactgaaaccgggctgccgaaaatagtagagatttcctagttttgacaaatttctcgcttttggaaaggaaaaaaatcaagacgaggccgcacggagcccacggaaaaaggcaaggcgaccgccactcgccatcgtcagttcgtcacccacccactcacccatcccgatccaacacggccacgccgcgcggctgcggagcagcggagacgggcgcccgcaccaaccacggcacgggctccgcaacgatgcggcgccgtactcccgttggctcgtgccgtttcatcgcgctaccttccttccttcacggagcgactgcgaccaatcccgcaaaaccacccacgcggccgccgcggtgggcgatgccctccgcagccggtcatttcaccgcggaggcgcggcccacgcccgcggcccaccaccgcaccgcctcctccttttatgaccggttccccacctccgcctccgttccgcatctccaccaccatcaccaaaccctaatcgcctcccttcgccaccgccgccgccgcagctgaccggcc

SEQ ID NO: 6877 - DNA, 629 bp, Zea mays
gacagaaatgtattgtaaccagcaaagccccaacaattatttgaggtgattcttcataatatccttcagagagacaacaaaaatattattgaaaccatccaatgtttattatctcttgctgaaaggacaaatgatacaagagtacaagacctacttttgggagccttatatttgcgttttatgtaaaaaaataaagtgaaattatgtataaatgagtattcgaactttgttgttggctccacgttcacactcacctaatcaataaaaaacatatattttgtgttttattaaaacaaaatttattctatgtcatatataaaaatcgtagcaatgaacatgactagtagacttttattcatcggataaatttcaaagtgttattctatgcatggtctcatacttagtttcatagacttttattcatttgataaagacgcaattattgaataaatcttgaagctatgtctctttcgcgtaatcgggctataaattgtatactccacgccattttttccagatcaaaaaaagctacagccacggccaaagcagagcaggagcaggccgcgcggaacgagggaagcagcaggccgctagactagggagcggtcgccggcctcggcggcggaggg

SEQ ID NO: 6878 - DNA, 962 bp, Zea mays
ttcaaaatattttataattaaaacataatgattttatatatggtctatatatgcgttgctatattttaggtatccaaatttcagaaaataatattactatataccaacttgtacgattaataaaaggataacttacaagagatgatttataattttttctatagccaaataataataaaattatattttgcttaaaattagatccgatctagacggaaaggaacgaggaaaggtcgcaggaacaagcggcgcttggcgcatgccgcgactcgcgccctgggtgaaaatagctctaaaatataggtgaagtagttggagttatcgtttttaagaagtttaatgttttttacttatcaaatatatacaaataatattaataattataggtataattaatatcattggataaacatttgaatctatttttataatagatttatttagagatacaaatattgttaatattttctatacatttagttaaatttgaaaagctttgaccgatatgattatatgaataataacgtagcggtaattgttttaggacggagaattttgtttttagtagttgtatatacatgtgtgtgttactacttctttgatttaaccttcatcaatggcacataatcgtgcttttggcaagcatcaaaaagagcgtgtgtaaacagctcatctgagatttgacccacccaaaagcctgccaagcaacgaggaagcaacagtcaacagggtgtccgtggcgtgggccccacagaccaccaatgcgttcgacggtcaaacggcaatgggcacttggggaggccgcgccgaatattcgggcgcgttgggaagaagatccttctccgccgcttataaatagcggccgtcctcatccctcgctgccccaagaccaagatagaccacccaagcattgaagccgtagccgccgccgccggacgagacaggttgagggcggggcggca

SEQ ID NO: 6879 - DNA, 174 bp, Zea mays
ggtgagtatgtagtattctgttttactcagaaatgaaacaggattgaactcatatatttgcaggaggctcaaactggagttgtcccgagcccaatcgatgtttataggagagggcatcgagcgaaaaacagtgaaatctccgacgagctgtgtagtcaagcggccattgagcgt

SEQ ID NO: 6880 - DNA, 854 bp, Zea mays
cgaaccaagtaagctagctagcttaatgagtcaactcgagcatgaacaagcacagccgagctggccggatatccagcccgagctaaaagaattgcacaagcctttagcaggtagccgatcaaatctccaccgtcctcatcgttgttaacgagaaaaatggtcttctaaagtctaaacatcgtgctttacatttttgctatccataacaaaatacgacgtaaaacattttatatttagatcttgtttgaaacagctccaacttcaaaaaaaaaaataaaataaataaatagtaaagttagtggagtagatcattagatgtccaaaaaattatggatctaagctataaayttttaaagacatttagataagtcattttatttattattaagattaaaaatatacttaaaactatttaaattgacattataaattaataatgattaatgtccacactagagcaatcccaaacatccctttaatttcaatatcatttaaatattttttgttatgtccccttaccaaagataaaaatatctaaaataacattgcaactaaatataacatattctgaaatatttgtttttgcgaaatcaatgttatcaatggccaaaagtataaagcgtattgtatttacagaaatccaattttatcgtcgtcgacgtcgatccctctctcgttctctcaacaaatcgacgaagtccctgaactcatttccagcctctccgcgccccaaccaccgccaccgcgtgcgagatcacaagcctccacaccgtgaccaccggcgccgctgcggcgtcctgagcaggcggcgagcctcgtgcacagggcaggctcggctcgccggggcggacgag

SEQ ID NO: 6881 - DNA, 266 bp, Zea mays
taccggcataccctgcccggcaatccgatcgagccaacgcttggagacgccgtctccgattgaagtaggggagagcggggtgccgggggtcagtttgttgccggtcatcctcctcgtcgtccaaccaggtgagttccgcatttcacatcatccatgctcgccttttaattttatatgggaacactaggtcatcgcatcgttcacgttcactctctgagactccgagacgcggttgctatggcctatttgttgattattacgggaat

SEQ ID NO: 6882 - DNA, 107 bp, Zea mays
ggtaacaaaattttttttgttattttattactattattattaacttctgggtcgtgttctaacgaaggtcatttcgacagagtatattattaagcaaggttctgaag

SEQ ID NO: 6883 - DNA, 265 bp, Zea mays
ggtagagccatttgccgacagcttctgtcgagttcatgagctgcattaccaaacaaaagccagaaaagatggattacatgaaaattttggttgctataactttgcttatcggaaaaccacgaagtttcccgtgatcagctaccgaagcaaatggccggcaggctagaaatcagagtggttttatgtcaaagttgacgaagacaaagagaagctggttcagagccctcttgaactaaccttcggagaaacaagaccccgatgcaga

SEQ ID NO: 6884 - DNA, 1500 bp, Zea mays
tcgcttctcccatacaattcctgagcactgccagtgaaaatgttggcgggttgtttaagaaacccgccagtgaaaatgccgatttctactggcccctagcactgaagtcactgaaaaacgccagttcaaatagctctagaaccaccactatagagcttctctatactagtgtcgggcgacaaattggctttctctttatatgtttacccttggcgctatgtaataattctcaatacaaatagggagcccgtggtgggctcccggctcaattattctacgaaaacaagatatccatctaggggtctagattgtttggttcaagtggagatggcaacgggatatatcggatagtaccatctcatatcattatttataaaaaaatataacaaactaaataactgcataatttgatagttaaacaaatgaaaggtagctagagaaagattttctttcgactaagatgaggtttattagatggttatagttatataaagcgggtatattttattcatgggtacacggatatgggtaatatcaactcgtaaactcgtacctatacccgtcaatccgataggtaaagattcttatccatcagtatagggtttttaggtaccaattgtcatctctaggttccacgaactaaagtttagtccatgtcacattagatatttgaataaaaattatgagcattaaatatagtctaattataaaactaagataaagactaaacgataagacaaatttattaaacctaatgaagtctatatttaatactcgtaatagatatttaaaaaatattaaatgttacacggactaaattttagttagaataacccaacactctaatatgagatacagcgtgttttgttattttaatacagaattatgactggaagtattaataatggtaatgagttgcaacagaattgtctgtcactggagataacgtagggaggaaaactatatttaagacatgatcacctcggtccttctaragagcatccttccaaatcccggaacacacaagggtccaaccatgctaataaagaaatcaaatcaattaaaccttcccaatgtgtatccagtaaaacaacagtcaagatgccaaatacctcccccttccccccaaccttcacattttccacgtatgtagaatactccacctccacccccgtgccccgtccatttcccatccccaacctctctctctcccccctaggagtgggagctcctggctccatctatccgcctgcagatatcacaagcttttcctgctgctgctgctgcagcagcacctgcagcttctccgtctgcagtgcgagcagctgctaaaaattcccccataagcctctggcttcctgcccccctcactttcttggaagcccagcacaacacgaggatcatattcactccctacagtggcgtactagaataccagttgtgcgcaaacagcggcagcagccgtgatgtacaggtgagctagctctgccgctccactcc

SEQ ID NO: 6885 - DNA, 1079 bp, Zea mays
ctgcagcacctacttttcccagctcgtatctccctcttgatatttcttgccgtcggaaaaatcaaaccgccaaaccgctctccttgatttttcctgaacgcgcggctctgctgaagctccatcgcatcgcattcctatctccacgtcgagcgcctctgctcctccttcctcctggcgctcctctctcctctccatctctctggtcggcctcctctttcttccatctcccatggccggtgctttgctcggattctgccgtcaagctcccaaccgagtttcctcccatggcttgagcctccctgttgctcgcgtcgtggcctggccccagctccagccattgcggctcctatggcgctcggccacctctacgcccgtccatggcgatttcccctgcgatagcttcgccggcacgaatccctgctcgcccgcgccccagctcacctctctccagcgcgcatgctccttccctgctcccagtgtctctctgtggccgcgcccagctcctatcctccatggtgcgtggctcagctgcctctccctcccatggccagcggtgctctagcccctgcgtcgcgcgtctgagtcaccctccagcgctgcgcccgactccagccagctctgctcctctttctctctgctcggcgtccttcctctgcccgctgagtccctccatcgcctggccgcgcccagcttctttgctccgtgcgcgcgcctgctcctatgcggcgcggaacttcctctgcgtccaggtccctcagctcgcgtccatgccgcggcgtcctggtccctacttgaccgtgtcactctgcgctcgcgtcgctgtctggttccgagcgcctgggtcttccttcccctgcgctcggtcatagtcgctgcgagccgtgaaactccctgtgtcgagctcggatccctgcgcagcggagcttttcccctagccaagatcgtcattgcgcgcagattttctttgctgctcgccgcgctcgattcgtcgtgcgctgggcgctgtccggcgccggtattcgccgaccccgcctcaccatgggtgtgtgtcatcaatctcgccctgttctgtccactcg

SEQ ID NO: 6886 - DNA, 113 bp, Zea mays
tcttcatccgctaggcgcgtgcaccgagcccggccgatcggtgctccgctcctccgtccagcggcaagcgcgagtgcgtgcgacgccgatgccgcgctgcgtgctatacacgt

SEQ ID NO: 6887 - DNA, 829 bp, Zea mays
tagagtaaatacccatcgggtatcgggttgcgggtacccattgccatctctagatatgggggatgggtgtgccggggtagaagtatagaacacactgaaacacgttgctgttgcggttacatgcatgtacagcagcagcttaccctccaaaccccatatggaagctttgcaagcttgcatgctactcattcgccatccccaccctcccccagtaccagtagtaggccagtctcgttgtctctttctctataacaccaaagaaggagaaggagattaggagaaggtgaaggaagagggagggagccaaatcctagcgcgcgctagaaaatagagattgttgttaggagtgttggtggaggaagagatcctgcaaccataaaagaagaaagcaggcgaacccaaccaaacataccaaagcgaagcaaaagaaaggcactcatccaacacaaggacaccaaactcgtaaagtgatcgtcggcgtcatatatagggagcagccgggccgtcgagaaggacagtggagctaggcacgcagccgcagccgcagcaagcaagcaagagctgcgactgcgagcaggcttattaagctaagcgacgacctccgttccattgcgaacaggctacagatcagagtgaggaagaagaggaagccgaatttcttttcactctcccgactgacctttcgccggtgcgcacgccacctcgggtcgggagcgtcgatcgagtccctggccggtggcggcctgggaacgtgaccggtaagtttgtacaatataaagcgcggcggccacacagtcacacacacacacaccagctgggagctgcggag

SEQ ID NO: 6888 - DNA, 846 bp, Zea mays
acgatgcattattacaagaatggccttgttatatgtagtagtgtacagtgcagtacagattgccagctgctccgtttagattattagggatggacctgctgttacatgtagagagagacagacaggagatctgtcttgcccaacattaattctagtatctgtaaatcttgttcttcttgtccaacattaattctaggatctgctgctaaccattttttttggatttatgtaaactgagtgattatctgaaatagaatgatctgagtttgctgttccagtactgagcaagtaaaaaaaccaaaaaaacaaatcgcccaccgtggggctcgaacccacgaccacaaggttaagagccttgcgctctaccgactgagctagacgggcttgttttccctttttttttctttggctataaattggatccgcatcagtcagctcaacacttgttacggagcaactaaacatagagagagagagagagggtggatgacgaggacggcctactgctttctttgagacagcatgcatgcatggcctgagcttgctttgagccctcctcgctcgctcgctcaccttcttatctcctccatccatccaaaaatatctccatgcgctcagacggggacgagacgacgggagaaggaggaggagggcgcccgcccgccacgcgcctcctccaaatcccagccgtccacgtgtcccagtccgcgacccccacgcgcctatatccatccatcatcctattcctatcccgccacatagtccaccaccacctattattccgctcccgacgcccagaattcacgagaacgcacccgcccgcctcctccttccgtccccatccag

SEQ ID NO: 6889 - DNA, 288 bp, Zea mays
ttccgcgggtgaaggtgggctgctaagtacgtttgtactcacccttgcttatttgttgtttttcagaaaaaggagatcgggtaagagttacatctaaattaaaaccctggcttcgcctctgctcacagtttatgccaaaattgctgataaagtggcacttcagattatccgagaagttaatggtgtagaaattagaaacgaagtaacttatattctctaggtctcgcgcatcgcctagtgccctagtccatcgagtagcaacgaagcttgacagcaacggagaagacc

SEQ ID NO: 6890 - DNA, 1500 bp, Zea mays
cgactgggacacctcgctcgcggtctcgcccgggccccgcgtgcagccgacctgccgggttgccggccgtctgcactccgttctccaagggcgcgcgcacgcgtggattttgttcatttcctccgatgtccgatccgccagggccgggccgggcggggccggatgctgacgactcctccggtcctgggggctggggctcgtgacatgacaccaccagcggacaataatttaaagccgccttcctgcacgccgtatatatacgtggatcacgggccacttctacataccttccgtgtgcccgtgacatgtgtatgcgagtggttagtactgtacaatttgccttccgccgctaaagatattggaaaagttcccactttctttttataaagtggagcgaaagttttccttgagtaggtgagttcagtaggtttttttttcaatgatacaagagataaaaaacacatttcctaactttttataattttcaaaaccagagatatttttactgcaaccggagagagcagtaaatgtcccaacgatgtcgatgtcaaggtgtcactgttttgtgcgtgcacggcggtcatgtccttgtgcgcgtacgtaagcaggaagtctcacaccttctagaactgggtaagaatcacgctggcaaaagcaaagcgctttactccataagtaaaaatagggaaatttggatccataccattaaaagatcaccactttagatccataccattattatctcacttacatgtgggtccatatgagtcaatgacatgtggggtccatggtatatatctaaagtttggatcttttttaatggtatagatccaattgttcctattatcttctgtaatactatagcatttattctgtctgtacataggtgggatcaaattatctgttaaggttccttcgtttatgatcttttacatctataatttgcaactcatctctttgtttgatttgatttgattgccctgcctgttgatggtgaaactagcgtctgtttgatagaacgcatttttgccggccagctccactcgagaatttgaaggaattttaccaacgtggggagctgaattttttttctgctcctcacattttccactctccacccgcgcctgactgcagctggctgcgatccccctatctaccacctgattcatctttgtctccgtcggtgccgccctctccgccagcctgaccccaggtagcttgccaaacggacaccttctcgattcactttacaatgggaatcaattccccagagaaaggagttaaattctgggatcccatcgtctaggttataagaaaaatttcgaatatatatagttaaccaaaaacaacaattgccttcgtgtagacaatatgtttactttattttctgggagtgggacataccagttttctgttctcttgtggtttacaatcatatgcacgcgatctaaagcttaatgttttttttcatgaaaccaccctcttttttttctcacaggg

SEQ ID NO: 6891 - DNA, 1500 bp, Zea mays
tatgctaactgaagttattgactttgtgcaacagacgtggaagttccaagccacaaatatttgcccataggattcaattcgtacctgatatatcgatcaaatctaaaagattgtatggaccacccgtgtcctagaactcaaggaacggctttgtgcacgctccgtctgtttggtttgcgaatctggagagcctggccagatccaactgttgttggactgatctcttcatcaagatggtccaacaacttcttttaaaatgagacagaatgccccactgaccatttcaaagtggtttgttgggtgtttttgcagaagtcgcagtggagcccacatattatttgatctctttctcttatataaaaatcatagcttttctatatgaagttgtattaaatataaattttatatagatatgtagagtttgacattatccacaactttatagctgatagtttttttatttaatatattttagagactcaaatatgcgtttaagttaccaaatttaatataaaaatatttttttaaatagcctcaaatgttgacatagtttataccttgtactcgataactttttttgatctaagggagacctaaatattcttttaaagtttttatatttttctaatttattttttgttatttttttcacacgacctctgatgttgacttggtatacaccaaagttatatctctcaacataatctataattttctaattggcaaatttttattaaagaccatttatagatctatttttatgtttgaattctttttaaagaatttaaaataaataattagacctataaataaatttagatataatattatcaactacaaaggtatagtatatattgattgttgcagctatgtgacgtagaccatgtcaacgttagagagaaaaagacaagatactggtttgctctacttctttgttgtgattgagggagcagttttcttgattaagttttttttaaaaaaaaacttgtattttgattttaatagttctatcattagttataaagaaagaagattaattattctccggtggagatcgtgcccgaccccgaccaaggtcatgatatggacgttgcaagcccacttcacgaggggacaaaaaagaaacagggttaccactttcatcagttaaagggcgtgacatggacgtgttgaagatccggcacattccctgcgaaatgtacacgtcatggtactaacgaggcatgaaactggccacatggccatggacgcgtgaagcgcgccatgcattggacatgctgcatccgaacttctgaagatcagatcagagagacactgatgagcgaactgccgtaacattctattctatatataccctcagtccctgttccagttctcgtcaagcttgcagcaccaagttgtcgaacacttgcctgctcttgagctcgatcaagctatcatcagctgcgtcttgcgcacagcaacagcttcccaactgcaaccgtagcaaccacaacttcc

SEQ ID NO: 6892 - DNA, 1500 bp, Zea mays
ctgatgccgatggtggtgttgacggtagcggtgttggtcacccctacttccctatgtgaattatctggttgatgaggtgatagtgtgatacaataccaatgaggtgggtgtaccaatgggaggggcctaagtactaccaaatgttggtggagtcgtggagtataacttctacgtggaccgatcagacttgggcatagtacaagaaacagttgatgcgtgaccaaggtattatgttcctctcatcgaaggagtacaatatgacacattatcagtggaatgcacacccgtgggaatgatcttcgacgggggtgtatttgtatcttcgatgttgtttgtgaactatgaaacaatgtcatgtaatgtatttgaactgctaaatgttgttattggacttttgttcaaattatgggacttcaatgtgatttatttgcaaaaaaacatatacctgagtttctgcatcagtgccgccagtttatctggtcaggagccgattaatcggtcttatcggttgactaatcggttttaaattgtttagaattcaaactaggttgactttaatttctattggttttcgtcgatttatcgtggtttacagattatcgatggacaccggtttgtgtgtcctcaatccggtttggtgaactctgatcctctaaagattttacagatttccgtagcagtacttgttgcttgaatccacattttcttcaaaggtacgtttagactgtgtcatttaaaaaattgttttgtcctgtttaacaatataaattgcaacatttataaagataaccttataacagaggaagagcaatggaaatcacatgggtcacgtctatctacaatctactagactactactgtacgcctgtatggctgtatcgtacaccctaggtgcgtgtgcgtacttgttgcagtaatacacaagtcaccactatatcactctctacaagcccactactgctcctgccactcctactatacagtatacactgcccagttgcgctagtgtagcgtaggaatactgtaggcgatgatcgacggtccactgtgcccagccctcgacaagtctcagtcgcttcatgcacgtcgcggtgccagtctcgttgctcctgctcccttatcctgcaaagctgaaagctgcaaggcctgcaratcacttccagtcttcaaaagtacagttcgcgaaagttgaaacgagcgagcgagcgaaccgaaccaaccaaccggcggcggccacgcaacgcaccccccctgacacaaagacaaagttacctagaagctagcccgtggagcggctagactactagactatcatgtctcggtactgcgtcaacgagcagtcgagcagccggcctcatcggctcatcctgccttggcagttggcacggcagcaccccagcaggcagcagcccctccaatttaaagcaagcaacgacgggcaaagagcagctcggcgggggctgctgcagcgccgcgcgtttgcgagtccgggacgacgac

SEQ ID NO: 6893 - DNA, 1055 bp, Zea mays
ctttgatattttagtagcatcaatgtgaataataacaaatccaacttttgtgatgaaataccgactcagataaaaaagtttatagatgaatataaatatacagtttgtttttaaaccaaacttattcagtttgttggagacagcagagaagacacacagaggcacagacgagggcagggtcaggtcggtcctactcgtcagtgactcaataactgcagaggatcgttgcgaccagcgagcggacaccccggcccccgcacccgccccggacaacagcgcgcaggcctgtgaattgcttccctctccacgcgcaccttcccgcctccgcgcccagcccaaccccaccgttgccacgcccacctccggcgtccacctcgcggttctccgctgcacaatcctccggaagacttccccagtgcccctgcgacccgtctgcacacctccgcggctgctcgccctcctctacccaaaccctaaccctaggtccgcgcgccggtgaggtacgtgtcatcctccttcacacgccttttttaggcccaattcggcgccccagggtctcgcctgaggcgttgttggcctctgtgggcaatggttgtacgaggctggagcgtgccccactgactcggccactcctggcaggggaacctctggcttaggctggaggtgatgaccccgtgcttcatttttagtctcttcggtgtccatgggatgctccatctctcagctgcgggtaagtgcgtttgcacggtgatgaccacgtgcctaaatgtactgtatgtaacctccatacattcactgtaatgctgccctatgtcaaattggcaatggcctactgcaagcagcactccctttagcacgctcaggtgtactgccaaaacgcagccttttgaatgtgccttatattaccgttcatttatgctgtttttccgtgttgtttctttgggattttgctttcagtccttcgcgctggaaggatacatctgtttgctggtgccatcagaatgaactgccgctttcagtgacatgcatgcgatgcatgcttttgcttttcttca

SEQ ID NO: 6894 - DNA, 59 bp, Zea mays
cctacgaaattcaatagcacagcgagagccaaggaagaagaagaagcaagcggagcgcc

SEQ ID NO: 6895 - DNA, 1049 bp, Zea mays
aaagaagcagtatggcgaacaaggtggcgacaattaaggcgaggaccatcgttatcgtgcggaggtatagatggccaattgggccgtgactagcgggccggcccgaggcacgacccatttaatagtgcccgggccagcccgacacgagcgccgcgccgtgcctggaccgtagcctcggcctgtagttctggcttggcccgtcccgacacggttatatttttttattttacaaaaaatcgtatatacatatgtataatttatattcaatattaaaaacacttgaacatgatgttctactggttagatggcttcacccagtgtctaccgcccttcttccatcaggacgtgggtttgaacctcgaaccccacctcctgcaccaattttttaacattttacgctgatttaaccaaatggcccgacgggctaaccgtttggtccggcacagtcagcaggccagcgtgccatgcctgggctggagctgtggcccgcaggcgtcgggcctagcgggctcgtgttaggccgcagtttggccatctatatgtggatgtgtggtttaagacgtggatgttggttgcgcggagggacgggcgtgcaacaagttaatttgaaatagatgtgaggggttattggtaaaaagataaagtgtgacgaccgttgaaactgatactttaatatagtatagaaatgaactagcggacgataaatatttaagaacgtagttagtattaattttcatcggtcatacatgtatatatcattttatataatatgattattaatgatgagtgcgaaaaattgacgtggacgacgactaccagcgtgaacggcggcctcgctcgctagacgagattgagccgtagaatctgatacagacacactctcatcctgtgactgtgagtgagcagccccgtggagtggcggcaatcatcgctagcaagacgtgaagagttctcaagcaggaggcgtgtgacgtcagcaaggacaccagtgttttcagtggagtggtggcgccagcaggaggccggcgaggggtcttctcttctagtag

SEQ ID NO: 6896 - DNA, 1500 bp, Zea mays
tagatattcagagagtcaacctgctgcatacataccgtacttgttggggatgcatggggagggagatattcactcgatcgtccggaggggtggtcaaccaccagagaaaagcacattaagttcttagaaaagctcaatggcagatccatccgcccaactactttgctgcctagtgccattgccgcctgggtcggtattttgggtgacctatggaacaatccatattcgcccaaccactgtactgaagctagctagtggcatcacgaggtgacctccctacacaaccgccaccagcaatcgtcccagagctgctcacaaagaacttaagggctggtttggtggacatggaattggagaggatccacggaggagtaatcccctccttattcaaatttaaatagagagagaattccttccacgtggatcccctccaattctctgtccaccgatcagctctaacagttgacacaatagttaatagtacatatcgttcccatcgggcatctaattttattttctgaaaatgcttcacgtacgttacgtatgtatctacgactatagtatgatcaaagttaaactattttattttctgaagcttattttgcagttttgatatagagaagcttgttcgacttggtactatatatgatcaggatttttcagctattgaacgcgtaatgttaagagagcgagacgacatacattgtccatgtgagaaggcatattgcttttggtacttgtgaagatattgcatctctatctatgaagatgattgaaaccaaaaagcaacttgtgttccctctggttttcaagctaattgagttggccttgttattactagttgtcggcgttccgagaccgggggtcccttgggccgacgagtgagtgtcgccgcgtgccccagcccagatgggtcgagcgcgagggcgagcgcgaaggggggaagaagcgaggcggccggagaccggcgtgagagaggtgggaatcccgcggccttcgtgttcgtcccgcgcccaggtcgggtgcgcttgcagtagggggttacaagcgtccacgcgggagagagagcgagcggcttccaagcgagcgcctgtctcgtcctcgtccccgcgcggccaaccctctctaagagggccctggtccttccttttataggcgtaaggagaggatccaggtgtacaatggggggtgtagcagagtgctacgtgtctagcgggggagagctagcaccctaagtacatgccaatgtggcagccggagagatcttggcacccagctggtgtgatgtcgtggctgtcggaggagcaacggagcctggcggagggtgagttgtcggagcggttgagtccgtgctgacgtcctcctgcttccgtaagagagctgagagtcgccgtcgtcatagggcttgcggggcgccatcattgcctatctggcgaagctagccagatgggacgtcggtcttgttctctgcggcccgagtcggctcggggtagggtgatg

SEQ ID NO: 6897 - DNA, 1095 bp, Zea mays
gtaaggcacacaacatagtaatggactgtgcgcggggaggagggaatcggaaaggcacacaacataggaatggactgtgcgcggggaggagagaatcggaaagacacacaacataggaatggactgtgcgcgggaggagggaatcagaaaggcacacaacataggaatggactgtgcgcggggaggaaagacacacaacataggaatggactatgcgcggggaggagggaatcggaaaggcagaacacggaatgggcagaacgcggaatgaccgactactattgcagtcttaataagtagtagagatttggtagttatttgttagctagctaattacactaacaatttttaattaattaactattagttttagtgcattcaaacatctccttaacctgaccgctcacatatacggaggaagacgaagaaaygaggttgatagaagggtctatttgttactgtgagaaattaaaatagtttttttttctttcaaaaaaacacaattttaagctaaggccccgttcgttttttttctatggattggattgctggaacggttgctagtcgaattggttcggtaatttatatgttgatcaagtggaacggtttaatcagatacaaacgaacacgatctaaacgatttttaatttttttatatcctttacttcatagtctatactgtatagctcatgtcaayaaccacgtgcccatcacctgcgagagcgcagtaaaaattcggtccagactccagacacgtacacctgaagagaccatgggaggacgacgaatgcgtggtatttgtatcgcggccggccggtttctctgcttcacgggagcgcagtatcaggcggaagccgccaacctcgccaccgccgcacccacatgcgctcgccttccactgtttggccgcacacctacaaacaaggccctcctttccctggcttgtcccgctatcgccccgcttccgcccgctggccgctgtccgtcagctctcgcgctaccggctgcgggataaggcaagcttgtcgctcgccttggtggtgtgcttccagttccagccaccagcgctagcttcctctgcgttgcacgtcggaa

SEQ ID NO: 6898 - DNA, 107 bp, Zea mays
tctgacataagaaaaaaattgaaaaatataataatcaaaataagcatctaatgggaaatggatgttgggttgcttatgatattgtataaaaaagggtgtgaagggaa

SEQ ID NO: 6899 - DNA, 61 bp, Zea mays
ggtatatatgtaattgctgaacctgcttgatttttgagctgaacggttctgcttcctccca

SEQ ID NO: 6900 - DNA, 220 bp, Zea mays
gaaggacttccccgttccggtgctgctgattgtattctggtaattgttgataaattcaccaaatacgaccacttcttaccactctcccatccgtatacatccagttcagtgggctcattgcttcaagactcatatttacaagctacacggactccctgctgccatagtctcggatcgcgacccagttttcacaagtcaattctggcgccacctgtttaaa

SEQ ID NO: 6901 - DNA, 685 bp, Zea mays
tatatatattctggtgcagcaaacatacttgctgttgatatagttattgcatgacgcatgttcaccgtaatcggatggtataccctgtctgcccacaaacccgcaaaccccccaaatcctccatcgagtccgcttgagtctcgacctatcacaacaagcgattccccccaagtcgaagcagcagaaccaacagcgagccgccggccgccaatggcgttctcatcgccggcttccgcgcgtccgcagcgctcgcctgacgaggtggaggacatcatcctccgcaagatccttctcgtctccctcacgccgctggccaaccccgggcccgccgtcgcctacctcgagctcaccgccgccgagctcctctccgagtcgcgccctctcctagctctgcgcgacgccgccgagcgcctccttatagaccgcctctcgctcccggacccgcccgccgggtctccgacccctttcgccttcctcgtctccgctttccgccgcgccgccgacgaggcgcgtaagatctccaccatccgcgacgctgctctccgggcgcgcctcacgccctccatcacgacatcccgggccctcatcctctcctacgcgcgcatcgtcacctggacacccgaaaccttccccaccccgcccggcgtgcaacaccccgcctccgacctccttgtattcctcctcg

SEQ ID NO: 6902 - DNA, 123 bp, Zea mays
cccctcggtggcgtggtggtctcgcacgcggggccaaagtagtttccgcttagcacgagcgggtcgttggcgttgtgcccgatcacggccgcggagcccaccgcgaagcggtcgagtgggagg

SEQ ID NO: 6903 - DNA, 826 bp, Zea mays
taaaaatagtatatttatagtttgacatgttatttatatgatacaaatcacatgtcaaattagttagccaacatgaatacatatgatataagtgatgtatatattcttaaattacatgtatcatcggatacccgtcggtaaattttgatgacagcatactgcctatatatatctttataggtacttgaggctcatgcacgcgcggtaaattttcatgctcgtacctgatatggaacaccatacctaatatgaaatctcatatgtatggataagattgccatccctatattagtcctggaccaagcaaaatatattttatgtttttattaattcgtctttgccaaaaaagttgtcacacgatgtcacacacaacttatattagtcaaatgtccgtgtattattacggttttgtatatatcatacgagtaaattttgttttaataaatacaaaatatgtgtgttctattaattaagtgggtgtgaatatgaagtcaataaccaaagtttgaacccttttgcatagttttatcttatttttgtataaagcgagaagggcggataacgatgaaaaccgtggaaccgtgaaaactagtactttatagtagtgatgatgaaatgatattgttttcatcggtttttatttcatcaattaaaatggtgacatgagtatatttttgaaaaaacgaattaaaaataaaatttaatccgtcaagggaagatggactcacgctcaatgggctgaatttgggctttcccgtagaaaactcagtccacgcttttgggctttccctttgcccctactcgtcttccccaccgaagcagggtg

SEQ ID NO: 6904 - DNA, 114 bp, Zea mays
ggtttttaatggatcaagtgtttcgtgtgtttacatccattctttggctttaaacatattaatggctcatgtggcagaattgtcttgcttgtaggccttgtggatggcttggat

SEQ ID NO: 6905 - DNA, 97 bp, Zea mays
ctagtcctcaccgtcgaggcgtcgacacagagccatcccaccgctgatgcgctgatccatccaagccaaggggtgcaccggcgtaccgacagcagcc

SEQ ID NO: 6906 - DNA, 103 bp, Zea mays
tgtgaggaaatagaaaaaatttcattgttttgttccttagactcccttgtggccctgtcacatatcaatctaactaaatgtatatgctttgtagactactggc

SEQ ID NO: 6907 - DNA, 1500 bp, Zea mays
aatttgagagctcccaattagcacaatgccaagatttgattatatccatatctatatgtatacataatattaaatataaaaaatcaaaatcttaccccatttattagcttcactatcccttaataccgaacaatgaagagtttctttcatgcgaacttatatgattcatgctcatacgagttagaattgcttttgtcaagcggtgatcgatatgaagcctgattcgaagacttattgggttgtgccctccgcatcttacatgtaagttagacttataaattttgctcatacgagttaaaataactcgtgtatagcgatgatacaaatagggtatttgattgagattataatctgattaggttatataatctaacaaattttgatctatttatataatttggacagattataattcgaaacaaacacctccaaaatctaattccaacatatattggatcatgtttataatgtacgaacacaattgctggtcaatgttaaaataagcttatatgttgtgtcttatagtgattattctacaacgtaggaagattatgttagaaagaaatagccaccttttaaaatatagaagatgtagcaagatagttatgataactttcataatctcaaaacgctattcttcaatgtttgtttaagtttgaagttgatggtatttatatctatagctccaaattaatttgttataaaaacatattttataattactttaatattagctatttaatattatatgtatcgatttttagctataaataattaaatttaaggtacaaagattctagagtagtatattttggtacggatagagcaagaagtgtgtgctattgttggtcggatgtccattcacatatttaatgtctatgtgttcagtgttatagtgctatacacgcaacatttttaggctattctcagcaccttttctattttaaattttaattttataaacaatgtcatcgtcccaatttattattcattcgtctgacttttttatcacaattttgaccaactcgttttattcaaaaaattatggaaaacgccaaaaaattcgttgtggttttgtttattatcaaatatactttacatataacttattttttttcattttttcatgttttttttaaaaagacgaatgttcaaagttaagattaaaaagtcaaacgaattatatcttgaaacagagggagtacaatataaactctattttttttcaagatccacttctagagcggttaggcaaaaccgcgcgccatttggccagagcccaccgcccagccagcgaggaatcctgatttggagcactggacgggacgcgttgccattagctgtcgcgtcagttacgttttgcttgccctgttctcgttcggccttgacaacccggaaatcctccagccctctagtccccaacgacgcaggaagcaggatcgagccgaatcctccggaactcgccgccggggccaaccgacctcacactattgatcgagg

SEQ ID NO: 6908 - DNA, 86 bp, Zea mays
agaggcacaagaaaagaaaaagcccttgaagcggtaacttcaaaggcccttatcacactgtgttacggcaagtaacgggagtaagt

SEQ ID NO: 6909 - DNA, 1352 bp, Zea mays
aatggcgtggacccggttcacggggcaatcgcgccgggcctccatgtgggcgtggttctccgcctgcgacctgcctatcctccagcagctgtgagcgtatggtccgagtctatgtcgacggtcgtatgaaatggtgacaactcgcgacggaagtattacggcggcggcaggcaccacagctcatcacgctatacccgtgatgggagcagaacaacgcggaatacgacgtgggcgaagaagggtcggtacggagcaactagcaagacgtgtaccgcccatgcctcattttcttttctcccttcacatctcgccttcgttaggccgcctgttgtggggaatgtaaataaatgtacgtattttgagaaaggttaaataaaatacttcaattacaagcgaagccttgtactgtggaacactaggcctgggcaggagctggtggggcgggccgcgttgcggacctgcgtagcagcccggcagccgaacgcggagagcgatgaaccaacgggtctggaaataacttgggccggggatggtgcgctgtttgcgggggccagtgccgaaagcaaggccagagcgatcacgggacgccacagcccacaccaccgcttcaagatgggcctccgctggcatagcagtcacaaattcgatcttgtatcgacattgactggcactaaaaatataaagtatggtcctgggcgtgagtggctttgtaggtgggccaatgtttagcgacgcagtgtaatatttggggtagtattgctattcaacatttttcttagccattgctttattgttggaaagcaagcgttgctattcgatacctccttttctaccccaatccaataaataaacgacagtaagcaaaccctttattcagactaatctaaaccgtcgaagacgaccggacgggtcgcatagctcgtgggccacgacgcaaacccgccacgtcccctcaagctgcgggtcgtgaacgaaatggctggttcacaggcacccgtgcagcgccggtgaggctgcagcccgcagccgcaggtgcaggtgccgatcagatagcgtggcgccaaaccactgccgtccaactgaaccagtggacaggagccacccctgcacggctgcactagactacacgagggacccccgtccggtctggccgtctccggtaaaaccagccgcctcatcctctagccgatctccttttttgtcgcctccgtgcgtgccccgggggccttgatcgcgcgcaccggtcagctcagcccgtctgattcgcgtgctgccagccctccgccgatcgtgaaacacaaccgtcggtggtttgcttgcttgatcgctgatcctcgcggacgctcacggtc

SEQ ID NO: 6910 - DNA, 809 bp, Zea mays
acccctgagatcgaatggacgaaaagcctcatctcaacacgaacgaagacgtgcacctacaaggcaatgagccggcccttttccccgcccctaccccccgcaaggcgagcgcacacgcgtgtggcactttatcctctatctcctcaaccataacttgataggagaggaaaacctccacatataaaactagtctcactctacttatgagagaaagagggcactagaaggtaattgaatttcttaattaagtttggcccataaatccaacaacaagtagagttatgggaacatgatgcctcgtagcccttacggcaacagtacttttgaatttataatcggagctgtgccaggtctttacaagccctagaacatggcgtggctgtgcctgtgcctgtgcaggttcatctagtggagtggctgaaaatgatggttggcactagaaggtagtgagtggatcttgacatggccagccaacgaatccaaggcaaacgatccctatgagaaaaagaggggcacaacagatcaccatcaatccatcatgtccaagttcagttcagttcagtgcatttcgtctcgtctcgtcctgcgtttccccgtgggcctcattcttttattggtgggccggccacttggggttggagatccactcggccactctgatcccggaaatatctttcaccgtctcgtctcgtctcctctcctctcctctcctctcgccccgcctcgtcatgtcacgtctcccaaagtcccatctcgccttcgcttaaacataaaccacacccatcgcacccagccagccctcgccatcc

SEQ ID NO: 6911 - DNA, 103 bp, Zea mays
gtgatggagcagccaatgtacatggatccctccctcccccttcttcagctagaagtaagcagcaagatcagcagcagcaggaggaggcagcaggaacagaaat

SEQ ID NO: 6912 - DNA, 295 bp, Zea mays
ggtacgcaaacccttctaccagtgtgtcgctcagagttgtagtttcccgtctaaactcttgcttcacacatcccgaatccactcctgcttatcgataagcaaagttagccggatgattcttcaaaatttatgtcctccgtattagagcttgcctctcaagcttcttggtattgcactcctactcgatttgtgctaatcgtggggggggcaagaatggcaaacaaaaatattttctttcgttatcccctccttcagacgcaagtttacgatggactaatgaatctctacgtccggc

SEQ ID NO: 6913 - DNA, 469 bp, Zea mays
aagaggctcttcagcgacacgcacacgtcgctcaagaaaaaaccactcagtaaagcctcgtcacgtgatagagcgagaggctgataggatcttaatcatgcctcatgtagatcggtgagtgtaatatattaacttgtctcatctctactactatttaagtgcctattgtaggcgttcacagatgcacgttctgccgcttgctgctagcgcaccccgcccgcctcgccctccccaacggcaatctcggcgtccaccgcggcaagctcgccctcccccgcgacaatctcggtgtcccccgcaatcacggtgtctgtccctcccatctcaccgccgcctcataacactcccgtgtcccacgccatacgcccaagaggccaagaccgagccgcctagatctgattgggttggctctcgtcgcgggggcgaaggggaaggggaggaagaaccaggaggcatgcgttcgtccaag

SEQ ID NO: 6914 - DNA, 110 bp, Zea mays
ggtgagcgttttgatgctcttctgcggctgtttcggcggttcgcatcgtctgtatgcaccgtgatgctcatatgcattcgttcgtggtgttgctgactgttgcagcaagt

SEQ ID NO: 6915 - DNA, 217 bp, Zea mays
cctatcaaaaagacaaatttagctttgcatggaaagaaaatggcgatatatttctgtttcccacgcgtggccagatttatgttacattacatggtgaattatttcacatcaaacaacaaacatgtaacatactccgtaaatataaatccgattaatcgcgcgcttatgggcgtccagaatccagatacagagccggctacgcgatgacgtggctgct

SEQ ID NO: 6916 - DNA, 109 bp, Zea mays
gggacaggctttatcaaagtggagagatccaatggcagcaccttcagtgtgatgactaacggctacccacctgccagctctgtccgctgcacgagcaatcctgcgacaa

SEQ ID NO: 6917 - DNA, 381 bp, Zea mays
catccccacgcccccctgctgtggcctctgctctctcctgccagttcacctgctgcctccggtgcccgctgctgtgcctcgctcgctcaccaccaccaatcgccaccccgtgcggcagccgcgctgccatcccgcggaggactggaggagcacgcatatccgagccttccctgccgcgtcgcatggactcatgctgtcgcgggccgcctcccgcatcgcctccaaccgggtgcctgcctaactggccgattttcttcctcgcgtagccccattccgcagcacaaatagcgcgtcactttcccaatttctatcgcgtgccccccttccgatcctgccatttcgtgcatcctgtagcgtctggcagtgcgggggtcatcgggg

SEQ ID NO: 6918 - DNA, 67 bp, Zea mays
ggtcttctccaacgctagacaacgaagaaggagcaattaatcaagtagatcgattcaatccaatcca

SEQ ID NO: 6919 - DNA, 70 bp, Zea mays
ggtgatgcagaaatacttcctgtctgtttttccttctcgttaaccactgacatctcttgactacctatac

SEQ ID NO: 6920 - DNA, 248 bp, Zea mays
aggtactcgatgagttttgtttggtgtttctcattggtaaagtacatgggtatggattttcaatatttttgtagtgtattttattgcattacaaggttacaaaagtgcaatttaaattcttttgctctttgaatattctttctccagagataagccaaaataaaaggagcgggaaaaatcaaaatttaaaaactttcaatatgaaaaataaaagttctgccttctggcatctgtaggaaactgatgga

SEQ ID NO: 6921 - DNA, 169 bp, Zea mays
acacccctagcccgcccatacgcgggaagcatgtagacatattcgtgcggcttggttaacatgacatgcatcatgatgatttcgcggtgctgcatgtgcctgtctttttctttctttctttttatttatcttcttttatttactttttaaaaatgctagtggtttgtcc

SEQ ID NO: 6922 - DNA, 762 bp, Zea mays
aaacggattagtcttatttacgtttctcgaataaaatggttatatacttctgtctaaacttctatcacagaagaagtttgcaacgcgttgctgcgcagcaactgatggatctatttacttctgccatcagaacgtatagacattatactagtctatacttcaaacatggtaaaaactcacccaatcaaatcactccatgcataacctccactaaatacaccaaataaattgtattcagatttaacacatcatcaaaattaacggtttatcttcttagataactttctctcccttactcaatggataatattattttgatcatccctctccgtgaccttgcaagcgctatcaacccattgcaagcgctatcaacccatccactcacgctgtcaaccgccatcgtcgaactctctcttactcagaattctaccataagcacgagctatatgttagtagtataataactgtacatgtttccaccacctccaggaggtcatgacgctagcgcgctgcgtattacccartccccactgcccagttcgctcacactctgatcgcacaactttgaacagctaaatcaaaaccggacgagcctcattatataatcctacacaccaagcccagcaacgtgcctgctccctctcggcacaccaaaccaaacccagtagcgctgctcccagcagcagcaggcacgaacaaccgcccttgccacctcacctccagaaccagtgagtcactgtacgttaccggagcaagcaaaga

SEQ ID NO: 6923 - DNA, 68 bp, Zea mays
tgaagttggagtagtttgtgcttcctcttactttgtgaaccaagaaaaaaaatatgaatgggtgaacg

SEQ ID NO: 6924 - DNA, 593 bp, Zea mays
ttgaaattggttggttttactattagcgttgaatttgatattttagaaaatacatgggcttttttgaacaaattattttatttcaatcaacaaaaacttcacaattcatatcgcccccccccccccccttccctccgtcactgtttttgttacgacaaaaaccaaaaaagaacacataattggtagctgtgtacatattctattatcaactaatgacatactccattatcagtagcttaagctatctgattatatagtatgtacgccaaacgataagacagttcataacttactatacaggtgccaaaaacatgctataattttgtctcagacttttgactttgctgggcttacagatgggcgcgtttcgtcgatataaaagtaaagttcgagtcgacaataagtaaacaaggaaaataatagaaaattacattagcccaatctactatagcccaaacatccatacctgcttgccttctgcagaagaaaaagaaaaaaaaagaacagctttgttactacttcccatcgttcacccattcatattttttttcttggttcacaaagtaagaggaagcacaaactactccaacttc

SEQ ID NO: 6925 - DNA, 569 bp, Zea mays
cttattaaatctctggttaacatttttagatacaaagtttaaaaaatgaaagtttttgttttcaaaaggaatctagtaagcaaatctaataagttttagataaaacaccttacttgaaattgaagatggacccatgtttgttatatgaggaagtatcttctgacttctgtgcccttttgtattagatgcattagttggctttagatttggggcgacagcccacgagtagggactgcaggtttgtgagttcggtaacaacgcaccatgtcagcatgacacaatgataacagcatcatcaccaagctaaaagaattaacaaatcatccattgaagaaacaataatcacttccttggcctacacaaggggtgtaaatccagtggaaaagaagaaataaacaagggccgcgctgtccggccggctgcttctagtagtcattcattcactactactactgccacctgaaaactttcagcattgcatctgcactaatcaaatagcaccagttccggccccaccaactcgcccccacccgccagaagagagtcatgtagggaaagggcgtggaaaa

SEQ ID NO: 6926 - DNA, 297 bp, Zea mays
cgtacgtacagtgtgaaagaagctagaaaggaagaattgctagctatagtatgatgtgcacaagctggtggagggatgagagatgatgaggaggaaggtaggcagagcatgcagcatcagcagaggcctgaagtgcactccaagctaaggaagactaccatacgataccatacgctaacgctagtagtatatctgattaatttgttagctgctaggtccatgcttgagcaagctctgctggtggcttgctagctatttctatcgatccagcagctatagctatgcatgcatgcagca

SEQ ID NO: 6927 - DNA, 769 bp, Zea mays
gccaggcgaagttcgtgtgccagcaatgggatcctatatatacttaggggtagtttgagagccataaaaccggacgggatttgaggggatagaatcccctttctattcaaatttgaataaaaagaggattctgtcacctccaattccctccggttttgtgtctcccaaactagctcttatggactacaaattttcagaccctagatgcgataggagacacagagaaagaaaagtaacggtgagaaggcggctatcggaggagatcgacgcccagagaaaggaatccgcgtcgtagccatcgtcaccgtgacgccgtcgcttgccctttgcgcctattgcctcatgggctcatccgctcatggctgcttcgcgtgggaatattttccaccccgaatgaccaggcgccattccaagccagaggcaacaaaaaatgtctggactcgactggcaccgttccagggcgggggcaacaggggcttaaccgaacgcgtttgttttgggcaggggttgtttccaggaggtgtgatccacggggatgggtccgtgatcccggccggaaaaggcttaaccgaacagcgtgcgaattgcgaacgagggtcagcgcgttcgagcccaatacaccacagcacggcacggcacggcacggggccacacatgaccagacctgacctgatcgatcgcctacgccccacgcaacgccacgagcccacgacgcaccccgcaagcgaagcaaagcaagccccaggcggcgccgccggcggaggacgcg

SEQ ID NO: 6928 - DNA, 489 bp, Zea mays
gcaaaagtattgatgaggtgagtgatattgtgcatctgctgctgcaggagaaacaagatcatgcttcaaatgcctatctatttgtttgtctgctaatttgagatggatttgagattgtgagtgtatattcgtatgctattttgcaaggggtgcgcactctgaacactgttaacaacttggaattcaatatcaccaccatgctttgttgtcatacttggtacccagctatagactttgtttgcattagtcgaacaaagaaggtagtcagcttgttcgctgcggcttgctgcggcttctacagtatttttctctctatggattgcagctgcagcagtccaaacagctgcaacagtgtcggcttgcagccagccgaacacgcccagtgttcccagccctaaaacacttgacactacgacactaccgtatcagtctggcaggtcctgtgcataatccaccatctcgctcacaggctcgccgcccccgccggca

SEQ ID NO: 6929 - DNA, 286 bp, Zea mays
ggtatcccaaacctgatatataagagttgagcgctgcaagctaaatggctttggctcatcaagactgacccgagtaggccttggagtggattggatctccctgttcagtcacaaggaagctagtggccagttcgatgtacacccatgtgggcaatggcaaaaacaccctttttggagggacagatggttgaatgggtgctctatcgctgagctggcacctgaagtgatctcaaaggtggataaaaaggttgcctctaccaggacagtgcatcaagccttagagggc

SEQ ID NO: 6930 - DNA, 443 bp, Zea mays
catttatcaataacattctcagaaaaggatctttaattaaaagactattccatatggatgcaatggtcaatctgacgactgctataatgcgctcgtcggaccttgagctacggtccgacggggggtgagcttgcccgacgcgctcgccgaggtccatcaccgtccttcgaatcaccgtccgattatgggtcagcttcagcggagggcatgggggccccggtaacattggcttcttcgtagacgtctccaatggcagtctggcagaggccacagtgccacacgccacgtcgtccgcgtcctagccactcacgaacgcgggccgagtcaccgcccgcccacctcctatccacttccccatctgccagccgtccgagtccgaccacctctcgtatcgattctccaagcgccgcgccgcgccgggcgaagaagctcgtctcgtctcc

SEQ ID NO: 6931 - DNA, 631 bp, Zea mays
agtatcataaccataacactcgacaaagagactaacaaagggctccactgatgttctttttgttaacgctagtccgataggcactcgacaaagagagaaagaggctgataaaagagctcactagagccttttttgccaagcactagtccattagacaatcggcaaagacagagcctagacactcggcaaacgctctgtcaccgtcatttggcgttgtgatgacgacttttctttgtcggatatcaggtggtactcggcgaacctttattcagtgtcataaagtgtccgacaaaaaatatgcggcaaagaagttattaccgatgtcgagaccttttttagagagtcacactttgtcgattattttctacactttaccgactgaacgtctttacaatccaaacctaaaatcaaacgcggccggcgaccagcggcgtttcgcgtttcgcgtttgtgacagagacagagagattaacggaaaggtaagcgttttggtggctttattaactctccgtctccgatcacctgatccagtggcatgctagctactcacgcacgcaacagctgaactgagttgcactactgcttgttgtgccaactacacacgagagctagacacccacgcgacgataga

SEQ ID NO: 6932 - DNA, 91 bp, Zea mays
ggtgggtactgtcttgttggcaagatggagaaggcatcaagggtatttgatgctatggtgtctgctggcgttgaaccaaacaatgtagtgt

SEQ ID NO: 6933 - DNA, 1500 bp, Zea mays
cctctctctccgtgcggtgactgactgggcaaccgccaccgccctccccctccgtcgggtcttcgccggcgccaccagcgacgactgggcggtctgtgtccctcttcgccggagacgatcacccaccaggtatgcccgctcccttctctcccttcccttccttcctttccgaagcggagcaccccaaaccctaagctatctgaacccggatctgaccatgattcctactagcttcgagttttttgcaagaaacaacgggtgcacgtatcctggattcactactttgtgcatcaatgctgctgttgattaggactagagctgcaggctgctgtagactagacttcgcgtggaagcaaggtacgattaggtttcacgtggttcttgcttcgctttgggaccactctctagtcagtaccatgtgtctgtgatatgcgcgacagggaaccttgtccatctgggaactctacctgcatatatagagggaaggaaattggtatgggcgtctgcggttatggttcatgtgtttatagttcctggcgacaaaaaatagagaaacagtttcactttagcgaatgagctccaactaatcaatgtttttagtgctccgtaattccagcccgtcatatattttttcgtttctgtttacctttggcctaagttgtggggatctattgttcaattcggattgcagcaaccaatgcatgccatattgtactttgaaactgttccaactggcacctaaagtgtcactactctttgaggggctgatttctctgccaagtccaattacatctgtcatcagatacctattgctaggatgctgggcgcaccatgtgtttggctcactctgtacatcaagtttataagtacatgtacgatgcaatgaaaaagtaaaaaataaattgtcaagtcttcttcttagttgttttgtttgttcagcagcgcatgcatagcgtagcattagcattacccaaggaaaggcattgttactacctgtgtatagagggaattaaatgctatgtgtgttagaggttatgatccctgagctgttgtgtagcaagtagcatggatatgggggcacgtggatcagtattgggcatatagaagtggatactgcagcttctgaaagaaccaaatgtatagatatgttttagtattttacataatttacataaataaataatgagatacaatataattttgaaggcagtagcagcctagcaggaactataaattagcttccaatatagccactttggtcttgtgcagtttccaaatttccatttaaccaatatagttttgaatcatttgtagtacaatagttttgaaccatccatacgttggccggacaacccagcctgaactactactatcaagtttgcatctcttgttctaaaaaatctgtgacctgaactgaatagttgctttgcaggtggatgtcgattttttggttgacaagttgaaggttacgaactactttgatcctgaggtgaagaagta

SEQ ID NO: 6934 - DNA, 147 bp, Zea mays
gcgctcgggtatactgccgcgttttgtgatgcccttgcaggccaagcgccagtgcgcgaaaacttcgcttacggattatttcccgtgaaagcggtttttttcggccagcctgtacagagggatttcggcactattttggagttttac

SEQ ID NO: 6935 - DNA, 1500 bp, Zea mays
tgcagaagttacgctcgcgctctttgccctaccagctaccaaaccgcacgccgtctcaactctcaatcaagtaggaacggttggatcagaaaggaacggcagagggggagggctcttttactagttgagctaaataatctcggtatccgcacggcggcaagccaagcctatctcctatctccagcagctcctccagacctccacctctctatggcgcgcctgctcctcttcccatcccaagcgtgcgtcgatcctggccgccacctcctcctccacccgccggtctccaggccccgtgctgtccggtctgggcctcctcccgccgcgccacgccgcaccggggtcgtctctcttcccggccgttgcccaccgcccctttgctggaaccaccatccatttcttccttgtaagttgtcctacatatatctggctatcttctgagaagaactagctgactatacattccctgctgctcttcttgttttttaaccaattaattaagttataatgcgtgctttgtgtgcagtatatttcgtttcttctacaagcactattatctaaccacttttttttttttacttatttggactctattcgtttgttgctaaggaaggcagatcatcagacagaggatgggtagtttttggttcagaaaacgtacaaggtcagtcatttcacatcaatatgtccgtgttcctatggaatgaatgtcttcctataaaggcacacattaggcttctctgtcaagcatattagatttttttaatgtaaactaatcatgtttacatcctctgtcaaagtgtgaaaataagctgtatcaatgtcatcgtccactctaatccttgctatgttcgtactgggtatctatttggtagcacattcgacggaatgttaccgtattcaacctggaccgtgcaggatatgttgatttttttttgggctgtgaagtttccaatcatctttgataaaaagacagtgctcctgtcatgtgtcctcatacataagttacttttatgtattacggacctgtcaactaatatcttacggaaccattagaaatgataccaaatggcatatgtagctaatatggcaatatccagtatgccgaagatcataaatggcatcctttgcggtcagccatctacgtgagctaaaatgccagctgttgtaaatgcaacttactatctatcatacagttctttttttgaaacatgccatcgtccatagttcaatacttcaattgaatagtaacgagtgagttgttatataatatagtagtatttcaagttaagactcacttttgtacaattgttttcctgatatacaatatatgaactgtctttacctaccagaaatttcttctcaccttcctcgcaaggatgaaaggagaagtgggaatttgcttctgcgattcagtgcactcccatattgcactatggcttggttgagcactgctcaattagcacaatctagtgttgggggaaaagctaaatatggttt

SEQ ID NO: 6936 - DNA, 1470 bp, Zea mays
cgcgaaaagcaggcgatgatggtgcgcaggcgcagcaaagtcggtccctcctccctcgtgcctggccctggccctggcccgggtctctcgccgggtagaaatttattcatcgctcccggcgccaacaattatttcgttgcctctgaagcacatggctgttcagtgttcactaaagagattgtgcagcagctgcttctaaagctagtagcttcacgtgccaaagccaaacgggtggaaaaaaaacacgaccgctccgtaggctggctggccagtggccatggctgggcggcggcgggcagaggccggcttgtcttgtccccgtagcatcgaagcaagactgtaccaaaaccaacctttcattattccacagtaacagtaccgaccactgtaggctttcttgccgtcttctctcctttggctttatccatcggttggttgtagcagagaacctctcgcttgcgctcatgggaatacgcgcacggccgccggcgagcacagcccagacccactccttcctccctcgatcagacatccatccctgccatctctatcttaacttcctcaccaagtcattcgttagcgcgaactatatgagaatggctgcgtaattaatttgcgcgataaaataacgacaagacgcatagtattttcatatgtacgcaaacattaaactctaaaacggaatttaatctggtacagtgggagcagtatgatcttgtggccacgtgagctttgtctgtacagttacatatacagatggaatgatggaatgccaaagaagaaggtgtaatttgtgttcagttcacattttcatgacttaattcattaacataaattcgtgtatatatgacatcgagatagagtcatagagagagagaaaaaaactatattcgtaattgtatgcagttcagttttcctttttcaatttaaattgtaagagagatcaacgtctgtaaatctgcaattctatcggttctcacgtggctgtaggcaaatgcgtgcgtgcgtgtggtgtgttgttggcgctcactgctcacctccaaaaggccggcactgtgtggggtcgtgttgcgcgccatgcgcgaccatgctgctgccttctgccacgcggggcatgtggctgccatcgaaagcacagcgccaccaccaacgaccacacctctcaagccaaaaaaacaaacaaacaaacaaaatggacatccccgtctctcgccgctagctttccctttcccttgcgctcctcctccttcactcctcaccctccccgcaggccgcggctcggcaagcaagcaacaacccccgccactcccctccctcaccaccatggcgtcgggcggctgcgctctcgccccgaggccatgacttggcgccgcccgtggccgtggctctccgtcttctccctctccccgcgacgaagacaacccctcctcctccaactccgactcctccctgggcggcggtgctagccag

SEQ ID NO: 6937 - DNA, 111 bp, Zea mays
tgcactgatgaatcccctaatgatttttatcaaaatcattaagttaaggtagatacacatcttgtcatatgatcaaatggtttcgccaaaaatcaataatcagacaacaaa

SEQ ID NO: 6938 - DNA, 1500 bp, Zea mays
aagcgctgctcctacggttcggatacggctctctctgctgctgccctgcagcctgctcctctgcctgccgctgtgaactacgtcaccctccgacctccgtggtagcgcggcgcaggtgtaggtgttggcttgcttgaccgttgctatcgttctactatttactgccactgcgttcggctaacgtcgccatttaattaatttgctttatataccttttgttttatatatagcgtacgcacgtcgttgttatgtgaataggtggacatggcatctgcctctgcgttcagttcgattcgagcgtgtggatggcaggatgggtgaattgtagaggcagctgttaatgttatcgactcaccgcacagctcatttaccggagttgatgtgaagcgagtgctgtgctcaggtgcatgtgcatccgttgcgtgcatgggctgcacgtgcaagctgtggcccagcaaaacaaggccatttcttctgatgcgggcctactgggcactgcactttgctccgctacaatctggcccaaacgcacatttaaaagaaagttggactagcccaacaacaagggcctgcggttgagggctggtagcagccaatgcccatatgctcctcgcacaaagtcaaaccggcgtgtttggtatggacttaggagcttggactcgccctcgcacaaggcgtgtttaccgtgtttgggatggctcatgttacagctttaacatagagctgtaatctaaatagttttaaaaatatttttttaatctaaataataaacaaaataacttattcaaatatattctaaaggcttataattttagtttcacattttttttgaagccgctaatgatctgctccactaattttaccaaattttttgaaggtggagctgtccaaatgagactttattctgttcgggaaaaaagtttccggttcctacgttccgtggtgtaaaagggaatgcaaatttggcacgttgcattacagctggtgcaagaaactactgcttcttcttcctgggccggggccacccccacgataaaaaaacagactacctaccttttgaagcagttttctaggtaaagctaggttattttaaagggattatttaacaaaaataacgtaactaagatggggaaataaaggagaaaactgcaaaaaaactactctttttttatttctttgtacaagcatttaaaaagaaaaaaacatctatagagctattttaaaaagtatgtagagaaaaaaaacagtttacaataactcatgacgttgtaaataaagccgtgccaaatacggcctaattcgaaacgccgaaagcgaccccatcttccccgttcaaagcaaccggtcctcctcccttttcctcattccaagcgtccaaaccccccatacaaccaactcgcaactcctcgcgcggttcctcgatcgaagtctccagacgcccagcgtcgatcgcgacgacgtacgccaagccgcagcaaagctccggcggtgtgcggtgag

SEQ ID NO: 6939 - DNA, 554 bp, Zea mays
ttaattgttaattgtcactccagggggttgattctaactggggatacaagtgcgacatatttttggtcgttgggtcaacccaaaacttgcaaaaatgaactagaatgttgtgcttcctaattaatttaggaagagaaatgaaatgtactagttgacccacaaaacaccattgggtacacttgcatctttagtcctgacccaatcgactgaaacaagtcttattgatttaggaattcattttgaaccagatagcaaaactcggaactgtatcaactcatcccacgaaactaagattgatttcccatttcccctttgtcccaggaactatgtggtccaacatgttttgaaacagaaaattccttatgcaaatgcacgcttggcatctctgtttgaaggaaagtatatatatctctcaaagcagaaggtgagcagcaatgtggtgcagagatgcattgagttcttcccagacgatgccaaagctgtcatagtgcatgaattcctcttgctcagagggtctcatttcgaacaactggtgacagatccttacgcaaact

SEQ ID NO: 6940 - DNA, 222 bp, Zea mays
ttgtttgtcttatttaccaccaccacaaactcacccgactgattcattgtagctgtgacatgcagtgaccgaaatttcacaccaggcgctgcaagcgactgcaatggctatgtaccagcgctccaagcgggcagccgggaactagctcatcagtcattactgacggcgtaatcttcatccgagtggtcagtggcgtctacagtcgcagcagcttgtgcgcgc

SEQ ID NO: 6941 - DNA, 261 bp, Zea mays
gtgtttggtagtacggtcgttccgacggtcggatgctcacaagagaaaagagatgctgtgtgcaagctgcagagactggcgtccgacccgatcccactcccacggtcccacctcgcctctcgcgctcctgcccacccagcctgtccgccgtctggtgtccgcctgttccccaaaagcaaagagaggcgcagagccgccgccgttgatctctgacctttccgatccagagcctagctctcaccgtctaccggagctctcacc

SEQ ID NO: 6942 - DNA, 275 bp, Zea mays
tgctgagcgactgcgaggcttaggcgcttagccgagcctgcgggatgcgccgatccgtccagaggactccactccaggtccggtacccatccatccgtcgcgggcgggccgtcaacccctttggcttttaatgcatttaatgcagcccttttgtcccttaaaaagctaccaccagccgctcgatcccgcatttggtcttggccacgctcgctagctcccttgcttgcttactttgctcagctagctagctagcgagagggccagagagcttcgcc

SEQ ID NO: 6943 - DNA, 904 bp, Zea mays
gcttgctcacttatcgggggcgaggaagtgagagatcaagacggccaggcaagcgagcgtcgtatacggctatatggcagtggggggcgtagcgtagtgctggtagggaacgaaagggatggggggtgctatgtgtacgtggtgtgcgcgcgcgaaatagtctggatgtgtaggaagatgatgcacatactacatatatactgacggatggaattttttttatttttttggaggaggaggaggggtgttctttcatctctctcaccagctgctttggtgttggccttttattaattgagctcctgctaaaatttagcccgggtcacatcaagtgtttgacttttaaataggagtatgaaatatagacccaaccaactggactagattcgtctcgtcttttaatcttcggctgacaaattagttttataatccgactaccatttaatatccggaatggaggttcaaacattcgattggacagagagactaaattttagcggggtgtaacctaacaccccctaaaaatttataagaatcactttgcctgttttataagaatcactaccgcatcagatatggatattacgcgtcagtattcgaatttgctccatataaggggttgagattcgatctatattaagtctaggtattcagtattcgaatttatattcgtatctgtatatttaaagttaaatatttaatatatctacgtctattcaaattttatcgaacacaaccaaccaggaatcataggcccagccgtgcgacggtcggtgcccagccccagcatcaggaccgtccgctccgccgccgtcgccttttcatgcctcgtgtcgtctgcgggtccggtcccggtggtctcggtccgaccccaacgaagggcgaggagagaggaagaggcgag

SEQ ID NO: 6944 - DNA, 242 bp, Zea mays
atagtgaagcagcaagtgtgtaatgtgtataggagctcaagcaagcaaatttgtgtatcagtacacagatgcaatggagctacttttacggcttagttcaccgatggctgtgtacattgggccattgtttgcggggggttttaatgctacgcatacttagggactgagaaagacatggacgagttcatgatgcgtgcagatcagtctggaagtcctggaccaaatagagagaaaacaatagg

SEQ ID NO: 6945 - DNA, 1500 bp, Zea mays
tgagtggggagcttggcagggcactgaaaaccatgtgtccacatctgcttccttgcccatttattatcatcgtttctgggtcgggtcgggtcgtgtgtgtgtgtgcgtgttgttttggactacccgtcccattgctgaccctgagctgcagcaatgcgctttgcttcgtgctgggagacctcaccctcagtcatcgttctctacttgtgagcattttgcacctcagtgcccggcaactccactcgctgtcccacctcacgttcttccgcttgggttcttatatattattagtgcacttttgttgttattttggttatccgtgtagacttttatatgggttttgtataatgttcagagtagggctcatgtgtattattagctagtattccaaatttattagttgtattaggcaatacatatttgcataacctggcctcactaccggaatcaatcgctttgccgagtgcctgaagcactcggcaaagcctttaaaaacactcggcaaatgctttgccgagtgttacactcggcaaagaaggctcggtgaacagtgcatcggcaaagccttctttgccgagagctttttctcgggcactcggcaaagatatttgccgagtgccagacagcactcggcaaagaaaacggccgtctcggcaaagactgacggccgtcagctttgggacggccgctgacggccctttgccgagagccccctttgccgagtgtttgacactcggcaaacatgtctttgccgagtggggacctgtgacgagtgtcctgcactcggtaaaaaggctcgttaccgagagccgaactttgccgagtgcggctctcggcaaagccatctttgccgagtgcccgagaaaaggcactcggcaaagcgtccggcactcggcaaaggctcggattccggtagtgagtcgtcaaaactagtagtgcatgcatgtgcatacaaaatgactcgacccggtgccgtgctagtgagggcaaatcatgatcatcgttttaatttttagcgttcccggtccccacaaaagacaccaatagacgattccaagtgcagaattgtgaccgtatagaaactggggagatatcccggggctgaaaagtaaaatgaacactagagtatttaatttagataaggagtagaattaagcaggagttgtttgtggggctcaagatcgtcgggctcctctcctggtcaagataacggttgcaagtgtgtggtgccccggcctttttaatgacagtatatataaaccactgggcctcaactagttgagcataaaatcacccacacacccagcagccagcaccgattgaagaagtaaaccctatcttattagttaccgtatgtgctcttcctgctcttattagctactacttatttctttgcagctttgctcttattagttacgaacatgccagtgaagaagtaaaccctgtctgctgcttttgtatatgtgttaattaattgcaggtaataatatgaaggccgcc

SEQ ID NO: 6946 - DNA, 306 bp, Zea mays
ggtttgttaggaacgtataacatcgtaccaatttggaccaagtgtactccgacgacgacgagaatccaggctttcaggcagcacacaagtatcggttctgtttttttttccttttatccaattattatactaaataggatttctttttttaaccagtccgctctatattccagagtggaaaaataaaaaaattcagaaaaaagtataaaaagtctaattagatctatctcgaatttttgagaaccccttgaacgtcttttcaaagggttctcaaatcaaactaaaaaggaaaaaaccgaaggtttt

SEQ ID NO: 6947 - DNA, 720 bp, Zea mays
acagagtggagttgacactttggacctcactatgtggcctggctcatgctttgtgctttgcatgataaaaaagaaaacaaaaacaaaaaaaattgttgacacaaaaaggatccgacctgccggattcgaaccagcgacctaaggattaaactgcgaacactacagtcctccgctctaccaactgagctaaggtcggtttttgtttaaaatactcctcaatattttaatatactatatactaactacatggtgacctcattactagacctacttaagttccgtatataaccaaacagtaaatgaaggaaccccttgccctgtggtatgtatttttcatccctctgatttcttttgcatctttgacctagaacgacgactaggtgacatctcaagatatataccagattagctgcaactttattcgtttaccctattaccactgccacttttaagagttctcaggatcttcatcccagcaagccctacgattgaggttgagctggaggctgtgggtggcgtagaagcggtggaggatagccatgcttcacatttgggccatgggcctgccgcttcttttctccatgcattctttttgcagcagcagcagcagcccaagcaagcctcgtcgacaggaggccaaccgtcatatgaattgctggtaggtacccctgccctggcaatacagatagatagatctagcaaatcgcgccgccccagccg

SEQ ID NO: 6948 - DNA, 818 bp, Zea mays
ccggcatagcaagctggccagcaacaacattgtgcccatgcgaaccgagagcgcccgagcccctcccgcccaggggtcccacctcccggagtccgtccacatccgcctcccattcccacacacaaggcacgcctgcccccaacaccaagatttttcataccaccactgtctgcagcaggcatcactgacatctttgccccgcggtctgcgaccccgcatgtcggtcgagggtgtcgttatcaaaatagtggctgcaaccgccggttagtgatacagttcctctcagaaagattgggcctgatgcgagacgttggatcggcatccaacgactgcgttccgctacggttcgccgcccacggcgacatgcggtgcagatctcggcttggcccgtacgccgcccccacactcctccacgcaaacacgtcacgcaggcagtggtggtagccccgctccgctcacagcactgttcggtggaatgcctcactagtcactcactactcagtactcactagtagggctcctgctgcctccaggtccagcccacgctaccccacaccgccgttcctccactgagcaaaccccgcgcgccgccgacgagatgaagggagcaatgccgccgcgccagttcatggtgccgggccctggggggccgatgctgccaccgcagcagcagttcgggctggtggagacgcgccccccgctggcggccgtgctgcggccgcgcttcaacatcccgggcctccacccgtcagcggcgggccgccgccgcggcctcgggcgcgggcaagatcgcctccacctatgacctcgtcgagccg

SEQ ID NO: 6949 - DNA, 880 bp, Zea mays
tcggtacccctgaaattttatcatgcgtccgccactgagtgaccctacccccaagtttatcgattcaatagttttggcctcaaaccatattgccaaaataaagaagctcaggttgtctgtcgtgcatgcggatgtggatggattcagcgcctagtccccttggaggtgaagaccaacttcacatgggtgtacagaggccctaccgacccttctcagatggcgaggaagagttgtttaaatcagacgttaagtagtacttgatgaaaattttccaagatttggccaacttcctagaaggtttctttgagaacatgcatgggtttaaccagtcggtgaaagccactggtggtctcgatggttgccaatacctgcattattacccaactctctgcattctggtacatggcgaccatcaccagcgttactttacagaaaggatgcgagtttgcagcccgagccaaatgcgctacgcgtcaatccatcctataaaataaaataccctcgctcccactttccctctctcccctgtccactagaacccagcacagcgacttgttaacattccctgtcagcctagtgatcacaattcagaacaggtataaggcggcggtaggcaagaattcccctgcgtcttcaacaggtatttgagaatgtgcgaacctagccctgtgacactagattctagttccacttaattgtgcaataatgcacttggctgtccagcactcccggccatgcacacgatataagtgcacccccaccagcatggcctcccctcccttgagacgcaccaccaccccggcccagagcactgcactgcttctccctctctgttttacggaggacgaggaggaacaggaagcagcattgttgtgcaaca

SEQ ID NO: 6950 - DNA, 1041 bp, Zea mays
ggcagcagtgtggatgatgtttcacaggccatactagggtagaagaaagggaaggatacttttgttcctctgagggagggggtatacattgctctggtagctttgaagaatcgatggatgggttgtgtatacgtggggggaaggaagatgccccgttggctgctgatgttgattcactgtgctgccatttcrtttttggaattcttgagtgtcgctcggcttgttgttgtgctgttatgttgtgtctgatggtaagtggcatcgcttatcgatgatatgtacatgcctgtaactcgttttcttttatttgttggacattgtgtgtgtgtgtgtgtgtgtttgaattgtgatgacctagagaacgctggtgtcaatcaatgcagcgtaccttgtttgcgcctaaatttggtagacaaaagaggagattaccttcgtagcatgtgtaccctgcatgtggaaggcaaacctatcaataattccttgtatgaatttgacatagattattacaaactgtcatttgagtattattattattttgatagaaaacagtcgtggagcagcaaaggcgaagggtggggcagagaaggcacacgcaacgcgtggcaaactctctctctctctctctgcacttgcaccagcctcgacttttgtgtcctcacgccagctgaattcccaacctaacagaagcaaccgaatatcccctcgcctttcaactcgtcttcctcctcatgtcgtcgcctcctatccctctatatcttctattctaagccacctcgatcggaccctaaatagatgcaagaaaagaaaagagaagagcctctgtggatagtggtgggtgctggatcactgggcggagcagcttctcatatcggatcgatcgattaattaatatatactataaacatacaatcaattacatacatatacgccaagagaagaggaacgccggcccgtttcacttgtctccttcctccgatccctcccggcggccggccgggctcgggcgtttttccccttttgtttcccatggaggacgccaag

SEQ ID NO: 6951 - DNA, 942 bp, Zea mays
tttaaataaatatatcagtatatatttatatgatatatamcaatcgtagcaaagcacagacaactggctagtatctatataattctgtgttgttctcatcctatatacaggactgtgatcactcatggtaaaggttgcattagagtcgctwattctgcctaatttaaaaagaactcaaactctaggtattgtagtttatgatggtttatgttctacaaagaaattatatatcatatatagaagccgtagtaacatacgggcaactaattagtgaattatataaatacttattgacacgcttatggattactataatctaggcatatagattacataacctgtctaataatctatgttgtctagattatataatcgatagagtaaataaacagggtcttacaataacaccccaacccaacatttccacgtctcaggtttttttatgagaactctagacataaaagagattagagaacaacatcactttgacacctgctactcagagtcagagaaacgggatttcacaatggacggctggacctatcgtctcgtggaacgtgggaagaagacggaggcagcaaccaaatccacttcccgcaatgactggctcactgctggctgctgggtgctgtcccccctgtctgtttcgctttcgccacgtgaccccgaggcccgagcccgaagcggcggcgcgccgggcgtcttgacgtccccaatgacgccgcgcgtcgtggacggacctccgcagcttccctctcgtccgttccgcagtccgcacggggaggggagctacagcgacctaccgccgaggcgggccccaaccgcaccacgcctacttcaaaccctctcccaccccacctcctgccgttctcggaggggatcaagttcgcttctgccagtctgcctgcgtgctctgctggacagctggagagctagatggcg

SEQ ID NO: 6952 - DNA, 1026 bp, Zea mays
ggcagcagtgtggatgatgtttcacaggccatactagggtagaagaaagggaaggatacttttgttcctctgagggagggggtatacattgctctggtagctttgaagaatcgatggatgggttgtgtatacgtggggggaaggaagatgccccgttggctgctgatgttgattcactgtgctgccatttcrtttttggaattcttgagtgtcgctcggcttgttgttgtgctgttatgttgtgtctgatggtaagtggcatcgcttatcgatgatatgtacatgcctgtaactcgttttcttttatttgttggacattgtgtgtgtgtgtgtgtgtgtttgaattgtgatgacctagagaacgctggtgtcaatcaatgcagcgtaccttgtttgcgcctaaatttggtagacaaaagaggagattaccttcgtagcatgtgtaccctgcatgtggaaggcaaacctatcaataattccttgtatgaatttgacatagattattacaaactgtcatttgagtattattattattttgatagaaaacagtcgtggagcagcaaaggcgaagggtggggcagagaaggcacacgcaacgcgtggcaaactctctctctctctctctgcacttgcaccagcctcgacttttgtgtcctcacgccagctgaattcccaacctaacagaagcaaccgaatatcccctcgcctttcaactcgtcttcctcctcatgtcgtcgcctcctatccctctatatcttctattctaagccacctcgatcggaccctaaatagatgcaagaaaagaaaagagaagagcctctgtggatagtggtgggtgctggatcactgggcggagcagcttctcatatcggatcgatcgattaattaatatatactataaacatacaatcaattacatacatatacgccaagagaagaggaacgccggcccgtttcacttgtctccttcctccgatccctcccggcggccggccgggctcgggcgtttttccccttttgtttccc

SEQ ID NO: 6953 - DNA, 1500 bp, Zea mays
gtgtatcgtcggcgtgctatgtcgcgcgtgtccgcgcgtcgttcgcacgctgtcatgatgtttcacgcgttacgtgtttcgtctcgctccgctaattcgttctgcttagagttgttgttgttatttaaattatttatttgactaagaatcgttagtgtggtcagctaattaaaattgtgcaacagttctagttctattttaataaatattgattaatataattagatcaaactaaatgttataattaatactctcttagtatggacgcgataacttctcgaccatagcctcgaccgtcgcgtttctttttcctcgcgtgactgtagtaacgcgttctatttcatattgcatgttttgattatgtgttcctttgtatggtgtaatgttcttatgcatatgtatatgtttgtttgctggtgcttgttcgtcttcgcttcgcgtcgcgaacggactgcgatccatgttcgagcttcgaggaatcgacgatcaagatttggtgaaccaccggtcctgagatcaagctcttcgagtcctacgagattgaagaccctgagcatctgtttggtgaaggcaagtgtcatctgacccattatgtcctatttactttataattcattgccccgcatactatgaacaacctaaggattgactagctttctatttaccttgttcttgattacctttcggcttacaatggttagcttcatgctagcgctttactttaatcaatgaacatgatgagatacaatgatggtactatgattttattctggatatgatgatatacttgtggcattttaggggacttgagcggtttctcgagtgcctctccgtaaggacttgttcgttggatgaccacccgggaaaacagtgcaaccatgagggtggaatgggacgcccttagctgaataattagaggaactggggtgtagtttgcttcgccgtcgtgccgttaatggggctcggtatatgcggctcgctctgccaaggttggttcgcccattggggaggagtgcggtgcatttaggaaacctaacgggcggctacagtctcagggaatctttgtaaaggcttcgtagtgaatccctggtcattcaccttgggagtgaataagggtcttgcaagcccaggctagagagggaatcacggcttgtgggtaaagtgagcaacctcttcagattgttataaaactgatatatcagccgtgctctcggttatgagcggccaagggagctccattgattagagacacattgaccagagatgttttggttactgatgatgatgaagataatgttggtttctattatgattatgattatggtttcaggtattctttccgtttggaaggagtacttttgggttaacaacttgggttaatgttaaaacatgactctctactagtaataatgacctgaccaactaaaagcaactgctcgactttaaccccacataaagctagtccactacagtcaaacgggacatttgctgagtacgttg

SEQ ID NO: 6954 - DNA, 1090 bp, Zea mays
gcccccgataaagtgcgagatagtgtccgactcagtctcttgaccgactcgaacgagctcaaccccaacaacattatgtttcctccttttaaaatataggccatttatattttcaaagttattttttaaaaccttaaccaaatttatatgaaaatataccaacatcaataacatgttagttctgtaagacccgttgacttacttcttaatagtgcattagtctacaatgtatatgttaaaaatattgctcaaagttagaaaaaactcgatttcaaccaatctaaagaaatctagtaatggtggaatggaagatgaaggcaaagtttgaatcgttttcaaaacgagtggtatttggggtgaatgtctagtctcatagtccaggaaaaaatggaggtaaaagaagagttcaaactggactaaggtggtcttccaccaaatatttttccctttagatatccctccaaatatctaaccattccttcacctctagaggactactcactttgttctacaatagttattgctataatatttatataggtccaaattttctaaatttgactagatttataaaaaaaactattagcaacatttatatctctatataaatttatacacaaaatttaaagatctatctaataatactaactatgcactataaataaatattgatatgtgcacgtgtgtgtatatatatgtatataagtccatgcattactacagtttttgtatattatataagttgtcttaacaatcaaagttcaattcttatttgtgtataattttattccattttttattaagcaggaagaaaaatggtgacgcgggacggccatgaaaccgatgctttatataatagagatggttaaaatttaaaataattgatttttcgaaaatctgcaatatcaactgttttaagacggagggtgtaaataggataaagtatggacccgggcaacaaactggcctttgcaaaagcgcccttcagctcccggaccgcttcccctgagctgctgcccaagaacttcgacaccacttgcccaccctccctggattcttgcggctcttcctcgagctcatcgaatccttc

SEQ ID NO: 6955 - DNA, 1010 bp, Zea mays
gtgatttaaatttatttattttaatctataatatacatgaaattagtatgagtcaagattcacttagcatgtctacatctctagatctaggatttcttagagctataagtgaccagctctaggaaatcctcttagcacgaacatggacttattccctttactaccaagtggcagcatgtattcacttcgcagtaacagctccagggctttcgttggtgctgatttatttgtttgtagataatagtagcgtgcctgttcatgaaattgcattgaagtgtttaaatcacaatgccataatgtgtttgcaaaatagcattgcattgtttaaaattacactatgataggctgtctttatatcctatcagatttatttatatgcataaaaaggtttatgtgtcgtctgtccatctagataatgaccttaagttccaggaagttattaatgcatatcgtgcagatctgtgtgtattcatctagcatgcctctgactgagtgttcctaggacatttcacgttatatggccagtaccacaaaatgtggttacaaccagttctatcgtgatgtttctcgtgttcttgacaaaattgttatatagttaatataaaatacttaagaatcaaagttaatgataaaacaagggtgttttcttttttttcttgaacatctctgtatttccttttctactatctagagtaaaactaatgtatgctacttgcatgcacacctacaaayctttattaaatactaattaattttccagttcttcgtatttcatttgtttgtgtgttgcgaagcggttggagttctttcaattatcaggtgacaaaatggttatgtttaatcatgcatgttatcttcctggccctctatgtttctttgaggcattcaactacttgtagtatcagggcatcacagatatgtatatatgtgttgatgttmgtcatycaagatcaaatacatcctgctaggtcattacttgctaatgtgcatctgattttgctgttgcyagg

SEQ ID NO: 6956 - DNA, 1500 bp, Zea mays
ccggattatctgttcatatcaatcgtgagtctttgagagagaaaaaagcgcagaacaaaaaccctacaagagttgctaaatgagtaagaaaaaatctctcagaataccatgtgcggtgggcactatagaataaragtgtgaagccaacgagggaggaaacgagcattgggacacacctaaccagcatcagaacgtccatcccaggtaccaaaacaccccagaacacacaggctgaagtaaatatgttcgatcgcatactcgagcaaaaatctagatcgcaaatatcatgttcgtggctaaccatgattcatgtgtcgagttgcataatggagccctaatcaaattgagcacaagtcgcagattcgtggctagccccgattcctcgaactcagtagtaacctactcccagtggcgcacctgacactcggaatggacagaagcagcaagcttctctccacacgacatgcaggggcgaatgcgaatccagcacagagcatgtttttgcgaagaatcgaagttagtgtgtaatacaacaatacatgctggaccagatccggctaaaatagcttagcttagagtttggggtttagctcggttccgcacggcgggcggataagggcgtaccaggttggattctcgtcgccggcgaaggtccccgacgaagagggcgtcgccgctcgccctgccgtccacccgaagcaaagaagccgacgagaggagagtaaacgacgagtgagttaatgggccagcccgtataggcaaattgacgggcctacggacatgagcagcccagatcgtagggggaaaaaggccgttttaattaattatttatttattccaatctccttataatcttcgtggttagttttttatatttattaatattttttgtgaaactatttattgtgagtggcctgagaaaaggcagcacaggggtacaagactatccggcgttcggctaaggctaagctgtccggacgttattctgtccctttcctccgtttcccacctcaatcaggtacgcgtccatctttgatgcacacgtttccatcctggttttgcttcccgacggacggagggcgccgctcgacgtcgcaaagaaagtgcacactggcagtccgagtccgaggcaaagaaaagttgcgagcacttgggaggagaacgagaggagaatctgggctctgggcggcgtcaacgagaggagaggatgcgggaggtggtggtgtggtgtggtgtggtgcagccgaccggaccggacccgacccgacccgagtcgcgagcgggacgtagcgatgcagataaagctgagcagctggctagacagcgtgtcaacgtcagggccgcatcgccttggccgcaccgctaagctaatccctcccatctagtccgtacttgtgtgtgtctttgccgacggtggcaaaggaaagcgcgcggtcaattgatccctatctatatctaaggcctatagctaactagctcggtccggcgatagaggccgcc

SEQ ID NO: 6957 - DNA, 1500 bp, Zea mays
tgtctagccagctgctcagctttatctgcatcgctacgtcccgctcgcgactcgggtcgggtcgggtccggtccggtcggctgcaccacaccacaccacaccaccacctcccgcatcctctcctctcgttgacgccgcccagagcccagattctcctctcgttctcctcccaagtgctcgcaacttttctttgcctcggactcggactgccagtgtgcactttctttgcgacgtcgagcggcgccctccgtccgtcgggaagcaaaaccaggatggaaacgtgtgcatcaaagatggacgcgtacctgattgaggtgggaaacggaggaaagggacagaataacgtccggacagcttagccttagccgaacgccggatagtcttgtacccctgtgctgccttttctcaggccactcacaataaatagtttcacaaaaaatattaataaatataaaaaactaaccacgaagattataaggagattggaataaataaataattaattaaaacggcctttttccccctacgatctgggctgctcatgtccgtaggcccgtcaatttgcctatacgggctggcccattaactcactcgtcgtttactctcctctcgtcggcttctttgcttcgggtggacggcagggcgagcggcgacgccctcttcgtcggggaccttcgccggcgacgagaatccaacctggtacgcccttatccgcccgccgtgcggaaccgagctaaaccccaaactctaagctaagctattttagccggatctggtccagcatgtattgttgtattacacactaacttcgattcttcgcaaaaacatgctctgtgctggattcgcattcgcccctgcatgtcgtgtggagagaagcttgctgcttctgtccattccgagtgtcaggtgcgccactgggagtaggttactactgagttcgaggaatcggggctagccacgaatctgcgacttgtgctcaatttgattagggctccattatgcaactcgacacatgaatcatggttagccacgaacatgatatttgcgatctagatttttgctcgagtatgcgatcgaacatatttacttcagcctgtgtgttctggggtgttttggtacctgggatggacgttctgatgctggttaggtgtgtcccaatgctcgtttcctccctcgttggcttcacactyttattctatagtgcccaccgcacatggtattctgagagattttttcttactcatttagcaactcttgtagggtttttgttctgcgcttttttctctctcaaagactcacgattgatatgaacagataatccggaagatacatgtgccagatgtgtcgatcacagggatagtaaagctctcgaactgggtgtaaagagatggtaagttaatagttttcacttgctaaatcaacatggtggatccaagttttttctagaaccacaagacctattcactaattactctttagtttgttcccgtgttagataac

SEQ ID NO: 6958 - DNA, 1042 bp, Zea mays
gacgtgacaggctaattaatatatgatacactccataaaacctccattgtgaatagcctaagtggctcacgtcgccagtgcaatgcaagccgacatgtgagtcatagcaacatgagatgagacgaggaggaaaaacgaaaatacttcttaccagatctgttttgctcttttttggacctttctgagaaccgaacagagatatacgctttactctaaaaagatagataacatacttgacaatattacgatgggagaaaaaattgtcatgtacccacctttccatgtttaggaatgacaccctgaggcaagacggattttattttttttatttctttatttgacgaccgagtattattaagttgtatgcaccaaacagtttaagccaaaaaacttaaactgatagtaggtggtgggcaattcatttatattatatattccaacacaccgccctatattgagccttttttgggtgtgtgacgtgaaataggagcaaacaacaattattatatttaattgcactaactaggattcgaattcatgacttctgactctgatatcatattaagttgcattctttaacctaaaagtttaagttgatagaaggtgatggataatttatttatattatattgcaactagcataaggttgattggcaagtgtggtgtgggatctaggaagatcaacagagattggtattgtttgctacagaacaaaaaaatcactttacaccaaatacaacttcgtattatatgacttccaaacacatacaagcatctgccactaaactttgacttgctaagacgcgcattcatttgtctccgtcgccttggttaacgcggtcaaaccagtttccttacaatattattaggaacgaagaacgaaggagcccaagtcccatgtgctgatttcgtatcttgcaagtcatcagtgtattataagatggtgtccgcccggtcatttgggaaccttctacacgagctgcagcaacttcgagcgaggcactgcttttgcatttctcacgagtcacgacctgagccccag

SEQ ID NO: 6959 - DNA, 234 bp, Zea mays
ctggggtccacgtcacgtcattagcccgcacctcatctcagcgcacccgcaccaggccgccttcgtcttcgtcccgttccctccagtccggctatataacccgcgcgccctcccatccgccgctccattccgtcgtcgtcatcagcagcttctgcttgctctgggggggaaggagagagagagagcgagagagagatctagtagagaggctagctaggtggtcctcgaacgaag

SEQ ID NO: 6960 - DNA, 1208 bp, Zea mays
gggggggggcataagtcaggctcaagagtcaagtcgaagcccaaacgaaaagaaaaaaaagcctgatgtcaggctcaattcagggccgaaatggccaaaataaggtaatggttttcgggtcaaacctgacatggtacttgaacaggtctagtggcattaactgatttagggaaattcactgtacctcaaattctaagcatataaatttggcatgaagaaaacttcagttttgtgtaatctggttcggaaacgcactaaattttagatgtgtagatctcagaatcctaaccgtttctttaggcgttttcaggtactcgattttccaaatggaaagaagaagaaaaagtcaggtcataccaaaaaaaaaacattcgaattatcatcatcacacaagtcccatgaaacactcgtgatgaggcatagaccctcagcgtaccaaacaaacaatcatcgcaacctcattttttttctgtagtttataaatccagcgccgagtgggacgtcaggagtgtaattattatctcaaccgtctccccccgatggaattttttgttgttgtggtaggtatcctgtcaatcgcccccgtgattcgtgcggccactgtgttagtttaggcagcgaattgattgggctatgtttaatcgacagtcatgccgagatgatgttgtttatcatggaagcacaccgtaaactaaaaccgccaactgcccggccaatgacgtattacccacagcaccgagcatgatcgcttctctgtttttactgatcggtcggcgtcaatctttcgctgctgccgtcgccagcaatgtcgtgttcctccggtccctgcgcttccaatttccctgggaagcggctggctcgcccggatggaatgattccagatttcaggtccatatcctcgaaaagctggatatcggccgcagcaaacaccaccacaaaccccccggcgcgcacaggagcgctcgacacggggtcgccagcgccgggcgacccctctcgtcgccatcacgccccaataattcactgcccacgcccgccatcgccaccactggcgtccgcaccgcagcccgccaataataacgctcccaaagcagaggccgaaacccgcgacgcgcagcgcagggccagtggcgacctccagctccagctccagctccacacgcgggcgccaccaaggagctgagccgagcccggcactgtcggcggcc

SEQ ID NO: 6961 - DNA, 1500 bp, Zea mays
ccgccgggtctgtccgccaccccgtccccatgcaccttttatatatgaatgaatctacatcgataagactatctatgtctatgtaagaatgtaaaaactctaaaaaggaataaatttatctggatttctctagcccacgttttccttcttttagcacctcttaagcagcttacgagataacatgtgttaaattttattacaccattattagctctcctgtttatataaccaaatggctaaaagtaactaaaaatctactaaagtttatctcgtaagattggaacagggtcttagattattgaggtttgatttttttttttttttttttggtttggacgacaggcggcaggtcacatgcgcatgaatagttgaatacgacctccggccgctctctgcagcgcacagggatgaataatcaatcagcaggacggcctactcatgtctatcagtctattgtgaactagctagctagtcgtcctcttctttacccctgcctgctgcttttatgcgcgcgaaatcaaagaaaaaaaatgttcggtgatgatcgatcgcgctttctttctttttcttttttttttggtgtgggtgtgttgtgccgggagaaacggcggggaaagatgggccttcttttttcctgcgaaatcatgcgggccttttatactcgcgcactcgtttaattccattttttattttgtgcgcaaacggcgctaatgatgcgcatgtgctggggggttggacgggcggcggttagtaggagtggtaatggatctcgatccaaatggctcttcacaatttagtagtgtcctaacttatttatagtttaaaaatgaatagaaacaaagtccgatcctaatccgattcgatctttaagttttatagtataaaatttgaggcccattgtcagccctacgcgagggcgactcggtcggttacgcgtgcggggcgctgtgtcggttccaggtgatagacccctgatctatcaccctaggtgatatatatctaagcttgtaattatatttatctaatattacaaatatttttttagaaatgtaaatatttacattttgatataatttgatagctattctgaacttgtatttttttatggacggagaaagtataggctagccgtttctcctgccatgtttatagacaaaatgaaatcaaaaccgagcactcctatacgccaattgccaggaaaacaaacataaaattatagacaaattggtaaaatccaaactgagagtgccagccacataaatcagcagcagcttgcattggctaggacggcgactccgaccacccccgaatcttctccgcaatatgctagaaacccctcgccccgtttcgtagctaccgaaaacacccctcggtgaccagcccctccgcaggargcacgcgtcgtgaatacggcaaaagcgcaggggtattccaggacaagaagcctaatcgccacggccacaytactccacctccgcgcggcgatgcggagcagaagca

SEQ ID NO: 6962 - DNA, 107 bp, Zea mays
cattgcgatgtctgcctgatcgaactcgccctcggaggaaaaactctcctctttccactcaagtatgttgcaccgtatctggtgtggtatcctctcttttgatattt

SEQ ID NO: 6963 - DNA, 1193 bp, Zea mays
gggcgactggaaagcgtttggaaaatttttacagttgactgaaggctttacttggcgaccctacgtctcactccactctctctctctcttaaccttccgacgccaaatacaggtctagctcccctgcgctaaatcgagcgggcggctgcacatgcatgctttggatggcggtggtggaggagggccaaggcccaggcacatgcacatgcatgctgttgacgatatagaaaagtgtgaaaaatataatataatataatatatgatagttggtataaagttgatatatagagtaattgtgaccgtgaagaattatttgatagagtagaaaatcttttaggatagagaaatatggtagcatgagtgttgatagcctaagtttgaatctgctactggtttccaccatctgctaatgcttccaagtcatggtcgttttgccgactttaacaagttgacgcttcacgtgctcgagtttttgttaggcaacaatgtttggtctaagaataaaagttggagttaaggttgagaataagtgttcagcgaaatttggacacagtttgatcacgtgtttgaccataaaaaaagaactccaatagaactaggttgtcactttcagccgtagttttaacctctgtcaaaacccactgacattattttcaacttggagcataattatccgctgaacaggtaattggatgcttggctaaaaaactagctagttcagctattagtattggatttttgtttgaatggcaataataaaactaatttaagccacagccttcgttctcaaatatgtgttgtcgctagtttatttttaaactaaaaacgataaataaaaaaaaatcaagataatatttttttagttagctagcttgcaactagcccttaattcaaacacgtagctttggatcgttgcgttgttaaagagaaataaaggtgcagcgcatcgatcacgtctccgatacgcagagacgctttaatctttatttagtattaagtccggacttgtttcgaattgaaagcaggatgttcctacctttaaccaagtggaccaagatctctatcatcgactccctccctgcccccctcctcttataaaccatacattgaaacgacgtctaattgtgttgtgatccaggcagcagtgagctcagtacacagctaggcacagcgacggggtccggtccagggcc

SEQ ID NO: 6964 - DNA, 510 bp, Zea mays
ctgttacattatattattagatacaaatatatttagtctatagtaaacgccggagctttccattgtcatagtgccgccaccaccgcatcacatcctctggccagatcttcaatttctgattctaagcagtcttcccttcccaactctggatgagcttcttggcgtggaaacacactatccaactccaagaatgagattcgttcgtgctcctccgatctcctccagagcaagaaaaaactattcgacccctggaaggttctgatataacatgaattatacttaatttgatttgatagattatataataaaagtataagtgtacttttatttgatatttttagtactagtcctagttgattacacaatgatcagtttttctcctttttgtttagggctatagatatataataattactgtattcccagtttcccatacggccacgcctgaatgcccgacctccgtccgatccggtcaaatcctcgccgcccacgcccccgcctccgccggcg

SEQ ID NO: 6965 - DNA, 504 bp, Zea mays
ccactgtctccggaaacaaccgctaccttagtacgtgcgccggtgcgcggcagaggaccgagatccaacgcgccaacgcggagtggtacgtacaggtttccatgtagcgcgcccaatccgatccggtccccgtaccaagttaggcgcggtgaccggcgcaggagagagagggtaactaggcagttcatagaagaagctaccccggcagctaataagcagtggcggcgatcatatcgactgcttcgcccaaggttgctttccagcctttacgccatgaaaccaattcaagttccaacacgcacgcaccaagaagattttacacccgatgatcatcatcacggcctcatgcatgcatccatccacgcattttattacgtcgggtggacgcatcgcgatatacttttcctgcacttatatataaagacagtggtagaggaagaagtctctgtcacagcaacgtaacgtcagaaacttatccttgctcgatcgctcgccactgcatcc

SEQ ID NO: 6966 - DNA, 1500 bp, Zea mays
actcgtagttctttggtgtgagtgtgtggagtgtggacacacacacttttcccatcgtagtaagtagtaactaaggttaatatagggcataaaattcatattcttgataaagttgaaatagagtatcgatactggacctgaacattttacgttcttactctagaaatttgttgtcctaaattaattgtcaataatgccaacaagcaagtgttaagcctgcttttttgcaaacgggtagagcggcccgctcatttttagtttaggaatacttaaaaattaatttgatcaaactcattttttaggcttggtcatctttgtcagacttgccataaaacaaccccaagtctgaccatatttgtgttagatttaatataatatatgttgtttaataagatcatcctcgtgtaatgcaagaagaaatattattgtgccagataggcctaaatatttgatttttttttgatatgacacacctttgacagtttctatgttgatatctgttttaaccaaatagcttttagctttcccacaatcatcaactccccacagttttctcatagcttatatctaaaatcatttttttaacacacctttgacaatttctttaaggttctatgtagcgaaaaatttggaccacctccctattcatttattaccataattcttgatttttttccatctgatgtgtcactttacaaaatgaggacgaatctggtgatgaacagtgttgccataagaatagcagggtagtgcttcctccattctttttttataagacgcacgcacatattaaaatttggtttggttatatttataactaaatgtttgatcaataacatagctaatagtgttaaattattatattttaaatttgattcggttatattataactaaatttattatatagtcatcgtaaatttgtaaatgtagatgatactataatataaaaacaaataaatagttagagcgagaatttggaagaccatatcgtatcaaaccgtgtcttgctataaataaagagaacgaaatcagcatattttcgccaaaaggaagtgtgtgattgaatactatgtatagatgaaacgtatatccacagttccacttccacgtatgcttctgcggcggtttttggggaggtggaatattgcagttgccccctttgaccttggccagagctgaccctgtgtaacgcggcgcccagacggggttgcctgccgagtcgggtattacgcagcagatcgccaggaattaggaaacgtgcggctcggagtcgatttcgtgatatggcctgaactcggccagctaaacactcacgatcgcattctataaatatcgacacccgtcttcctcccgtttcatcaaatccaagaactctcaatcagccagcccacagccaattaatctcgctagagggccggccggccggctagctaaccacgagagagaaaaaaaaagatcgcgattgctttcgcgcgcgcgctgcgagaggcgccccggcc

SEQ ID NO: 6967 - DNA, 1500 bp, Zea mays
cgtacgaacaccaaacagtctcagacacgttacacacatctattcccgtccccaccttctgcgagcacaaagagtgtgggagagcaggccttcgaaatcgccgtccacagagcgacacttgcacgagtgtgcgggtgatcaggtttttagggagcgtactcgcgactgcttgcttcgtctgctcgaccagcactaatcaggttgctcatcgccgacgccgttagagggaccgcactgcgtatatctgcctgcgtcgactgcgtacgattacatcgaacatgcacacgagatatctcgtgtgaatgaagccacttttgccttgagcatcggagcatccgtagggcacactttgttctaagtatttgtgcatattttactgttgtttactgtttacgtgagtagtaatacacatacatatacatgttgtcacatatatcactgtgattttctagattaaattaaaactgaaaatatctatttcttgaacaatataagtgctaaaacaactaatattttggtytggagggagttttacataacaaggggggagtatgtcgttgtatagacgaggcaatttattgttttagctcaagccccacgaaactaactccgtctcaagaaaatcttctaaattcctcgcgagagaacacaatactctattatactccctttttattttctttacttgacgttttgtagttcatttttgtactatttagcgtcagatataaaaagatgaatatactctaagagtagcgaaaccatgaatagtgaataaggaagaaaaactctaaagagctttctagagaaatactaaaaatatataaaaagggaaaatcctagtcttcgtttgatcgtgcatgcatatgtgtggcccaaccgcccaatccatcaccggtacgtgctccaggctgtagctgcttggaagtcttccgttcttgcttgaccgattcctgctagcctttggaacacggagaccgaggccaccaataaatcctcacatgcgtggtactggtacgtggaattgaagcaaacaaaatacggctgcccgcggcggccggataatatataagatgatggcggcaaattgtcttcgcagacgagaaaaatcgcaggaaagcggtgacttctagcaggtagcatgtgcggattttccaccgcgatgggcggcggcggcggcaatccaaatctgatgatatctcaacctaggctagagtgcttgtgtctcgatacatggtgcgttgcatgcattgctgacccatgcgtcaaaagttcatcataaaacgtgggacagctgtacgttcccgcgtgcaatggtggacatcacacctagccactccacgtcgcatgccatgcatcgacaggatgcacgttccgatccctatataaaggggcacccagcttgtgacacctcaaatcacctcacacaacaagctgcaccgcagcaacgaacacgaaccttggcagaacgaagctgaagtagttcgctgtgaacccagt

SEQ ID NO: 6968 - DNA, 1500 bp, Zea mays
tcccacctarggatgacgatcgaaaatttccatcggagaatggctcccattcacgtttgtataggaagaaaaattctgtctctgtccccataaacgctcgtgagaagtcttttctcctatccccatctccgtaggagaatttatccacacaaagaattcgtcctagttaggaagtgcaatttttaaaagcaaatttaaattaattatatcaaaccaatgtaaactaaacaatcaagattttaaattataataagagacatttattttagagtttagtttactattttacgatggacttagtattgagtttaaaatataattttaacaagtcattagactaatttagatcaagagaagtttatgggcggatacacaaggaggtgatggttccccatccccacgaacatgacggggactaaatcttctacgttttgattctcgataggactaaattaccttatacccatctcctaatagaaaaaattctcatgaaaaatcggagaacaggttcccactgtcatctctactcgggccctcgctgtcaagcccgcgtctccgtcgacgactgtcctatgccgtcgagcaccttccttgagcgcgactgcgcaagggattgagggagcaggggtcgtcagtcgccaggaagtggaaggggacaaagggttactgggctagattttctgagcctctagcagtaacaacaacatttctatagtatgcacacatttgggataaaacaccacagacactggtgtgctagctacggctctagattatttagtggagttggtggagtaagtcatcaggtacttcacaaaattatggagttaaagctaggaaactttagcaaatatttaaattagttattttatttattatttagattaaaaatatttttcaaactatttaaactcatattataaactgcatttccaggctgaagctgaaacctgaaagttgacttccacggattattagagcggagagctttgtcggtggcattgatgtctagaaaggccaagagaagaatggtgtgtcatgtgtgcgtggtcaaactatgcaactatcaaccgcagcaatcttggaagtctttctatctgattgaccgttcgtacgttcgattgggcatacacgtgacacgcatcaggccagccacgatatatatcctcacgatgcatcatccatggactcgaacagtagacgacggctgctagtgcctagtgaatactggcgacggacgcaaccagcgccacaaaccacgtgggagcgaatacacatgcccacgccggcagcaaagcacacgtaccagcaagaatacatggcgaaaaatggactcatgtaagggcagaaaatggtataaaatataaggttatgtggtagataaaagccatgcaccccaccgtgccatgcacccctcaaaactcagaacatgtactagctaattaattaagcaaccgagctctcctacccagttcagcgaactcaccgacgccgacgacg

SEQ ID NO: 6969 - DNA, 677 bp, Zea mays
caagtgctcatctgcgagtggattctttacaatgtagcaaccataaatcgaccttacgcctctagcttgaggccaccctaaacggatggagcagatatttcctagtaccccaaatgagttccaccatcgccgtggtttcctccgtgaggcgcacgtctgtgccggctctcacgaacggcgcgaagaacatctccgatatggtgaccaccatgaaggctgtgacgaggaggtacgccgctgctctgggcggccgccacagcccggccgccctggcccgtcgctcagcgatctggaacgcggcatggaacacgaagaagagcaacatctcacccctgggctgctgtagcgtcaggtaccagtacaggaactcgtggagcaggcccgacattaggaacgcggccagcacgccgacgtcccgtccccacctggcgcgcacgggcgcatacaccgactcgcggaggaggtccacggccattaggttccactgttggccccagaagctgttcagcgaggtgacggcgagcggcgtgctgaactgcctctccaggctcgcgcccatgagtgccgcggagacgagcgcgatagaggagaacacgaggtcgagcgtgaggaagatctggacgcagtagaggtagtggagcgcgtagagcgggagccacctcgtgtaggggtacgcc

SEQ ID NO: 6970 - DNA, 286 bp, Zea mays
aagatacatgttttgggaacaaagtttcagaacaagcttcttgaagtaatcgatgcaagatcctgcatgtgtttagattctgcgtcgacttgagggcaagtcgaattttaaggaggagggaatgttacaccgccattgtcagatactccatagaaggaagtccgtcctgagtgggtactaactgcagccttgttgttgcggtcctatctaggagtaagtctctagcgtgtgaggctgtgtccctcggtcaccggttggtgagccatgttcctaagtagtcgtatat

SEQ ID NO: 6971 - DNA, 206 bp, Zea mays
aacaccgtgaagcacggcctcgcctgcgctaccatttcaggtgaacaccgtaacatcggttgcagaacaaaatcctctgcaggaacggcgatctgtacgcgggggagtacttcgcagacaagatccagggtttcggtgcgtacagattcgccaatggacacagctacgagggatcttggcacgaaggaaagaaacaggggttcggg

SEQ ID NO: 6972 - DNA, 225 bp, Zea mays
tccctggacggcccaagcaggcattgcgggccgagtacagtcgcttcgcctcctacttggcctccatcgacttcgtcgaggccaagtcggacacgtccctgatcatctaccggcgcggcaacgacgccgtttacctcctggctccacgttgacagcattgtgctcacagcatccaccgccgaccttctacagcacacaatcggcgcccttcagcgggagttcgca

SEQ ID NO: 6973 - DNA, 288 bp, Zea mays
cccctgaagctccaaaataatgcttgtggaaattttgaggatttcatgttctgtccgcgtaatcagctactcagcgtgcgttgttgtagtcctaatctgtacaggagaaaatgaatcatagagttggggttgttgtttagtatttgacgttttatttttctaactattaacgttcagaactagaaattgtggaaaccttaacccaattaaattcttattgcaggtttctaacaccaaggcacctgccaataaattttgcctactggcactccatatattagaagcaat

SEQ ID NO: 6974 - DNA, 862 bp, Zea mays
gccccctgctcaaaaactattggtaggaatatttatagcagcaaaagaacaaaatggaatgtgtggtttcttatctgccttagatgagataagatttcagacatgtgtattcatgttttcgagtgatttggcagtatgaatgcactagatggttggttgcttttttgttaattgctcaggtgatatatgctgtatttctagtcactagttgtcggcgtttcgagaccggggggtccctaagccgacgagtgaatgtcgccgcgtgccccagcccagatgggtcgacgcgaggccgagcgcgaaggggggaagtgaggtggccagagatgggcgtgagagaggtggaaatcccgcggccttcgtgttcgtcccgcgcccaggtcgggtgcgcttgcagtagggggttacaagcgtccacgcaggagagggagcgagcggctccaagcgagcgcctgtctcgtcctcgtccccgcgcggccaaccctctctaagagggccctggtccttccttttataggcgtaaggagaggatccaggtgtacaatggggggtatagcagagtgctacgtgtctagcggaggagagctagcgccctaagtacatgccgtcgtggcagccggagagattttggcacccagctggtgtgatgtcgtggccgtcggagaagtgctggagcctggcggaagaaaagctgtcggagctattgagtccttgctgacgtccccctgctttcgtaagggggctaagagccgccgtcgtcatagagtacgcggggcaccatcattgcctatctggcggagcgagccggatgggacgccggtcttgttccccgtggcccgagtcagctcggggtagggtgatg

SEQ ID NO: 6975 - DNA, 406 bp, Zea mays
atctccaatcggacccgaccgatcattttcatacggcggaggagtgtatgcatgcatctgtcatcgcgcctcatcatcagcatgcatgttaggttaatccatccatccatcacctatcacatggctagatctgagtaccaatacaagcagttgcgtggcgagtaacatgtacaacgattgcaacctttcgtcagcgaactgcagctgctcccgtttttatatgatattgcaactggacctatatattttaattttgtttagcttaagtgggacagcagttgaccgagcatgagtggcaactgccatgaatgtcgtcgatcattaggtacaatccatgtgatcggtgctttagagatcgagttattaattctcacaaaaaaaacttatgatatgagacggattttga

SEQ ID NO: 6976 - DNA, 198 bp, Zea mays
ggcccaagcaccttccatatatcactggtttggttcaaaatcagcacagaaggtgcagatgcctctgaatgttgttacctctgtaattaatggcttcaaagattctatgttgaaaaactgaagcctttggaagtcgcctacagatataatgattttgctcacccattattgacaaacagtgattttgaagcaaagcca

SEQ ID NO: 6977 - DNA, 817 bp, Zea mays
aagatatgtatggcctagcttatctatcagatggagagagagaggtgttgccaagtccaaaaaatcctgatatctttaatcgcggcaaaaaaaaactgcgtggcatatctgcttcacatgtttttaggtaggcttcttgtttcattaaaccaaccagatttggctctccgattgkcttggctgctggctgcacttggttccctgatctttcctcgaattggataaacaaatagcaacgcagcagcatacctcctgctaactaaccatctccagctcctcatctttttgcattgccgccctggtatcttgcttacccatcatctttcacacagcctgtcarccattgcattgctagcttttcttcacttctggttggcatctcttcttgtttctagtacaaaaggacgctgtttgcttcataagcacgaggagagatacatcgtggaagctactcaccaagtgtcttactcagaaccctttgatcataagcacgaggagagatacaaaagggcgctgtttgcttcataggctctgagatgagtaatgggtgctgaggatagagttgcgcaagcttcctcccattctgcgtccctgctaacatctggagattgccagtggctatgatctgtaaccaaagaagagggaaagtgtgagattagcagctggttcagtgttagctcagtatccatcattcacttgtaagcacagtgcacttgactgaacactacagttatagtttttatgacagaatctctcctgctctaagtgatgcctactacacacaaggtactcatctttcagactggctgtttcaggt

SEQ ID NO: 6978 - DNA, 797 bp, Zea mays
gctagggatgcaacatccacttatgggctgtgcacgtcggggccaggccatcggccgtttcgggcgggcgacagcggggcaaacgtgggccaggcccatcgtttgcatgcatgcacgattgcacgcccccggtgtcaatcgcgcgcaaattgagcttggggcttgggcctgctggcccctatctacaggagttcaccttcacctatgtttaggaatgtagatacgaatgtatattactcgttttatatttgtttctatagtttcttttcaaatttatattatatataaatattattgagttgtgtggcatgttaagtatctaagtttaaatatatgagtcgtctgatatttaattactcggtctcggatatagattgtgaatcagatctgttgatttgtacagtagagtgacgactgacgagtgacgtccgaatgctacgggcagcatgccagcatccgcaacagcgagcaaccagacgagcttgatcccatcccagccgtccacgtacccttcggatacaccgctgaggcggttgatgggcactgttcccttgtctttgccgaaacagcgaggcttcctcccaattccaatccaagccccaactaacgacctccgcccattccgctcgcggttgcctccgcctccgcctccgcctccgcgcctaacccaatccagagccagggcagggcagggcaaccaaaccctaggccctcgtgctcgtggtatccatgggctgaccgcgtcccggtggggagcccggatccagagctagggttccgtcctcggcggcaacacc

SEQ ID NO: 6979 - DNA, 495 bp, Zea mays
cgtgaaaccccagttaaacaacgcctaatcgggaaacatcctcataggccgtgaacaaaaatggaaggacccctcacctagggacaggagcgagggtgcgrggaagggaagcggaggggcttcggctggcagtggaccggaggaaggcggcggcggccgggcgagtgaaggagcggaagcgcgacgccatggcttgccggcgacagggttgggacgagcacgcggcggaggccggaggggcggtgaggccgtgcgggtttttagggttttgaaccttgccatttgggaaaaaagacatagatgggccttaatggtagtattgccagcccatttaattggcccacatactattcatgtccagcctactaaaattgcctttcttctttccccaggtgaaacaaattgcgcattttcttctcctgcggtccttccttcgcttccccgttcttccagaatcctgtcgagacctgaatccaccctcacccagcggtcccc

SEQ ID NO: 6980 - DNA, 306 bp, Zea mays
tggggaccgctgggtgagggtggattcaggtctcgacaggattctggaagaacggggaagcgaaggaaggaccgcaggagaagaaaatgcgcaatttgtttcacctggggaaagaagaaaggcaattttagtaggctggacatgaatagtatgtgggccaattaaatgggctggcaatactaccattaaggcccatctatgtcttttttcccaaatggcaaggttcaaaaccctaaaaacccgcacggcctcaccgcccctccggcctccgccgcgtgctcgtcccaaccctgtcgccggcaagcc

SEQ ID NO: 6981 - DNA, 298 bp, Zea mays
ttctattttagtttttaaattatcaaatatagaaattaaatagagtaatttatagactaaaataaaatataatatagagactaaaaattagtcgctgtaaaccaaagtaccactaaccgtactaaagttgaaaacgtccaaaggaggaaaggtattttccacgtagacaattccagtaccgcatctgccgccagtgaggcaccaccgccgttcgcttcctctccagcctccactccgccagatctcattgcctcctaagtcctatcgcccaccccgatcaccgcgcgggtatcggagc

SEQ ID NO: 6982 - DNA, 671 bp, Zea mays
agtgagacaactttagatgtgtgtcattggtgtcaatgatcgcttgtcgttaatgatccagccgttgtcgtgaacaattttagatgtctgatcagagatcccacccaaattttcaagggaacacaaggaaaaaggtttggcatcctccacaagcattgagctcctaagattagcaggcgagctatttgtggcgggcgaagcgaaagagagccaccttttcagcttccccactcccaggagagttttaactcttttttcatagaatggctgcatgcaaccccaaaccacacgtcccctcccccacctttcttgggctctgtcgttaggaagcaatcttccgtgaggagggagtaatttgagccaaacgaaaaagaagaagaagagaaaaaaaattgtgttctcttcgaaggcagaagacctcccttttttactttacccctccaggaaggttggtgctgattcattctcctgttcttgccatggtgcttcagattccatccaaatccgctcgtcgacgttctgattcttggcagctttgatgcgttcagcgccaaaaaaaaaaaatccatggaagggtaatggcagctcgtcccgcctgttgctgaggaaagagttctgtgacgggagaaaggcaacgattacctagtctcgtcactgtaagttggaaggcc

SEQ ID NO: 6983 - DNA, 1500 bp, Zea mays
cagtagcacgaccagttccattccggttagactttctacctaccactagaagccagaatccatcagtaaatttccaaaggtctgccgacaaatatcataatcagcgaaacgatccgtggcccaattccaaacacaaaaaggcagagtggctgcactctgcaggcaggagatagcatcatcagtgacgaaaccagccatgcaagtactgtgtatgtgtagtacgtactattttatttctcgcccccgatgataacaaaaaaggccgatgataaaaaaaaaagagctcgtagaagaatccaaatccagttacccacttatcccccccctccccgcccaccccgaaagcccaaactccggtgccatcagtgtattctctaatcacctcctctcctccctccgctccttcgtcctccccgcgaagggaggggtgtgtgtgttgtcctgtgcccgccaccgcgtgggatgctcacgcttcgtccccgccaccgcctctccggttgatccgccgctgaggtgagctctccgcccctcccgtggatcctcccgattgcgagccatgccgtggattcttccgcggcgcgtgttcctcacgtcctctgatttcgatgcctcgtcgcgtagcgtagcccctgtcggtttggactttgggtggctgtcgtttggcgcctcgcgcgcgcaagagataaacctaagttttattaccgggatagttgcgagcgagtttcccttcccagatatttttgtggtagcctccgcggaggatctgcggatgaccattcacgggtgcggattctcgattctgtcgagatgataaagccccgttgtttatatcctcttttgccttttttgtgcggtcgtgcctggcgtgtcttagtggactagtggagtgggcatgtggcgccgcttccgccgccgccgctgcagcactactcgttcgtcagaatagtatagggtgcagttgcgtggagatccacccgctcgtggattggcttctcctgcgggttgcaactggcaagttattccggccttggttggatgtgttatctcggtccattttgttagatttggattcgtatgcttcgtgctgttgctgtggtccactatccatccccatccttgcttgatgaggtgatggatcctcacttcttcagtatgccggtcgttttttgttgagccgcacttgcacccacttattaagctgggtccagtttattttttattttgttcgtgggcgtcaactgaatctccatgctggcgtccctcggaaagtctgtttctatgtatatcttcatttggtgaaattatctgcatcagagtacttagaaacagaagtgtttgctctagttgttttttgggctagtagataagtttcctgttaggttggtgttgagtgacattgctcattatctggattttctcttgtttcgttggtttaattcttgaattcaggagaacatcagaactgattgaagaacagggttggtaagtggagggagcgag

SEQ ID NO: 6984 - DNA, 1500 bp, Zea mays
cctttttgccaacctgacacacttcatcatcaatgagtcgtcgatcatggctggttagcagaatccagtagctaaactttccccacattttccatgcacacagttcccaaccgtatagcgatcgagctccaaacgacgacccggccgtcacctacgattaggtgtttttgtaggcatttcctaggcagcgccaggtcgggcagtagttgtagttgaccccgcccgccgtcgcgagtgcgctaccgatcggcgcccaagggttggtgtcgagcacagtcagcacctcgcgatgctccggcggcgatctcattgctcaccgggatctcattctttagcggcggcgtcgttgtcaggcacctgtctttacatacctcagaattgtctgagatttttcagtccacgagctgaatgcgtggagtatatagtagtggtgtggccggggcatctcttatgctgcgttttttttttctttttctcatctgctgtcactctcgtggatgctaatataatgactgccaaccccacaccagaaatggagtccgaatatgaactcgtgaggatatgcaacaacaaccgtcactctctgagagtgcgatcgcgatcgtgacggtttaaccactaggaaagagaccgcgcgggtccatgcatgtggatatggacgggtcgtcgttattgtttatttggcgctaatcaagtagtcagaaagaaacggttttagttggagcagctgcaggttggcagtgccaatcagctgatcttaactggtctcttaaaaacaggtaataggattcgaacagttgacctagcgagctgagagtcatttcgctgtcgtcgtcgaattattcgctggcagtataaccttgtttgcttgctgcagctactttgattggactctctttttttttgtctgctatgtttgagattgagatagaggttcatgtgctgatctaatttgctttgtctagctatgtgtgtctgtcgtcacgtagatggccacggtttctgaataccaaattggccgtacgcgccggtgaagtctgaagtctgaacggcacttataaaactggactacacggagtgcaatcaatagcaatgagccaatggcaataccgcgctccagtctccaactcaatgacgggtattatataatcacacggactatctatactacctattaaggctctaaggggtaggctgcctcccctggttctgccttcagccaatctgcaccgtccatctatatgcgtcaaatcatcaccgtttgtcccgtcgcctctgcttcagcctcctcctccatccatcgatcgcaactgctcctctctcccggctccccacagtcccacggcacatccctcgttcccccctgctccgcaagcgagcgcgggccgtgcgcgtcgcaaccacttccaccacctcctccactcccctcccgctccagctctagctcgtctctctcctcgcctcgcgtagggtttcgcttcccgtctcgccgtcgtcagc

SEQ ID NO: 6985 - DNA, 1500 bp, Zea mays
ggtgagcaatgagatcgccgccggagcatcgcgaggtgctgactgtgctcgacaccaacccttgggcgccgatcggtagcgcactcgcgacggcgggcggggtcaactacaactactgcccgacctggcgctgcctaggaaatgcctacaaaaacacctaatcgtaggtgacggccgggtcgtcgtttggagctcgatcgctatacggttgggaactgtgtgcatggaaaatgtggggaaagtttagctactggattctgctaaccagccatgatcgacgactcattgatgatgaagtgtgtcaggttggcaaaaaggaagatcgggcacatgggaaatggcgcacgtgtgcgctacccaccagtagacctaagaacgtggtcggtcgtttggaaatgcatttgttttttttctttccaactcttctggttggacttcggagaagcatctctttgaggattttctttgctttagctagatagtttattgacattcctccttgtttaggtgtggttgcttttgcagcaacaagtcgtttgatcctacatgcatgaacaatcgtagtagtttgatgtttctctttcaatgaacttgatccaaaatcaaacatcttaggttgtcttcaacaactcctctaaataatttcctaccttgtatttagagaagatttttctcctctatacacaccagcagtgtactctaaaatgtcctccaaatacggagaacactccttcatcctctatatagaaactatatatcctctcctctatttatttatatttgagtgtatgataaataaatatatacaaaaatctagagctatatatatatatatatatatatatatatatatatatatgagagatagagagagagagagagagaggatgttgttggagtttctataccctctaaattctcataaccacatttaaactatcttcttaccttggtttgaaatggttttaaaggtaagtttgtctttttatttaaaaaacagaaaatacttgatgatgtttttagaccataaaacatagcttacctttttaaaaattctatttttctagatttagattttcatcggaaaatgttaaaaatatatagacatttttgggtttaaaaaccttatcaaatatttacctaacttcagtaccactccaaactataaaaaacagggtaaataattatttaaataatttatagcgtgagatgtctgattttaaaatttaaaaataaaaacaagcatagtgatacttgggacgtagaatagactttcttttccttttctttcagtctggactctggagattctagatgttttgcaatagtaagcccatatattttcacccatccgaatagtaagcccatacagcccacgtatgggcccgataatgctgaaagttaagcccgtaaacacccctctattatacggcatgaaattgctatactagatttgcaggcagttgagccgaacggaaagaaccaaaaaataaccagaca

SEQ ID NO: 6986 - DNA, 1500 bp, Zea mays
tttggagtccaacactgagctcaaatagtaaaaaaaaggacatcatgatggaaaaggttaaatatgagaggtttgtgtatttgaatatgtcccatacacatttttactttgttattggcactttgatttgcactctaacttgatctatagtggaagtgccatttttggtatttgtttgaggtgaaataggtaaacgatggagaagatgacatagaggtgagtctatatgacttagttcattggattatactctaaccatgtttatctaactaatagaaaggtgctcaagaaaggtcaaatcaaatggaagaagaagtgaaggaaaatgataactttgttgttgtctcacgcaccggaccgatctggtgggacactggaccacatgcgcagagaagttctctgagagttttagagggtagagtaaagcttacacacatttcatgtacctgttctgctttcatattctctatatgaactaaaaaaataatgctcagaactcatttgctttggttgttttgggtaggatgctttgcaaagttgtaaattgctgcattctaaatggggcttgaaagagggattaaaatgaaagccggtttccagtccaggttcgaaaacctaccatgcacccatatgatattcgggcatgtagcttcttctgttcttggattgtcatcttgtcaattgcttgtgaatgaatattcactcaagtcgcagtarcatcgtgagttagttgttttcgcttctcaktcggcgttgtaagactacctaaggtaggacatgatgatcttcctcacaattctacgtatcaactatgctcctgtagataaataagcgtttgctttaagattgatcaatgcatctttagtttgtttactatgataattctggtggtatcagaacattgcaagaattgaactakcgcgatgcatgcaggttgcagcgccttcatgttctattttgcccgaggaaaaaactctttttgttaagagatagtttggtaacttcatttttacatggcgaaatgaactaatttcttttgagtaaatgaggttctcaaactagctttaaaaaggtaggaaaacacttttgtttaaggaaggcaaaaactttttgaagaatcgaattctgcaaatctgtagacaattggtttatttgttcgcggctccgttccattccttttctaccgctatggcgacgggtcacgggagtcgagaaggaaggaagaggcagtacagacttcacggcccatgaattcacgtagtctaaaagcccatagcatcaggattcaggaggcatcgcagcccttaatcgagaagcccacgtgaccgtggactccgtcatcgtattcgtcaccaccgctctcgcgtcgccgccgccttcctccttcccctgcgattacaaaaccctaggacaattctccaccaattcctataatccctcgtcgctaggtagttcctgcgtctccatcccgatccccttgtcgattcagttgtaatcagg

SEQ ID NO: 6987 - DNA, 841 bp, Zea mays
ggtatacgtgatataatttaaaggtaaacaaatatatgaatgccatttattttcggagccgggcgagcagttgtcacctggaaaaatacaatataactatgaggtgtaggttacgtcaggtagcgtcagacattccagtgcgtgcctggcaagtgrcaaactcgagctgtctagtcctcggttcgcgaatcttccacagagaggcagacggcaggactcgcttcaagctcctcatctcgcgcagggggggtcgcctgaggtatcggtcaatcagtaatcaccccaaatcctagggttctagtcgcttctcgtcgtttcgttcgtaggtgcgccccctctcatctgcactaaacctgagtcctgattagggttctacataatcgcttctctttgcctgattgatttgataccctacatccgtggtcgccggttgttccggattagccggatctgttggtctccggttcgtgtgtgctgtaccggatttggggtatgttcgagttgcttggtagatttacgttggtacatacggttgcacagaagatctggatttactgagtagtaggctagtagctgcctacggcgtacacatgacttgtgtatgaatcgtgtatctggcgtgtcgatgcttagtacgcgtagtgctgcaccatactgaaactgaatggacattggctgtgtggatgatttatgcggtgatgcattcagctacggtatgctgactagacatgctgctgagttttggttcttcagcacttccgatcttaatatcttgccaccatgccctcttgagatgaacttttttccctttgtgggtttttggtggcagatcacagagaca

SEQ ID NO: 6988 - DNA, 1500 bp, Zea mays
ggaaatcctaacatggagggcagacagttagaaaagtttatgtacctacgtcaatcggatcggcttcatcgggccatgcccagccctgcttgcagcagtgaattaagggaagggagacgtgtgtgtggggaggggacggttgtgcaccgctgagaactcggatggggtgattgtgcgagccgaggcgctttaagcctagtttgggtactcttggattgaagtggtttgtagggattgaagagtgtttaaatccccaatagatcaaaaactctcccaatacatctcaatccacttcaatccgtctcatttctagagtacccaaaccaagcctgaggagggttgcctccgagacgagtttgcacgtttttagaactagcaccagccttttctgggccctacatgtctgccgatgttagtgctccatcttttctgcgtgttgccactagcctcagtgccaggcaaatgacattgatgggctgtcactcagagattgtgcaaagttcgtcagtgacttgacagcccgtgctgctctgctcccagtgagagtaatcactggcagtcgctcctttggctttgaccgccactggagcgtggtttgattcggtgctcatcatgaggttggctcggcgctaacgactgctcctaggtaattagcttcacggatggcctgttgattgccctgcgcgcttgcagtgcagtgcactgcactgcaatcctcgagtgtcgctgctcgtgctcgcagcgcagcgcagtgtgtcgtttgactgcttggtttgacagagtcgttactgggaccacctgacagtgtcttgttctgggctcctgcctgggccgaccccgctgcaattaaacaagtcacagtcgttcgctgatgcggcacagctgctcgcttggcccgttggccgtgcaactactgcagcaacagcagcaggaatcaacgtgggcactgtggtcactggccactgcacattgcccaggattttctgtggatggccgggcccgggacagcagcatggtgagggggctcctgtttccaacgtctttccccgtaccaagttggcctgtcttgtgcttttacagctagctcgatttcccttttgtttgtttgtttgttttcgctacgaaaacgcatggtggtatcatgcatttcgtcctttcttacattactctagactgtacgaacgatttattttattttttcttccacacagctttgctcgaaagaatgcgtttttatattgaggattgctgccttacaacgcaatttcctgtctcgcattaatcagaagatcatataaacatctgactgttaagttttggcgttttttaccaggaaaactgtgatgctcttgttaccgtcgttagatttctatcactcgttcgtaacttacatcaagaaagaaagatttcttacactttgccactttggttctctgcatttatttgttgttgttgtcatcgcgtacaggtgcgtacattggcgtgaacattggcacggcc

SEQ ID NO: 6989 - DNA, 978 bp, Zea mays
catcgtagaagatctgcaccacactgacaggagtctcgagatgttatagagattgctagttgagcaaatcgataaaagtatcaaagtttggaaccccgtctgctcctctacctggctccacgcctccacggctccacctgccccgttccgtgctaaaaaaaggcgtggcaaaagttgaatttaggggcgtccaattatttccatacggacagagacttgtgatgggactgatgagtgacacgaaaaaatggtgagagtatatatatgatatcatagcaacaatcacagaaactcgtgccatctgatccagccaatatacaagacatttctctaaccagctaacctaccggataacaataaaaactaaaagcctggaacacggatattattgagcaaaataatgcccactagctcataaggctagctcaaatatatatatacatcaaatatttgaatggtaacaacgtgtattgaatataattaattgtaaaactaataatacagatagagactaaaaaacgagacaaatttattaaacctaattaaacctatatacaatacacataattgatatttaaacgtttgatgactaataaactacacttcctcgctccacccgtcccctcccgtgcagaaaaagggtggcaaaacgttgaaatagggtcctgcagttatttcaattgtacgtgattcatgtatggaaattacgaatgcggctagagctcaggcatatttcgatcgtgattcatatatgaccggtagtaaaatatataatgttctactacactggctcatatatagataataataaattttgttaaggtaacctcgccgacgctcgacgatcgacccctatataatagtcttccatatggcatgcgcatcctaaataaagcacacaacttgtgcaagtgcaagctagctaggtagtaaaagctagcctcgccaacaacactgactgtgggcagctagctgatc

SEQ ID NO: 6990 - DNA, 311 bp, Zea mays
agcttgcatgcctgcagcacctcgttccaacgtttccccgcgctctatgccacgtcatcgatccgtgccaccacctcccaccgcatcccttccctctgatcccaatccaacgccccagctccaccctcccacggatccacacgaaaccacctcccgctcggcacttctccaaactttcccattccctcccaaaccccattgataaatacccctccccaccccaaatccgaactcagtcgcccacaaaaacccagtaactcgcatcttcctccgtgatccaagttctagcagcgcagcgctcggtttcggca

SEQ ID NO: 6991 - DNA, 1063 bp, Zea mays
gaccatgagtccaacgagctcacgagctacgagtgttttgtgcagccctactttaacgtagaaacgacaagggatagtataaacatgctacgcctacctccggagcgagcactgttgcacccgccgtggccataaatgattggggtcaccgcccggtcggccgcgtccgcctcccttccctccctagctctttctcccccacctctcgtgtcccggatcgacgctgcagctccgtcctcgcctccacagtttagcctccagctacaccctatctatcgccacccgcgtcccgtcctcctccatctgtaaccactccccgtcgtctctttcgcggtctcgcctcctgcagcctctcgcccagaaagggaaaccgcatctgctcccgtctcccgcctcggcgccgccgcctagtcgacctgagcccagagaggggggggcgtcgaggccgtcgggcgctcaggtgagctcgactggtgtgcgatttccgttgttcacttgctctcttgatctcttctcgcaactcgttaaaattggcgtgtctcgggctcggctacccaactagcccttctccaccctgtgcgctgcgcgcgcgagttttctagctaggctgccgcagtagctggagctgctgctggcctcagatcaggcaattcttgggatgtgctggcctcagaggcgccgtacttgccctggaccaggcctgattctgattctgattccatctcccctgttgcaaaccctagttctttactcctcttttctcgattaagtagcagcagaatccaggaccacgaaatcccgaactagttgtttacaatttcttctctgcttcccactttccgccctctcgaaagcttctctcccttctgcacaagctcaggattataggtactcctagtataccacaagctacaagcatataatccagctcgctcctggtcctgggtgatggcggcgaaaagctcagtcatttgattcggtgttttggttcccggcgtcgccgtcgcactaaccgagggggttcttgcatgcagatctggggcgggagtggcaagcgaaggac

SEQ ID NO: 6992 - DNA, 1161 bp, Zea mays
tggcgcggcggcggcggaggcagagctcggggcggatggaagtttggtgctggcgggcggcggcaggttgattggggagtggggacggatgttagggttttgagttgagagaattagagattctgtgcatttgacttcgccggtcatggtcgatcgatggaagcgacgggcttgcggtacggatgaaacagagtgcagcccaccaaggcagaaaaagaagcctatgtattattccactcggcccaactaccctccaatgacgaaaatttatttttaaatcttttctaaaataattttaaaaataactgttcgaaaactaattaaaaaccccgtttagccacatcaatccctcttgcatatctaaatctaaacagtgctgatgccatccacttggtcaccaccgtagtagatcagctgattggctgatgtgggcgccataccgtgccaacgtgtgcccactaaggcctcgtttgaatattctcatattcacatcaatccatgtattgtggatttatagtggattagaatgcaatttagttttaagttacaccacaatacacctcaatacatataaattgagatgaatataaaagtatccaaacaaggcctaagggtttgttcggttgctagtggattggagggattatgaggggatttagggcccgttcgtttattacggtttgaaaacaggcctgtttttattcctggcccaaatagagtggatccagctggttcactcaaacctggtgaatttgcgttaccatgtccaggattctatccagaggagacaacacaaggctttgttccggatcatggaaggagaagaaagtttaaaccgggtctgttttgcttccagttcaaagctaaacgaacggttgaaatgactctaactgaattccaaaccggaccaatttatttcacctagaatgagcctgaaaacaggtcaatccgatccatccgaacgggcctaaagggtgtgcgaatgcgattgggaacatagacttgtggtgtatatatataaaccatttccgtacaggccactaggccagtgctccctcgtctcccccgtcggtccgggccggaaatccccccacagtcccccaccgcatctcccccgctctcgcggcctgggcgtgcgaccgagactgcgcgaagggagcg

SEQ ID NO: 6993 - DNA, 1500 bp, Zea mays
ggcgcgccctgcccacgctgtctgtcagggagcttgcagagcggctgccggaatggaacggccgtttcattgaaggcttcaactacccacgcaaccaacaaggcaaggcaagaagaacccaaactaaaatgttggagcagaaggcgtgagcgcacagcacaggcacagcagcacggtaacgaaccgtcgacgctggcccccgcgggtgcagcagcgcagcgcagcgcaggcaatgcacacatcggaagcaaggtagcgctgcctgccgcatcgatctgtctgtctgtccgcctgtccgcgtgatgggctcgcggcacagcactgcacctgcacggctgggatctccagtccagactccagatgctgctgctgctgctcatgtcctgtccagatgcaaccgcagtaatcaccgcctctccgcgtgtgcacatccatcattctagctggctgtccacgccgcttcttttgcccaacgcgtttcgttggctcctgcacaacaactgtctcaccgttgtgtacctacgtgccgccgtttcacggcttcaaccaggagccgctagcgcttcaaatttggcatgccgaatactgtaaaaaagaagaagaaagaggttgtctgtaaatacgcgagatatttggggtgtctgcacaccgagtttgtccaggcgtccagattccagcgccgagacaggcagcttgtcccgacgccgtagatccgatctcgccgtgtcttcgcctgtcctccgtccccgtgttccgctgtcaaccagtccagtccagtgccctgcccggtcggatcggaatggattttcgacctcactgacggcgccgtgacgcgggacggacggatagattagccagccgcccgcccgcccgccaccgacagcccgcacgcaacgaatagcgagcgcgtcgtgcgagcccactcggcggcacgcccacacgaccgcggtcctggagtttcacttcacccgtccatgcatcagacagatgagaagccgcgccgaagcgtcgcccccgctcgctaatccttccgttagtttacttttatgtgctgctctcgttctcaccactctgggtctggggctcggcgcggcggccagacagcttgcgccttttaaccactccactcggttgctgtctcgggcgtggggatttttgtttttattttttagttttagtcgacggcgacggtggtgggagacgggacgggaggcacagccgcggataaataaagcgggggaggcgagctcccctgctagaccgacgacgtggtgagctgttcttccttccttccgcgcgcgcgcacaccctctctctctctctctctctctctctctctctctctgctgtgcccgcggctattaagcccgttctggatgagtcggtgagggaggacgacgaggagagccggggtcatcggatcgctgccgagggttctccgtttgtgcgacagagaggtggtggtggtgacggtgtcagtgcgtgcgtgcgtgcgtgcca

SEQ ID NO: 6994 - DNA, 1161 bp, Zea mays
tcgctcccttcgcgcagtctcggtcgcacgcccaggccgcgagagcgggggagatgcggtgggggactgtggggggatttccggcccggaccgacgggggagacgagggagcactggcctagtggcctgtacggaaatggtttatatatatacaccacaagtctatgttcccaatcgcattcgcacaccctttaggcccgttcggatggatcggattgacctgttttcaggctcattctaggtgaaataaattggtccggtttggaattcagttagagtcatttcaaccgttcgtttagctttgaactggaagcaaaacagacccggtttaaactttcttctccttccatgatccggaacaaagccttgtgttgtctcctctggatagaatcctggacatggtaacgcaaattcaccaggtttgagtgaaccagctggatccactctatttgggccaggaataaaaacaggcctgttttcaaaccgtaataaacgaacgggccctaaatcccctcataatccctccaatccactagcaaccgaacaaacccttaggccttgtttggatacttttatattcatctcaatttatatgtattgaggtgtattgtggtgtaacttaaaactaaattgcattctaatccactataaatccacaatacatggattgatgtgaatatgagaatattcaaacgaggccttagtgggcacacgttggcacggtatggcgcccacatcagccaatcagctgatctactacggtggtgaccaagtggatggcatcagcactgtttagatttagatatgcaagagggattgatgtggctaaacggggtttttaattagttttcgaacagttatttttaaaattattttagaaaagatttaaaaataaattttcgtcattggagggtagttgggccgagtggaataatacataggcttctttttctgccttggtgggctgcactctgtttcatccgtaccgcaagcccgtcgcttccatcgatcgaccatgaccggcgaagtcaaatgcacagaatctctaattctctcaactcaaaaccctaacatccgtccccactccccaatcaacctgccgccgcccgccagcaccaaacttccatccgccccgagctctgcctccgccgccgccgcgcc

SEQ ID NO: 6995 - DNA, 1500 bp, Zea mays
aggagacataattgtttccactcatatcatatttgttggatactttgctatctgttttactagttttattatctaacatatttagtttttgggtctgactcatcttgttgttaaatgtgtgcatcccttgatcatttcccacaaattgtttaatacagcatatacataggtgtgttgctcggttacttttatttcttccgtgttgctatcggaaaaatgaaattatcgtggtttgtttatgacttacaggttctatattcctaaagaaacaaattcattatgtattccttacagaaacagttgagttgtttcaatggtgcacatcagtgtcacttttatcaataatgtccatttgcctatcacacaactattcagtcaaaagtgccaatttactttgtacttctttgcaatattttggtgtgccaagaaacagatgtaaactttgaacttagtaacctgccagtatggattatggatatgtatttgttatgtggcaccaccacctgtaatctatcttgtcgctccaattgagattgctacaatgggtgtggcctgttgtagccttctactcgccggtgtgccttgccagagatgaagaaaatgatctttgtatcactcaaacgctcacaaaactcaacacgaacactagaaggacactaagggtgcgtttggttacaatgacaagacgggacgggatgggacgatcactcaaataaagttgtttggttcagagtcaagggttgggataggactatcccagtgttgtccccagttatccctcaaaattggagggacgagagaggacaccaggggacgcccctgtcctggctgtcccgcaaccaaacacactataagtttttggcgctgccaaactacaccgatgccatagatgtattctattaatctgtttatatttacatacacaattacaaaggctcaaaaggaaattatccaatcagctatcaattagctaagaagaggaactaatcaatcaactgagaagaaaacaaataaaccgagctggattacgcaacacctgccaatctgttgcaatgtactccctctgttccaaaatagaagtcgttttagccttttaacaaatgcattcaataattgatgtatatgtgtttagattcattgtcatttattggaatatagacataaaaatgaagacctaaaacgactactaatttggtacagagggagtattgcattcttgatcgatgtgttgatctaaacaagaaagatctatctgattctgaaattctaacatgtttgttgccttctttagtaactgatgctgaattggaaagattacaacaagcgttgaggattctttctgatgctgaaaaacagataagactttcaagcgagcgttcgacatggttcactgctgctttactccagcttggttccggtcacaattcagaaataactcaatcaagaagcagcagtaagcaaagcgctaaggcgaaccgagcgaaaccatgatggaagcga

SEQ ID NO: 6996 - DNA, 1239 bp, Zea mays
gaactaagtttgtayacactagcacacagtgtttagatctttagtttggttaacatgttatgtgaaagtggtacttcagatgatgttttgagatgtatatggaacttgagatgtatatactagtactgttattgttctgtgaatgtgatttatgatgtgtatgaatctgtaatctgtatattgatttgttatgaatatcatctagtgatctggattcatatacatcatctaaatgtaatctgtatattaattctgtatatgaatctagaatctgcatattaatctggaatctgtatattgaaatacagtcgaacctatatttaaaaccgtctgtggtatgtgtctaacacaagcggctaggactagaaaccgcttgtgatgtgtgtctatcgcaagcggtttcattagccggaaccgcctgtgatgtgtgtctatcacaagcggttttagattgactgcctgagatgttgttttacatcacaggcggtgcaccacaagcggttcctggaaccgcctgtgtagaggctaacaggaccgcctgtgtagagctttattgtagcagtgtcttatagaaaaagatttttttctaaattagaatagtagtcttacacggtaatttggatgcarcattacaaaatacagcagacacrcaaacagggtagtgtagcaaacatacaaattggctaaggaaagtaattcaaaatctagtttttttccttcattttctagccacattaaatgtaccacataaccaaatcaatgttctagctataatttttaattaccgcaaagtttaaaaaggaaacttgcacattttttgtgtttcgtgatatattttgattgcaagattttctgaattcttgcacttggtcctacactaattttatgtttaagaaaatgttccctaattaatacgagaactcccaagagccgcgcctatggcagacgagcaaacagatagaaagataaacaaacatatagataaatagatagatagatagatagacacataaagaaaaaagatagacagatagataaagggatagataggtagatatatgaatggagatagagagatatatagtataaacaaagagatagatagataaattgagatagatagacaaaagctagatagatagacaaatagactatggactacatatatatattggccatatcttgtagctttcaataataacacattgttagtattagaccctagctagttcatcaccc

SEQ ID NO: 6997 - DNA, 188 bp, Zea mays
ttaatcaattcatcttgatgggctggactgatcgggggccgacaaacagttaaagtggcggcaacgggccggcctcctatatccttccttatatgggctaggctggattgggctggccctgaaatggaaaggaagttcgtcctctctctcacggtctcacctctcacgtccagagagagagagagagg

SEQ ID NO: 6998 - DNA, 1295 bp, Zea mays
ttagagatagtgctagaaagtttgatttaacaaaatctaaaagcttcgtttaacgagttcacccatcttgtttttccttctttcatcatctacgttgtccttctctcccttcacsccttcttcaacctcaccttcgttgtcggatggagtatggagcctaacacctctctcacgccatctgaatgttggccggacgtatggatgctggcgggcttggcgttggacagggcggcactgggatttgcgagcagcagcagctgcacgagcagctcaccgagttgggttacgccagtaccagcttgggtcagactcgtcactcgttgcttgaagtcggcgataaacggacctcctgcggtagcatccattatttcagcagagctctagtgccgattgagtcatatcacactccacaagcatcgctaaacagagtgcctcaaaagtgccttccgcagtggcggaatgttgcaaactcaaaatctctcaccaaatctgaagaaaacagttccaatatcagcattgtgatcaacaatgtactctccccttaccaaccgaagctttgataccaacaccatatgaagatccatgaccaacacgcctgaaaaagtccatagggttccctttgacatccttgatagcgatcaaagcccttttcttggatccaaaacaggctccaggatgccgtgtcggggaaccatcgggaccaagcgctagaggcccttggggagctcaaggcgttcgtaggtagtaaggagtactacgacgacggctacaaggctacgagaggcagccaatggataggagcagtggatgcgagcggaggcggttgacccctcacctggggaggtggagtgacaggggcagcgatgtgctcaagcgagaggaggagtcgacgtgctcaggcgactcagaggaggcggtgacgttcttgggcgactctagtcgagacgcgcggtacgtaccctgggcagccggccccaaccgtagcatgcatgtatgtaccccagccgatccgcccggcggtcagcgctgcaaccacgttctcctccccctgcacttggtagttggtacgttaccgcgcgcgcgggctagcgctataaaaccccccgcgtccgctcccccaccagtcccacccatccagcaacgttactatagcataataatatagtgctcactgctcagcaacgtacgttactaggaacgtacgttacttgagttcccacaagtaattaacggtcccatatatcgtcgccgatcagcaggtagcgcagtcgtcgtcacgcgcgcgcggccggcat

SEQ ID NO: 6999 - DNA, 181 bp, Zea mays
ggtgagtgagtagaaaatactagcctgtctgtctctctctcctgccatcatctctctgctagcctctgttccctccctgacgaccatcaaccatcatcatcacccgcacgcagactgcaagagctacctggccaactcgctgttcgtgttcggcgagttcgggggcaacgactacaacgcc

SEQ ID NO: 7000 - DNA, 1500 bp, Zea mays
ttgatccgaccatgcatgcaatgcaacacggctggtttgtcttggccgtgaagctatcgcctgcaagaggcgcgccggagcagaaaaggtcgccgtagccgggagctgcagggctagggatctggtcgggtccaaagccgcagctgcagggccgctggacaaggcaaggcctgctggaatggatttcgcgcacagtcttcagtcttctcgtttgacgagacagcactgtcgagcgttgcgccgtggatgtatctcccgacaggaaccggtaggttccactacctgctggcacacaattccatggctttagatttgacgagatcggcaccgccggaaggatccagctcgtcagctctccgagctttccatgtcactcacacggcgccggcgagagtgtacttcgttgttgaaccgctgactcggcggcttggctacgccagtggcgagcggagacttcggtcgggagggaaaccgagctagaacccagaggacagaggggttttcgctggggaaaaaagggagcatttttttacacgttggatcgccatggatctgcatcatcctcatccacgggggcgtggggccttgccgtggatctcctctctgcaggctgcagcctagttgagtttttttttcttctccagccctcactttttaccttttgacattttttggagaaaaaaagtacagtgttttcttctgctatgactacgatgagtcggatcatgtgtgggcatgttttccatggcttaaattagtggtgtcattacaatgagccacgggataaaagtcaggctgtctatttgttggcccttctctctctctctgtagtagtttggacttttggatcgtaagtaaggtttctaagttccctaagaaaatatggtaacgatttatatagagaattgaaaaaaaaacgagatcgtcactgaaaaaaaagagacaattaatctccatatattagattagattagatcatgaggcaccccaccccgcttttcccgtaacccggctcacgattgtgcgagcacatgggctgctgcttcgaaagcggccgagccacacctgtccccgccacgcaagccctcgtgcggcggaaagaaagaagcaatatcctacggttggccgagcctcctctcctctgcccggtgattccgaccggccggtcgcgcgcacgatcgaaagaaagctcggagcggcggataggatgacacagccccacgtaaagcatggcccttttctcgcgagcatggaggacctccttgcgccgatgagccagcagtgctgactccgcgcggatccggatccactccccgtcccctcccctccctttcgccggccccagattctgccggccggccgcggtttataaaaccgcctgccctgccgtcgtcccgagccaccgaacctcggcgcaatcgcacgctcgctcgctcgctctctctctctcccatcccccgcacgacacttgggtagcgcgagagaaggagagatagagac

SEQ ID NO: 7001 - DNA, 193 bp, Zea mays
gttgctactgaccggccatgaattcttgtgcgttgggacgacggccgttgctgacgttgtgtgagtgtcctcaaacaagatgtatgtacaggagtagcacatccggtggtgcaacgaccaggtgtataacctcattgatgagcccggggtgcacttcgtttggcagcccagccaagagttatcggtactcgcc

SEQ ID NO: 7002 - DNA, 1500 bp, Zea mays
agagggaatggcggtataatattaagaggagaccaaaacattggtcccagccgagaaaatctccgaacgctggccatcactaactggccggcgtcaaccttccactctacaatggttcaaccggagggtggcacacaagacattgtaacccaagcgcatatgaggcacagtgaggggatttttttaaccaagccagaaaattctccctcgaggggaatcgaacctgggtcttagaggtgcttctcggaagcctttaaccactaggctagatgccttttcacatatccttaatgggtccaacttactttgttgcaactttatttttgtccaaagcccaccatataaactttcttggtattttgtcataagccttctccaagtaaatgaaaaccatgtgttagtccttctgctccctatgttgttccatcacttgtcttactaagaaattagcttccatgattgacctttcagtttcaggcatatgaaactaaactggtttatcggggtcctcattattccttttcagacaatgctcgataactctctcctgtagcttcatagtatgactcatcaacttaattttctagtaattagtacaactttgaatatctcccttattcttgtagcttctccactaattagacatcttgtttgaccagaagatatagtgaacaacttggttagcaatactgtagatatgtataatgcaaaacggtgcaaaccagtgtttttagtaaccatatgggtgaactgttgtacattgcatccatattgtcacccaaaacaccgttttgcactgtacattgtactgtttgtagagtatagtttgaatatgagtatgagtacgggtatgagtaagctgctggagatagtcttacacctaaacaaatttctttcgggtttcatctccaccagaatggctagtttaacattggctcgccaagtctaacacaacccttctcctttactagggtttgagacttgctaagttgagacaacataggaggagttaacccaagtgctgggctcacagcaaacaaattcataagtagatcttaatcagtaacacattttcactttattaagtgatatgtgatcatctaccaccaagttgcccttccaaaattagttttgcagtttcttcctcatgcatacctgctgccttgcacttaagctatcttccccccctacacacattacaaaacatgcttatcaatttgtctcttttctattaatgtaaaatttccattctggagcaggtgtagatgataaagttatgagcatcagggccgatccatttatctatgaggggcatactttacatgagctacaggtaagctcatttttgttgtgaatcgggctcttgcggatatgaccagtcttgttaaacaaagccaaatttaactgctttttagatgactaacatctccatctgtaggtgctcaggcaattcctagctagctattaccactaaggagagaatcagagactgaaaaagca

SEQ ID NO: 7003 - DNA, 352 bp, Zea mays
cgccgtaatcctgccaaccaaagagcactgcagtgccgatttctataggaacaaaattcctatttttttcccctacaaacttcctacgttccaaaggagtgtcctcctcgtgtgcccatcccatattattcaagattacgtccgctgactcctcaggcctcccactgcgtgtggggccgagccagcttgctccatcaagccgagagcagtctcccactcttctttctcacctcgcatcgcactgcctcaatctctcgtctctatcgccgcatcgcttctctgccggagctccaacaacctcgcctcgcgcagcactccgctgaccctccctgactccctccctgccgctggg

SEQ ID NO: 7004 - DNA, 532 bp, Zea mays
cgacctgcagctgctgatggctctggccttctcggcggccccgctgacgctgtacgtgccgccggtgcgcagcctcagcctcttcgtcgaggccatggaggccgtctgccgcgactgcgcgccctactcccacggcgccgtcgcccgcttccgcctcggcctctcccgcgtcctcgccggcctagcgcgcgccgtccgctaggcacccccgccccgccccgcatcgccgccgccgccgggtcccttctttcctctgtcctcctttctaccgataccgagagcaggtgggttctagcgcaggcagcacagctagcaatatactgtactatacatgcaggactagcgcgaaatctttctgttttttttttttttgaggtttgggtgtagcatgtagggtgaggaaaggttaataaatcaatccgaatgaaggggagattttgcacgagatgctgaggaaatctagtgtgtgtgggggcgtgagaggtcagaattccatgtggtgtgaatattggtttgtctgtatctcgcggca

SEQ ID NO: 7005 - DNA, 1159 bp, Zea mays
tgtgatgacgagtatcaaaaattgagtttctttttttttttgagcatatgagtatttctaatcttgtttcatgcccttgcaacaccaataaaatggatttgatgaatgtaagtatcgccatattgttgaagtagttcttgcactttttgttcatgcctttgtggcattaaaattttggactgagacattcatgacagttgtatttctctttaacagattgacgacacatgtctttgcttttgcttctcctaatgaatgattgtttggatataaaacatttatggtgatcctttatgatttaataaaatgtttgatgtgggaactttttaatcatagtttctttgttgttgttggtttcatgttttgtagtgtttatgggtttatatcgcagagtttatactctggtacgatggagtgatatcttaatattttgtgattctaggatgtcacattttcttacatgcaatatctaacaacaaaaaatgattttataataataatggacaaattctagtgctcgtaatgtgtgttgagcaaaatttgcctaaactgaaaaaatcgcctaatggtcaaaataaattgtttcattcttttattgtactaaaaacataaaaatattacaaaggtcattaaaaacactcttgaactctatattatcaatctattgaagttgttgtatgatgaagctaaaaaaccgaagctgcaatttgaaacaaatcttcctaaatagggcaaagagtcaaactttctaaaatttaattaaatatatatagcatcattaaattaaacatgaaatattctttatatatatatatttacttgaagatataaacgttaatattactttctgtatttttagtcaactcaaaaaagtttgatttctcgtaaacgggacgtgcatttattttgggggcgtagagtcgtagagagctagagatacacgcagaaggaaccttctcacatggaaaaaaaacatcgcaagttcgcgacagaatagtgacatcctgaagcagtcaagcactcaacctctccttcagtccttcccatctcatcctccatctcgatctcttcgctccgtcgaactttcacctagtcagcctgccgcgctacccctccaccgccgtctccacgcccgtggccaagccagcggaaccctagc

SEQ ID NO: 7006 - DNA, 324 bp, Zea mays
cgactaacaagatacaataacccgataatgtggggtccagcgcatggaagtttgaaattgaaaggcagatctgggaacaggcccgctcgaacggtcagattcctcgaattcaaatccgggcgcgctttattattttacgaccccccagggcccaggcccccacgctccccgtcgttcgtattcgatgcgcacctcagtcctcagctgagccgagcggaaccagctcgcacgagaggaggcggccaaacggagaggaagtgagaccgaggtgagaaactgacaggacaggaggacaatcgccgccgcccgcagcaagaagagagc

SEQ ID NO: 7007 - DNA, 1109 bp, Zea mays
attttctcgttgcaacgcacgagcactcatctagttagacataaatcaacaatctaaagcctgactcgtgaatctgacccacactacacaagagatattggaaccatggggttgtgaatcgcactataaaaaatgtctggatatatttttttgttctcaatcattattattttacaatgagtaaaatcctaatttataatttgtttgacctttttacactcaatttaactagctcatcttattaaaaaaatattatttttatcttatatcgtttaacatataatataatataagtaggactttatttttataaaaaaattgaataaactgtcaaacttaataaaaaattaaatgaattataaattgagacagaaaaaaaccggccaccactctctgggtctctcccacacgatataattagatatgctccccgtgaaacacggtgtgaccctgatggcctgatcaaacgccaactcatggttacactgtcacactcacattgggtcactgggcacacggcaatagacttggtactccattaatagtttagctgtaaagagtgacactccataaatcagttggcaaaactactagtagtatttttttttgaatatactccgctgtgctgttctcaaatcctgggctcttggctgtcacatctcacaagcatacaaaacccctgaggtcccattcccatcggccataaaacccaggccaacacggcgccccggaatccctccactcctcccgccgcactaccgttgccgttgcgattcgcgagtcctccctagccgccgggcgccgcgccccgccggcccttcctcccgctgcatactacattagccaggggctcggcgacccggtgcggcggtgccagcagccgcagccggcaggcagcatcaggccagcatctcggcctcggcgtgacccggtggccgcgtgggcaggcagcagactgagccctgcaaaccgcatgcacgcacgccgcaggcaggctagcaagcagtcagctctgtattgattgtgcttttggagtggcactaaacgtggaaattgacgggctccgctactggtagccgttgccgtagatggcgaggggcatcaccacc

SEQ ID NO: 7008 - DNA, 1088 bp, Zea mays
attttctcgttgcaacgcacgagcactcatctagttagacataaatcaacaatctaaagcctgactcgtgaatctgacccacactacacaagagatattggaaccatggggttgtgaatcgcactataaaaaatgtctggatatatttttttgttctcaatcattattattttacaatgagtaaaatcctaatttataatttgtttgacctttttacactcaatttaactagctcatcttattaaaaaaatattatttttatcttatatcgtttaacatataatataatataagtaggactttatttttataaaaaaattgaataaactgtcaaacttaataaaaaattaaatgaattataaattgagacagaaaaaaaccggccaccactctctgggtctctcccacacgatataattagatatgctccccgtgaaacacggtgtgaccctgatggcctgatcaaacgccaactcatggttacactgtcacactcacattgggtcactgggcacacggcaatagacttggtactccattaatagtttagctgtaaagagtgacactccataaatcagttggcaaaactactagtagtatttttttttgaatatactccgctgtgctgttctcaaatcctgggctcttggctgtcacatctcacaagcatacaaaacccctgaggtcccattcccatcggccataaaacccaggccaacacggcgccccggaatccctccactcctcccgccgcactaccgttgccgttgcgattcgcgagtcctccctagccgccgggcgccgcgccccgccggcccttcctcccgctgcatactacattagccaggggctcggcgacccggtgcggcggtgccagcagccgcagccggcaggcagcatcaggccagcatctcggcctcggcgtgacccggtggccgcgtgggcaggcagcagactgagccctgcaaaccgcatgcacgcacgccgcaggcaggctagcaagcagtcagctctgtattgattgtgcttttggagtggcactaaacgtggaaattgacgggctccgctactggtagccgttgccgtag

SEQ ID NO: 7009 - DNA, 1500 bp, Zea mays
aatacaatggttttaactcaaaactataaaaataatactttgcttccaatcacctcttaagaagtttgccctggatagtggatactatataagctaaaataaacatgtaatgaacagtttatgatattatgataattcgaccgtcatatcgtataatctagcctaataatctgtatatttgttcgatttgaagctagatgattatataatatagccaagattataaagatgaaacaaatatatcctctgcctataacgacgcatgggttgcgaaagatcttttccccccgttgtgtgcgatatcaaagcgatccgggaaaccccatcaatcgatcaatcaatgaaacgaaaacgacgtgagcacaggtctctggacaagcggaaatctgtggagcacgtcgaggcagcggccaggaagccaacggcgatgacggcgacggcagcgttcgtccggtaccggtacgcggcccgccacgcggcgacggcgcgtccgaccgagagagctctccctccactcccccttgcccgctgccgctgccacaggcaacccccagtccccacgcagcgtagaaaccgcttcgccctcgtcggcaggcacgtgggcagcggcccctccacgtggcgtcccgcgacagcgaaagcttaccctgcacctggagcgagcgagactaggggataggtccgggcccacgcggccagagaacgcggggccccggcctccggtgtcggccggccactcggtcggtgtggtcaaagtgcccctgcacgccaccccggcgtgggccggtgcccctgcacacccggacggacccccccgaactcgtcacatttcttttctcacgccaatattggaccgcgtgcgcggtaacaatattctaatacaactaaaactagtagattatggtcttttgtttttgactaataataggtaataagtaagtaaatgtgtactgtaaaagatggaacgcctgagtttgccgagctgtttttacaaaaggggtcaatggcggtaggggcaaaatagtcactggatcagtgaaactggcagcaggtcaaaagaagggcagaacccccgtgcccttttgagtagtacgtactcctaagcaaaggcaacagccaccaaagcacaactcaaacaaaaaagaaaagatatgaacaacacatctccagggacaaaatggccattttgggtccgtcgcgtctcctttctctctgtgcccaagtggcggcaaccctccacggacaacggctcgctcaccagtcaccagtcaccgccacggcaccaccaagcatccaatgcttcccctccccctccccctcccgcctcccttcttaaccccgattcccaccactaaccgctcccgccaccactaaaccccgccggtaaccaccagcctccgggtcttgtcaagagcccagagtgcctgcccgcccgcccgcctgcctcaaggaaaacgaacagcaccagaaccgcgcgcgcgcgcgggggcgggcgccggg

SEQ ID NO: 7010 - DNA, 73 bp, Zea mays
gtgaaaaccgattctgcaccggctgaagattaacatattagcttctttctggagttacgccgaccttggcggg

SEQ ID NO: 7011 - DNA, 835 bp, Zea mays
tggctggggaactggggaggcaggggggttcaaccgttcaaggtccggtggcgcgcggtgggatgaagccctattgttttgcttgcctggctcttggctgggtgttgtgtcagtgtgtgtgtgtgagagagatgggagctttgcggctgcttgctacgtgggccgtagggtgaggcgtgggcctacttactggcgccttttgcaggttgggccggcctgcgaggtgcatttggtgggtttgggttggcgcaagccgcgagggaagggagggccgggcggctgccgggtcgccgtcgaggcgtcctccctcccgagtcccacgagcacggagcaccggcctccggttcagattcggtgacacgcacggcacggacgaacccaacggggcactgctcacgggaaagagagaggattcctccgccgcgtccgcgttggactggacagctcacgccgctgcgaaagcaaccagccagagccagatccgtcggttccaacgaaacatccattcacgcccgccaccggcatccccatctccgatccgccgcagccgcagtcgcaggcacgtcctcctctccggccacccggagcgcggcagccagcgagcgagccactgtggtcgccgtgcaggtacctaatttttgcagcccccacaaagtcagagggtgggggcaaaaaagaaagggggaagacagtcacagagaggtgcgcggccaacttgcctggtgcgggtggtttcgggcacgggcgagcgccatccgctcgctgccgatcccaatccggccagcagcggccgccccgccaccgggcctccctccgaccgttccccccgcccgcc

SEQ ID NO: 7012 - DNA, 304 bp, Zea mays
ccacggttccaccactttttaccctgtcgtcccggccctccccctcacatggcgccgatgtcgtccagtcattgtcgccctgtctcccttatataccccacgcatccacaccggtcaccgtcgtcgtctcctctccacagctgacagctccggtccgtccggccggcgcgcgcgggtgatgcagatgcaaccagagaccagtaggctagctagctgcctagctcgctcgctagccgagcagtagtagagtatctgggcgatcgactgggacgacggtcgactgggacgccaccattaatcagta

SEQ ID NO: 7013 - DNA, 260 bp, Zea mays
tgccatcgtggcagccggagaggttttagcacccggttcgtgtggtgtcgtggtcgtcggaggagcactggagcctggctgaaggacagctgtcggagctgtcgagtccttgctgacgtcctcttgcttccgtaagggggctgagagtcgctgtcgtcatagagcgtgcggggcgccatcattgcatgtctggcggagcgagccagatgggacgccggtcttgtttcccgtagcctgagtcagcttggggtagggtaatg

SEQ ID NO: 7014 - DNA, 141 bp, Zea mays
ggttaggaccaataccttctatttttctaacctgttaatgccactcttccacttcaaattctcttgttctaacttgagttgctaactcaataggatcacccaaaagatgctgattacctcaataggcccatagagaactat

SEQ ID NO: 7015 - DNA, 1425 bp, Zea mays
actagaatcacaaatagattacgaaactggttctcttaacaatataacacatatttttacataaattatcgtgacattatacgtttccgttgcaacgcacgggcactcacctagtttagcacataagaacttaattaaatgtgttgggcacttaatcaccaaaacataatagaaattgcccacgagcacatttccctttcatatgggatcctgattccatatatcaaatatattgtataagatatatctaatgttgaaaaacgaattgacgcaaacctaagaaacgaatcgacacccttgtgttgtcgcgtattgcggtgttcaccatcatggacggaatcactaagagattgaaccaattcatcaatttcttgacacatggtttgtgatctaatctagttgcattgcatattcatcaatttcttgacacgtggtttgtgatctaatctagttgcattgcatagacatgtcacaccacctctggtttatcaatttaatgactcatggttcatgactcacctagcatcgcacaaaccgttcgcggaggcgctgtgcaggggtgggtggtcagattctaagaatcggatttctcttaaaaaagttgaaaagcccgagctcgaaaccgctactttgacatatgatctaaagtccaaattttggtcccaaacccttatcttactcgataccaagtgatatcaagtgtaaaatgtgagaagaaacttttcacataatatcaagtgcaagtatgtgtttatgactacaatttacatttatcattttacaatattagaaaaatttattgcgctcaatagaaattgttttttacatcaattaataatttctttaattatatatttatgattttttatagagagagagagaggcatatgtactagtttcactcggagcctctaaaatgctaggaccggttttaaccgtgacgatgtcgtaccattttttacagtacttcgatttcaactaccctgtatgaggctaagggtttgcaagtaggatcttatgtatttaccgaatagtaagcaaatttgttggctttatgaaaggtttccaaaagtatatctacacaatagaggatctaagctttgttaggctatctctagcagatcctctgtcttatcctctgtttcaaacttcactctgcaattccacgtcccctattttaccctacccgctggagaccgtcttaatagccgcacttggttatttcatctactgcatgctgcttaaacgaagcaataaagcaagttcgacgaatggtgggatattttttgcgagcggcaacgaaaagcgacctacaacagatccatgggtaagagaggcgcgctgaagggggagaaaatcgtgcacctgaggcggactttcgagagctcccggtagcacttcccatagtgccgtagcgcgtcggag

SEQ ID NO: 7016 - DNA, 1175 bp, Zea mays
ttaggaaaatcgatgttgtcacatcgagttgtttccagtttgcaccagtacttttggttcgctcagctttcctaaaagaaaggggcatatgttgattaccatttatggcactgggcacggtcggacagtccacccttaggcacgaacagtccgtgattagatcagaccaggcgaattaagctcctatctccacatgtgtaccatttgaggacgcctaggaacgggtcgagacctccccttatatatttaaagaaggtacaaccgattgaactatcaacaatcgaatcaaatcaatatatctttcgttcctttactttttaccctataagtagacaggaacatagtctttttcactttgatctttacttctcttcgactctacgttaactagtggcgttttggatggcatgtcgatcttaagacaaactctaggatatcttctccgcaatttaaatagaatgacctctcttattgaaaagaagtctgcagcaagaccggcgcgatgggaaccgaaggaggcgcaataattctgctggttgagacctcgatttgagtggaggtggagatatgattgtccgcgaacggacggaaggacggatggatggattggacgcaccacgtctgacaccaacgggtcagcccccgcaacggtttcaattttcaaatcgccatcacgtcaccgtctctattgtatgtattgtattgtatcgtattgtttgtgtaatacaatagagtcggccttgtttatattcaattcaagccgaacccaacgttttcagctgtgacctctggacaccagttgggttggccaggccttggcctttcagttgtcatggctccaactccattcgctgatgacgatgtcagagtgtttttggtttgaggaggagattgaagagttaattctctctctgtctcccaactcccaagctgagcccacgatactctctatctacgcctatggttgagcttgcagtataactgatagtgtgtgtgtgcgcctgtcctgtgtctccataaatacaaccgccaccggtagtccggtacagagagcgagtacagatctgcccacccgctgcgttcctataccgccttcctcttgcttcgcctcctcgtcctcgtcctccaacaccaccagctgagaagacccgatcgagaggtaattaacgtcgtcc

SEQ ID NO: 7017 - DNA, 390 bp, Zea mays
ggtgtgcaacgttaggttcgagggcaacgtgatcaccacccccgtgacggcatccggcacggccgtgtaaagcaggcttaacgagatcctctcagtccaccgcgcgccgcctgcacaagctcgtagtcgggctgaacgcctagtggcgccccagcttcagccgcgcctacagcaaatcagccatcctccatctgtgcgtcggagccacgctgcctcatcttccagcttctccacgccgactatgtccccaacacgctggatgagttcctcagcgaccccgactacacattcgtcggcgtgggcgtggctgcggacgtcgagcggctcgagaacgactacgacctggaggtggcgaacgcggaggacctggccgaactcgcggcgaaggag

SEQ ID NO: 7018 - DNA, 97 bp, Zea mays
ttctcgacagctttggaattgctcagctcagcttttcgacgccgactctatagctgctgctcaccactgccctcggtgtctgtagtctgtccatgga

SEQ ID NO: 7019 - DNA, 240 bp, Zea mays
ggtaaaagactcggttcctcatggacatagccatccgcggatccccccaggtgttcgagggaatagcatcgctagtggacgccggcggtggcaccggcgcatcagcccaagcggtggctgcagcattcccggacacccggtgcacggtgctggagcttccgcaggtggtagacgctgctccgattgatgggccggttcgctttgtcggaggtgacatgacgaagttcatccctcctgctg

SEQ ID NO: 7020 - DNA, 1500 bp, Zea mays
ccccctttctagcgtcctggccctcatccggagacgtcgtctgaccctgtctcttttttggcgccccgcacttcgaggagatcgacattcgacaatttacacacaacttttattcgattagaaagagcttagttgtgtatttacttcttttttcatatactttttcttctttaaacttgtatggtgtattgatacatatggaatttgaatttcatggaagtagtttttaccgtcttgcttgattttataatgtggttttttggtccccacgaatttcggtcctgcttccgccactggctcggccgcgagtccagagacgctaggcctttttattgtaacccaaatagataaatattgttttaatttttgtttctaggtatacatgcgcattacgcactatatatatttaatgttttcaaaaaaaatcttaggtatttatttgaatacccatgaatgacgtgagcccgtccttcgtggagagttccaactctccaatacattagaaaaatatcgaagagtttctaatcttgctttagtttaagcatttatatttatgcaattatattatttaagtatttacattattaaaactgccatgctagaccagaatcgaaacttaaaatgcaaaattttaagtgtaagatagaaaaaaacacttatagacacaagaagtgaagcggtttttaataggctttaatttgtgtaagaaattttagataaatttagttcattttcctaagcatcttgaccctttcacacgaaacatcgcaacttcagacaatgccgaaacttctgatggcaacctctcctgagatgtgggagccatgcaactacgacctttcaatgggttttggaagtttctacatctcaactttctaattcccatttggacgtatatattggagcatggaattaagaactggaatcaactttttagaactctatcatttggttgcacatggaattaagctttggaatcagaaaaccaatcccctaaaattggactataactaaaaactctctctcacaatactgagcatcacccatcagtattgtgtggaattggaccacacaattccaaactctaattcagtgacatccaaacaataaattggaattacgtctaatttcaatagcattgttgatttgatatttaccccaattaaatttcatgtcgtccattgtcgacatccaaatggagataagtgaatttgtaaccttctctaacaccttttttgtggtcaatattcatttgttgagttttgaaatactagatatttataaaaaaaataaaatatcaagaacagattgtcccacaaaggaacacatgaaaaatgagcgaaaaattaatatgtggtatgagaagctgcaggtggatggtatcattctggccagtcatcgatgcagcaggtactgcttgtacttactagccttccgagaagaggatgcagatgaaggcaacaacgaatcagcccaatggagccgcagtgcaacgtcggt

SEQ ID NO: 7021 - DNA, 142 bp, Zea mays
ggtgagtttgcacttctgacgagtacagtgctctgtagacagacttggattaagagcacaatgcatccttctctgtcctctctatttaaaatccataaccaaactcttcatccttccatgttttatttatttacaggacaca

SEQ ID NO: 7022 - DNA, 480 bp, Zea mays
tcgtgatgactgtctgttaatactgctactcgtatggcaatttaatctttgtgctgatttacgtggagttgtaattgggctgttaagccgggatttggggtgtcaatgtggctaattagccttgtaatagtgggccggccttattagcttgactataaaagctgtaacctggagtggatctggaaataagaaagaaatagaaacagaatcccaacaaacttatctgtgagtttgagcgcttttcttctgttcctctcctttgctggatttggcgcggctcacgtcgtcgaagttgcgcatcggcggccacgggcggtgtcactccagtgatgatgcatggtttgagcatgattttcgctacaccragtgggttggtggtgtcagggtggaaataggcgattcaggtaactggtctggtagtgactagtgcatataaaataattggtgtccttggtgctgtgcgcgcaggagacgctcaac

SEQ ID NO: 7023 - DNA, 238 bp, Zea mays
tgaaggctcgtgctagtccagtgtgagcctgcccttttgttctttgtactgcttcggaactgaatctaagcggaacacacagttgctgtgtactgcagttttactcactagtgaactattttaagaatataagtactgcaaccctcacatttcctgattaactgcttcaaatgttggtcagacatcataggaattttgatgtacttcaaccctcatatttcctgattaactacttcaa

SEQ ID NO: 7024 - DNA, 357 bp, Zea mays
cgtatccacttcagctttcaagtttggagttcgtcgtcgtccccagcgtgactgcgcgagtgctatccattccaaacctgaaaccactgcggcccaacccggcaaccccgatccccacttccccagtaccatccctatcccagccacgccatcgtcatcgccttgcgcgcaatatccttggctccacgccccagtaagcgaccagtgacagtgagagcggtgaagcaaaccaaagcaaagctatcggaagaacctcagtcgagggggcgagcgagccgacgagacgactgacgagcgcacaagaccggacggggccgcctaatccagagagagccccaggtctcccccaaccccgcc

SEQ ID NO: 7025 - DNA, 386 bp, Zea mays
atatcaaataggttcttaaattattacattttctttcatagagatatgtcttgatctaacctagtaacattttcttgtcagtggtgcatttttacttggtggaggtgtttataccctactggacagggtgtttccagcaacatcaatggtcatgtagaccatggttggacaagaattgctaggcaccagtctgtttggcgtgcgaatgatatttggatgtgaagtagtgaaatgatggcaacaaagtttagccagatctctcagcgttgtataggcacgcaggacattttgatcgggacaagcaaagcaccttgacctaagtacagtagtctgcatcactgtatctgtatgggcctcgatacttggggccggtctaccctactaaa

SEQ ID NO: 7026 - DNA, 1500 bp, Zea mays
ttatcactgctctagggcttgtagtgatgtgatttatctgtccaagttccaccactgttcatcacatctggctaaaaaaatttagggttcttttggattgtaggaaatatgtaggattttttaaggaatactattcatatggaacattttcatatccttgcatttggttcataggaattatgcacttcattttcataggaatctttttatatgtatgcaattttataggaattttagcatctaccgaaacatctttgtaaatttactatgcactaagtatgataaattctccctcatgagccactatgaatgcgtagtgcaaaaaaaggctagctgtttagttaataaaagacatgtcctattcttagattcctgtatttttttctatgacccatccaaacaaatgtttatacaaaaaatctatattcctaagttttgcaatcgctaccgtatgctattcctatgtttttctattcctatattatttttatattcgtgcagtttaaaagacccttatgcggaaggctcgtccagccagccaggtgcacagcgccacagcccgctgtcaatacccatacagatatgcaagcgtaatttggcgagtggccggcgggcgccgcatcagccatggcccatggctcctgggatgcccggccggtgggcattattggatcaagtgtcacggcgttgccatactatatgatgtatagataatacctaatggtgactcatcctctaggaatctattgatccctatccagcgctagggcacagctgccgaaatctattgcttgctgctgctgcttggattacgaaccatatctaatgacgatgccaccaccgccacgaaataaggttgcatgctacgaatattatccgttcatattcgaatttgatccgtctactagtaatatctgtttgtttccgatatgattatatttgaaaagaaccaagccaacaaccaggttcagcttcccttcattaaaacacaccaatgaaagacatgttaaacatgtcgcgttcctgcgccccagctgcacgaacgcttcacatttaacattccagattctggtggtggggttggtcaagtttatgttcgagcagcacctggatcaatttgtttgggataggtttccgtataataaaaacagaaaccacccatcgctgtggctcgtcccttcgttcgcggtcagggtcgccgcgctcccatgccaatccagctgtccccgaattccagttgatctccggtcacccggagttgatcaacaccaggaacaagtgcgtcccgatcccggtcccggcccggggaaggcgtacacgcgcaggtcgtcctgctcctgaattcctgatccactaaacattggtgagctccttttttttgtggtagagcactggcatatgcctataaaaggtcagctcctggccactctagaccgcacccacacagccagtacccagtagtgctccacttgctagtccactcccctctcagtcgaggca

SEQ ID NO: 7027 - DNA, 174 bp, Zea mays
ggtgccatcacgtgaccacgagcgttctgctcggattccgcgtctccggcgtccgagtcgtcggccccgagggcgccgtgtggcggacggagcgcccggaggtgaaggctatggacattgtcggcgtccgccgcgtgctccggcgctacgtgtcatccgcttgccgacgagggg

SEQ ID NO: 7028 - DNA, 967 bp, Zea mays
gaccttaaaagggtagagcactcagttttaccacaatgtagtagtcccttctcgaggaagctaccgatagtcgacccccaccttggcctataaaaggagtaggtcggccaagaaacggaaggaggacactcaacggaagacgaccacacgctcgatgagaccaaaagacccagaggccggagctaaggcgcgagccaccgcgatgtccaaggcttagcttagaactttagtcccatagtccttaggtccacccacgcataaaagacttgggatctcctccctttcttgcccgcttgtaatccctacgtatactacgagctttgagcaacaaatgtgtcggtagcgtgagtcgccgaagactagatgtagggacgttctgcccgaactagtataaatattgcgcccaccgagcacaccgtccgaaccacggagcgtgtgcacacaaatttacttaaagtaggatcgaaaacaataattagggaaacaacagtaggatcaaacaacttcattccccgttcacttcttgctctcgtggaccttcactttgccccttaagactatctccagtggtttaccatacccatactcatattcaaagtctactttacgaacaatgcagtctacagtgcagaataatgtttatggatacactttaggtgaactgctggagttgactaataggatagagtagaaataaagatgaagagatattcggatccgaagattccgtccaaacggctcaataaccttgtagacagtctataagcaggcgaaagtgaataccaaagcccatgtaaaaatgcaatactttcagcccaaacatcagacaagagcccaccgctgcgaggccctatgctacgttcccaaacgctggcgctgcctggcaggctggctggctcggtgcctcccctgagttccatctcctgtcatgccgccgccgcagtagagctaacgagccacgggtagc

SEQ ID NO: 7029 - DNA, 1403 bp, Zea mays
ggccactagactaccattttggtgtgttattatgagtaaaacaaaacactaggggccacatttatttacaaagcaagcccttcattactttgtaagttaaccccactctgaaagggcatacgatggggctacattattataaaatgtttctaaacattattataagcctatagttcaaaattcattgagaaagaaattaatatacaataatgatgaataaaatagggttttcagggactcataatatctaatgaggttacaagcgtctaagttggcatttattacatttacacttacttaaaaagggaagggttaaatccctagcttagtttcaattaaaagctaattcaatgtccttaattaaaccaacatttaattaattacctaaaacatgtgacactgtgaaataacattgttaacatgtaggaaatgttttataatgctaatgcaacttgaatggagcaaaatagatttttaatgcaaaagttatgaagctttaaggtttcaaggacttatacataattatatatactttgggggctacaaggggttttcacaggactcagacaacatgaaaatagttttggagaaaggcaggagaaatttattctatataaataatcatattagcttacttaatttctgcctaaattataattattagaatgaatcatatttttatgaagcatatgggccttgtagaatttcataagcttttcatatggtgcttaatcatattttttcgaagcataactaagatttaaataattacccagactaatcccttttaatctggtttgcgaatgagattgaaccgacgaaaatgcaacttgacgcctgtgatccgccgttgttcaatcttcagaaccacagaacgtgcaccgaagagggtttttgcattgtcaacaagcaatgtgaagggaacttgggttagttgatggaccgttataccgtgcgaatcttcttgactgagtagcaaacttagtctaatcatcatcagctgattaattctcacggcaaagtcctgaaaacagaagtcaaaattgctgattcaggccagcatctgtatgattaactcccatggcaaagtcagaagtctagtttcctggtagctttagcccatccacgtccgtgatgatgcaccgctctctagagctgccaagggaacacacggattgttttcttctcctaacagctgcttgtggcacaccctaaacctccactccacctatcgtgtgattgatcaagtctttctcctaccttcggttagcctgatgagcaccggcctcctgtatttaagcagtggtagtatcccaatgccatgcatcattcccgcagcaaacatcctgatcggtcacctagctcatctccttcccaaaacacacaccttttctctatctgaa

SEQ ID NO: 7030 - DNA, 595 bp, Zea mays
ggtatatatcactagtacatacttggtcagtatgtgaaaaatacaagtgcgagtgttatattcttccaagttttttttttttttttgcttgtaaactgtgaccctagagaatcctcatatacagttccatcctcatgtttttgaaaataatccttatggtttttcagatttcttcatataatatggcaaattctgtatgttgtcgactcgtgagtcatgagaggagagagagattccgatgttcccagggccctcatacttgaacacagacatggattctcatccaaaactatccagtctctaacctgcaatcgaccataagaatcatttttatagaagaaccaaatctaactatatatatatgtttcatttgcatatatgataacaataacataacatgtttagcaaatgctatgaagaatagaatccagcattccaacatcttttccagcctataaaaaggcagtcctccccatggccagtagcacgaaaccacatcaacttcgaagccatttcagcacccaaaggagagggcacccgcaagaagcctctagaaccttccggtaaacaagcagcagcagagcagaggatggca

SEQ ID NO: 7031 - DNA, 630 bp, Zea mays
aatttatatcaagatgaatatgaacaacatatcaaatactattagatattaacaaatattaatacaaaggccgataaaaggtatatgttaaaaataagcatgacccttttttatactttgctgggtcgcttctcctcctttagctagcgaagtggtaccttataggagtgttgctacgtgtggattattgttgtgacgtgcttaagtgttttctcatgaccgatatgtggtgtacccaccccattgataatgatactatctctattttcgaatatttatcgtccacaagtttatttatgaaataaaaggtgacaataaaaaagaatggatgaagtatattttatacatatcacatttgatttttttagaaagtaagacatttcgaaaactggactaataaccatcagttgatacattcaaattcattgaacaacatttattaaataaagaaattttatccggacctcgaatatttagctcgaaggcaaaaatgtccgcacaatgtgttttcattgggctaatgtggaccgcttatactcgatcagacggtcgatctggctctgcgaagatctcgacagcaccgttccgtttccatccccatcgtcgtcgtcgccgccgccgccgccggag

SEQ ID NO: 7032 - DNA, 1500 bp, Zea mays
ctcgaaaaaactccacccaaaaccaaaaaaatccgacctaacccgacacgtcaaacccaaacagggagccaaacagggagccacggaccaaattgacccgacactaggcacaggtcggttacagaccgtgataaatgacccacgacatttaaataggtctaataactacttgtgatacggaggattgaacaggaacatcaccttttaaaaaaaaaatcagaaccgtggacgtggcactggtggtggcattcctcgcttacttggaaggacggtatggtcggccacggccagaaaccacccggcgagccggcaacatctccgtctccgcatcgacacgtatggcacggcggggatacgccgatggcgacgctgagaaacgagaggagaggaggcccatccccagatccgcttccgatactcctccgtccgacaacgcactgtgcgcagaaccaccgggggggtgggggggacacgcgcgtggcgcgccatgccattgccatgcccccgcggcgtcggcgttcagcccaggaacggcaaagctgccggcctcccgtcgcgtcggcccttccggttgccgggttcattgcggtgcggtgtacaaggacggcccggcaggcagcagccatgcgcgtgccaacagaacagtgcccggacggttacgtggttacgtcggtaggcggtcggtccgactcggcgccgcgtcggaggtgaccgggacgtctggactcagcgggagcacgcgcgcgtggtgacttcgacggggaggaaaagctgttgtcttgccggatgccgggatcctatttctctccaaaagctggccgttttacacgttgggccgctggtccctagtcactaccccccgtccacatcgcaggcaggccaccacctccgtcctccttcctgcttgtctgccgatcgcttgcggacgcgccggtcttgggaacagcgttcgcggcgtggcctcctccatgcatgtgagcatcccctgtctacgtttagacactctcgacaggcagatgcagcgcatgtttagcttaacccctgatatcgtcccggtgcaatgcctgaagctctgctctaaacaaaacagcagcagcggtcccgggagccaaaagctcgggcccggtgcgactagcgagaatgtgcaggcacatggggcgcttctcggaaagcggcaggcgcggcgcgggcgccggatcccatagagaattccagaatcatttgcacctggccatggcctccacatggacaggacgcacaagaatcgggcgagcagttttctggtagctgcgatgcgaccaaccagttggccacgggaccgggtgtctacgctacgcctgctttaagccgaacatggactgcgccttgcctttctgagccgctggtgactcggccggccccgcctgctgactccgcaaatccactgcctttgccaaagccgctccgccccaaagggtgttccagttccacttccaccaccgcggccgccgcgccctataa

SEQ ID NO: 7033 - DNA, 1280 bp, Zea mays
tttcaaccattaatgtgaatggcatccgtcaaacttgattcttagacttcctctaagctatcgagtgctaaatttcagaacagtgcatcatactaactcggtaggcttatctaggtcaagctattagtccatacctcttttatggttggccaaaaaaaacaaaattctaaattgctctaggtgtctcctaactccaaatgtgctaagaactatatctttttgaccttgtcgtccatcatttgaaaactgaaaatgaatttcatcactgttagttatacaaacaattattataattatgacctaactgataatacctctatgaaatatatgttagttaaaataatcgtgtgtagttattaggcaccaaaatccaactgggagcctggatacttttatctaggaatgataaactaaggaaggaatttaagagccttttgtttttaggggcccgccatttagacctatgtttttaaggatttacttggtttaggatctgtttatttccctcttaaattacttaggtaagattatggtggaagagtaggagggtaaaatatgactttgagattacaaataagctacccaatattagcttatttcatgttatttatagttccaaagtgatattttaccctactaacttttcaccataatccaacttatataatctagggggaaaacaaatacatccttagtgttttactttaaattttagtctaggggtttattggagagctcttctgaagagcaaggataaatgaactcgtcattttaagggtgtgcatgccaaattaaaataacgtacgtcataggtaccaagagtggagcctacgccacagtgtagtacagagctcggtgcgtgctggaagaatacaaatcgagcacgctggttgtggcccaaatggccaaatgggaatatatatgggatatatataagacaaacattatcgatttccctatagagacacatgcggccattcatatactctgaaagaaacagcgtctttcgggtaggccaggaccaggagtatgcaactcttgcggtcttcccctcacttggatcatgcacacaagatgatgcaagaattggtcccaaatttccacttcccggcagccatggttgactgcagacgcacgcaggacacagattgggatccatgcaactctacctcgaagcactataaatagggactcaaatcgaagctgccgcgcagagagaccttacggcttaagcaagtagcttcattcaccgagcgtgcaggcacaggcagcagcttgcc

SEQ ID NO: 7034 - DNA, 216 bp, Zea mays
acttgtagctatagctagcttgctcgtcgaccgagcgcccattgatggatcgaccgacacagagctcgcttctgatgaaccccagtacgtgtactctctagtatatatacatagatatagctatagattgaacacgtcatcaataccagtagaataagtggtgaaacgaccacgcaacgacaagagtgatcgaagcagtgtcacttggttaccgaa

SEQ ID NO: 7035 - DNA, 477 bp, Zea mays
ctgccgatccttcttcaatccctcgcctgcaactggctctctgtccccttctgctccccccacggttccccagagcccgagccaaatctaggggcttccttcatccgagcgtggtttcaattctaggggtagtcacctcacctgaattccgcccaaataaattcgtcgctgccttgtgatccttggggtttccttggttcttgagttgcgatcttctgctggttcgtgtcccccaatccgtaatcaatccggcgtctaggaaaccaattgctgctcagttctcttatttgctcctcgccttccttcctccagcctggttaaaatatcgaaaggggatttttttttaaaaatctgctcatcgaggaagcagggaagacaagaattgttgcatcggataaaggtcgggtgaaaatacaagcaaatcctgggaactcgcgtccctttgctaggtggttctttcctgatacaaagaacaca

SEQ ID NO: 7036 - DNA, 238 bp, Zea mays
ggtgtcgtgcagctctagcaagcgtcacgaaggaatggccatgacaaggggcgcaataaagatgtgcactcaaccaagggcgacacgcgaggtcaacaatgacacctgccactactgtggaaagtctaggaactaggcccacgagtgccgaacaaagaagcacgatgaggcatagacaccaacaaatcaagcataggccaacctcactaaagcagaggaggattcaccttttctattc

SEQ ID NO: 7037 - DNA, 1476 bp, Zea mays
  unsure (1)..(1476): unsure at all n locations
aaacatgtgttcttttaatggtacacagccaattctcccaataaagttgggtgggctagtgggctttgctcagtgactctctctctctctctctctgcgctcggctggtgatttggcacctcatcatcagttaataacgcctgggcccgcacggacgcgacgaccaagaacactcaggacccgttcaccacactgccaatgatgagcaggtacggtatggtatggtgtggtatgtgggcagctccagcgatcgtttactaccccaatggtcctctctcgcctcgtctcgttccggtcccggtgcattatttctgggacttgcatgggcgccatgccacccagagctcggatggagctctgctcgggttcggcggtcccccggaattgttttctgtggcgtccacncgcgggctccagcatgggcggagcgtggctgggggctggggcgacgggatcgtccagctgagctgcgtgtacaggtcctggctggctcttggaggccgtatgtctcaagcgaatgaatgtccgtgacaaccttggccatcgcagcgtatccagaaagaccgccccccctcctccccgcatgtcactagggactagggagaaggcggcgcgaagctgccgtgcttggcggttcctccggccgagattggtggccctgcactgcacgctcgcggccccgggccctcccgcagaaaggcacaaggcagcgcaatgatcgccatgcatgtgctcagctatagcgcatgtggtggatttgcttagaattttgctctccgttagcacgcgcgcgtgtgcaggttacagctccacgttcttttgtcgcgtatccatgtacagacgacttgacaggatccaacaactgcccaagtgactacacagccatgcccatgcgtgcagggagccagcgccggcggcacgcttggctacggcttgccaaagttgcaggctcgcgtacggctacggcctacgggcctgcgccgaacggactggcaagggcctacggcggccgcgcagctcgtagtacacgtacagtgacggacgggggcgcgcgcgtactgcagctgcagtgcagagccccaaatgcaaatgcaatgcaagctgtcctcaaccctccaggttggcatcctcctccctctcgataggcccgctcctttttctctcccttcccttcatcaccgcactacccgacgcgtccacctcggctatatatacgcgcgcgggcgcgcaccggacgccgcctcggtactcaaatcgaagtcgtccagtccactccaccagcagctcacctacctcctctcccctacactacactgcactgctcaaggctccatctaaagccccctgtaactgtaccaacagccacaaaacttactctggattccttcacaccatcaacgctctgaagcagcagcatcacacactagtactagacgcattctcaggtccgtaagttccacaggccacaacagcaca

SEQ ID NO: 7038 - DNA, 113 bp, Zea mays
tcgttttgttgactataatttgatttttgtattttagattttaaatcggaccctcgtcttcttccccaaatcgcatctctctcacttgatcagccaaacctaggtacggcaag

SEQ ID NO: 7039 - DNA, 303 bp, Zea mays
aatgactccttaggtcatttgagagatgggatacttcatgtgggtgctaataattttaagactactattaaaactgttccactttttttcctgctagttactcagctaagatttttgtggggttttaatgatggttattttctcactagctggctatagttgattgttttacttttcaagttaattgttccatcaaatcattctcaaggtctgtgaaatagcgtgaacacttatggtctgaatttcatctgactccttaccattcgtctatatatacagaggaaaagagctagatataagaag

SEQ ID NO: 7040 - DNA, 1155 bp, Zea mays
gctctttatcctctttaggctttagctactaataaccaagctggacactctgccactccatcgacgcaggcacctgactgaatggaacatggcatcgtgagagccactggattcaattgagtttctttcggtctggttttgtgtagtttctgtaatcttgacgaaaacagcgaactgaattccggtctctttcagtcagatatatgctagcttttcagtcacaaaactgcgatggttctgtttttgcgtgtgtgtgtgtctgatgctatttctgtggtctttggccaatcgggacagtttgtttgctacatcagtgcagttgtgttgtgccgggaccatatatatacttaataagacttacattctgtaagaaaccagcgaactggatccagttggtttgggtcctgatttgtgcagaagcagttaagggcccgttcgtttctttaggattggacccggattcattccaacctatcaaaacttatataaattaaagaaacaattcggtcaggaactattccgggccttcaatccggaaaaaacgaacagaccctaactgggttcagtttcagtcggatcatgtagcgtccgagtgctagtacatggacagcagttgtgctgaacacgctcagtgtcgggactcttcatcagacatcacatctcaatgcaatttacacatcgcatcttgtatcacccggaaatagagcatctacgtcaaaggagaagagattttcataggccctgtcacacaaattacagtaaaattttttctcgagaagaaaagaatggatattggtggcggtttcgccactgtcacacaaccactctctgtttcaaactcgtgatgaattttccgtcttccccaatcgcccaaaaagatcagacgccccgatcgatcgcctctggccaacccgagaaccagctggttagtccacgaggccaccgatccccccagatgtacaaggacatgttgcagcctacgcaagtacgcatacacaaacacaagtccagaaccaactagcccagctacacaaaccaagacactaccccgccgtcagctactgcggcggcggcggctgccgtcattgcgcctgctgcgcgtacgcgacggcccgctccaggtgctgcagcgacttgtcgtagctgacgaacccc

SEQ ID NO: 7041 - DNA, 353 bp, Zea mays
ttgttgttaaatagctaaaatttggcttgctgagctatttagctagtctcttggagatgctgttaggatacaaacgcatcatattttattgcgagtcaactgtacctgtaaagtgcaatcagcttgaaacgaaagacaaaggagttgagattcacgtctttggccacgctgtcgcggccattcccggcctccgttgtcggtgcccgaaccctccactccatccctccacggctgaggtaccattcccgtcgcagcgaattgcgccaatgagggtggctcttgtcgaggcctgatccggagacctaaccaccggggctttttgtcggcgccgtcgggttcgagcggcggcggcg

SEQ ID NO: 7042 - DNA, 168 bp, Zea mays
gcttttttctcgaactggaggagaatcatctgcgtactcatattcatatgaattcttgggaccttgcatagtaaataaccctaacgaaaagaacaatgttttaccaggttacttttccaacagtgttaaggaagagcccactttcacaggttgtggtataagcctgat

SEQ ID NO: 7043 - DNA, 503 bp, Zea mays
gaccgcttctgtacaccttggatgagatgcaatgcatttttttcaaatatataactgacacaatagtggaagatgttttttaaaaaacgtaaaccaaaggttgttacacgaaggatctagattaagtttagggccaattccctgtatgcggaaaatataagcgttccttgtgtgccactgcccccacatgtcagacacacaaaaatatacctatatgtcatttagtgacacacaaggaatgaatataaaatctgatgatataccaggattttttcaaaaaagttgacgctgttgtattagaatatgttgcatttttttgcactcgaaaaaagggttctataacaaataaaataaaagaaaagaaaagaacgagaaggcgcaaagccataaaaccgccagggtgaccacacgccggcgcgcaccgagaccgagagaaaggcagactgggggagagagaggaatcgagagaccacacgccggcgccacgtagcttgatctaggcg

SEQ ID NO: 7044 - DNA, 1306 bp, Zea mays
tctctgtttccgagcttcgaggatcgacaatcaagctttggtgaccaagtgtccaaactcttcgaattctataaagttgaagaccctgagcatccgtttggtgaaggcaagtgtcctctgacctattatgttccatttactttatcattcatcaacccgcataccatgatcaacctaaggattgactagctttgtatttaccttgtccttgattaccttttgggttcctatggttagattcatgttattgctttactttaatcaatgaacatgatgtgaacacttatgatacgatgttgtcattatgattatgatgttggactggtgatactttagggggctcgagcggtttctcgagtgcctctccataaggacctgttcgttggatgaccgtccgagaaaacagtgcaaccatgagggtggaatgggatgcccttagctgaataattagaggaaccggggtgtagttcgcttagccgtcgtgccgttaatggggctcggtgtatgcggctcgctctgccaagtttggttcgccccttggggaggagtgcggtgcatttaggaaacctaacggacggctacagccccggggaatctttgtaaaggctacgtagtgagaccctgcctattcaccttggtagtgtttaagggtttgatcggcccgaggcaagagggaatcacggcttgtgggtaaagtgcgcaacctctgcagagtgttatgaaactgatatatcagccgtgctcgtggttatgagcggccaagggagctccagtgattagtggtacttaatcagagacattttggtttacaggtggcaatgagattgatggttcttggtattgactctggtaatggtaagtggtactctttccgtttggaaaggagtacgtctgggttaataacgtgggtcaactctaaaacttggctttctctactagtaataataatctgaccaactaaaagcaactgcttgacttacccccacataaagctagtccactacagccaaacaggatacttgctgagtatgttgatgtgtactcagccttgctctacacaccaaaccccccttccccaggttgtcctcattgcaaccactgctcaggagaagatgaagccgtggaggaagacttccaggagttccaggagtacgatgagttctaggcgtgggttagcggcaaacccccagtcggctgcctgtgtaggccgtgtgtatctacgtttcttttccgcactttgataattgttaaagactatgtggatgtcttggacatcatgatgtaatcaactattataccctctttt

SEQ ID NO: 7045 - DNA, 180 bp, Zea mays
gcctatactcgttacgattacgagcccaccagcatctcctctgcacgggggcattccaccgagcacctcacgtgatctccaccccgcggcggcggcgcgagcaccgtctccgcctctccgctctccggcgaatcaaacccctccggcgttgcccctcggttgcctttcccctccgccaca

SEQ ID NO: 7046 - DNA, 126 bp, Zea mays
cgcaagtccctcaccagctcatttaataaagcatattgattgttgttggtttaacacgtgggttgttggttttaggttttggggcatgtgtgctaccacatcatagctgccggattgaacagttac

SEQ ID NO: 7047 - DNA, 777 bp, Zea mays
atgacctagagcaggaggaagattccaataaaaatggggaactggaggagtgtaacaaatgtgtaatttattttttccactctatatgctatcttagaagtttcaaaagttccttgtttgtgcgtaattcaaaatttactattagtcattgttcctgaacaacccttgattttatttcttgaatgtgcacctgattcgtctaatggaatcatggaaccacatgttgtgctactattttggttaagaattacaatgatcttaaggcatttgttttgtatgttgtctcttaattttgtctactttttatatttcattttccatctgtattgttgtgtgcttattacaaaatgaaaaatgtatgataccaaccattaatattttaggactcactaagcaaagccaaagataagtgtttgaacaactatccatctacctatgtgatatataaaacctgtaacaacgcttcatctatgtaatcgttgtgcactaaaatttatcgaataatttgtacgccgtcgcaacgcacgggtacatacctagtaatttcataagagtttagccctttcagaagaaaagtttacgtccatatgtaaaagtcttttgtttatgaaaatctggtctgggcccggcccatgtgtatacttttagaaatcctgtcgccgatccctctttctttccgtcgtcctcctcgtcccaagttccaaccccgtgggccgctacatcgccaaaccctaactagggttttgccaagccctctccttccctatcctcaccccc

SEQ ID NO: 7048 - DNA, 553 bp, Zea mays
tgacattaaaattttttaaggtctaaacgtgaatttttttcagagaaacggacaaaatacaaaaagttcgggcgcatgcatgggtggggtgacggtggcgctcgcaactcagtaactcacacgtgcccgctcggactcaaggggctggggcacgggcatgggcatgggcgcatggcatgcctgcaagcagagtgtagcagacggcgtcagcacgccaccttggccgcttggcggccacacggtgccgacctgacaggggcgcgcgctctcgagtcccagtcccaggctactgccgtggcgggccttacggccgccacgtcggccgaggccacccatccatgcaagcggcgcatgggaacgtggcattccggcgcgacggcacgaccgcgctcccgcgccatgcgtcacggtcacgtgcacgcagagccccgctcgccttctataggtagcgccgcgcgggtggcgtcgcttctggtctgtggcggatcggatcgacacccagccagcgcgtggagagtagaacacccccaagaggccaggactgagactgacc

SEQ ID NO: 7049 - DNA, 399 bp, Zea mays
gtcaaactttctcaaatctgattaggtttagagaaaatttagcaatgttcatatatttaaataagtttattgtaaaaatagatttaagtgtcaatactaattatgcactgtgaacattaatattttttttatataccttatcaaagctaaaagcatttgactctttggaaagagagaaggacgattcttttagaacgacgcgagtagttatgttatttaatgcttttgcatatagtatatattatgtgtagataggaacgtcatgttggcatttcgtcatgttcttgcattgtttacgttatatatatacggagtagcgcgcggcagtatataagcattagctggtgggatcgatcgctgcagagttgttgattgcagggaaaccgccaattggcaagg

SEQ ID NO: 7050 - DNA, 742 bp, Zea mays
tctatgcctaggacgagggcaaacccacccaggtcgatgtcgaagcagctgatggactgatggtaaaatcctcctaacctatgcatatggccatgttactttccacgctctcgtagggaccacgatcaacattggccaccatgtcccgcattttagttttgtttgtggtccctagtcagacatggcgcatgacccccgacattgatgaagttatggatcgagccactatctagcaaggcaagaagccgatgaccatggatgtaggcatggaggtgcatgcatgctgtcctcaatgtgaatgtcagcgatggcaatggagggggatgactcgagcagttgtctctaktagctaccctaacttatccactrttttaaactttaatatacaaatagtgtaatgtaccgtgcaaatgctctattttacactatttgttgyagggcccatcctcaatgaccgctcgrtgccctcatctttgtaacaaaactcttcttattttcatatgacgaggaccgggattcgttaattagccaataattagcaaaaaaaactacagagctctctagactttttgctaccctatataaatggagggctggtggcgttttgtaggaacttgtaacctggctcgcagcgttgcgtgaaggacctcgcgcgcgctctcctctactgcttggtcgtctcgttgccccggccgaacatccaagcctctccatgtctggcccttcgaagaagcagcgcggc

SEQ ID NO: 7051 - DNA, 131 bp, Zea mays
ggtaatttgtatgctataatgtggataagttacggtgaatagcgagctgatctattcattatctaatataatgttctctatttgtgtgtccagccattgatctagttgatgaagcagctgccaagctcaaa

SEQ ID NO: 7052 - DNA, 1500 bp, Zea mays
ctatggccgacgggtgggcggttggctcagactgcacacgcagcatgcagcagaggtggagaaaggcttggagcagtaaaaaaaaaactacttctactacacagaaatgaatgatgaggcactccattacgctatgattggggagcaccccaaggagaagcaacaagcgatcgagtagagtagaggcgtggcagcagtataccctgcctgctacctagggaagcgacagggcgcagacgcaacagtagtgtggccggcgacggcgagcgagcgagggagggaaggagaggagaggagaggacggaggtctcatcacgtcaagcgagcgcgacgcgggcagagtgccgggcggtaggatggcagcgggcgctgtggcctcgatgaaggtgtcagcagcagcagcagcaggatgcggcaggacgcgcaacgctgcgttgccgcccaatgcaatgcggatacgaccgctccctcctccgtgaccgtgacggcgaccagacgtgcgtgcatgctgcatgctgctctgcatccacccgcccccgcccggcattgcaggccccaacccctgtccttctttttcttcttccctcccccatgcacctgcatagcccatagggcaatagacgcctccctctctctccgcccccacacttttgcagtagaagagtagaaaaccttcttcctttcccatccaagcagacatgcatgcatgtgtacaaacgtcacctcctgtgcgactcgtatttttagacaatgcaacacttccgcagatgaaacagaggataataagtaaacataagacacgcttgacgtgacactgagcaactgactaataaccaccatcctctcagttcggaaactgaccaccgccccattttcggcactgtacggacggacggacggccgtgctcgcctgcagcaatgtagtacgagagagaggaacaaggaagacccactggatcatggatgtccacgtgaccatgtgtccttggcgtcgtgctcgcctctcctctttttttttcgcgcgccaccatgacacgacgcgttgctccgtcccttggttctgcaaacactgttcttcttcttcttttttttttttgcttttttagggattcttttcttctctggcgggttgcgccgggacacgtcacactcacaaagtcacaaggccacaggaaccacaggcctcgtcgcctcggtcgttttatcagtggcccgttccgtgtagcggctgaacaatcgtggtagagaaggtccaggtccagtatatgaagactcgatggcccgacttagtctgctggaccaacccatgggcctcgtattaatgggcccaaacatgggctggcctgctgggtgcaaagcagacgtgcggttcgcgaatcgggaatgcgcctttccgtttcactctcctcgagaggcggcgctgctgaggacactaggcccgaccgcccgaggaaggaagagaaacccgcagagggcgatagaggtcagcgcgattcggag

SEQ ID NO: 7053 - DNA, 1500 bp, Zea mays
ttaaaaattttatataagataaatagtcaaacatgatatctaataaaagcaagagacttgctaaaatctaggtgtctaaattataactttctttcggaacacggttattgcgtatattttagactgaatttatagtttcagttcgttacaatttatatagatataatctctatttttttggttctgaaaatagaacactcgttagatcataaacctgatatattggtgcacagataaataataatttacaattattgtatagttagataatgacattttttatatgatatgatgtagaggcaaataacaaatcataaagtaacaatttactatgtactgctttgttgtatctgaaatctctttaagattcaatcacctgacaacccttggttttcaagggatttctattttttctaacagaaaataaactaatttctcttgaaaaacagaaatcttttgaaaaaataaggacacttttattggaccgagtcaccgagggagtactcggaatgaagagaaatccacgggtcagacaagccgctcttgttgattattccgttcgttagttccgtcgcggagctacgctaagcctacgcccatcggcccctgttttcctaatccgcttctcctgcttccggggaaatttcgtgtccagtatcttgatcttccgccgccgcgcttcacgccagggctccttccaccggcgtcctccttaccgtcgtcctctactggtgctggactgctgcgggggtggagatcggcttagatcaactcttaattttgccgggactctttagagggcgcgtgcgctggtacaggtacgagcgcgcggtttcctgttattcttcctctactcttcttattctgcatcgtgccgtactcccccgccgcgccggccagcggcgccgcaacctccacggctccaactcgcccttcactaatccgaatcggagtcgtggcgccggcggcggtgccaccctccgccctcacctaatttcaatcggagggggaaaaaggcgtgccctcgcccccgccgcctcgctcaccgcccctccaacygccaccaccgctgggccggccgccgcccccaggcctgcctttcgaagcccggagtacattggaggctctttaagctccaccccaaaccctagccttgttggcgcactgtttttcttcgcgtttctcattcattcacatgtcaacgcttgtccacgcgttgctactgttggcagcgagcgcrttttaagtaaggatttggtgtttggacgggatcttctaggtgttcgttttgctttgcggatttgctaatcgaatccatatatttttcgtccttagcgcgcaacattactctaagcgaagtgcagtctagtttccagaattctgggttttcaactcccgcgtgaagtttgacatgaaaccttttctagtcatgacgccaatttgttatctaactaagacatgcccattttctcgactaattcggagtttstgcagcaaaaa

SEQ ID NO: 7054 - DNA, 831 bp, Zea mays
gctcgaaaagtgaacagttgcttgtgagcgtgcaaattacacatgcgcgtctgtcccagaggtctgtgttctgccggagaacgagatagcctaaccaaacaaaaccaggttttccgacaacccagagagccaaagaaaggactaccaacaaccgcaaccgctcgcttcccagcacctccccacctttcgctccctccctccctccaattgcaggatcggcaccgatgcgattcgaccgcggcctcgcatccggtgcggaggtctgtcattggagggaggctcctctccgctgcgcgcgcgcgtcgcggcctgggcgagtttcctgctggttcctcgtccctcggtacgcgcttcacgccctgtgtacgttctcttcctgtgtcatccacatttgagtgcatgcagtcctagcccccgctgggcaatgctgccctgtttgtttgtttcttcttttttttacgaaactggaggcggccagagctactacagcaagaatttattattaaataaagaaagctaatattacgctggttgtgctaaggtaagatgctggttcaggtttcattttctctgtggttttcagggagagattttgcgatccttggcgttactgttcgattgcaaacagtattgctgcttctctgaggaggcattagggctatgggcagttgaactgaaccgccggtaaatcaaaagtctctttgccttcaagtgaaattgggaaattattcaggttgaacgtggttacatcattcttcgttccgttggtgtttttcagcggcagaaatccattccgtgggagagagaaaatcaagaggagagtgagtgatc

SEQ ID NO: 7055 - DNA, 1206 bp, Zea mays
ctgaggaccctaccatggatgccgtggcgattccatcgaggcgcgagggagaggcgcgggaatgggggatttgcgcgttctcgggcgcgcaatggaggagattgaggtggggcgcgagggagggggcgccggcgtggacatgtggggggagggcgagggcggcgccatggatgccgcggcgagattagcggtgggggaacgaagacgggcctcgcgcggcgcgtgcgcggcgtggtgattagcgggggaggagggcagagccgtggtgaaggtggtggacgccctccttaccctcttaaggagtagtagagatttcaaaataactagtacaacaccaccaattgattctaatttgattccacaccacaagcaatgaaaagaactgtagaactcatttattctgtaaggtttatgaaataatgacatttgccaacatagtaaagtgaactccagtcttttacgaaactttatttgcaacattttgtcccattttaaaacaatatgttgaaaaaaatagttttggatctaatccgaatctctggttgtgagggtcgacgattaagtcatgttgccgtgcctgctggactgctggtaccattatgtacttttgagggccagttttgatgatagaaagttagtaactgatatttggaatctaggttagaacgtggaattctcacaatcatgataagacctattttggagtggcctaacttgatgtatcactatctattttggggattaaataacaatctagacatatttagtgattcgtgtgaaagatagaaggttgtatatacagtaaagatagaaaagggaaaagtgtcatatgatcccaacttgattctgttgtagtgttgagcttggcaccctgcccctaataaatcttgacagaatgccgatgctgttatctgttatgtataagattagattaagactgtcttaatcccggcctgttacatgtatttctataatatgttatcttaaacattaagacttttaaaatatataaatttttaccaaagttagaaatatcggacaagctagaaatatcgtctacatctagcagcacgcagaaaagggaaatgctaaggaacgtctctttccgcgcggcgacagatcggagagtccatttctaagcttatctgcaatcgcacagccatccgcttctgtcgtccaagcagaccactcatcccgtcatccgtc

SEQ ID NO: 7056 - DNA, 760 bp, Zea mays
gatgggtatgtgtatggggatggtgataggtatagcttcatagggatgtgtatgagatgtctaatcccagtagggaattctccattgacatctctagtcccgacgatccgagtcctacccctcagcgaacccactcgccgtccctcgaacctagcggccagtgatatgccctcctcacctctaagaccggtcgcacccctcagggaacccactcgccgtcccctagacctaggggccagtgatacaccctctcacctctaagaccacatccagtagcagcttactcatatttatacctatattcaaactacactatacaaacaacataatttacagtgcaaaacggtgtaaaaggtgttttggcgactatatatacattgcaccatggttactaaaaacactattttacacggtttaaagagtgtagtttgaatatgaggaagagtaggtgtaatagcgagatggtgtaactctaattcctagccccgagactgacgccggctgcctcgctccatttctaatccggtaatcccccctcccgagtccaaaccctaaacctaaacctctcacccggcgccgccgccgccaccgccgccgccccgaggccccatcccagcgcaaccgacttccgcctcggattgaagcagtcagtattttccgtccccttccatgtttctctggctctattcgacctgtttcgtttggttcttgtcactttcttgccattactgatcggtttgagtgttggtgtgagctgcag

SEQ ID NO: 7057 - DNA, 357 bp, Zea mays
gcttcttggcgaagactgggcctcgggcgagctgagggtgtgtacatcacttgagggggtcctcgggcgagacgtgaatcttccggggtcggctgcctttgcccgaggctgggctcgggcgaggcgaggccttgccccttgagtggaccgagccttggcttaatcgcacccatcaggcctttgcagcttagtgctgatgggggttaccaactgagattaggagtcttgggggtacccctaattatggtccccgataggaaccttcggacatgctttgtttagaccagtgtagtctacacacatccgccatttcccacctttctttttcacaagcacagggttggctagccattcggg

SEQ ID NO: 7058 - DNA, 81 bp, Zea mays
tcggggaccataattaggggtacccccaagactcctaatctcagttggtaacccccatcagcactaagctgcaaaggcctg

SEQ ID NO: 7059 - DNA, 1126 bp, Zea mays
ccacctatttaagttgattgatttgttcttttaacttacaatatgttactaaattattagtagactatagcattaaagtgggccatttatgttgactattattgaatattaatttgaaccaaacctatattaatccaacattatcgcgtgtatcttgggtgccacggccaacaagttgaatgaagcaataatttatgaaaaggcaacgtcgtttacgccatgtttggtatattcttgccggccgggacatgttgaggatcatatatatatatatatatatatatatatatatatatatatatatatatattgttgttgcagatgaccggtcattacttggagtaaaacagcaatactaatatttttttgctttgaataacatttttgcgccgtgccggccaatgcatgagcgtgcatcagaagtccgctcctattttggaggtacgtagtagtatctcgggtttgatcaagtagggttggttggcaggaaaagatgatgaagacagaatttgtcaaacttggagactagatcaaagatagaagtgtgagactgatcagtttgtttgtcctattctttcttttctcctgagcaaagatacgaagatatatgaagatttttgttgttttttccctaatgcacgtgcacgatcatttagtccatgtatacagtgtaaaatgctacataggttttgcggtgtccatttaattagccgtttagtctatttaagtattattcggttcaaataaatcctcttcgctatggctttagtcctctgatttctgttttttctatagtattttgtctttattaatttcagccgcaacagtacaaacaattttaatcaagctgcagcgaaaacgatatgtgaccgaactcacactcttgactgtatgacgtagccggccggccggccgtcccgatccgtggaagagtaattcaaaatagggtgtaataagagtagttcaaaatactgaaaatatgttgactgattcgctaaaagaaatttctttgccttctccactccaatccatgtacgtgatggtgatggaggagatctcagcaaaacaacaagaataagcagtaacaacaataatctagcctgcctgtccttagcgtagtcatgcc

SEQ ID NO: 7060 - DNA, 105 bp, Zea mays
ggtaacgaatatttttgttattttattactgttattattaacttttgggtcgtgttctaacgaagatcatttcgacagagcatattattaagcaaggttctgaaa

SEQ ID NO: 7061 - DNA, 196 bp, Zea mays
gtcacacccggctttaaaggacaaagccgggtgcatctcatacatgcgccaagaagacaacatatataataacagagtgtatagagataaatgtcataatacatcagagtatttattacatagcggaagtcttattacaaaataaagataaatataaaacgaactaaggatcgtcggcgccaatgtcgactgagaa

SEQ ID NO: 7062 - DNA, 105 bp, Zea mays; identical to SEQ ID NO: 7060

SEQ ID NO: 7063 - DNA, 51 bp, Zea mays
ggtgtgcctcctgtcacaacccgtggcggccagtgcgatcaagccaacgac

SEQ ID NO: 7064 - DNA, 1489 bp, Zea mays
ttagtgaaaatcagaattagtgttgctttaccgtagtaaaatcacaatatgctttggaaataagatctgtttggttccattggaaaactaaatggttccattggaaaaacttaagtatgtgtagggagagaagaaaactgacgtactaagtggactttccaatactccaaaattatcatagttttttgttagaccatggtatttaaaaatatattttatctgtaccaatcaaacaatttttagttttcactactacagtatcatcaaatactatagtattatttcaaaactgtaaaaatagtaaacttccaaacctgacctttctctttgttttccctaatctaggagggctcaccgacgttcggggccgtccagcgtgctatctcgtgcgcgacgggcaactcttgctgtcttgcrtccccaactccccatgcatgcagtgccgtgccccgtgtggactctaatgcaacgcttggaggcccaaccgcccaatcagtcaatcagacaagacaagcactattccacaacgcttttcttttacctttccatttttcgatcttctttttctatagcactcagactttcggaacagattacagagacagaattaaactaacggcaagcaaatctatcttgcaattactccatctacgatttgttacttaaaataaacaaaaattaaagagcgccccttcttatttaaagcaagaccaaatactaagggcgtgtttgacatgactatgttctacytagagcagctctactccaaaactctgcgtggagcagctcttctctagagttaagattaattgagattgtttctcgtaaccagtacaatggcgggtaaataactcaaaactccatgattgcttttttagagttttcagatcagcaaaagagctactccgcagctccaaaaactccatagaatttacaactttggagtctggatgtttgacatgcagctcctccttggagttttgctctagagccatgccaaacaggccttaagttacttgacatttaacatcacgccgtcgtaatatgatcagctaatgtgtattaaactagttatttgcacatgaacaggttagcacaagtggtagaaagagagtgttgagggagctctgaatcaagaagagaaaaaaaaacagaacctagacgtgtcttgaaaccaatcacaccgtggaaggatagtagtgctaggcttgcatcgtcgctgctttcttgaagtcgatcttgtccaccttcacctcgccgtcaatcagctcgtagacgtacaccaccacacggagtccttcgatgtccatcagcacaaagcttgggttcacgtcgtaagtgatgctgctgtaggcgcccgtggcagagccagggttgatcaccacgcctccctcgtgcttatatgccttgaactgatggctgtgcccggtcaccaggatgtccacgtccagctgccgctggagcatcgccagggagtccaggtcgcccc

SEQ ID NO: 7065 - DNA, 570 bp, Zea mays
atagagatgaagatatgtatgttttatattttgcatagatgtagatataaaatactttctcccgttattcatttttttaattttttctaaatatattgcttttactactacatattcagacacaatgtatatgatagcgaaagtagatatcttattagttgaagtggagggagaatttcactaggtagagtacaactatgccatttaactttttccatatatgccaattgcaggcgctccagggcttttttccatatatgccagttgcaggcgctccagggcttcaacttttgagttctctcttgactccacgagacaaagaggcgccaaaaaaaaaagaaacagaatgataaacaagttaatgcaataacgccaaattgatgagtgactaaaaaacccatcgcaatgcgttcgcattcctgactcctgagtatcacgcgctctcttaaaatcctcaataacaactgacgccggcccacggcttcaaatagctgcagattgcagcccatcatcaagaaaccaacaccgtaccgtaccgcagctctccgtcgccccaccgccacctgcaag

SEQ ID NO: 7066 - DNA, 1018 bp, Zea mays
ctctctctctctctctctctctctctctgtgtgtgtgtgtgtgtgtgtgtgttaggagctagcaggcagatctcagacgccgcgccgagaacgcgtcgcgtgccgtcgcaaacgaggactccgtctttcgccccccgcggcggcgctcgcgttgaaccggcgctcgtgacgtgaccctgctcgcaccggccggctagcaacgcgcagggcacgggcacgggcacgacgctgcccgctggtgacgctccagttggggtgggcaggggcttcacgccacttgtgttgcaccgttctcaggtgccagcacacagcacgggttttgcacggaacggcggaagcgtttctccggtttcctgccgctgctacggccagcctacgggcagggcggttaccttacctaggacgcacggccggccggccggtggaaacgcgtggagcactcactagtagtagtacgtcgtttcgccgtaggagccagggcagcaaggcggccgtgcgtggtggtcactggctcattgcttgcggcggcatcgcccgatgaatgtcgtagcagcacagcactcccaggtttcacaaagttgtttcggtcctcttggcgatacacaagttcccatcactctgaatctgaggcttcaaaatcactctcacaagtcacgagccagtgaagcgagcgagcgagcgagaagccctggccaggcgtaactggtggtcagggttccagtccaaagtcgccagcgctgactctgactccagcatctgactcaagccagctcagtagccagtgaagtctttagaccgtccaccacaacgcagaaaaagtccaatctgttcgtgaggcgcccaattatgcatggggggccagtcaaaagaagaagacgaagaaaccaagcacatccaggcacgtttataaaggacagtgtaagcctcgctggtcgtcatcgtcactcgcgcctcggtgagctgcttcaattgaaggctgcaccgctgcaggctactcctatatagctagtctgcagag

SEQ ID NO: 7067 - DNA, 210 bp, Zea mays
tacagaattttctccttaatggatatttctccttgtataaatagtagctgcttatctcaaaactgtagaaattataataacggtatgaatctcttaatcaccctgtttagctctccacggcattgccccctcgtttcattccttacctgtcatacaaaatgtattgtgctgtagtatgtatgcactcatttccagtttcttgcagctcta

SEQ ID NO: 7068 - DNA, 1195 bp, Zea mays
aatttacaaaaaaaactttttacagtttcaatctttgaccaattgttccagtctgtacctttcttgcacttcggttgttagcataatttgtcaattggaacagttatttgacggactcagatgcatttccttgtatagaatctgaaatacatattaaatgcatgtctagcatcattctcgtgtgcgtctgtgaaatcctctttatcttgtgaatatgcttaacaatacactttactttaagcacatgcataaatgttatcaagtcgtttgactaatcatgattagtcgggctgattggtgctatggagataatcaattagtcataattaatatcggctaatcgtgattagtcgggctgatcggtgccatggcagctaagattgattagacaatttgataacatgacttgccatagctcccacaaaatcgaaatacagcaaagagtttacgagaatgcatgttgcttccaattaaacatgagattataggttcatgatatgagcatttacttatgttataataatactatggtttgtgtgttctgcactgaaaattgtgaccaaacttgtgcttcagcattatgtaataatcatcctagcctgaagtttttttcctgatgtacctcaatgttcatcaagcatgcccattctgtaaaataaaaatattattctgcctgcagcccatagaaaagttaatctcatgaattcaggaattgttttgtactgaaaactgtcaccaattttatgcccaaacattatgcaataatcatccgagcttgatgttcttctttactgatgtatcctcttcaatgctcatcaagtaagctacccattctgtaaaataacaatactattatcttgcctgcagccaatagaaaagttgatctcatgaattcaggaagaacagtggcatccagcgtttcctgtccagcgggaaacagcggcagcttccctccctgcctccttccaggatttcttgggttcccagtcgttttcgtaaatttccacttgttcaaggccattgttcgcagtcctgcatcttccgttgtcttgggaatctgtggagggagccttccttagaccgctgccccataaggcattatttctggtctgggaattggccgttgggagctgcatagctaaattgtggcccaagacttcctagtcatcttgtggaatcttataggttctcgaag

SEQ ID NO: 7069 - DNA, 941 bp, Zea mays
tgtagattggatatgagatatagatgatagaatatctacaagtgattttctagtttatttgggcagtaaactcatcttatggagtgcatgtaacaatgttctcgtttggattcatcacttttagcatatctaggttctctttgattcattaaatgctaatagctcgtagtgaatattagctagctaacagtgagctggttttgtccaactaataaaatacttattgattggatatattagagtatgtacaacttagataccatgttgcggttctctaagctctagatacacttaaaaactcgttcatataatctaatatatataagtattgtatcttattcaataaaatctctcaagatccagtttatttatgtgggttgtatatgtgaaaccatatcttaatcttagagagacgtgctatagacgtttcattgttaagatacgtttcttgtgtgtgtgttttttttgcaattacagccttagatatatattgagatatgggtcatacatgcagttagataacaattagctggatctcgtctggattcgaagtaggtagttataagtagctaactattagctggatttcgtctggatttaaatgaggtaattattacctgcttggaacgggtctgggcctgggccatactaacaacgtctgataactgacgccggcccatactgcccagcactgtcgaacccgcgtccacgccgcaggtattgccgtatgcgacaaaatgaagcggcaaacctccgtgtttcttccactcccgctccttgccttgcctacgtgcgtttcgctcgcacaagccaaacccccctccccaaaagctcaacccccccgcagtcgggctgtcccataccacctaccccctccatccatttgaatctctccccctccccgatcatcgcaggccgatcgatcggcggctgcggcggcg

SEQ ID NO: 7070 - DNA, 298 bp, Zea mays
cgccaccggtggtcgcggcgccgcgagacggccacagcgacgagggaggcaccggtcgcacacgcgacggcgacgacgaagcccgtgttgcccacgagcacccagaacaggatccagggcgcgaaccccaggacgaacgacatccccgcacatccctctcgtcggccccggtcctcatctcatcgcatccggcgatgccccgtgtccgcttcgtcgttgccgatctgcgacctcgtcgggcggccgtcgatacggggtcgtgcttccccggctggttacccgggagtatcaaggaggt

SEQ ID NO: 7071 - DNA, 1455 bp, Zea mays
ttttgcaaatactcatacaacaaaatggtggctgaagtaaagaagtacggagagaaccttgctgtcttgagttcaggcgaataccttctgtctccaaggtttagccttcaacctaagggaatctaaaaggtaaacatgatggactcatcaaggagccacaacacgttcattcttttagaatgttcggttattaggtgaagtatacagagctgtaaaccggtgatgcacattcatgcttcatctaaaacaaccgaaggttatggcttctgwtagcctactcgacgcagatcgttaaatgatcagatattaagatgaccaggagttgtgtaaaagcttgatgcatatgtaaaatgttatatatacttggcattggctcattgcaatgggagaaggatattctagtttcataagttgatgtaagacatgtacgctcattttaggattattaatcgcatattgtgtttgcttctatttggattcaatttagtcctttaaaaaaacaaaattcgtttcagacttctgttcatttttttcatactggtcttattgcctatctcttcattttattatgaaagatattttagctaacattttatataatgcaagatgttgcagttaacacgaatgtgcagagcagcagtgacgaaacgcgaatgttcaagtagtcaggtctgtttgatccactgcgattataataattagctaaaagaatttaattatgatctaaacagaccaagattatgatgtggactatataattaagacacaatatgctttgctttcagtttttaatctaactcaaacatgtttttggtcattaagatttctcccttgaacaaacccatcacaatataattcaaatagtctgattattagttcaacatttcataatctatatataattcagattatagtaacaaaccaaacagctgctgagcccggaaacggtcacagatgatcttaggatcgaaacccgtcaagcgcacatcatacccatacactgacaccgggccccatcgcatgctatgacccacaggtcagtttgcatatcccaaacgagcgcgtgggcaacccataccctgggtaaccggctgcggccggtgtaccctgttcccctataaaatccaagcgatccccaatcaccgcctgctccccgtcccgtccaccgatacacaacccaactcccgcacgcatctacccccaccaccagacgacctcccccctcccccgcattctctcacgccgcctgcgctctccccctcgcgagatagacaaccctagctcccgtctccttgcttaccctcctctccaacccctctccgatctctataaaagacccgaatttcgaattccccctcgaacccgcgatccgcgctttccttcccgcccatttcggtctctgattcggcgcggattcgctgcgcgggagcccccgaggttgcgtgcgtgattcgg

SEQ ID NO: 7072 - DNA, 567 bp, Zea mays
ccaactactacaagagctctagcattcaattctagacacaccaaagagatcaaatcctctccatattccacacaacgccttagtgactagagagagagatttgcttgtgttctttcgagctcttgcgcttggattgcttccttctttcttgattctttcttgtgaccaaaccttcacttgtaattaaggcaagaggcaccaattgtgtggtggcccttgcgggaagtttgattcccaagtgatttgagaagagaagctcactcggtccaagggaccgattgagagagggaagggttgaaagagacccggcctttgtggcctcctcaacggggagtaggtttgcaagaaccaaacctcggtaaaacaaatccgcgtgtcacactcttcatttgcttgtgatttgttttgcgccctctctctcggactcgtttatatttctaacgctaacccggcttgtagttgtgtttatatttgtaaatttcagtttcgccctattcacccccctctaggcgactatcaattggtatcagagcccggtgcttcattagagcctaaccgctcgaagtg

SEQ ID NO: 7073 - DNA, 1500 bp, Zea mays
gtgatgacacaaaatgcaagcgtgtttggtcatcattcgatcgtgctgccgtgcgtggattcgcacccgccggcgggatccggacgaatgtcatgtgacaaagctgcaagcggcggtttcgtcatttcttgcatgtagagctagcttgcgtgtgcatgcatgcgagcacgtcacgaaatatatgtactgtcagtatatgcccccatatcacgatggtattcgttaattgctagaggaagtgtgtaaatcatttgatcctctaaatctggaccacaccttgccaagagagcccaacaagagcaacaagaggaaccctagctaataatacatgcaaaaatgcacagcgctcgtacggtacagtccatgagacgtacgtacgtacccctagttttggtgcacacacgttcggcgggcggtgtgccggccggaggaaggcaaggcaacatgcatgtcgaagccgacgtcgaccggccgatctatgcattaaatatataataatactaatagcacccttggtgatcgatgaatcgacacatacagccccactagtccccactagcgctagctaggcaccgaatcatatatctcgcacactggtggtggacccattggttggttcttcgttagtttagttactggtggcttactgaaatgcaagagccaagaggaggccggcccggagcgccaccagcagggcagcagacaacaaattcgacgacgacatgacatgactaaccccgcatgccaatataaattaatcctaggtatattattgttcgtggcgcgcggtacagtccggtcgctttcaggctgatttcggagcggatctgcgtgccacacgaagaagtgatttggttggccagcgccccgcgagagacctaacacatgtactacgtactagatgctcgtacgtgctgcgtgtcacgcagtgcaggcctccgcccagcaggctatatatggtacaaaacaaaaataaataagctcaaagcttgcggcacgttcaacttttcactggcggtttccgttatcaaacgtcagtgaaagaaacaggtgggcccggctttaaaaaccgccagtggaaatcaattttcactggcggtttttaaagacaaccgccagtgaagtgtctgttataaatacccctcttcccccgacagtgaactgtatgctcgcagccaacttccattggaggcgattttggaggtccagaattcacaaaatacatggggagaggttttgatcttcattttttggaagaagattgctaagaaaggttggtttatgttgctaatgtcaatttttattcatttttgctcaattttagacacattttggatctagggtttcaccattggagagagagtgtatcctctctcaattttagccacattttagccacatttttgctctattcgctcaaataaagttgttcattttccttaaatttagccacattttggatatagggtttcaccccttcatccttcccgacaggtggtg

SEQ ID NO: 7074 - DNA, 1464 bp, Zea mays
tatactattaataacaatatgctagagatatttatgtgctactttttttaccatagaggagcgagacgaatagcgtcttataaggtatagattataaacatatttcgttgatacataaaataatttccaatattcctcctcatgaatttgagatagacttatatctaagctttggaaagtgttagaatgtcaaatgccaagccaaataaactacttcatcaagtaaattccaattcctccaaaatgtatagatccaaactgcccctgctagtgaacttaagaatttagagagaataagaataaatcgcaaagaataaaacacacgagacaaggcaacttatcacgtggttcgatcaagcgtcaaatgtttgcctactccacattgtggtgtccaaacggacgagggttgcgcagacgacggttagatttttaatagactaatatacctgactaacagcctccttgatttgaggattcgtggacaccccaatgacgtcagcgcaagacaccccggaaagaacagaacgagagaggactcagggggtggcgccatctagcccgcgaaaggagggagaaggcaacgggaagcgatagcccgtgccgtggcgcgtggtgggattggcggcaaagcaagcgggggcgatcggagagagagatgggagaaattacgcgtcgaccagcagcagccgccgcaaccagcagcccgcccaaccctacccgcgcgcccgtccccctccccgtcctcgcccgcgtcatcgacccggcacccccccttctcgtcttcccctccacctcgtcacgccgcacgggcccggcccaaataccctcgccctcgcgctcccacctctcgcactccacaaaccctaaccctagctcgctgccgcctctggtccctcgtcgtcggcccactgtctgagataaacctctcgccgccgcggttgctggtcgagctattcgtttgctttcgcgctgcttgatttctctcgttgcgtgtggtgtggtgtggtggtggttggtgggggacctcgaggggttttggatttgagggttttattcttcgcgctgcggatcgaagctgttcgtcggcgttcgttgcagctcccgtgccgcgctctcgcactcggcggcagcgaggtgctttattttgatattttttggtrggttctctcggtcggtgctctcgctttcatggtcggctggcaagttgttgggcgtatatttgtctcggttcattcgtgagggattttttattatctacatacagttgctctgttagaggctctatttggcttatcgtatgtytggtggctgcaacttgattcagtgacatatattagattttttcccataaggaatggcatatatataatagctataatgctggcatgctgcattggttacatgcaggtagcagagttgcttgcgtgcgaaggccgcttggtctggagttaagcgcgtgttgta

SEQ ID NO: 7075 - DNA, 1500 bp, Zea mays
aagtagttatattggctcaattccaagcaacctttacacttacattatgcaaactagttcaattatgcacttctatatttgctttggtttgtgttggcatcaatcaccaaaaagggggagattgaaagggaattaggcttacacctagttcctaaataattttggtggttgaattgcccaacacaaatctttggactaactagtttgctctagtgtataagttatacaggtgtcaaaggttcacacttagccaataaaaagaccaagtgttgggttcaacaaaaatgcaaaggagcaaccgaaggcacctctggtctggcgcaccggactgtccggtgtgccaccggacagtgtccggtgcaccaccggacatgtccggtgcaccagaggactctaactcaaactcgccaccttcgggaatttccagaggccactcgcgctataattcaccggactgtccggtgtgcaccggacagtgtccggtgctccaaggaagggcggcctcaggaactcgccagcttcgggttttcactccagccgctccgctataattcaccggactgtccggtgtgcaccggactgtccggtgcatctgcggagcaacggctacttcaggcgccaacggctccctgcagcgcatttattgcgcgccagcgcgcgcagaggtcaggaacgcccatgctggcgcaccggacactctacagtacgtgtccggtgcgccaccggacatcaaggcgggcccagaagtcagaactccaacggtcgatttccaacggcactggtgacgtggcgggggcaccggactgtccggtgtgcaccggactgtccggtgcgccatcgaacagacagcccagccaacggtcatgtttggtggttggggctataaataccccaaccaccccaccattcattgcatccaagttttccacttcccaactactacaagagctctagcattcaattctagacacaccaaagagatcaaatcctctccaaattccacacaacgccatagtgactagagagagagatttgcttgtgttctttcgagctcttgcgcttggattgcttccttctttcttgattctttcttgtgatcaaacactcacttgtaattgaggcaagaggcaccaattgtgtggtggcccttgcgggaagtttgattcccaagtgatttgagaagagaagctcactcggtccgagggaccgattgagagagggaagggttgaaagagacccggcctttgtggcctcctcaacggggagtaggtttgcaagaaccgaacctcggtaaaacaaatccgcgtgtcacactcttcatttgcttgcgatttgttttgctccctctctcgcggactcgtttatatttctaacgctaacccggcttgtagttgtgattatttttgagaatttcagtttcgccctattcaccccccctctaggcgactttcaattggtatcagagccaagttgcttcattagagcttaaccgctcgagtg

SEQ ID NO: 7076 - DNA, 104 bp, Zea mays
gtaagcatgtgctcttcgttcttttatacattgggctaatttgcttgcattagctgaagttgacaaggcagattgcaaaaagcttctgctattcatctgtagcc

SEQ ID NO: 7077 - DNA, 372 bp, Zea mays
cccgccccttggcccttgcccgcgggggagagacaggcccacccacgctcccgggcccggaacgagatgggtggtgagctcaccgctgcctcgtggtgggcaacgcgaggcggccgaaactgacacactccctctccgctctctctctctctctcgcagccatgctcacacacacacgcaggcagcagtcacgctgtgggaggggcagagaagcgagcgacacaggaaactgacgtcgcttttgacggcctgctacataaatcccctcgcctgcctcccttcccatctccttccccgcaaaaatcgcccgggtgccaggtgcgcggcgcagggaggtcgcgacggattccgggcaagtgcatgtgagatccg

SEQ ID NO: 7078 - DNA, 697 bp, Zea mays
cgcatgagagcacaacaccaagcctccattgatcatcctaagatgcctagactcctcaaaaacgcatccggatcactgtggttaagatttgagcacgtgttgagttgtagacttgctgcggtgtgttttgtgtgctcgactcttgacttgtgtgcatgtcattactgcaactctagttcttacgtgtgtttctttccctcccttactcttgtggttttcattgagatcaatattgtaagggtgagagactccaacttgtagagattcctcgcaaagggaaaacatctgcgaaggaagaaagtcgtggtattcaagtggatcattgggtcgcttaaaaggggttgaatgcaaccctcgtccattgggacgtcacaacgtggaagtaggcaagtgttctacttggccgaaccacgggataaaaatcgttgtgtcacttgttgctattcttgtgcaatcttctactcacttgataattggtctaagtgtaatactcactttgtgaagagcaattaagtgaatgagtcacctatctctcttgtcataacaccttggtttgatttcactamcatttcataaaccaagtttgtggcattwaaagctgatttttacaagatcacctattcaccccccgccctcgaggtgctctcaattggcatcggagtcgtactcttcattaagggactaatcgcccgaagag

SEQ ID NO: 7079 - DNA, 1084 bp, Zea mays
tttggttgggtctactatggttgggctcaacttagtcagggagctagactaggtctatatgcggttggatccgtcgtgttaggtcggagcgtgtgtgatcgaggatcggctttagttacgcgaggcctttatctccaggagtgatcttttatgtttttcttggatactttgtgtacatgtacttgtcgcttttaatgcttgagttatctactcaacaaaatctcatcaagagcttagttttttatatataatatttttatctgatgtcatacaagaaatatataaattttataagtggtaaaattggtacgcaatcaaattactgacactttataatatttttttgaatatcttaacgctcttaaatgataaaactaaaaattagaaagttatagatttaaaaaggctatagttttttttataaaataatatcttaatctgatataattttttctaagattaagatttgctcctgatacgtgaatcttatctgtcatatttagggctggtaatgagatccaaatttgcactataaaatttaatgatcgaatcgaattagtattgagctctattttattcaactttgaactaaaattagttaagggctcaaataaattgtcaagaaacatttaaatcatgatccattaccactcgtatttatatgtgttgagtcaccgtattatgccagctatagagtcgggtaaacggacttggatatccgaagtaacttgggaggttataaaattacattttgagactttagggatctggtaaatttcactcagcacagaaactaagcaagtatgcgtttgtttgttgccaattttaaagcaagatgctttgcaaattgcgatatggccgcatgctctagtcttccttgtgatctgactgaccccacgtctttttccttgttccttcgctatgctacatagttgttgctttcgtggcttgtttagtcacgttttattttgtccggcattgactgggtcagtactcagtagccactagccagtaccgtccagtcatccacgctgatttgccggaaggcgcctcggcggaagctgctatctagttgaagccagcc

SEQ ID NO: 7080 - DNA, 380 bp, Zea mays
gctgatcaagatcatctaaaattctaaatcaaccgaaggagtgtcgaaggactgcagatcaagggtgaattccctctggacagcagacccaaatagattattatagaattcccaaactgcatcctcctgctcaagaatcacctggtccacctttgtcttaagtcaaatattactatatttcaaaaaatccttataatttcacaacatataaattatatattatgaatgtatttatcatagtgaatctaaaaatatgaaattgtgtcatataatctatataaaattttgaaatctatggtcaaagatacaaatgtttgacttaagataaagctaatacgacatgtaaaaacaaacggaggttttacatacagaaggaacat

SEQ ID NO: 7081 - DNA, 885 bp, Zea mays
tggggattgagagggattgaatcccctacaagtcaaaatcaccctcaatccactccaatccccctcgatccccatggattagggatgaaacgaacaaagcctgaggtggacaccgcggtcaaagtgatcaacgatggtgagggctggggaaggtgagtcggggcgctgggtagcttgggagccaaagtggtgggggcgaaaggtccaccgctagccctttttatcattattatgttagctgttgtgctgtgcaatagatggttacacatataattcaataatataaaaacgaggttttctaacctaggcatgtttaaatgcatcctcacatggagtcgagcctaggacctaaggtgctactaaggttgttgcacccactgggctacaaaccctttcaccctataatctattgagaacaggaaattgattaagggatgtttccacaagagtaaattttaccgtcagcccttgaacttgttctatgttctcatctcggtcctagtacttgcaaattgcacatttagctcccaaaacttatctcgaattcttagtgttggcacttgcgttgcacgcttggctttctaaacttgttctatgttttcatctcgctccttgtacttgcaaattgtgtggtagactctctaaactcatattactataccatctaggtccaacccccgcacgctgtgttgtccttgcccttcgtccctccacaagtgcacgtctcacaaacgcaactactctatgcttcaccacgcttgtcccgcctacctgcatcgcatgaatgacatagtgtcatattaccttgtcacaatgacacttgacaccaccattttgtacccttgccaaggcgccttgctcctatggtggtgtaggcgcacgtcc

SEQ ID NO: 7082 - DNA, 1406 bp, Zea mays
tgtatggaagcattaaggaacaaggaaaatcagaggtcctagtatggagatctcagataccctgctgctacatccatgtcaattcttgtaagattcgagagcgaaaaatttccagtaaagaaaaaacttaaataaataaaaccatgtaaagtgtaataggttacaacattgccaaactgtactgttacattttcacatgtgaaggataagtgcttatatgcattagctactcagaccacccagcaggccattgtcaacagagcctcatggtcatgcttggtggtttgcatgactgttgccttaaggagatggaacaacttatcaactccctctagccagtaaagaaaaaagctctcaagaggactgggcttcccactgatatctggcccgcaaagagttggaaacagactggagtcagttgtactgtctactgaattgtttcacattatcagctgcatatgtacacaattttttctacatgtactctaaagtgggcaggcttggtgcagtgagtcaccaggtcgctgtttttttctttcttttgtacacttgaatgagagcgttcaaatttatgttcttgcattcatctgatatcctaattgtcctttgttttgatagtcagcaggtgctccaatcactccaatttagaggtattgtattgcaatatgctaattaaaactatggcttagaagtttgagttttgaagtattgtatgcaagtgtccctgtggtattgatacatggtggatcttgaacgcttctaaatttaggcacaaaaggaactaaaaatttttgctgtctacatgagcttttaacataacacttaaggttttactgttagttgcttcattgtgaatttacagtgcaaaacctggtctggaggcaactactgtgttcagtcagtaggataaaaagtgtaacagaggacactgattaatatattttttgtttggtatacagaaatacattataccagttgctaagcattcaatcttattttcgtgaccttgatattacaggtactctatggataaattacatagatcatggatgttgatggctcagtggttcactcagcgaaggcttggaatggaattcaacagtcaagtgctatacgtattctctggaatagctaactggtagcaacgaaattaaaaaaaaaaagacaaatcagaataattaggtaaaggagaaactggtcccaaaggtcatacatgtgactggacttttgactctctttcagttctgtttttcttatatgtgtttgcttcttgtcccccaaccattcccggatcccctttctcacttgagctttgacgtgaaccacagaatacagagtttcagaaacatcaaaactcacctctgagttttctcacccatccacagaatacaggaaggggaactcac

SEQ ID NO: 7083 - DNA, 1500 bp, Zea mays
ataaaaaaattattcgtacctcctaacaacagctctactaagaacacaagatcttccactcaagtatgaaggtaactacggatgtgcttaaatcccttgccagccgcttgcatcacctagctgggcgagacaagctgtttggtagtctctctcgctcgcctcacccagttgttaggcaagcttacccgcccgggcaagaaaatctttgtcagcataggcgagccaaatcaactctcctacgtaagcaaggtcctcgatcgtgcacctccgtggacactggacagtcgagttggcgtcgcatcgagacttgtcggtgcccagtcgaggctcaccggtgccgggttaaaatttaccgacgctgaatcgaggcaatcgaggttcgtcgccgctggactagggctcctcgcgtcgtatggagggaggctcaccggcaaccttgagttgactaaggttagccgcctaaattctacattacatcttaacatgactaaaataaattttgtcacacttttacaaattattaacgtgagacctacgtatttgcagaaaaatcttgtcagaactgtggctgcaaaccaaacacatgtctagctctgttaaacatgtgtaaccttagacrtgacaaaatgtaaggtgaggctgcaaaccaaacaacccaaaacatcaatacaagtacgtagtacttttactgatagtagtatactattacaaaaggcagaacaatcatgtttaaatatgatcactacctattacttccccttttccaatttaaaattcgttttagccatttatggattcaaattgttgtatatgttttgcatatgtgcctagatttattatcattcatttgaatatagacataaaaaccaagatctaaaacgaatactattttagacggagagagtatagatttgtaagaatctatttagctgatgtatcctttcagttaggattcaatttttttttaataggaggattcaaattttttgatagtacatctagattctagaccgtcgatctttcaaacgttgaaaagaggaagaagagcttgacgttttgcttagcttaacgctagcccaacgaacttggcgaaaccgatggagcctcaaacgggccgtatccgtcgtgcacagcatgctaaagcccagtgctgacgacgacgaacaacactcatccggcccggtcatgagcccaatgcggggccacttcgtcgtttttgacaagtagacccacagtggccccacgtgcttgcccctccctttctcttctccccttgtgtcgcgctcgcgcatctgaagcaagggggggaagggccaagggggatcggtcttgttctcggagagggttgagctgcttgacggttttgactcggatcatggtgtgcagctctatcagatagagagctgacgtgaggtgtgagacgcggatcgtggagtactactcagtaggagatcaagaggaaggaggtggggagggggaagaaggcgatagccggggagg

SEQ ID NO: 7084 - DNA, 80 bp, Zea mays
tggtgcctgcagcgcaacctcgatcgcgcacagaggcccattccgccgaggagtggcacgaggagacgacaggtccgggg

SEQ ID NO: 7085 - DNA, 1352 bp, Zea mays
aactaaactaagccattaaggggtatgcagcggtactcctcagtatttactagatggaaattattttggctttgctattaacacaaaccttgcctataaaatagttgaaactatacaaatttggtttatgatagattaaaaactaagtttttggaactcacaacaaagattaatctaaaacttgagctctacttcgacaaagtagcaggttgttcgcttcggattaaagctgaatgatcgtactactgctgcaatccatatagacaaaacactgtaaaaacattagaagccgatacagattaaaaccaagtgaacaagctatagattaagacactagggccttttctttctcttctgagtggagctgcctaagacaaaacaatgctcccataaattcaatccgagtcctcccaaacaatgctccaaacagaccttcacgatttgagtcctccctacttgagatgaattcaagatgctgaataatttgcaaaaaaaatgctcgaattgcatttttaatctgtaatttaatgtggacgtttctatatttgaacccaagaagttaaagtaatatgtaactaattttgtaatgtttgactaaccataatataaactattcattctaagagagagaaacactatcattttaagagctaatttgatgataagagaattagagaggattcataagaaggaaaccatgtgctattcaaaatcgagtaccaatagatttccttccccatagattccacgtgtgccttgtttcggtaatgtcaacatataccatatatgttctaaattaatatttatttagctcttgttttttatgtttatattcaaatgaactatgataattttagattcatatacaaaacacataacttaatcattatatgaattcattaaaaggctatcatgaatttttaatttgtgacagagagagtacatacatattcaactatacaaaattcaattatttctgaataatttcggatcgcaatgcacggatgaagctataaacgattttttcttacgaataaaacgataaaacaaatggaaacataactgcttaaacttttctgtttgacatttttgcccctattcctccaggagagcactagagctacagcggcccgtccacaccataaactcgcaatccccacgaaaactccaatttccctcgcttctcgcaccccttcgtttccctcgttttcttccctcccttcctccccctaccccgcgcaaaccctcgcccgccgcctcctcctcctcagatcccagctccaggaccctgccgcccgcccgcgcccgcgaccgggcctccgatccgcgcacccgcgcgtgccccgatcccc

SEQ ID NO: 7086 - DNA, 971 bp, Zea mays
tcctatccgtgttataatccctgtatcagtctctgatggccttgcttcctgttgcagagaaagaagaaaacaatgttctgctactaggacaacacctgcttccgtgaggagatgacaaacgcggcggaccccttcatttttctgacacttgtgaatcaacaggtttccgttgtaaatcaacaaaattctggcataaataaaatgttttttttttaaaaattgcaatcctgagcattgctgcctcctcccggtctcgcaatctggttgttgttagttgcagcataactgcataattggttggttagccgcgccgatgataattggttggtttcttagctgatgcgtatcgtcaagcgtgtctcgtcgattgattgttctgactctgggtgaattattgagcaggccagctgttgcctctagcaggggcatgcgtcgtgctgcgtttgcttgttattatggcccaggaaagatgcattttatttgcttcttgcagcaggtagaccgactgcagcaacgttggataaagcctcctattcgttatattattatgagtgaatcttttagagaaaaatgtaaatgcgaaatttagtgaaggtattaatatagagaacgtcggaggacccactttagatagaagattgggcctcatgggccctccgagggccacaaaccattaggcccaatctagttccagaggctcaagcgatctgccaggcgaagaggaaaaaagaaaagaagcccgtttgccagccgcagtccattcttactcccactgccacacgggccccaacgttttatttattttcttcccccactccatcttggagaagaagaacaaggaggagaaggcaaaagaaggccgacgcgctcgccgctgctaccgaaatcggccagacattccccaaaccctacgctcgctcgctcgccggagccctcgttgaaccgagcaggcgggcgaaggaggctcgacg

SEQ ID NO: 7087 - DNA, 1087 bp, Zea mays
cttgcatgcctgcagtccgcgtgtccataataattcttttattaagtttttacttgtgtctgatgatgaatagataagaaatttgtttacttatgctatagaattttagaaaaataatagagtttgtcgtattcaacaaatatatgaaattgttcgaaatccgataaatacgaactttgatataaatttttacccgcaaatatgagcacagttagatattggttcaacaataaatatgattacagacggatattaatatccgatcggttgtcatatctatatgtacaaaacaatgtatttgcatctagttggcgtgagagccaatgacctcatccgatccctttccctttcccatccgcgcgtccctactcctccccctccctcctcaacgacgcgagaagacgcaatcctgggagctccgaaccctatctcctaatttgagccccggagccatcgattcctcaagagcccgccgcgattcggctcccgtagcagcatatggctccaccgctccccagctgcatcatcatcgaccgcgggggcgcgccacctcgactacgctctaggaagcacctagtctcggcggcttctcgcatcttggaggccttccataaggcggtttcgtggtgtccgagcccggatctacggcgatctgcaagcggaaggcgatagatgaggcgattcagtggtaacccccaatccggtgggtttccggctggcagaggcggaaaggttcgggccttcggcgggtgatcagatttctccgtgcggcgcgcggcttgtgtctaccgcaacggtgtaggactggagcgcaggagccgacgaggcggtggagatacaaaaaaattgcttgcttgtacacttgttcatgttcatttgttcctgctatctgttgtggtttaaagcatcaattttccgctcaatttaagggcgaagacactttttttgttccttccttgttggtttctatggaataatctctatattacagaagaggagtgtggaaaagcaacaaaaaagaggaatataaaatacaaaaaagatataaccagcagaaaaaagagattttttttgagtgggcaagcaa

SEQ ID NO: 7088 - DNA, 813 bp, Zea mays
tgcagccccctgctcatgtgggtccctcggtggcgcactaccgagcgtaatcgctggcgtaatcgcgtctcctcatctcttgcggtagggggtgtttggttagagggaccaaagattagtatctagtttttagtcctatttagtaccttttttgctaaatactaggactaaaatgatttagtctttagtactttacatatgtgctaaaagggactaaaccatattaattctatatttacctctcatttagttcaattcaattgtactaatagcactaatagcagaagaatgttaaaaactattttagtcttattatgagtcatttaatatattcttattatttttagccccttgaaataaacatgttaggaattaaactttaatttcctaactaaactttagtccttagactaaaaaaaacaaaacacggccaaacaacggactcgtgtgaaaagtaagcagaagcatctagacgcgcgggggcggttggggcctcgctgaccatcagaactgacaacagcgctgccgcacctacccctctccactacgactccacattttccaacggatttttattttttctaagaaaattaatttttttagaaaaataaaaatcacttggttgcactaaaaaaagcaggcacactcgttactcggtcgccgcaacgacctcccagttagtgtattaaaggggaaccagtgaaccacccgatgcaacttgcgtagagagttgggcgcagagaatccccaagcaaacaaacagggtagagggagaggagaggagaggagaggagaggttgggtatgggacacc

SEQ ID NO: 7089 - DNA, 827 bp, Zea mays
tggtgcgacttcagggccaactcttttgccaactgtgacaccgaaggggcacttgattggattaaaaaggaattaggtgaagttgaaaccattatcaaagcccgaagcgattattgtacaataattggatctcatggcatcttaggctatcttgatttctatgtctcctttatatattcctttatattttatttatctctaatgacattcttctatattttatcatcgacaattgtattttacttatattatagttgtattttactttagatttttatgcgtgtatttattatattcttaaatattttatacatattttagttttacttaatttattgtttaaattataaaaatggatagatgaaagagtttttatatatgaaagatgaaagagtgttctctatattagagaaaattttagagaacactattagagacgagaccgtaacaaaaaggatctcgtaaatagtcctcacttcgtataatcattatttatagaatagagtttgaaagatataaatataagttaactattaaaagacagcccataaacggtcttaaatatacataaatgcacggggtgcactgcgcagtctcgcctactctcgctgtggcgttggatgcagctcatttatgactaacaccgccccgtcctttgcatcacgacggcctctataaattcatgggtatccgagggcggcataacctgacaacttgtgcggtgcaattcagaagctgtagccactctcgccgtacagcgaccacaaacactcacgggggcagggagaggccgctgctggagggagctgcttattacggtgaaggcc

SEQ ID NO: 7090 - DNA, 1250 bp, Zea mays
tgcggagggagaaaaaataaaagagaaaaatttattgggtcccactcaaactagtgatatgacaagttttaacatatttagaaagtcatatatagagaactgttggagaagatgatttttttcttcctatattatttgaggacgtactaaatctaggatttaagtactagaattatacataactattgaaactgctaaagacttgctattgctacagatagagccagttttgtatctgtagtattgacatatcaaatataccggagacccaataattgtttcattggatgaccttgcatcccaaggcctcaatcctcggtagctcatccttcctctcagagtcaattgcacaattgccatcatggctcatatatcataatatgccaaactgaatataataaattcgaaatatggtattcctactactcagaatacccacttttaacttcacataaatcggatacttaggaattgctttcttgcctaggcagcaataggtggcaattagatggatgattcagataaaaacaatcggatggatgagtcaataaattgtaaacatgtatctaaacaacgaattaattgtagtagaagggaaaaataataaactttctcccaaaggatacctcggtcagacaaacacctttgggcgtgttcggctggctacaagccgacactgttgcagctgtttggactgctgcagctgcaatccatagagagaaaaatactgtagaagccgcagccgcagccggattgcagccgcagcaagccgcagcgaacaagctgtttggttttagctttatccaacttctagccaccagaaacatactgtcaaatgcgttacttttcagctcgcttctataaggatcactttagtcaaaactgttcaaaatcaacataaacacagaatcgaccgaaccattgtaataaggaaaccatcactttctatatcctaaaatctatatatggactcttttatcttacttcacatgtaatctccatgatactcgaattcctctccacaatcagattttccttatacacagatttttagaaaagattctcagaaaaagctaaactaaataggcttttatatcctgatcgtttgaagccactgttcgcccgcaggttgtcgaactgcggccagacctgtgcttggcagctgggccatatatgtcgcttccatatattctgcagatcaagcagcatttgaccagatgctttgacactgcacttctccattgcagtgg

SEQ ID NO: 7091 - DNA, 164 bp, Zea mays
agaagatgagaaagctttgaaaaagaaaaaaatccaaccctaagccgaaggtggctgttccgaagaaaagaaaagctgcgactacgaagctaagaacaactgatatagaggaagaaattccttcaacgcctcctgctgctgacgtggaggaaattttaaaggta

SEQ ID NO: 7092 - DNA, 698 bp, Zea mays
ttgcatgcacttcacttatataagttcttaaataccccttaggctgcaccacatatgcataggttgattcaccaatacgtcattataaaaaaattacatgagatgttggagataaacaaaacacattgattgcaataaaaattacttcatgttacagaggtggctcaaaagatgatcaaacaaactccagatgtttctccaattgatgacaatatttattgtttcaattggatataagttggaaagagaagcaagtagttttgcaaacacaattatttccatcttgcaacccatcctgtcgatatgtctgactccttatctagcagagcagtccattatgagtctgcaaaatgttagcaacgaaagactatcgaaacaacatgccagataagtcgttgaaaatctatgagttatgccaacaagacgacatctttaaaaattttatttatttgataaatacgtttaagtccacctttagaaatcactcacttttaggcactataaatataaaaaaccatgtatataaatatgattttcatgaaaagtttgtgtaaaggttatgtttatgtagatgtattttaggggggcgtatctatttagtcaactgtatctaaatataatttctaagggtattttgtaagatatatgttgggcacttgtttttgattactgaatcataaaacaaggcaaattgttaa

SEQ ID NO: 7093 - DNA, 213 bp, Zea mays
tgccctgattttgtgctgatttgacgccaaccaccgacccacgcgacccacgggctgacgggccacaacaccggcgcagcgccagcgcatgcatttatacctctacactctacagacaccattgcgagccgcccgcgacgactttatacatccgcttcctccagtcatcaaagaaacagagcgagcctagactgtgaggaagaaaggactacc

SEQ ID NO: 7094 - DNA, 1307 bp, Zea mays
ttgatgtacctttttttataagtttgagttcatgtgacttattttagaaacttgagctcacaaactttctcttatttggtctctgtatggtggaattatgtcattctataatctatgttcattctatatttatttttgaaccagagtycctattttaattaatcgggctttacataaaagcaattctatgaacaaaatcatcaatcaattatgagcaaacaaaattattctctaaagacaaatgagatcaagcacttgttttgaatttttacttttactttctattaagttttaaatgaccataatgcattattttaattgatagatttgaggtgttacaccctacatccatttcaacgccccatcaatttttcttttggagactttatttgaaataaaacatggcgctttattaagaaatcatccgattaaaaattaagcaaataaagtttacataattcataaaccataaataaaaactatataattcataaaccattaataaaaattacataattcatagaacgtaaataaaaacacataatttatgaagataaaaaaaaaatacataattcatattttttttttgaaaattttgtgatttttgagtacaaacaatcttaaaacagagagttaacatgatacacatgtaaactgattaaaatgtgcgataccatattaaaaaggtgtttgattgaaacctcctaaagtttaatggctaaagttgaatttattttagtttttaaaataccaaaaaaagtgactaaaatatttctttaaaatagaatttctataatctagaatttagtttctaaagtttatgaaagtgactaaagaaatcaaacatcttctaaaatcggttcgatatcgaatcactatcaagctcctatcgataccgccgaagattgaccggccttagcgactactgttggccataccggttcatatgtcacgtaaacggtaggtatcttcaagagttggattagtcgcatcatgtgtccacacacgttcacacccgcataaaatcctccgactccgaggcgaccagggccaaccacaccaaccacgcacgccagcccgctccagcctccaacccattcttcggcggttcggcccggcctgcaccctgcagccaccaagcaaacccagtggctctgccttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacggg

SEQ ID NO: 7095 - DNA, 248 bp, Zea mays
tcttgcaaatacacaccacacaagcaaatgatttattgtttcagcttcctggtcacataaaggacatttgcttgggtgattcagatctctcttagccaatttgtcatgtaatgtccaaaggagcttgaccccaagaaaagatccttataagcagcctttgcggtgtatctgccatatgaagcaatgctaaagatatgcttatcctccctattgggctgcagttcaaaatctgagggaacttcctaaag

SEQ ID NO: 7096 - DNA, 1114 bp, Zea mays
ggggggggggggttagggcggacccacaacaaaataaaaaaaacgaaacaaccggggggggggggggggggggaaataaaaaaaaagggaaaaaacacgggggggggggggggagatatatatatagatatatgtgaatgagtgcgatcgattaagaacgactagacacgtttcgatcgaaacaatttaatttctttactatttctgtcctaactcctagttgtagctttttgctaatcgactgtatgtcgtctagatatataccttatccacctccgcatctaatgacgtgggatggatgttggctcacatcatctcgctttcttcccgatctccggaatatatctggttctttatgcgcgctgccggcagcacgcggactcgcgtccgaccatccgcgtcaccccagcgccgcgacgtgtcaggctctagaacgtttcgtcatgggggccggacctgcatgtccttttgtccccctcacttcccacgcgcccgccggacgtcagcgtaaaccttccactgcctttcggtgagcttccgcgcgccgttcaactcgcggcctcactagtctttggattctactgcccatccaccgcggagagcggactataacggaaaacgcaccccctgctacctgctacctgctcctgctgaaccggagcaagtagtggttggtgcgccatcagctgctggtgctgacacgtatacccatgtcgccaatgaacgagcgcgcggccgtgattccccggtttgctacgcttaccacgcgcaacggaattttgtagcatatatagagtggggtatcaagcaaggtgttcgagacgggtttcgccgcgtgctctgtatgtagcgcgcacgcgcacgcgcaccgcgcggccggtgaccggccggccgtgtgctctggttcgtccattgtgtaataggtagatagacagataggtagaatctgggcctgatgaggcgtgcgtgcgctcgtgtttcccagaaacgatacagcagcactagccaatgcaaacacctttttccctgcgcttatatatagcgctctccagtcctagtgtccgcgtcctcgtaatctctcctgcgtccatcctctcctcgcggcgggggaaga

SEQ ID NO: 7097 - DNA, 1500 bp, Zea mays
attgttggtttccggatggatgattactcgcctgcgaccgtgacatccccaggtgacaaccagaggggtccaaatgcatgcagcatgccaaatactactccagccagactgtgacatcccctgcaggtgacaaccagaggagtatactactgtatgtttatgaaatcatgagtggttccttttgtttttagcgtacccaaaaaaaaagagcacgatcgaggatgcagtgtatacagtacttaagttcagttggtcactgaatcagaggccagcccggccccatgtgaaaccgcgggaagtttttcgccgcgtgtgatggcacgcggtcatcgggtcgtggtgcccgatttgcttgacgaatgcttcccacggggggtgggtgggtgacccttgttcacgcggccgctgattttactgacatcgagagctatatgtgtgtgacgccatcattttgaccaactgtggccttccagtttcaatggaaacaaaagagacaaggaaaggagggtttggtatcatccacttcccattttcgatcgatgggggcggggaggcacatgaccgtggcgtgccaccatcgacaacacccaaagttagcatcgtatcgtaccgtctagtggccggctaatttgcttgccagaacgcgcaaaggcggcacggaaaggattcatccaaggaatcgaaaaggggtaccacatcaggacaggacgacgcgtcaccacgatagcgccgaaagtcgctcagccactcttggccttggtggctccaattactcatgcccagcccgacgtgcgctgcgagcctgccacgcgttttttcttcttctgtagaaccggtgcggaggacaggaaaacctggtgcagggaacgtaggcaacaaaagaaaaaaaaaaccggacccgactcgagcgatcagcagcggcaccgctacggaagccgtgacgcgtcccgagtccggacgcgttgacatctcggcggtgtggccgtccgtctatccgttcagagggaaagctgcggctgccggctggctacggtacgcgttgcgtcatctgggctgtctctggcccatcaggcggctgcctctgccttccagttccagccgcgtcgctgcctatcacacacgtcatcggacgtgacctcctcacccgcagccgcggtggggcccgtctaggacgtgctcctttccctccacggctttgacatcgcgtcacgccggccggcctctgcctgacctgcctcggcgcagccccacgcgacgtacgccacggaacgacgcgccgaccgagccaagccagtactaccacgtccccccagccaaaccaaacgcaggcacggcacggcacggcgcggtgctcattcgcattccccagccccaccgatcggatcggcaaaatccctcccaccagctccccacagatcccggcgtccccaccgcacatccctccctgcttccttcccccatcgccccggccgcggaggcggagcttccccccacgccacg

SEQ ID NO: 7098 - DNA, 332 bp, Zea mays
tatcatatctcactcgacctgcaactgcaaagactccttttagcgctctgctgatgcgtcgtcgaacgcggcacgcggtccttaaagcctgcatgcgaaagccaggcaggcgtggacgtagtgattagaaacggttcgggttagatgggtcgagaaaacccaggtgcggccgtgcgggtgccgggtggtgcttgtcgcagctggtgcggttcgctcagctggtttgatgactgatcggctctagcgagtggacgtctcttcctcgtttggatctttactcagggaattacgaacagcaggaggatcttgtgtgctctcctacgcgtcgtcgc

SEQ ID NO: 7099 - DNA, 590 bp, Zea mays
ctgcagctgcaggagtgcaggtggtctcgtgctgacgacggcgactcctctatatatcatgccccggcgatcgcaagcatacgcgtgcgcgttggtacggtggcgcgatatgcatgcgtgtcgaaccgcgacacgacaacagatgcatggcctgaccacatgcacgacttacatgcttcaactagaagcagaacgcgtggcgtggtccggtccggtccggtcggtcaaaaaaaaaaaaaaaaactcatccccacagggagaaagaacacaaaaggcagacatgtgatccgtccagttcttcttccaggaagcaggacaggacacgggagggaaaaggcaagagcgtggaagtcaacacccacgccgccatggcccatggcgcgaataagtcaagggcagccgtctagaagccataccaaccacaaccagagacatggcgacatatatagaagactgagcaccgagacgagacgacatttatagctcaagcgatcgagtcgtgcagcggctgcttgcgttcgtgcatttttcgtacaggaccgcgcgcgccgcgggtttgagaggagcgcgtgcacacgtacgatacgagc

SEQ ID NO: 7100 - DNA, 1049 bp, Zea mays
gggtttgagtgtttacttgtggcacgctatgctggttgaagagaaaaacagatttaccctaggctaatgtttcagaggagtatagacatataacgtgtcgtggtctactgtagataaaagaaaagaaaatttctttgtagtggggataaatttctttggattaccgcgtacattcatcaataactgaaggggtggcagtgaaaagatggccggaaaagaaagctgcacgacgcagggatgcaggcagggcagtcccagcgcagcggacggggcagtacaaaaagccctcccaaatcaatcaaagcaggcgcacgagccaaagcgtaaaggcaaagcaccgttaatttcccgcaaaagggaggggcctatatacaaaaagatcaccactactgtactacggcaccccttcctcccccgctcccccacctccgctcccgaaaccctcgccgccgccgccgccgccgccgacgccgaaatcctcgtcgcggcggcgatcactgctcccctctatgatagcggcgcgtgagggcggcggagcgcggcctgtcgctccccggtccgcgtgcccggggcggctctgagagcccagagctcgtctcggttccctgccaagcgcagccgagcaccgcgccggcgccgcgtggcagttcaggccgtagtctgggcgctgttctgctctgggtctactggagtgcgtttgggattttttcggttcctactacattcgggggcgctggtaagtaatccgagctttcttggatggacttccttattcaaagattgtgctttctcggtcaagaccgattctttctttcttgggcgcgcaagaacgacattgcttcacacaataaggcttctgactgggtgcagtttggtttccatgtgaacccccacatgtcccacgccaggccagtccctgctccaaatcttttctgttttctatctcgctagtgccttcctgtttgttctcttggcaagcctaggaactgatcggtcaatgcaaaatttcacagaaaataaggcgtctctctttcatggggcagccaggg

SEQ ID NO: 7101 - DNA, 1034 bp, Zea mays
gggtttgagtgtttacttgtggcacgctatgctggttgaagagaaaaacagatttaccctaggctaatgtttcagaggagtatagacatataacgtgtcgtggtctactgtagataaaagaaaagaaaatttctttgtagtggggataaatttctttggattaccgcgtacattcatcaataactgaaggggtggcagtgaaaagatggccggaaaagaaagctgcacgacgcagggatgcaggcagggcagtcccagcgcagcggacggggcagtacaaaaagccctcccaaatcaatcaaagcaggcgcacgagccaaagcgtaaaggcaaagcaccgttaatttcccgcaaaagggaggggcctatatacaaaaagatcaccactactgtactacggcaccccttcctcccccgctcccccacctccgctcccgaaaccctcgccgccgccgccgccgccgccgacgccgaaatcctcgtcgcggcggcgatcactgctcccctctatgatagcggcgcgtgagggcggcggagcgcggcctgtcgctccccggtccgcgtgcccggggcggctctgagagcccagagctcgtctcggttccctgccaagcgcagccgagcaccgcgccggcgccgcgtggcagttcaggccgtagtctgggcgctgttctgctctgggtctactggagtgcgtttgggattttttcggttcctactacattcgggggcgctggtaagtaatccgagctttcttggatggacttccttattcaaagattgtgctttctcggtcaagaccgattctttctttcttgggcgcgcaagaacgacattgcttcacacaataaggcttctgactgggtgcagtttggtttccatgtgaacccccacatgtcccacgccaggccagtccctgctccaaatcttttctgttttctatctcgctagtgccttcctgtttgttctcttggcaagcctaggaactgatcggtcaatgcaaaatttcacagaaaataaggcgtctctctttc

SEQ ID NO: 7102 - DNA, 1049 bp, Zea mays; identical to SEQ ID NO: 7100

SEQ ID NO: 7103 - DNA, 111 bp, Zea mays
cctttatcgggttcactttttgtttatatagctggggcccatgcacgaagcatgcgccgcaacacatcattcaaaaagcactgacgggagaagcttgagctagctacgcca

SEQ ID NO: 7104 - DNA, 1500 bp, Zea mays
tctacactttgtatttattgtaaaaacattattatcttgcttggtttgtattacaaatgcaatatggtcaagaaatgctcaattgatttggagagtattgcaattgacaagtgataccaattgatatttgtattgtgtatgctagtggaggatgaaggagacatatagggtagctactgtattttcacaaattctataatacaagtataaagttggtttggtgttctaaattgtttgtgttgtatgtattatagatttaatagattgattgaccctaggtcggtgagagctcagaaggtagcatcctcatcatagagctctagcgttaggactcattgaaccacgacacaagagaagttgcttcaaattcatgaagcgatgaggttgcacgtgagcaggagaagcaacatcaagagtatgatcaacaccatcaagtctaagattggtagcgagataagtatttctccaactatatagcacattaacaaatgatgtttcaggtaagttccattgatcttctattattatttttagcatwtaatatagcgaaggtttttcatctattctattgatagacaatgttacaacaaatggggatatggttattaaagcgataaaacgttaaaatgttatgaaccaactttttaacatttaaacgaacgttgaaacgtcttttcagacttgacatagaagttcaaatatagaataagttcatacataagttgagtacttgagttcacaaatcaaatagcataaaaagaaacaaaggataacaaggaccgaagcagtggttcaaagtgttgttaagacaatatccttttgctcaaaacaatttacgtgaaattcagacatggaagcattttttgaaaaccgtctgtagataaagttactttgcaaatcatatcaaaatactatcattggttattcttttagggcctatttggtagtttatagtaataccatggtttaaaatggtttaaaagtgttggcaccgatttgatatcaaacaataaaaagaaccatctgacggtactatttgcgggagcgcggacggactatgttgtcaaacgggtcctcgtgaatgataatttaagttttagtatactgcttgtactatactagctaaattagagtgttcagccaatggatacatatctaacaagaacaaacaattcatttccttgtaaacgagatggtgaacggtccaccccaaatacgtcgaccttccaatcaactcaattgccgggcaccgtcctataaataacagatatatttatatgggcacaggtagagtcaacacttcaacacgagagttcagacttgagagcagcaatgagtttgaatgaaaaccagcaagctgaataccaaaaccatgcgctcattcatcttcctactagttcccaccataagtctactacgagactcttaatttaattatagagcagcaataaggcacgaccgcaaacatgtataagtgaaggacagtttggatgaacagta

SEQ ID NO: 7105 - DNA, 228 bp, Zea mays
cgtgggccgcccaccggccaccgcccagccgctgccgcagtgccgcccgcctgcctgcctgcctggtgcggtggtgcctgcccacgggaacgggatagctggctgacggacgcattgcggagcggactgggagactacgggtaagataataaaagggccaggcgtggcggggcgcaaccaccgctgtgcctcggagaggaggacagctctcgcgccgcggctgccgcc

SEQ ID NO: 7106 - DNA, 572 bp, Zea mays
cctggattgctccatgatgggacggcatggcgtcgcaagttgtgattcgtccagcaatcaggccgtcctcccctgcacttgatttcgcttccactgggccaacctgacctgacgcgggcaaaagacaagatcgcgcctcgcgggctcgtcggcatccatgtgacggtgcacgatgcaccgcagctaataatctagctgtgccatcgatcgatcacactcaccagctctgcaacaccatcagcacgcactgtagctagttagtgcccttcaatacactgtaactaacccctatgcttaaattaatagctttagctagttagtctatttatttggctttaattcgtaccggtttctattagttctaccgtgtttttatctctataaattataattacagtaatccggacagttccagttatccacgctctagcctgccagctctccttcgtccttccctataaataaagtactcaagcaatcctcgagcctcaggcccaagcaaagcatccagcggagccacaccacaccacccttggtccggcactagcactagctatccagtggagacgaag

SEQ ID NO: 7107 - DNA, 1049 bp, Zea mays
cacctgcacagagttgactaactagtaggcacgataatgattggaagcagccgcagccgcaccggcaccacccgcctttgtcttgttttctttcctccccctagaggcgagcatcggtttcagtttacacgcggttggactgaaagacggatactttgggctttgaaggcgtgctagtttcattcataccggttggaatttgggtacttgttgtcgtcaggcttgctttggtatgggggtagacatcagacatgtggccatgtgatgtgctactgcttcagcctgtcgctgtgctggctagtgctgcgaattaggttcttgttctgcttatctgaatataagttttccatcgatttttttttctcacactaatttgtactatcaagtatcaggaccctttgctttacttgatgctattgttcggtgggtagttcatttatcaataaaaatactgaacaatgattgcctcatcatattcgaaaagtatttgcgtgggtgatgttattgttcggtgggttgctcattcctcaataaaatactcaacaatgattgcctcatcatattcgaggagtgtttgcgtgggtgtcgcctatccaggtgtctatgctgataaatatgttcttgattcttgtttgacgtacgttacttttaatgaaactcagctccacgggtagtatgctgttacttcagcctgttgtagtgttgccccgttatgaacgttctaccttcctttcatactgtatccaagtacctttacttgggacagtcagagctgcctgcataatttcttatctttgtgattcaggtttttggagtacgcttgtttgttgcagtagcttttgcttttccatgtcttaggattttgtaggtttatataggtggcctgcctgccacatcgctctgttttaacacacaaaaaaagtctcatcgattaatatctagtaaagtgtgtgacctgctaatgtttatccatctattgatctttgttattcaggtttctggaggacaattcttcgctgtctagccttcctcaaaagtaaaaagggtaa

SEQ ID NO: 7108 - DNA, 1085 bp, Zea mays
gcgcatgatatatataaaacatgcgtatattgatttttatatagcattgataataagctaataaaaaacaccgcatgattatgtattgaaactatttataggcaaaacagatcaattagtaattgattagaaacagcacaaaagcaactaatccacatcccttatatttccttgcagtattggcaaaacccgccggccactactaatacttaatctacgatattatacttatacactagatactagtaatttagtaaagctactaaaataattatgctattggcctattgccctattactggtttgctacgtcgatcaggattcaggactccacggaacaatggaccagggcaggactgcagcgcagagagccatagaaaattcacatgatgcctgctggagcgccgtcacgccttggtgtgctggaggctggggcctggggcgacgaggcgacgagcaggcaggactgcaggagcagccgacgccggccccggtcggccgtcagaactttggagaacgcaggcgtcgtatcgtattctgtattcagatgttgtatattttctgtttgccttatgggcaattgggccagttacgagaggttggtgggccaggatcctgcgcgccccccttggctccgcccctacctgcgacccaaatagctcaaatcttctattcctgcctgcgtcttggcctacggtttttcagttctcactcactcatttatacgttttttaattcctttgttttacaatgctttgttcaggacttcaggccctcaaagttcttttatcccgcttaagatctggacatctggccatccatctcctgaccccgcacgtgatcccgatcgcgccccctttaccccaaccgtcagttcaggatcggacgaaccgtgaggtggccacgtccaccccaccatacgtctggcgccgtgcacggtgcacgcacctgtcgacgggctcccatcgaactcgaaccctctctacgccgactcgtctcttctcccctaatcctccttccccgatccagtcccgcagcaacgccgagggagagcgaggagagacagatacagatcgcgcgctgag

SEQ ID NO: 7109 - DNA, 1500 bp, Zea mays
ttcatatcttggtttctctttttacgtaagtttgtactgaagcttaaatttgacatgggcctacaagggrccaacatcggatataagggacgtaccagacgcgagtatgtaacaatatacaagcaatctccatctaaaacaatagacggcccaggccgcgtttggatttgttgccagcttgtttcgtcctacctcgctgggccagactatccttgctaggccaggcgagccagattggctagaccatgctaacaaggattatttctttgttgttgacttgttgtgtcagtaaaacaaccaaggtgaagcggctatgaactagcacatccaaattgctctatgcttcgctcaatcaggcaaagcaaggatcaacaagagacacgaacgtcccctatggcaacaattggtctgcactttcgcgcagctactaaagtctgtctgttccaaacagatacagctgcggatgcaccagaacagcacagcacaggtaatagtttctgcaggtattcgtttgcagccgctacaagcgaaagctgcagctgcatgcttgacttggactccacgctagtacagagtcactggacacacactgacacacacatatggactctggagtctggagatagagcatgctgccacgctctatttccgcggtacactgtacccggacaagtacgtcatgcacgaacaaatactggtaccgtacgtagcgcgtccttcgagtttgaataggagtagacgatcacgggctacgtccgcgcatatagacggaggtgtctccgcggcagccgagctagatgtcaacagcgtcctcgtcagatctcgcgcgtcgcgcacggccggggttggctgtatctgtctgtatccccacagaagccgtaggaaaccggttcagatggtcacgcctcctcgcggctctatcagcagtgacctgtcccgtttgggaaacggccggagagcaacgtcacccgcgcagtcggattctctgccggacaaccgaacagaaaaagagagcccgagttttcgtataacaccgccagtatctgtatctatccatctagctgatctgatctcgtgccgcaaaagataagtcgacaacaagcacgtgcggtgtgcggaatgtcgtcagggtcttggagtgcgtagagtatttttgttagccatagcatgcgacgacgcgtaggagagcacacaagatcctcctgctgttcgtaattccctgagtaaagatccaaacgaggaagagacgtccactcgctagagccgatcagtcatcaaaccagctgagcgaaccgcaccagctgcgacaagcaccacccggcacccgcacggccgcacctgggttttctcgacccatctaacccgaaccgtttctaatcactacgtccacgcctgcctggctttcgcatgcaggctttaaggaccgcgtgccgcgttcgacgacgcatcagcagagcgctaaaaggagtctttgcagttgcaggtcgagtgagatatgat

SEQ ID NO: 7110 - DNA, 121 bp, Zea mays
ggtaacaggaacctgaacaaaatggccttgcagtctttttttttactgtgtatatctttttcatgtggagtccattaaaaatccatgcataagcagccgcgagaggtctcagacagataag

SEQ ID NO: 7111 - DNA, 185 bp, Zea mays
agtaagcggaggcgagcttctcttcgctaacgttgtagattttgtggtttgcgtgcggtgaagagaggcaacggcgcctatttatatccgcaagttgcaatacggttggaactttgggcgaaagccgcggatgagtcctaccaaccacggactcttcggtaggcggggtccgaaggccgaagcgg

SEQ ID NO: 7112 - DNA, 497 bp, Zea mays
gtctctaatgctgaaatattattttgcgtccacaggtgaggatagcctaataatcaattcgttgagtacttaagtgcaaaactacaacgaaacatttatttttatttttttcccaaaaagttgcggatgctttcaactaaaaaatttgaattgtgaccttttataccgcgcggaccgtgacagcgtgcaggcagcatattgcagcatctcgctggcctacaggtgggcccaaaggtacctctctctcccgctcttccccgcttgcgactggcggagtccaaactccaaaccaaaccggcgcttctcccacgtcttctcgagttcccacgcgcccgcctgctataaatcgcatccctcaatccccactctttatcccctcctcagccatcgcctccctctcccctcaacccagcgcccccctcccgccgccgctagggtttctcctccctccccgcccacccctaaatcatttccgaagcttccagtgcgccgcagcc

SEQ ID NO: 7113 - DNA, 231 bp, Zea mays
tcttcttctccgcgattatttttccagtcaaagctgtgcagcgattgattcctcgtcacttaccgattgtaccaggccggcggccgattgaattcctcgtcgaggcccccctcggcaataaattggtgcggggatttcctccctgacctaaccggccagccagcaggtcgcggtcgaggttctcttctcggctcgatttcctcccgcggcggagggccggccgggtggagc

SEQ ID NO: 7114 - DNA, 135 bp, Zea mays
ctaagaaagtagagccatcaaagccttctacctatttcctccacaacatctaccccttccacctccttccaccccaatcacaaaccctagagcccgaggacaccagatctgttctcttcttcgcttgtcccaacc

SEQ ID NO: 7115 - DNA, 658 bp, Zea mays
ggtatgctttattacgttatccttgttagatgtatagatatgtgagggttcctttgcatatgcacactcacttgtgacttgtatatcaaattatcaatcaacctttgggcctggtaatagttggttgtcctcattctaacacgacggtatcaaagagctaggtttcgttttcttgccggcggtctcgagcctcggcaccaccacgcgccccgcggcgctcgcgccgcgtgccatgcaccccccgccccggatccttggcgggccatgccgcgcagctggcctctgtggccacgcgtaactgtcctcgccaccatggaggagcaggccgctgcgttgtccttccgcgcggacgacgcgcagctcctgctcgccttcctcggctcggcaccccgacgcccgcacgcgcggcacccgaccgcctgctcgcgcgtttccccgcatttctgcggcttggcacttctttacctttttcttaaaaagagagagaaaaaggaactcctttcatgcgttccccgggcgctctggttctgttggtgtcccgtcattttcagcacaaattagagtgaccaacagttgtgagttcctgttatgttctccccacgacacccatatacctactgaatgctgatggtgatgccaaaagtgttttacttgagga

SEQ ID NO: 7116 - DNA, 1500 bp, Zea mays
gtttcaccagcatcagcaggaggagctactgccccggcatgaacaaacctggcgagaatttgataaaaaaaacatataaatgtggctgtgaaaaccttagcatcagtttgcttagtaaaggtccacactcacatttagtggcattctaaattctatataaataatgttgccacacttaattcaacattttgttccttaaatattactttagtttctacttgttcaatcctttttttgtgctggcaggtcttcaaactggacaataaggagatgctggaacttgtagcagagttaccgaaagggttggcgccacactttcaccagcagctaggaagcaaatacatggtcaagaagtggcattgataactctggatggtttggagcctaaaagatggagtctatattgtgaagctggttctgcaatctgccgtcggagtttaagagttgttatccgacctcttgtgttgttgtctatgtttgtagtagccaaagtgaaggggagcttttgttcaagtttgtttgctgttgtctatgtttaccgaaagaggtccacacgaatccccgcggaagcccacacatccacaggaacataaaaaatacgtttataaaaaaccatatttcctcattatgtgaagcgttgttttataaaacatactcccctgtcctaaaatataagccattttaagattcttggaaagtcaatattttaagtttaactaaatttatacaatgaagtaataatatttaagaattcaaatatataccattagattctctattaaatatattttaatactatatctattctgtgtcataaatctttatgatttttgttattttttatcaaaatttttaaactttgactattcaagaatcttggtgacttatattttggaaaggagagaatatttaataataagaatgtaaaaaaatattttgcaatctacatatgactcaaatattttgtcaaataaatacgtttttgaaaatttctattaatatggtacgaaaaatataatgaataagatataaaagatgaaatttagagaacaatattaaagatgatgaagatataaagaatgagattttttaagtatattgtaataaactgagaatattatttagggttgaaatttagaagatgtcgtcagaatcttaaatatgcaattttttagtttgtgaacctggtgataatcatgcaattgttttacccttttaatctcaagctcgggcacgtgagcgtgccacgtgcgtgccgccaacattccaccccggactggccatcccttttcccgcaactgaaaagaaaatgcaacagaaaaaatgacacgatcgcaggagaaaccaaagaaaagttcctttttctttattttcttcgtcctcttgttctcgactcgctgcccactgcgtcacccgaatcccttcgatccaatctccaaaccctaggcagcccgccatcagattgttaggtcctccttccttaaaccgcggcggccggcc

SEQ ID NO: 7117 - DNA, 1061 bp, Zea mays
ggtggattatatagttatatagatttaatattttaaaatagatatgcatgaaatttgatgttaatcttttcttatgttatcaagcacattatatttttttacaaattgttttatacattatttgcgccctacaacaaaaaagtgtaaaacactagttttacggttccatggccaacgtgctctcccacatttaaatagtaaaaatgataaaattatgtacgaggattcgaaccatgattgttggctgtaaacccacaatctgggtacgatttaagtttattcataaaacgcaaaacaagtatatctttttgttatatattctatataagcataaataaaaaaccatagcaacatatatgtactttgctttttaagaaaatatatgataaaatttaagtttagttttttataattcttcataagttttaatactaaaaacaataatataattttttatagcaggttctatatcatatttatacataatcaaataaaaaataaaaaatcgatattagaatatccgttttcgtccctccacaacgtttaacccaaagtaaccgtcccgtgtttccgtttgcttcgcctggtcaccttccgtggtgcctgtggctgtgtacgcggtcgtctccatccgacccatcaatcatccaaaaactaaaccaaatcttccccatcgatcccaacttccagtcgatctcctcgctcggctgttgcctcccaaagccgtgccttacaacgagattcctcccctcctctctccaataaccctagcctcctccgccgccggcgacgaatccggtaagcgtcctcgcttctgctagatccaccgcctccagatcggtgcggcccgcgactagggagagggtcggtcgcgatccgccgttcctctgccttaggtcatcgcggtcggttagtcggcacccgtggacaagctctccttttccactccagttatttttgggttgtgcttgcaattgctacttgatgagtttctcgaattagcttgtgaatgccgttgttttgcctcgcaggcgttttgagtttctgttgccagcgtagcc

SEQ ID NO: 7118 - DNA, 734 bp, Zea mays
cgccggtggtcgatctcctccatctgctcgccgcggcgcaacccggagaggagaccgcgctcggtcgagcaccacctagggctagcgtcctcgcgacgagctccggcgcggcgtccgccctctgcagccccggtgtccccgcgaccggctccggcgcgaccggcacacagctccacaggtatgtctccgtccgcacagcgtcacgttcttctctctcctccccccgccaacatctcgtccctctcgctccctcttcgcctgcttgattctgctctagcctcagaccggccctcgctctaaaaatgtcattacgcacccaatccgcttgtagctgtatgctgcaatctactctgtcttcttcttccatcaccaacgactgcgccggccgtcgctgctgtcctacttcgccactcgcttcccttcctgctgtgcaaagccgtgcgcccaaaccttaaacctgaacatactattcgtaatcggatctgaatctaattacaggtgtatatgcatgtattatgatttatgcctactaacttctattgctttgcaaaaaaaaatactgggtgtacatgtgtacactatacatccatgctctttactgagtccgcccctggtctgatcgattcttgcttgacgccgcctggtccatggatgaaccgtgtcacctacaattgattctgggatccggcttctgatttttccgtgtgagttttcaggccaacgggacctgattc

SEQ ID NO: 7119 - DNA, 477 bp, Zea mays
catgtagtattttaatgtccgacagtttaggccttattttcgacgactttggctatcggaaattttatatttcagtgttgtgttgcattccaatcctaagagcacgatttcagattttggaaatcacttttattctctagcttcatcataccaaggttagcaactgctgcttgtattgcttgcagacgtgacatcgcctcaatctccagtgcaacttcaacagcatccatttggtctgtaacagcaaaacccaaatcaacgtctccgcatgcatgcatgcatgcgggcagccctctgtttaagacgtgcgtcaaggtcctcaaggatatataagatggtgggtccggttcgttcgttcgttctcgttgcctggcgcggctataaaatggcagctgcggagctgccatctttgcacgaagacacacacagcagcagcagctgagcagataagtcttctcgttcccatcatctctcgcc

SEQ ID NO: 7120 - DNA, 1500 bp, Zea mays
ttgggtctcacctaacctaagtcacaatcagttgaaacaaacctgatacattgcatcacatcgttttctcctctgttgcggtgaacatgccataaaagacgcgggcggtggcacaccgtttgccatcccgccgttcgtcgacatcaagtcctccgtggcctcactcgccttctattgccatgaacaggccatgagtatgcaggtggcggtgcgctgtttgccatcccgtcgtgcgtcgacatcaagtcctccgtggcctcgctcaccttcctcacgctggtcgtggcattctggcagctccagccctatggctccttgctcaccgtgtctcgcacctcctcgtccccttgcaccctcttcaccacaaccgccgccatggaccttacttctcctcacaccaccggtggcactgccacaaatacgaaccaaccaccaccggtgtcacacccggattttagggacaccaaaacaggggcgtgaaatataatcaccaagtgtgctaggatcaagtcttacacatatgaggactcatggtacataaacaaatgtcacaacattaatatataacggagttctgtacaaaataataataattacatcatacgaagtcaataatccagcaactaaggttgactgggagacgacggcctagacctctcacgaatacatcacaacatccttcatgtgccttatccggtggtacctattcttgacctgggggaatgtgagtacaacaagagtgagctcacatacgttcatcgctcaacaagttgtggggaataatgtgcattgttgggggccttcggcttccgaaggtcctcaaaaacatgatttaacagtgtttctagagtataatgtgtgaacaggtatcttcggactcgtatcagagagggagaagctcaaaagatacgaaagttgacacagcgccgaagctgtgaagcaggaaagcttcggcatgttcacaaaaaagggaaccgacttgaagatgaaaaggccatttagacctcgatagattactatagaattaccaccaaatgtaaagggcatgtatgtaattttgtatgggttgtaccccgtgcctataaaataggtgaacagtacccccgtactgttcacgctgatttggtgttcatttttgcgtcacgcttgtactttcatttccttcaaawtggaggtacatctgtaattcaatgttatttttatttatatataataatgatatatgatgatctacgtaattctttatgtttcttgtaattcattcttcgtcaatatgtaatgcatttaaaaaggttcgccctttgtgaccttcgtccgaaaatcattatatcccaagggaaataatgcttcgtaggacgaaggacttaaccgattaacattttctatgttgccttgttcttgaagcatttgagaacaagtccccaacattggcgcccacctccggtgaactcacttccactctttgaagttttttatcttcggcgatcataaaccttcgtt

SEQ ID NO: 7121 - DNA, 1134 bp, Zea mays
ggtgaagccgtggaaggagacttccaggagtttcaagactacgatgaattctaggtgtgggttggcggcaacccccagatagctgcctgtgaaggccttatctttactgcgtttcgctagtactttgatttacctgttaagacaatgtctatgtggatgtctatgactctgtgatgtaatcagttaatactcttttatgttattattcgagcattgtgtgatgatgttcatttatgtaatcgctgtgtacgtgagttctgatcctggcacgtacatagttcgcattcggtttgccttccaaaaccgggtgtgacataagtggtatcaaagcccatgctgactgtaggaccgctgacctagagtagcactggtcgtactaaggactattgaccttccctctcaccttgacctctgatgttacttcaaaagtcggtcacctcgaccaaccctatgttttactacatatatatatactatattataccttgtcaaaattttattttgttctatctatggtttactcacttgccatattagttctgttcttactcttatgcttacggtgtcttttgtagatggctcgtcttagacacactgcacataagtcggtgattcctttcctgccgtctcgacttgcggagcatcctctgcgccgcaccgtgtccggtcagtcgagtcacctggagagactgcaccaccgcctgcgtgaggagcaggaacgccggcgccagcacagagagcagcagggctcttcctccccaccccagcgagaggtggagtccgtgaggccccgttcctctgttgcccagctggaggcgccccctgcaccaccgcgggacgccccggctgttggaggagctactggtggagatcatggaggagaccccgacgacgacgactcagaccacagcacggagtcctctgagccgcaggaggcggaaggatgggtcgcccgacccatcacccgtgacgccgctcgcggttgtcacttccacgacgcactcgacaccttgctgcgccaggctttcgaccggcacacctggtcgatcgagtaccgttgtgtagtctaccagcacagtcgcgagaagtacccggaccgctgggaggctacctgcctagttcgccgtccggagg

SEQ ID NO: 7122 - DNA, 393 bp, Zea mays
tgtagcacgatacacgcaacatagccggcaatttctagaaagattataagaaaacgcttgacgaggttcggtgcatctaacatgtacaatagtcaccttaggtgtagagtttggcagggcagttcagctatatctgccatctttctccatcagattcgtctgggcaaaccgatcagctactattatccaccattacgtataataataataataacataaacctccctgtttcttcctggtccttgctgtatgtaacacgcagccaccaattcatttccccttccaagtcattctaagccatcccagaagaagaatacatatggttccatgcatatatagccttttattggcacaacaaagtgcagttgcattgcatgactaccatcgtcggtg

SEQ ID NO: 7123 - DNA, 1055 bp, Zea mays
ggggggggggctgggccgaaatgggaaagagagggagggagagaaaaagaaaaaggttttctttttctaaaatctaattttctcgggatgaatgctttcacattttaaacacccaaaaaatatgcatggttcggcatgatgcttcacacaaaataaagtaatttaggttttttctttacacgggaaatccaagccaaaccccgctataactttggaaaaatatcaaggtttagcgagggaacgagaaaagaaaaggggtaacgcctgaatttggtgagagacaagaagaaaaaattctacccccaaattcagggcgttacaaccagaaaaggaaggagatcggcaccggaccgtctacagtgattgtccggtgcgccactcgatagaaggcaaggatagccttccttgttgatcttcaacgactcctagctgtcttggggctataaaagggacccctaggcgcatgtaggagtaccccaagcattcactaagcattctaaggcatccagaccctgcactcgtgcattcgctttgttgtgttagagatttgagctccattcgagtcgagaactccctgtgtgtcatttgagcttgagtcttcacttgtgtgcgttgctcttcccaaccttactcttgtgcgttctttgtgatcaatcttgtaagggcgagaggctccaacttgtgaagattcctcgcaaacaggaaaaggatacaaggaagaaaagccatggtattcaagttgatcattggatcacttgaaaggggttgagtgcaaccctcgtccattgggacgccacaacgtggaagtaggcaagtgttacttggccgaaccacaacataaaatcgcgtgtctcttgtgattgctctctctttgattgtctgtgttcgcaagagctcgtctcattgacttgattaacccgcactaatatctttataatcaaggttgttggaatttagtgttgaattttacaggatcacctattcaccccccctctaggtgctctcattggtatcagagtttttctcttcatctaagggactaatcgcccgaagag

SEQ ID NO: 7124 - DNA, 60 bp, Zea mays
ggttaacagtgttccattatttgagatgagtttgattattacttattacatgaaatcctg

SEQ ID NO: 7125 - DNA, 646 bp, Zea mays
taaaagaaacggaggaagtactaatttttaagtagttacgtatataaaaacagtgattgattcagttatttcttcgtttgtgcgtctgataaaaatatatagtatatgaagttaaatttaaactgaaatcagacactcatatactatatataatctattaaatattgtttatgatctcttttataaaaaaaaaatcctggctacgcacctaacggcaggttttatcacgtttcgtcacgatcgaaagccgtcagcgtggtcgtgtcatcgtgtgcaaagcgtctgcacacgagccgacaaagacctgctctccaatccaatgcacttctttgcgcagccagcagcgtcgttctacgacagccttgacaaatcccgccgtcacctttccttccttccttccttccttccttcctctctgcttttctatataaacgatcggcgtgcctaactgcagggtgccgcccagtgccattacacattgctgctacgaggacgtaacaaagcgcacggcgcgttctaccagaagacgcgagcgcgcgcctcaccatatatatacatggtgaaggcgaaggttttgtggggaaagcaagcggcaacgacgacgagcaagggctcctcgccggtgcgcgccggcgacggggcgacg

SEQ ID NO: 7126 - DNA, 622 bp, Zea mays
tgaccgctacgcggtggcaaggaattcctgctgccaatattgctttaccaggaagtttcctttcttcttcagtcttattcctcccttctcgaatattatatttatcttctgttagtattattttgactgctttgtgcacgcctaacgacctggcttttattttcctagtcaagtcactataagactttttaatttcggataaggcttgtgattgccgtgtttcaactgaaagataacctttttttttcttactctttcggactttcggttgcgtgaaagacccatgcgaaccaaaaaagagaagacacaaaagaagaaagactcaagtcagtggcatcacaatcatgaagtgtgattctcttgctcaaatagctgttacgtggaaggtgcatacgaaccaaaagacagacaaaagaagatagactaccaagtcagtggcatcacaatcatgtagggccaattgaagtgcgattttctttctcaaaaacagtcatgtgcgattttctttctcaaaaacagtgaagatgctcaggctgtatgcgactctgggtgactcttgtcttccacacatcgccacgccactgattggctcgcgattatgtgattcgtgaaccttcttgcc

SEQ ID NO: 7127 - DNA, 602 bp, Zea mays
cgagtaacaaacgaaatccgtccaaaaaaaacccccccgccgatttcaatttgaaactgtaaatcgttcgaaaacaacgaaattcgagcggttttcgctgtttttcggttgtcggtcgctgccgagaaacgataccaaggttaaccctgctccatasgcacgcacgcccactccccctgcttctgaggaccccgggatccgcccgctccccgccgccgacgcgccgcagcagccattttcacctgctcgtcacctttcctgttaccggcgcggcgcgagaggaagaggaaggctgcgtcgtttggtgccgtgtcggggtccgccaatccggagattcggctgcgaaaggaaggtgataaggcggagtgcccgagaattggcaataactgctggattgctgctggaggcgctcagttccgcgttcggttgcccgatttcgtgccgattcggagctctcattgggcgctcgagcgtgcgtttatatatagcgcattggtggtggcctctcgccgtccgtggcccgtgggccgtgggtgtgggtggagaacttgtcgccgtgctgatgatgcattgagtggcggcgaggcgataccccctccctg

SEQ ID NO: 7128 - DNA, 1500 bp, Zea mays
ggtcaaaccataatcacaaacagcctgattggatggccgcacgtccatgcgtaggctggcaccgtcctggccaaccagatacgacaattttgaccgtatgggtagatgcagtttaatagtatcaaaatgacttattctgcattcactcatgcatgctgtaacttttccatacaaacaatcaaacataatttcaaataaaatcaacacatgtggtgatccaaaataacgcgagtaaccaatcaggctgaaagttttcgaatcgatggtatcaagaaacggagtagcaggtaagacatgggcgccggaagacacgggctcttggtgccagagtatcggatagaccagtctgcagctgtagcagaacactgctgaatctgatatacagtgtgaggtatttaacagtcaaatcttttcactgcacgattatttctctgtgttcagcaactgattatagtatatttttcccccgaaagaagctgatgcttttatcatcatgcatagtggctatgtcttaatatttgacgcaagaggaattttttatagggaacagtgtttaattaatgataatttcctcatttggctatagactgaagtgaagtgaactgtacccaaacacgccggtcctgttagaaatttagaatacacggtgcctgcctgggtccaaatgcatatcgattcgattgtaatcgtgagtggtgactggatttcgtgtgggccatgggtttaattaatcaccttctcctgctgaattctatgtagtagacacatgaaaagagagtttgtccgcaacctcatctaccagtaactgtagagccactgttgtttgttcatgtgcatatattaaatacataatgtggggcgaaaccaattaacacgcatatatattttggtaggtcaagtaacatggcttgggtggttccttctgacagtcctggcctccaaaccggctttctcactggcatttcttcgtatcccgttgatcagaggctctcccacttgcagcgctacgcaacacaacagtgacgcgagctcgttggtatgggtacggcctctccctctctcttctctctcctctctgtctctaacatattcacagtctatctttcactaaagaatatcctacatatgaatctacaatttgggccacctggtactttgtccctatgggtcagggacttgagctggaatttacagtctagtggtgccacgggaagctcgcttcaccgatcttgcctgctacttggggttctcctatgcaactagagctagtagcactatttaacaccccaccacctgcccatttcttctcccgtgcacttggtcttcctcctccagtagcttctctccactccagtccttgactaccatttcatcatcatctgtgtatctcaaacttgcttgcattgcttgccctcactcctaccatccaagtttctttctcggtctctggcaagacttcgttcaccaatatctccggcccagacagccacaccaaccgag

SEQ ID NO: 7129 - DNA, 648 bp, Zea mays
taaaaaaaatacccacctatcatcagttataaagatactagtttaatttttttcttctatttcatctttgatatattcccagcctgtaaaccctttctcatcccatacagtgtttctggcgtgtggcggtgctcgtttcctctcatgtgtttggcttacggagttgctttttcacagtccacagttcaaacatgtcctaaagtagaccgtgtcatgtaaacacttactaagcttaaaaaaagtggaagtcgtatccacaattcaatcaaacatgttctgaaagtagatgtaaacacgcactaagctcaaaaaaagtggaagccgtgtcccgtgtccatgtattgtttcacaaagatatactgagacgaaatacccagatgagactgaaaaatgatcgaccacgtcacctcgaaccttccacgcacacgctagcagtagcagccagcggctctccggcccccaacaaccgcgcgagcgcgacgacctactcctctctccgtgctgccattacatatagcgcagctgcaggctgcagctccgaccaagcaaaccttcatctatcgagtcgcccgtcaccacagctgatattgaggcgacgcgccggccgtccagatcaaccaaaaaagaaaaaaagaaaaaacagtagcc

SEQ ID NO: 7130 - DNA, 652 bp, Zea mays
cttagaaattagtacttggctgtttgcttttggtttagcctttttctgacagggaactggtctgggtactactcgccaaaggaccatatatcataattggaaaggagcaaggcaagctgtagggaagatcactgcacaattatttttatattatcgttcctataaggttttgagaatctgtggttaagttgtattgtaaagctagttagtagcaaaattgtttataaggctatttgagctcttatatcttcatacacatttaatttttcgcagcttgtgaacattgggaagcccaattaaatatttgaatctgcatagagtattggaaatagtcaatagtggtgaacttttgaatgattcagttttgagactctggttggagcatgtgtagctactatttagtggggtgcatgtgacatcaaatttcgattgttgacctcatatatgttactggatttcaaaatttgttcttccattttcaatctgactaactacttcgtcgaagtttttctcatattttttgtgccattattagataccatgatgataatagatcctgactttattttttgtactacaggtagcacaagagtattctgaatgcccatcagggaagaaaggtggagatcttggttggttcccgcgtggcaag

SEQ ID NO: 7131 - DNA, 1500 bp, Zea mays
ctgtgtcaactttcgtatcttttgagcttctccctctctgatacgagtccgaagatacctgttcacacattatactctagaaacactgttaaatcatgtttttgaggaccttcggaagccgaaggcccccaacaatgcacattattccccacaacttgttgagcgatgaacgtatgtgagctcactcttgttgtactcacattcccccaggtcaagaataggtaccaccggataaggcacatgaaggatgttgtgatgtattcgtgagaggtctaggccgtcgtctcccagtcaaccttagttgctggattattgacttcgtatgatgtaattattattattttgtacagaactccgttatatattaatgttgtgacatttgtttatgtaccatgagtcctcatatgtgtaagacttgatcctagcacacttggtgattatatttcacgcccctgttttggtgtccctaaaatccgggtgtgacaccggtggtggttggttcgtatttgtggcagtgccaccggtggtgtgaggagaagtaaggtccatggcggcggttgtggtgaagagggtgcaaggggacgaggaggtgcgagacacggtgagcaaggagccatagggctggagctgccagaatgccacgaccagcgtgaggaaggtgagcgaggccacggaggacttgatgtcgacgcacgacgggatggcaaacagcgcaccgccacctgcatactcatggcctgttcatggcaatagaaggcgagtgaggccacggaggacttgatgtcgacgaacggcgggatggcaaacggtgtgccaccgcccgcgtcttttatggcatgttcaccgcaacagaggagaaaacgatgtgatgcaatgtatcaggtttgtttcaactgattgtgacttaggttaggtgagacccaaacagtgaatatgactttaatagacacattttaaaagtttataggccagattgacacacccgcataagttaagggaacataaatgcactttactcatcaattaaactaatataattttatatagaatatatttatatattgttgttggtcttataagttgatatttatatgctatatttatgttgaagagcgtgttacgagttacagaatagaaatatggactagtgacacataaaatcaatttccacaccttatcctataaatttaggataggtttatatcttaacttaggaaagtggtcaaaaccaaataactttattaagtaaattctaattcctttaaaatgaaggaaccaaccagcccttaaaaaattgacgtggactgggagggagtaggttttagcaaaaagctagaaacctctccaaactttgcagtaccctataaatggagcgaagcaacacaacactggcgttaaggccctcacgcacggtgtcctctattattgcttggacgttgttgcccccgtgtacccaaagcctccatggctcatgtccccttgaagttgaagaagcgcggc

SEQ ID NO: 7132 - DNA, 557 bp, Zea mays
tgcagaggaggctgctatcgattcggttccatgggtccacgtccatgtccatcctgggccgttgggccacatgcagatcccaaagcaggccccgctcgccacagctggagcacaccgtcaccggccccggctccggaatcagatgctccgaccgactacgagcaacagcaaaaaggaaaacgggatcgccctaaccatctctgcgtggtgggcccaaccttagccactccactgtccactcctagcaaggaaggaacatgatacccgcgccccaccccgcagtgtgatagcacgatagggacactcacgcctcgcctgcccccgtcgcgagctccacccgcttcgcttccctgacacgcaggcctcgcaagcaaccgccctactggagcccactcgccagggaaggccgctgaaaatacgggggaagaaacacgaaaaaggcaaggaattagaacggccgaagcggcacacaattcgcgcagcagcgtagaaactagaaagtccagtccccaaactccccagcgggggcgagcagaggaggaagagtagccgccgcc

SEQ ID NO: 7133 - DNA, 278 bp, Zea mays
aggccacgcttctgtatgtgcctaccgccaagacaccttgagctacacatatggtttgttattatcttgaaagcgtaattgtgccaatactataatcttaatatgcttgcttgatctatattttttctgccatcaagaatgaggcaattggataaggatatttgttagctttctgagtattgtctgagtctttaagcatagtagtaaaatttttggcacaccattgttttagttattatgatctgaacaacccgttttatatagggagctcgtggcaa

SEQ ID NO: 7134 - DNA, 204 bp, Zea mays
ggttactgtcgcgagatttgtaactgaacagtgttaggttgttcaagaacgtaaacttctggaaattgttttttgaaagcgaactgctgcgtactccgtgctaatttcatgcaaaaataccatgtgccatgtcataaatttctgcaccttcgaccatctgacaaaaggaagcatttccgcaaatgtgctttctagctcaaggac

SEQ ID NO: 7135 - DNA, 363 bp, Zea mays
tgcagatacaaaatcatcaaagcaagtgttggaagaaaccatacagtggttgtaactgatgatggcaaatccttatctttcggtcataacaagcatgggcagttagggacgggttccttaaggaatggttggtacctttcacttcttattgcctgtgagtagtcacagaggtgccagcacacatcattttggtgctaagtgctaacatattgttacgtttttcaagtttaaacaatcatgatacactctgcaaagtgcaaacattttgatattttaatagtttcttttttccccttatgctggatgaaaccgctagtattttgatgtagcatctgatgtgaacttgaagttatctttgattac

SEQ ID NO: 7136 - DNA, 1500 bp, Zea mays
gtggttcccatcagaaaacgcactgtaaccacgctcgatcggctcctaaagtactactagtaggaggattggacgccgcttgattatttgttaggactatcctgaagtactacggctacgtagcatttgttaggactcgttatcaaaccagtgatttaaaattatatatagcaagttaagcctagttttatttataaaaaacagtagtaacacatgtgaattttttggactagatatattgattaagagatacagttaccaaaaagtgtatataacattatacagtttggtctaactcacaatagtttgagccaaacgccttttaggttttttacattttgagctcacatctaaaccaaacgcattctaagtattatcttctagacttgtttggatactaaagtataattaagcttttttattttcgacgaaagtataattaagctaaagctaaacattagttaagagtagtcataatatatctaagcaaaggagttaattggtagactattttcatattagtcaagtctctaattagttgatatagccactgacatataattttcgaactaattttcaactccaactagttagctgctactactagcgttctagcgttaggctgatcaaatataacatgtattaactgtctaccaaaatcgctacggagaattttacttattatccagcattctaaaaatactggctctatgaagccacgttgaatcggacacttatccagcactagggcacggtgctgtgcacagcgcgcggcctccgcgcgcctgctctccgctgttttaaattcctgccaccgtgcagacacgcgggccccactgaatcggacgctcgatcgctcggcgcagcacacgcatgctgtgctgcctgcctgcctgcctgcttgcagccggcgtatgtatatatgccgcccggcacccagcgtcatcattcatcaacgcagcgcggcgcctaccgctcaaactccctatgcttcctccccctctctagcggagctgcaggagcaccacccctccaagtcggcgtctagaatccattggacgctcaagtacgggaagctagtctaagaggtgagcgagctgttcctccttccctcccttccccagtcggggatgcccatttgatcgattcgggcgtgttgtttgatcgactcgctgatcaattggggcgcgggttcgtgttgtttgatactttgacatcgggatcagttctacatgaaacagaacaattgcagatccaacacattggctactgcctgattgattgctatcgtgctgctctcctgttttttttttcctgtaagagttcagttcgtgttccgttattatgagcattatgtttcggagacgattttactctgcattgtgcagtcccattcgttccaggggtttcgttgctctgattttccttggattttcccgtaacgttttgatccgattcggtttacaggggaaggtaccaggtggtttgcgcgggggcgcc

SEQ ID NO: 7137 - DNA, 488 bp, Zea mays
aaactccaaccagattcctccctcctagtcctagctgatcgctttagctttacacgctgccattccgtcaaggcatcagcgagacgacagtgactcatttatttgcctcctcaaatcatcactgctctcctagcaaaaggcatggatgattccttttcccccctgctgcacctctattcttctaatccacgggttaatgagtgcacttaaccactactctgggtgtgggggtggtggcaggggtaccggccacgcgtgcgcttatccggtgccacgccacagtccagcttctcacgcccaaaacgtgcgcgacacacacagaatggcatcgccctccactcggcccggccccgctccaaatctataaaaggcggccgtcggcctccagttctgtgccaagatccagcaaccagagttctccaaagcgcgaagctccagctccatctccaggcagccgtcaccgtcaccgtcagggaacgcgcgcagca

SEQ ID NO: 7138 - DNA, 1208 bp, Zea mays
gaggaaactggtgtctgatcagacagagttgggagggagaaagaaccaacagccatgcatgacgcatctacagtacatggctcgattattggatcccaaagcgatagcaccggccgggcaagcataataaaaaaacaagggtacccttgctgccctcacctttccagctctctttagccggatagtagttctctctcatcgcctttatatatatatatatatatatatatatatatatatatatatatatatatatatatatatataattcagatcacaaggctgtaacactgatccgggggagatccggaaagcatgcgcgttttaagatcgagcacggtcgttattgaacaatgacctattgctgctgtcgcctctgctgatctgtattaataaggctacgagttctgacctaaccggcatgctttcagtggaagccattagtttccaagaaagaagaaaaaaaaaaagctaggtatgtatggaattcagaaaagactgtgtcggcggtgcgcatacgcccaacagtacagtacagtagtgcacaagacaagacgagacaaagatgcctgctgttgcagggttggctgctatggcggcggcctaacctaaaactatcagtcaccctagagtctcagacaagccgtcggcgtccggcgttcctggtagtcccaagtcccaacgagatccaggactcgattggtgatgagtactgaagcacacttgccagtgagagaaacgacttgcagtggatcgtattgtgttgtcgctctctctaatttcttttgggaaaaggaacaggaacaggggtgcacacatcaacaggtgagaagagattggatgaacgatgggccatgcatggcaagtggtgtgatagaatacagatacatatatatggctatatgcatggggcagagaggagcccagggccagacagacaggcaagaaagagaggagatagataagcaacttgatatagatagatagataggtatccactaactccagacaaagttctttacctccagattcctcacaaataaaggccctcaattattaccctccaaagaaagcaaaaaaaaatccaatgctcctcctacctcgtcctcctttataaagcaaattgcaaactgcttctgatgcaccatcccagcaagagcaagcttcaacctttgcatgcagagacctagtggaatagagcgagggga

SEQ ID NO: 7139 - DNA, 148 bp, Zea mays
atggggggatgtgcccgtgcatggtcagttcatctgctgaataaatctggtctggagatatgatcaggttcagctcactgtcaggtgaaaacccatagagttttggacatattgagtcgcttagaattgttttgatggtactgcaatt

SEQ ID NO: 7140 - DNA, 367 bp, Zea mays
taatcttttctaaaaaaacacacgataatagacggtgggtactcgggacagaccgaatttgtaccgaccgacggattcatcgataccagctaatatcgatgctaacacggtcggactggtcaatctatagacccactcaacgtgaccggctgaatcaatcattattgaaatccatgtggtcggtagtgatacgtcagcggtcagtatcctttaccgttggatcctggctgaggtgaggtcgatatgcctggcagatgcgcgtggcagccgaggctgtgaaccaagcagctcccttctcctgatcttctctcacaagttctgaccacttgtacactaagctgatcctctttctcaccgcactgcacac

SEQ ID NO: 7141 - DNA, 1500 bp, Zea mays
tagtgttcctagtttagcaccactgctagctagacatccaagatggtaacgtcatcggcgatagcctaaggcaggcacggaggcagttcggtttcatggcagtcggttggtgctagttatctcctgcaaccctcaccggttttgctatagctgataaatggtcaggagagaagcctggcatttgccgatgccagggcgtattgtctgaactctgaagaacactgctgtctgctgggccattggtctcacgtacacccgctgcacgaagaatctgcggctcgctgtcacggattcttggatccattcggcattagtcgtagttgatcttcttgaagtcctagttgatcttcttgcaaggatgcaaacgctgacgtagcggctggattcgtacctcaattccgggaacgacgacgtagcagcggagccgacgagacgttgttgcggccgcggagagctcgcctgtccctgttgactccacgtccacggattcgggccacaattccccttcgaattcccatgatggccgatgctgattcctgagtaaggtgcgcggcagctctggtgtggtcgtttcgttcctttcggtcagtccccgttccgcgggggccgggcttgggttcgggttcccagattccacctgcatgaaggacgccgctaggaatagtactacatcgctgctactagtggaagggcacctgaagcacaaggggaatttaggagctggacggcctgctgaatcggattcagatgccctgcgcccacatgtgccggagcataccttccagccttccaggtgccaagcctcggaagatttgattctctatttctcttccaggtcccccccaaccccagataaaaatatccagattatctgtatttgtatttgtttttaatatagatactaaagtatccaaatttatttttcagtttctatttacgattctaagaacagtatttgacaaaaatatagaatatctgacattagtaaggccccgtttcaatctcacgggataaaatttagcttcctgctaaactttagctatatgaattgaagtgctaaagtttagtttcaattaccaccattagctctcctgtttagattacaaatggctaaaagtagctaaaaaaaactgctaaagtttatctcgcgagattggaacagggcctaagctacaaccacagcagtggacaaccaaacataagcagtgcattcgtaccgcttcaagcctttaatgattatgattgaatgttcgtttaataatcatgattctatatttgtatgtcaatgtcatttttaacatctatgataatgatgtttcgtcatacacattttttatatgctactatatattggaggtttacgttcatttcggctcgggtattagtcaatttttggatcagccactgtctagaaaaggtaaaataaaagcataatgaccagtgttaggaaatcttagtctctcttttttttcctgtactgagaaataaaaactacgtagt

SEQ ID NO: 7142 - DNA, 994 bp, Zea mays
ttactagttgataacttgtggttgtgttgttgctcttgtatagttgatttgcttagcttgtgtagcttaataattgtagcttagtagttctactctagtataaccaattgaatagtagtaatacttttgctcattagaatgtgtaagatctttaaacttttccatatcaaataataaatttatattgcactggaccaatgggttgggataccagtaaatatttcatgaactatctaaattaaaattaaattagtgtgtttactatccgttccactttataatttatttgactttttatcccaaatttgtcccactcgttttattcaaaatttttcataattatagttaacttttattgtaatatcgtttaacatataatatactttatatatgactttgatttttttcgcaaaaaaataataaaacgagcctgttaaacttagtaaaaaagtcgaacgaattataaattaagacggagatcatttcaagtctagcttcagatatttggtatcgggtcttttactcacctctatatacaagcaatatagccaactaacagagatagctttgtacaactaatcatgcaggtttagcaaaacaacaaacatatatgagttgttgagtggctattttatttggtatacatgggacaataatggtaggctccgattctccctccgaacggcgacagcgcctgctccgccagaacgcaacgtggcgcgcagcagctaagcgccccgcgcacccgtttcctgctgcacccatgtcggccagctgtgtttcctactactctcgaaagcaagaaaaaaccccataaacactgtacgagatcactgaccataatcattagcaatttagcattagcctcagctggcgtaccgtcgagtccattcccacctttctaccccttccagaaacctccaggatccgactccaatcgaatcgccaaagcagacaggggcgctcgcgggggcgccgagctcgacggggcgag

SEQ ID NO: 7143 - DNA, 256 bp, Zea mays
agcggtgattgaaattacattttagtttctccgcccttgctgtttaaagctcttcaactcattggcatcatggggaactgtcgtgagacatcaatggtcagagtctgaccataaccacatatatagttttaacaatgtctcaagttttgtgttattacctgttgtctgctgtctgccatatgtaatagtttcctttcacaagtcaaaagcacttccttcccattttctttgaagtacttgttggcttgtattctac

SEQ ID NO: 7144 - DNA, 112 bp, Zea mays
ttagtttcttattatgcccatccttttatttttgactatgaagcaggctttctggaatcacatttcttaagaactatctgttggagagctaaactaggctcttgttcatatt

SEQ ID NO: 7145 - DNA, 1500 bp, Zea mays
atccgaggatgaggaagccagtggagttcaggcctgcaaatctgcaaccaaatactactccctatccctagtattcagaatgcagaaagcctgcgccgcagctgctgcaggctgccggtgccggcacaagaacttttctttctgcttttcctgatgggtactgtcactgtgcgtgcctgcagtgatgccggctggttgcttgtgtctgtaatgtaaagccgctgctgctctgattaacgggtagcaaaggcaaatcaataggagagcgagctctgtgatgactcgaccagccagcgcccatctgggagtcgagcaagagacaccgtacccatcgtgaaccagatggtgcactgttgctgtattattagtgtggtcgtgaccctccaaacgcgacatgtcaacagtgagcggacgctggccttgtcgaaaagctaagctgggacgctggagcgtggagccacagcacagcagcagtactgcctgtcttcattctgggcttctgtccatgtcccctccacgcctcccgtatctgccaccgtttccattgccgccggtgacgagtcttcggcccatgggcttgaccagagtttgctcgcccggagaagcaacacgggctttcctcctgcctgccacagactgccgagcccataccacccaccgccgactagtgccaggaaaatggctgttttcttttttcatcgtaggaccataaacattggttcagcggccaatggtcgtggactagtccgacgatggaagttcctctctgagtgtttttgtgtagcgtcggacgattaaaaaaacttcgaatgaaagagtagtgtggtcttttctttcgttttgtccattacttagagctgttttctcaaacaggataccaaatcagctccagctccaccggtggagctgtttgtgtaaagtgaagccatgctacacgggagagctctgtctcccctccctcatggccacgccactttgaaagctcctgctcctgctcctggaaagcagcctgcctgcacccgtgaaccgccaccgccggaatgaagcctctacagcgaccgagcatatataatatactcgtgtcgtgtatcttcaactccagctagcggctaagaataaacggggctaaattataggaacctcgctccatcaacatcgcctcggcaccaagccaatggctacttatagcatctcccctttctctctcgtcccctccttggtccctcggcacgcgccggccgcctccgcccatcgccgtgctgccatgccatcactgccgagaagacgatcttgcaaggacgccatcgcataaaaggagatcagcaggaggtggagccaaccgacgacggatcggtccctgcgacggaatagaccgagacctagcattggccgcgcgccggagtgggctgcactgcagtgcaggtgggtctcgcatcgcacgcgaggaggatgtaggctgtcgacgcccgggagaaaaggtgaaggtggagcgggtgggca

SEQ ID NO: 7146 - DNA, 1500 bp, Zea mays
aacacgtgaaggttgatgacgatgatcttgtcatgactttgataccaggtaatagtgcataggcgcttggaagaactgatgacaaccttaactcgggtgtacacatgttacctgtcatatctgcatgcgttgcatattaatttgttatatgaataataacttcttacggctgagtacatatatagaaactggctctaagagcttaagataattataatatgcgtctaaagtagattttagtctatctgagaacaaaaacatctagagtatttaaaatatcctattacaattttgtatatcataaatattccttaacacgtgctgcatccttgggtgtgtccaaatcgagctcatgagcctagcctgagttcctgacggctgcagtgcacaaggcaataacccacacgtcattcttagataaacaatactatatgtatgtgcgaatcaactaaataaatttctctacagagactattaagatggaatcaacgaaacattatttttccttttttttaagtcactgtatccagtcaacctgtttgtactcatcgaggatatataattcaggtctgctatacgaaatttcattcatgtaacggaacacaccctaacaccgtgcgtaaaagcggtaagccataacacaattcaagagatgtgatgattagacgcctgactacggaattaggtttctgctagcactcatgtattctttcaggttaaaagcaaaggcagtttcgagagtaaacaactgatataagcttcaaagtggagttgcgcaactcccccccccccgcccgcgccaactttttaaagttcattcagtttctgcttcgcgtagcctcgtcgtgccaggaaagcgacgaatgctgcctggaaaggcgaagcactcgctcactgtccaccagtcgcgcgcgcgcactcaccactctctccggtcttaggcacacggaggactacaaggttccacggcgcagggcgtcgtcccgggcgcgggggggcgttcgtacgtgggcgtgggccacctccgcccgatgtgcggatccacgcatcccgcaaaggcgcggaaaggagtggcgcgcagcgacacgccaaagcacgcgccgggacggggcgagcgcgcggcgcacccgccgcaccacccgaggcgtgcgcccgatccccatccggcggtgcgcgatcgccccgaccgaacgcggagacacggagccgccccccgcaccccaggagcctggagctgctgagaggactttaccgcctcgctaacccacgtacgctgagagccggtatcctcaccaccacgcctagctaaccggacccgaccccttggttagctcgtggtcgtgggtcacccgagaccccagcccttggttgcctgcgcggctgcgctgcgctttatatactaggcctccgctccgggtggccattggccgggctccagtgctgggcgttgtatgagaggtgagcctcccggtggagcgtgggtggtgctgggtgccgggg

SEQ ID NO: 7147 - DNA, 110 bp, Zea mays
tcagtgaacgggcacgcatataaacctccttttgagtaacgccacgcattttctctctgcacaatgctaagataaaatgattacctatctgataaaagcgatggttcagc

SEQ ID NO: 7148 - DNA, 1291 bp, Zea mays
tgttgaaagggaattaggcttacacctagttcctaaattattttggtggttgaattgcccaacacaaattgatgaactaactagtttgctctagattatacgttctacaggtgccaaaggttcatctacaactatactaattcgactgtccggaataccgtagattattccggacaggagaagctttttggaaaaacaggccaagcgcggaccgtccgggcccctggcggcggaccgtccgtgacagaagaatgatcctcggacagaaccaatgcaaaaacacaagtttccactacagactgtccggaggaaaagcgaagaccgtccgaaccctcgcgcggaccgtccggcctcaggcgcggaccgtccggtcggtaagaaaccgaaaaacccgaaggtgacgggttcggagaaatgaattatagggggcctcgcggaccgtccggggtgcacgaccggaccgtccgcgactggctctgtctgacatctgacgacgcattaaatgcaatatagccgttgatatagccgttactgctgaccgttgcattttcagccgttgatctacaggggcggaccgtccggacctggctcgcggaccgtccgcgctcggcagaatggcccaacggctaggaagtggttggtggctataaatacaaccccaaccacctccattcacttcatccaagcattccaaccttcaacattcaatacaagagctagcaatccattccaagacacattcaaagcctccatctctccaagtttcactattgagataagagatcattagtgattagtggcttgagagagaaagtgatccgtgtgtcatttgtcgctcttgttgcttggcctttttaatcgtgctttcttgattctttcattgcgatcaaactcacttgtaattgaggcaagagacaccaatcttgtggtgatccttgtaggaactttgtgttccaagtgattgagaaaagaaagctcactcgatccgtggatcgtttgagagagggaagggttgaaagagacccggcctttgtggcctcctcaacggggagtaggtttgcaagaaccgaacctcggtaaaacaaatccgcgtgtcacactctccatttggttgcgatttgttttccaccctctctcgcggactcatttctttattactaacgctaacccggcttgtagttgtgtttatatttgtaaatttcagtttcgccctattcacccccccccctctaggcgactttcaattggtatcaaagcccggtgcttcattagagcctaaccgctcgaagtg

SEQ ID NO: 7149 - DNA, 741 bp, Zea mays
gcatggttttagctgaattcacagtaatattcagttcggcaatcttgctagaactcatgtttaccttkggaaaaaaacaaacaataccttagtttttttcaactcgtttctataaggattactttagtcaaaaccgtacaaaatcaacatgaacaatgaatcggtcgaatcattacgatagtagaaagagaatgtatctagtgcacatgatgcacatattaaatcatcatcactcatattagatctaacgtctgtagttgtttggtatatttactaaggacatttgacatgacagactgtagtggtggaagatgttatttgtaaattatagttatcaatcagagacattagatttgatatgaatattgatgatttaatatgtgcaccatgtgcataaaagctttcatgtgcaccggataccattattttcgacatcataaactctatggactgttttattttcattcacacactttatacatcctaaactttatatactcttttattttcctccacacgtaatgtatatgatacttagattttttctacaaccagattttctcacattcagattctcagaaaagcttccgaaaaaactgaaccaatcagaccaaaaaataatgagtcaagaagtgactgaactgcaaaatctgcaccccctcgaatcggataatacgaagtgcgaagcagaggtcttccaaaacacaacgcggcaaacggctaatgctccttcctgtcacc

SEQ ID NO: 7150 - DNA, 1500 bp, Zea mays
tcctttttttatttgacgtcaaaccgtgtaaaaatgactgtaaacgttaaataaaaaaacggagggagttccttttaggtatagaagactagataggataccagatcgagacgctggtggcgtcctttcccaagcaaaactagagtactagacactagacattaagggcttgtttggttttgaccctagcaaacctgcttgggccaggtagctcctcatgaagttgattctgagcgcctgtcgactggatcaacctgtctagccgagcagtcccaagccatgttgtgaaccaaacatgccctaatagaagcatttgcatcggccatccggtgcctagcctagtgggtgatcctctttattgaaacttttgttgggatataccattttgaatagtgaaaatcatgtattgagaaagtagttttttatgatgaatatactactatatcaaacatgtgttgaggatctaaacaacttaacttttcatatacttatagttaatggttgagtttaaaaggtttaacctaatagaatactaaaatgacatgcatcctgattaggaggggcagagcaactccactcgatctctcgtattgcttcctataagttgtttgaaaaccactggtgtagtgaattgtctagcttctgagtagcatctacaagttctgagttcaattcccctcgaagatgaatttatggtttggttaaaaaaatcctctctgtgccctgtctgttctcgggttacgtcctgcgcgccatcctctgtccggatagagtagacgataactgcccgctagtgatgtaggaccaaagttcgataattttcttgacagagactatgtttcagtctctttttaatataatagcgggagtgcggtctttcccaaaagcaataaattgtctaaaacttatgttctagattctttgtaggataggggagatgagtcaccatcttttatttagaaaaaaacgaggttttttagttcatatcctaaaagttttagctacagaaaataaggtaggacatttactgtaatttgtttatttttctgaaacgctacttttgagatatagaatattgacacttgacaggatcttcatgtcaattccccttctagagtaagaacagagcaagagcaatggaccgtggacactggacagtaacacaagcatatgcacaagcacaaccataaatatataatacatgcctagcctagtgtgtgatccactgatcctcttgattggaaaatggggaatccttcctgccaccaattcctacctgtcatctgtctcgcccgcccccactgcacatcgaattcagcaaaatagcaaatccatccttctcctttagacagaaagaaaaaaaaacaaaggatccagctcgcattcgcagttgcagcccatccatatccatgccagcctatatataccggacgccctcgggcccgacgtgctcgtgctcgtcctcgcccagcaccgtaaccaccggacagagcacgcacc

SEQ ID NO: 7151 - DNA, 219 bp, Zea mays
ggtacgcacttttgtacatttgctctgaaagtagtgctgttgaggacaattttgggtctgagttctagattatttctccattcctcttcttagtcatgggcctatgggccttagtcacatacacagcccagcatcaacaatgttgaaaccctggtatgcattttgacccaattttcgtgtgtgaacttgtagataacatatggtgatccatcggtacga

SEQ ID NO: 7152 - DNA, 691 bp, Zea mays
ctggcgaacgcggacgcaacgcaaaacaaacccgcgcccagccgggtttccctggcaaaacgcacgtcgcgatcgttggcgcgccacgcgggcgcggggcgcgggcgacgacgcccgccgccacacggacaagcaacgggagcacgcacggggcccgcgcgccggcggggtacggtgggccgggtgcccagccgcccgcttgccacggcgtcgctcgtccaaccacctggccgccggtgcccgatccgacggctcccgtggaattctaggacgtgcgcgcgcgtgtcgtgtggcgtgtcttgttgagtgctggccaacctcttgtgcttccttccaagcttccgccgaatcagacgacaggtctagctagtggtagcatctagcaagctggagataggagtagataggaggagacttgtcttggcgaccaatgcaagcacgatttccgcggccagagatatcttgggcggcgccttataataagttctctccgcccctggctcgtcgtcacttacgaccagaagaagagatcacgtacgcgcaggtagctgcttcgcgatcgcgcatcgaaatcgatcgcatccatacaccagtttgtcagctgcgcttgtgcctgcaaccggaactggcagggttgtcgcgggagttcgtcggagcgcgcgcgcgcaggctccttcgtggatcgacgacg

SEQ ID NO: 7153 - DNA, 186 bp, Zea mays
caagaccctcacgtctaagatcagcaacttcagtcttccaatgatatcaactagcaagaacggcaaggtgagttcagatgattggtgaagctctacatttgcttgcctgatagctaaagctgtaactgttccaatttcacagattctttcagagacccccattttgctgtccatgaagacaattat

SEQ ID NO: 7154 - DNA, 105 bp, Zea mays
ggtgcgcccccgcccgagcttggcgccttgcggggcagccgcgacggggagtgcgacgccgagctgcagcgcgccgccgcgctctacaacccgcagctggtggac

SEQ ID NO: 7155 - DNA, 141 bp, Zea mays
ggtgatcctctcgaccgattttcccccaaaaatagctgccggagctcgcgataattcggcgggttttactacagtttagtttgtctctgatgctatccttggatcgatctcatctttgtcgttgacttgcgcaggttgtcg

SEQ ID NO: 7156 - DNA, 1338 bp, Zea mays
ccaccggacagtccctgtagctgtccggtgcgcgatctccttccatatctggcgcatccgaccgttggtcctcgggatcggttggcgcaccagacagtccggtgtgcccaaccgaccgttggcataggccacgtgtcgcgcgatgatcgcgcggacaacctttggccgcgagcgcctttggctcaccggacagtccggtgcaccaccagatagtccgatgaattatagtcgtacgcctctgtcgttttcccgagagcagccggttcaccgtcggccaccctggcgcaccggacactgtccggtgtgcctgaccagagttggtgttggctgaactttgccaacttttctccaatttaaatcttcttttcttggcactgtttctagcacttagataaccatgttagtatataaaacaattcaccaagtctagaaacatacctttgtctctgatttgcacttctcacttatttagcacataagaacttaatcaaacgtgttgggcgtttaatcaccaaaacattatagaaatggcccaagggcacatttccctttcactttgttttcctgtaaaactatgtatgatgaaaccatggtgtgattgtatttgctggccttaccctgttttgtttcaatgcattcgttgttgtacaggtaatatgttgaaacacaattcattgcatatgacaattctgatttttctttctagaatattgatagattgttggatcattattttctgagcaataatcatggctattcttatagtattgcataatacctttttcttttcgaaccctagcacattgattctttagtgaagtgattatagtgattccagcgggggagtagggtggggagcagagggttgattctggactgattttggtggagattaaatagggagcagtgaggcgcatgttttttagatcccaccagtatatgtgcgccattttgctgtttggctaaggagtgatgctcacggagaatccgttctcaggagctgtgccaaatgtcgccttaggttttatgatatgacctgacttctatgttaatatttgttagatctttattttatttgaggttacaaaggtggtgttctcaagctagaaacaaagttgcggctaggtcaaaactagatgttgctcttgaaccgtgtcttttgactctgttacttgctgcaggtttggtgttcactaatatgttgttcaactttgagcaggtcagcaattgactggtgttgctggcagcctggcatatctggcacctgaggttctactaggaaattactcccaaaaggtagatgtatgggctgtcgtggtgcttctgcatgttctgttg

SEQ ID NO: 7157 - DNA, 1450 bp, Zea mays
ccaccggacagtccctgtagctgtccggtgcgcgatctccttccatatctggcgcatccgaccgttggtcctcgggatcggttggcgcaccagacagtccggtgtgcccaaccgaccgttggcataggccacgtgtcgcgcgatgatcgcgcggacaacctttggccgcgagcgcctttggctcaccggacagtccggtgcaccaccagatagtccgatgaattatagtcgtacgcctctgtcgttttcccgagagcagccggttcaccgtcggccaccctggcgcaccggacactgtccggtgtgcctgaccagagttggtgttggctgaactttgccaacttttctccaatttaaatcttcttttcttggcactgtttctagcacttagataaccatgttagtatataaaacaattcaccaagtctagaaacatacctttgtctctgatttgcacttctcacttatttagcacataagaacttaatcaaacgtgttgggcgtttaatcaccaaaacattatagaaatggcccaagggcacatttccctttcactttgttttcctgtaaaactatgtatgatgaaaccatggtgtgattgtatttgctggccttaccctgttttgtttcaatgcattcgttgttgtacaggtaatatgttgaaacacaattcattgcatatgacaattctgatttttctttctagaatattgatagattgttggatcattattttctgagcaataatcatggctattcttatagtattgcataatacctttttcttttcgaaccctagcacattgattctttagtgaagtgattatagtgattccagcgggggagtagggtggggagcagagggttgattctggactgattttggtggagattaaatagggagcagtgaggcgcatgttttttagatcccaccagtatatgtgcgccattttgctgtttggctaaggagtgatgctcacggagaatccgttctcaggagctgtgccaaatgtcgccttaggttttatgatatgacctgacttctatgttaatatttgttagatctttattttatttgaggttacaaaggtggtgttctcaagctagaaacaaagttgcggctaggtcaaaactagatgttgctcttgaaccgtgtcttttgactctgttacttgctgcaggtttggtgttcactaatatgttgttcaactttgagcaggtcagcaattgactggtgttgctggcagcctggcatatctggcacctgaggttctactaggaaattactcccaaaaggtagatgtatgggctgtcgtggtgcttctgcatgttctgttgatgggcactcttccgttccaaggaaaatctgtcgaagctatctttgatgttataaagactgctgaacttgactttcacagcagtcagttggcatctgtgtcactgcttgttc

SEQ ID NO: 7158 - DNA, 1500 bp, Zea mays
aagcccagattatgataatctcataatctcctcaagagtagcttatttaagattatttttttggcaaaagatccactacccatggttatgtaaatataaattacaatatatgtcatccttctttcctcacttcaaatgaacaaacaaggatactgttgtctttgtgaataatctaaatttgtataatctagactatcaaataactacatatagattataatatatctagattataatctataatttagattataatccagattatataatctataagccgaaacaaacagacccaaatcaccggatcgaatttatcccggacagagatatttttcttgatctatcctagttcgtgcacttaaaaaamcatcctatagaaataaatggccggctcagatatatctatctatcttcatcatcactactataaagaattcattcaaagttcactcaagagaacatatcgatgtacatggtacacgtattaaatcatcaatatctattttagttagatctaacatctctagttgctcgttatattttaccgataacgtattccaccactacgctctatcacttcggcggatgttcttttataaaatatatagaacaatcagagacataagatctttagaaaatttattatgtgcactagactccaattcccacgtgcatcatatatgttctcctatcttaatattcatatctaaattttaatctataaatattagatttgttacacgcgctgccgcgtgcaagtgaccagtaaatattacggggatgtttggttctatacataaggtgccaaaaattaccatacaattttatgccacacttatctaagatgattaaggttaggcacttaaattatgtgccacaatttgtcatgcgtaagaaaattttgccacacttttacaagtcattaatataacgagtggaacstacgtaggagagaaaaatcttatcataattatggcttcaaaccaaacacatgtctaaccttagacgtgccaaaatgtggcaagtgagacactaaaccagacaaccttgcatcgtgcgctaggtttcttatattccattgatcgtggaaacataaaaaagtataattataattatatatatatatatatagtgtcaattttgtacctagaaataatgttagagtaatgattagtcaacgatcattaagtttggtttttttgaaactaaggaaagcggtactactacttagcagccaagtactatagattaatccaagtagccaacttgtagccaagttgcaccgtgttgagttgaatagtatatatatcattgcagaccagtgatcatagtatcatacactaaccattgccgttttagaaggaaactaaccgaactcaagaacgctactctgtttggacaagcactagagtgagagcaccatcaccaccatgtacaccaatagctccccaacttccttacttctaggcatactcagcatactcttatcaacgcatcccc

SEQ ID NO: 7159 - DNA, 144 bp, Zea mays
ctgatcaataggaataggaggaaaaaaaagcttatgatgagcatctattggagtcgatcatttccaagatctaattcgagtttcttattatgtagtggaaacgccttacaatcttcagttttacgcttacgcttaagggaagaa

SEQ ID NO: 7160 - DNA, 724 bp, Zea mays
ttggtggcaaattttaatattaaaagtacaggggtcatgggttcgaaacagcctctctttatttgtgggggaaggcttgtctcagtttatcccttccccagcccacattgtgggagcctccggtactgggtctgccaaattaatcttatactttccacatgsccattgttgtatgtcaagatgaaactagaatactagatgaccttcagggatccaaaaggcgaatattttttaaatattccatcaataataactgttgatggctaggttccatcactagttcatgtgtcggatgatttgtgtaaagtctgcatctaaattcatctgttgtgcacttgcacattaccatgtataatataaagcaaaggaagtctgcatttctatcagccatacattgtattgagccagatattttgttgttccttgtggaattgcaaaatgctttacctagagctgctgtgccacgattggtgtgccttgtctaagattcccattgtcactttgagcgatctcttattgaagttgtggaacttttgacaatacaagagatttctttcctgggtggactttttgctggtttgctgaaatcgaactattgatggatttaataatatgtttataaatttgaatgtaacattgttattaattaccaatttgaagaaaaaagggaactaattcttttgtattggcccagctggtaatgatgacttgtgacactctctag

SEQ ID NO: 7161 - DNA, 1500 bp, Zea mays
gggcgagagagcgacctcggggtgcatttcaccctcgcgacatcatgcatgcacatagccctagctgcccgagagggcgtctcctacgggcgtgtggccgtgtttgttggtcccgagtcctgagcttgcaaaagcttatgtctctctagcgcagtcttttttgtggtttctagctctttcctacagtatcagaaaagctaaagtttagggtaaaccaaacctttgtttcaaagcaggacgatcttattgctagtacgatcttaatgttgttccgtctcattataaattatcattttgttggtttcgatcgttaccgatgttctcttgctcgcacaatgccgtttccgatttcgacatcaccgcaacgtcgcggcgccccgctttcgttttcgagcacgaaaaaaaagtgaatttgaaaggggcagagcctttcggcaagctaacacattgcccagcttttggtaatcgcatgcagggcggatctagaacaaaaacaggagtgagggcacatttatgaggacatgtatcaaagtaacagagcgaggttatctaaattggattgagcagaaaactaatagtgaaaaattgtgttctactacttgcaggtgaaaaacgagcggggctgtgcacttcatcatatgatatggtcgcggcgcttatatatccaaactagtaataattaatacagtacaatttagccgaccgccgtataggtacggttagactagctagcttcgcaatgccatctgcgcgtctccatcagaattcagaaggaaaaaaacaactctcttcatccacgtagcgcagccgagtcgagccggtaacacgtccacgtttctgtttatctgtgtgtaatcgcgtggcgtgcatcatctctcttcatccacgtacgtgatccacctcatttagcaagcacgcacaccaaacgttttcacatcggcctgtttcgacggatcgatccagctacttcgaatcgatatgctcgcaagttgcatccaaaggggaaaatctatacgatcttttttttctcgctgtctcgtcgtctgttcctcgtcgtgccccaccgagattatgtatgggatctgcgacagtgcgcggggcatgcatgcatatgcgtccgttgcaccggccgggttgctttggctaaaaagcaagcgcgatgccacccataattgggagtccgttatgagtcgcgcttcaccggccggcacaccatgtcgtcaccgtgccccacacacgtcagggggcaacatgcctttgtttcttcgcttcgctcgctcgctcgcttgcttgcccctgtactgtatgtatatagccgccggacctctccagacctcaccagcagcagcagccgcaaaagccaaacaagacctctagctggctgactgctactacccagcaaccacctgggactgggagtcgagctcgctccagcgcccccttcaattccgtcctgatacgctcgagcacgctagcctagccaccgatcgacgacgacac

SEQ ID NO: 7162 - DNA, 816 bp, Zea mays
tggaacaaataaaaattgtctgtcttcacccaacatattgtcacagaatattgtaatcattgtgaactaacattttatcgaaaaatttacatatcgtcgccgtcgcaacgcacgggcactatactagtatctcttatgccttgttcgtttttgtcggattgcatccgaaatcgttctagctaatcaaagtttatataaattagagaagcaatccggttaggaatcattccgaaccacaaatccggcacaaacgaacaaggccttagctgtatccaacaatatgggtgagctatatatgaacgtgtggagaaggaagcacgaaaaggataagttgctgccatagtgactcccacaagttgaccactagtagcatccattcggaataagtatgttgttttagattgagataagtgcatattaccaagatctagaaatttatttatttattttaaaaaggaatgcacacggaaacaaacatcctagattcatgctatcatttccatcgattgcgacatggcactagcagtagcagacgcatgagtcaacaaatctgaacaacagaacaagcatcgaattgaacacttcctgtgaacccctaccataaactggtcccgttcctatccaccgaatttaaccctttttagcagggaacactggccagcggcacccaatacatcagatcagagcagcttgccaacatagggtacccataaacgcaacagcagcagccaggcaggcgagagaaaagagaactcctggagccataggtgtgggcgtgtggctagcatagctgtaggtcatccttcttgcttggca

SEQ ID NO: 7163 - DNA, 577 bp, Zea mays
  unsure (1)..(577): unsure at all n locations
atatacacgctttcctagtaacatcgtacgtacgtatatatatatatatatatatgaaactaggagacctgcagcatgtatatgacacagttgtttctatcactccacatggatgtaaaagctctgtcttggaggacttcaatttaaaaattacagcttcaattttttagctttatcataaaacgattttaatagattggtaaggtaggattcaaagtgtttggtttgcatataaactccagcttctataatacaattaatttatgcgagtttccttaattatattttacaattagcgggtagagaaagagacatgaattggtaggtcatgtaacaaatggtatgataagtaatttttgtggaactttatgaggaggtatgaaaccaatatttttgaagcactttttgatgaacttaaaaaattttatgaaactgacatctagttttagtttttttgaaactagagatcgtggagctanatctatttggatcttaaatagatttaatttttttgaagtgaagtctctaaacagggcctcacacgatatccatcaccgggactgcgggccttgcggcg

SEQ ID NO: 7164 - DNA, 257 bp, Zea mays
ggtacccctgaattaccgacgcgggcttggtgggctgggccaccgaattgacggtgggcctgcttttggcgctgtctctggggtcaccactccctagcctatttttttttcttctcaagaagaaggcaaattccctgtccaaatgctcgttctccacgaaccaaaatcactatttcttatatattgtatagcctcttctatgtgcaccggccgccgcgccgagaacgcctatccctccctctatccatatccaccgc

SEQ ID NO: 7165 - DNA, 794 bp, Zea mays
gctgaagacggcgggtgccaaggagatgaaggccaagccgtcgtcggtagggactggagctggggcaggagccgacatcgcagggctgtcgctggagcccgacgcgcgcctggcgctctacatcgccatggcgcacgcgggcctcgccaccgcgctgctcgtgctctacggcctttacctgctgctcgccgacttcctccgcccgctgcagtgggcgttgctctgctccgtcccgctccgcgagacgcagcgcgcgctcgtcgccttctgggagcccccgctccgtggcggactcagcgccgcactgctcgcgctgccactcgctgtgctccggtcctcgaccgcaacgctcgccgacgcgcgcgccgcgctcctgcgccgcccgctcccgtcatcgccggcgttcccgcgcctcctccgctggctcgtctccttctttttcttcctcatcctcttcgagcgcctcggcgccgccaccgcgctgctgctcctcgttttcgcgctcgcattcttcgccgcgtcccccaagctcaaacgcgctgcctcctcacgcatctccggtcggcctccctcctctcgcggcctcctattaactggaggcatcctccgccaccttaagacactagtcgctcttggtctcatgcttggtatgatcgccgggttcataactggcagcatcttcttctcctacaagattgggctagagggcaaggacgccgtcatgtccctcaagtcccatgtcgagaagagcaactactcagagaagattggcttgaagaagtggatggacgaca

SEQ ID NO: 7166 - DNA, 205 bp, Zea mays
ccccgcgttaaatcgcaacatggctgtgccacccacactaatcacccccccaaatcgaccacccctccctctccctctcttaagatcgccggcgaggggagagccgagaggcgcagggcagcccccgccgacgcttccgctcccgctcccgccgctgccgcagccgcagccgcagccgcagccgtagcggcattttgtcgagcat

SEQ ID NO: 7167 - DNA, 1500 bp, Zea mays
tttgttgggtcataccgtatcgctatgataaaatttcgattcaaacatgacacttcaacttctcgtcgtgtcgtatcgatctaagacatgttctagtggagttggtaccgataccaggcgtggcacggtcaacagtaagtaccgatctcgacgaagtcaacgacgagcggtaggcttaagtggtcggtactgacaaaggcattgaggcgaatgtcgctcataatcaggcaaggccagtagcaacagttgctaacagtcgctcataatatgratttatttccatattggattgaggttgatccgccctatatatataagtcacacaaaaagacagataactcattgcattacttccgtcccgtaaactcttctcacctagcgaagatcgccggttgatgttatacttttttttcctacaagagtctttcatgtcaaatttagtgtctcatgtttcatttatatttgcattatttgctaacaaagacgagcacgaaaagggagatggaagacgggaagacgagcagtgcgccttgaggagcgaatctagaatcttcttgtatcatcggtcttatataacctattggatttcgctcttttgctttttatcttgactattttgagctgaaaaaaatagagttacatgagccaccctcggactggtctatggcagccatcatgggagaaagaaaaaatataggagaaatgataactatatatataacagggagatatgaagttagagtttggtctttatatattttgttccttacgattcatcgactatatatggttcatctaggacaatccaacgcttgaaaacgatcaaactgctacgtggtgccgatataatttcatggtgtgtatctgtgcctgaccaaatatatgatccatatgccagttgccacttgccagcactgccaccatgaactccgtatctaagcaatgatgatagtgttgtgcttttttttttgggccgggggccggtaccgccctatggtgccagctgggccgtttggcctatatatagccggcactgctcatacatacgtgcggccgtatgcgagtgatccgtcaacctaacgccgcgtccgcgtacgtacccaggtggccaggtctccctccgtggaggatgagagaggcggaaggaacggaattgtgttcttggcagggggggccgcacgggtccaccacgtgaatggcgaccggcccccaccctccacgcgcctccgcctatcgccatcacgcctccgtcccgcccccttcacttcactcgatcgactcgtatagcaggccagcagcagcaggtagtagcgttcagttcacctccctttctccactcccccctgcccgtcgctctcccccgcatcccatcgcgacccaacccggcgcccgccccggatacggtgcgcgtctccactgatccgcacgatcgcgcgctcgcccgcgccccggccccggcggccggccgggtgagcagtagctggagctgcgtctgcgtgc

SEQ ID NO: 7168 - DNA, 125 bp, Zea mays
actcatgcgtgccgatgaaatgaaaatgcacgcgtttactgcgatttaaccaccaccattctcgattgacgttctcccttttttataccagccgttaacacgcacggatatctccaccagcagcc

SEQ ID NO: 7169 - DNA, 301 bp, Zea mays
cgtgaaaagagcacctcggcttcgcctgctttcgcagctcgcacggcaccttctccaaaagcgagaagcaggaactcggcaaacttcgagggggcaaagcgcaaaaagcgcagaacgccagaggttttctccgcagtctagaaaatgtgccaaacccgtcgcttcgtcttcctctccttccggcttccggccccgctcctccccaaaatcccccaaaacctgacgagctggagggccgatccgcggctccccgccgcctgatccgagcagtctactcggcccagccggggatccaagcggg

SEQ ID NO: 7170 - DNA, 241 bp, Zea mays
ggttagctcaatgcaggagaggaccatgtcccattcaacccttgggttcacatgcacagaacctgttatttgtatttatctaatgatggtgcatgagtcatattggcatcaccaagcatcagaatttcttccaaagatgaatgctggtttgatctttggtccaccagcactcgatagtcatgtcttgcgcgcattaattctgcgataacaggaccgatgattgcttggattatttcagatt

SEQ ID NO: 7171 - DNA, 138 bp, Zea mays
aagatccatgtatgatacctctgaaaggtttacttaggcctagactcagtttgtctctgattctgtacattcttgatagattatatttgctcaagatgttgtttcagtgcagcattcaactgcaaattttattgctgg

SEQ ID NO: 7172 - DNA, 1500 bp, Zea mays
aaaaatgtcgccacaagtcgttagcttgccctgcatactgttgcccatgacccgttgtagccagagtagggtaggttaggccgttagatatggataatggacaactggatatactgctccccttcgggtttttttttcgcacttggaactttggaaagtgtacctccaatccaattttggatgtctaataatatagtaatttggacatagatcaattaagctaatatagtttaatgtgaaatatattttattattagcaatatgatgtgaggatatttatgtgttagagcatctccaacaatgactcaaactaatgcctcaaatcgaaatatagggctttacacaggaaaaacaactccaacagtgcctcaattcaacaaattttgtcaaaaaactatagggcaccctctcaagtgcctcaaatatactacaccgtagtgggctgccctataatctaaatttggggctttactgttggagcggagtgttttgttggtgccctaaattctataaaatttacttatttttaaattataaggcatttttataggtcacgttgttggagatgctcttatagttttactatagatgagtgagaccaacaatatcttataaattacagagtagaaacatatcccgttaatacataaaatcatttctcatactctataccacattaatttaagacagtcttatatctaaggtttgaaaaatggtggaatatcaacttcaaaactaaatagactaatttactaagtaaatttaaattactccaaaataaatagatccaaacgtcccgtttggataaacgccccaccatctccattcccggccctttacgggagaacatggaggaccagagcagagctcgtcacttcttcgtcccgtgctgctggcgcctggcgccgccgccggccatcgyggacggcgggcgaagtacgtatcagtgtatggggttcatgacacagaacaagggccaaccgtgaagcgcgtcacttgtttcatctgcgggcacgcaacggaagccagctaaaccgatgtcacgttgcgctttcggctccggccggccttgccttccgctgcacacggcggcggcgacgtacgctcgcgggctggtttcgctctacggcgcgcggcgcactggaaaaaagggtggacgtacgtacgacgggttcgttgctgcacgtaccgacgtacgttgtgataagataactggccgccagagacgacaaagcgcgccaagtcctcctcccatagtcccatgcacggcgcctgacgactgacacccggccgcctctccatccctttccaccgtgtggcagatcagataacaagcaagcgccgcaacgcacgcgacgggccggccggggaggcgtataagtacgggcgcgtcttcttccgccgctgccccgacatctccctctctcgctggtgcgagagcgcgcgcgcaagcaagcaaggagcgtcgtgtctagctagctgagcacctggttttggagc

SEQ ID NO: 7173 - DNA, 199 bp, Zea mays
tcggtacccctgctgtgctgactgggttttgctgccttggaaagcttgccaaagaaatacatatccttcagcagcacatcagatttccataattgtattatccagctatttgagctgttgatgacagtgcacttgttttgatcatacattgtgggcgaggattgaggaatgatactacaatttagttactgctatccac

SEQ ID NO: 7174 - DNA, 1500 bp, Zea mays
tttagattacaggatccgttgtagtctagctggtcaggatattcggctctcacccgaaagacccgggttcgagtcccggcaacggaactttttttttttgtaatctcctcttctatttttttttaaaaaaagaacgaaacagctgatgttctatgctctgcttgtctttatgaaaatccgttgcagactaggagatagtaagaaaaaatccaatagtcactgctggatgttcagcaatcgatttgagactgggattagcttggacctggaagttcaacctgtatttcacatgttgtaarcttattataaagcttcctgtcttcgatgcacctcctgttcaatacatattagaagctgaatcaaacaagcagccatgtcagtcaaaaacactaatctagatgtaaatgagttttccctgaagattttaatgatggataagagattaagattttatatgtagctggcgaaccacattctacacgtacggagaggatcgaagttgtctctgtatgtaccgtttcttcatgaaagcatgcactttgacaaggtaaaaccaggcttggtgccaatctatttctaacaattttgaaaacgtgtttgcaggcttatgggccggtaatataatccgccactgcaaacgcatacgcatctttcttttgggtcgtaagagtatgtgctaggataggagctctatatatgctcgtcgagctcatgcatgctgtacagttgattacttgaaggccatcgtataagaccgtctttttattagcgacttctcaatagctaggatctaaaaaggtatctcgagagatgtctgtgagtgtagcctagagctagcatrcatttcagtcacaggtcaaattctaccactgataagtaaaaaaaaggctgcatctactgccgttcacatcattcagctgaggagggaatctgagcacaccactgacgaaaatcgccgaccacaagcacaagggctagcccgctgctgttaccatcgtcgtcgaagccatcgtgattaattaattgattactccgtggataatttcttttacagcccgttttgttctatataaacgtgccttaagattgacgcgtgcagctagagaagtcgagaacacaaatcaaaacgtaacgtcagaatgatacccttgtaggatatatatatgttcggtatttttgtcagaaagatcgggacactccgtaaagagccgaattctgatagtgcgagtgtttttttttacccttgcttccatttacaccacttccttttcctccttrctgagaataaaggaatcgttggatataaaaacaagacaaaccggtaaaacgacaagaaagagagagggatattttacccctccacggtaaaccatcgagattatcacgcattacgtgttttaccctgcagggggctctatccctataaatgcacgccatactgtacccttgaattcatggagacaggtgtttagtttagtacacacggggtgagagaggatg

SEQ ID NO: 7175 - DNA, 97 bp, Zea mays
gtttgtacaaacttgccagacctgtttacaggccaaacccggcgtacccagggaaacttcaacccttgttccatttggggcctaggaaacaatcaca

SEQ ID NO: 7176 - DNA, 136 bp, Zea mays
gtgcccgtgattgattccggtttcttgcttgcggggtcgcaggaacgcggcgaactcggacgaaatccagctgcggatcgacccggtgcacggggacctcgacgaggagatcgacgggctgcaatccagggtccgc

SEQ ID NO: 7177 - DNA, 527 bp, Zea mays
cgtttcattaatttgttcttctatatattcatcccctgcttcatttcccttcacctgctgctgccccccttctcaacttaattatctcctctcttgccacagtgaaggagccttatgagctggttggctggggctttactccaattctggtgctactaagatgggccagggcctgctcagcaacaagtctgggacaagactaagcatagatgaaatagcaggcgcttaccatttcttgctcttgctctcccccgtggtttccttctgggactgcatcttccgcaagataagatactcattcagacctgagtgggtgtagcagcatcctgcactcacccacccatcttagcaacagttcctttccttttcttcctcgttattaaaataaaaaaaagttagacaaaccaatgaggccaaagaatgaagtttgaacattttgttttctttcttccctaattatacctagtagtgagtagaggagtcaggtctaccagaggtaatagtgaatagcagcaggcacggctgtc

SEQ ID NO: 7178 - DNA, 1500 bp, Zea mays
gagcagggaggaactgtatcattcttcagattataattgacaatttatggagcagggttctccaggttataactgatgacacattaaaatatatgtgttataaaatacacctgaaattgttgaggtaaatgcaatttcacttcagagttctcagcacatcagcctacataaatgtcgaagcaacagatggcaggggtttgccacctaggccatattcatccgctgamcctctcatacaagatttctgaaaggccaagaagtctcatcagttcatcacaaaatctaattcgagatacataataaaaactgcttccatggcggacaaactacaatataagatttgactcgatccggtcttcagaatcacactttgaccgaaattttctgttttacccaatatacttttatagtatttattttagagtgttcgtagattcatatagtatttgatatatgcgttttatagttttatatacgtgtctaaattcattatcattaattgaatatggacaaaaaaaagtttagaacgactagtatcttgaaacatagggagtacattattataattttgaacgcataaaatgccgacgtgacacggtggaacgtgtatccagttatggtaagtccaatctcagtgagaatttatgtcactgtttataagatttataaagagtactgcaaatagtagataagttttatccttacacaacttattttatcatataaatatgtatcttatctctctttattaataatacgctatattagcttatttacttagcataaaactatgataaaacgactattgagactagactaagaaacatcacgtgctgatcacactgtaagcaaacagaaagcaaaatcaggcatgcctacctccaggctcgtgggtcggcgtgaaccacctacgagcaacaccaaccccagcgccagcgagccggaaggccacgcggcaccgacgcgaaatgcgaattggcagcctctgccacggtgacgtaccgccgcggaattctccgctcccctcgcgactcgcggtcgcgtgcaagcgggcatgctctgtcctcgttcccctgatggatactaaaacaggggaggcccagcaggcaacagggaaaaagaaacgaagccccatttatttaatataacgcagagcgcagtcctacacctagtcgtactggtctactggacgtcgtgttgtttatagtcaactagcttggacctacgccgtcgtcaccttccgcggccgccaccaggcgcgcttccatgcgcatcgtctgttccccggcccccgttcgccgttgcgcgtttgcctccgcgcctaagaaagcagaccacgcaatcgagaaccttaaaggcaaagaaaccgtgaactttatgttcgcgcaccgcagcaaaggtgccgccgcagccacagccacagccgcgctcgcctcaagagcgacgacccaagtactccccccatcccaccggctgaccggtatgtcctaccccgaggac

SEQ ID NO: 7179 - DNA, 459 bp, Zea mays
ggtgatgcggacccacgacctcgccttcgcgacgcggccgctcagccccaccgccatggcgctgctcggcgacggcagccgagggcctcgtgttcgcgccctacggcgacgactggcgccacctccgcagggtctgcacccaggagctcctcaccgcccgccgcgtccaatccttccgccccgtgcgcgaggacgagctccgccgcctgctcgcctccgtcgcctcgacgtcggggcccgtcaacctgaccgagaagatatcgacctacatcgccgactccacggtgcgcgccatcatcggcagccgacggctcaaggaccgcgacgcgtacctgcggatgctcaagggcctcttcggcatcatgcccgggatgagcctgccggacctcttcccgtcctcgcgcctcgccatgctcctcagcccgcgctcctgcccggatccaggcctaccgtcgcagc

SEQ ID NO: 7180 - DNA, 457 bp, Zea mays
ctgcagctctctgttggccccacctccaggcaccatgtctaccgtctactccccccagtcttgtacgtatatattccacgcacctggtccacggctccacgattatgaactgattaactgaagcacaggcacagctttcacttgcggttccagcgacgcggaatggaaaccgcagcagcagcaaaactgtagatacacctggtccatgcacaaccgacgtgggaagacgagctacagggaccgacaggtggacccatacgacgttcgaatccctccaaaacgggggtggccaccttgccaatataactgaccgccccccacgacgccctccgtcccacccgcttcgcttctccctcggcctcgctcgatcgctcccacgccctcgcgccccctccacaaaccaccaccacccaagaccgcagcgcagggcgcgagagggatcggcaggtcgggcaag

SEQ ID NO: 7181 - DNA, 1093 bp, Zea mays
cccggacgcacaaagcgtcgccggaattggacccgacagccggttgtccgacgtgtccaggaatgagagcgggcagttcttcccaagctccgccggcagcggccctgaaagctggttgccgaaaatcctcaggtcagatagacttggcgtcgtccccaacgtcatcggcaagtgaccggacagattgttctggtagacatgcacactcacaagccccggcgccgcgaacatgtcctccggtatctccccggtgagcaggttcatggagatgtccagtgaatggagcttcttgaggcctcccagccccacgggaatagcacccgagagctggttcgagaagagctcgatctgctccaaagaagtcaggttcccaatgcttggtggtatctcaccagacaagctgttcaccgaaaggtccagattgacgagattcttcagcttcccgatggaagaggggatggtaccggtgagggagcagttggcgacgaacagcacgcggaggttggccaggttgacgagcatgtccgccggtaatggcgacggggcgaaggggttgtaggcgagttggagctcccggaggccggtgaggttggccaagaacgccggaaactcgcctgacagcgcgttctggacaaggttcagcacggcaagggaccggaacccggcgccccacgagcgcgggacatggccggagaagttgttcccggcgaggttgaggtgcctgagcgccgggagcgccgcgacgcaggccggcagcgggccctcgagtaggttcgcggagaggtcgaggtgctccagggaccgcaaggagcagagcgcggttgggaaggcgccggcgagggtgagattgtacaggtcgatcccagcgacggccgccgcgggcgcggagttgttggcgcacgacacgtgcgcccagcggcatggcgagctacgtctgttggcagcgtcccagccggcgagcgcgccggtggggtcgcggagggcggaccggacggcgatgaggtgcttggtgtcggaggatgcgcccgcaatggtcgggaggaggagcagaagcagcagcaccaggaactccaggatgtagcgggtggcatcc

SEQ ID NO: 7182 - DNA, 1215 bp, Zea mays
agagacagatcaggacactattaaatatattgtatctggtgggtgcccagcacagcccatttaaccatctatgcgagatggaccttgaattaatagatggacagagatttcgtgcaaggtttcctcgattcgaccaacccagtgcatccactatcaaaggcaagtttggagatctctccaactgcgaaggagccatggaagatatatgctggacatggagcctggcaagacctacctgctacaagtaatcaacgttgtacaacacagcaaccatagcaatgaatgaagtcacatcgaaactatggagaaacaataatactatgagctgagataccatatcatcatttcttatgtgtttttagcatttatattatatgacactttcatgacaaagatatataatgctgcccatattcaccagcaattgcagttctattattttgtacacgcgcatggtagaacgcttgatagggcgtttttttttctagttggaaattaatactggcagaactgaactatgtaacctttattgtgcaaatccaaatccttaccaagtaattgattgcgttgattgactgaacaaactgttcgactggacaatcataacgtagcctcaagaagatagtttccacatccccatttacccgttaaggaaaattttcccctgtttacatcatkgtgaaaaagaaagttttccatctcatatccaaaggctttgttagatattctagtattcatcttaatttatatgtattgagatggattagagtgatttcattagaagaattttccgcgaggattagggccattaccatctctactggtcattataaaagtttgccgcataagttatctaaaatattataatttttgaatggtcacaggtatcatggtctacttttttatgtcattcttatcagatttaatgtgttattatttttgaaatattttttacttgtagtcatttaatttttaataacgcatatgaatctctaaggttttattacgacaaaaaatactcacacgttacgcgtttcggccgatcttgtccgcggtctgcctccytgacttttgttggcgctagccgtgtcgaaccgaaagtcccaagtcccacccaccaaacccaacacatcgtgtctgcgttctccccctttacgccggcgagtgttcgtcgctggctcgctgcagcggggagaatagaggcagagagcaggg

SEQ ID NO: 7183 - DNA, 1500 bp, Zea mays
tgctatcaacggagaagtataatatggcacagacacagtataattggaatgtacccccgtggtaatgatattcgacggaggctgtatttgtatcttcgatgttgtttgtgaactatgaaacaatatcatgtaatgtatttgaaatgttaaatattgttatttcacttatgatcttttgttcaaattatgggacctcaatgcactttatttgcaaaaaaatacatatgactcagtttctgcttctatgccatcggtttatcaggccaggagccgattaatcggtcatatcggccttgttcggttagctctcaatccatgtggattgagtgagattggatgtgtttgaatcccaaacaattcaaacttcttcttaattttttccaatcccatccaatccatgtgtattgggaataaccgaacaagttcttatcagtctcaaactgtttcaaattcaaaactgaggagatatcggttttggccggttttcaccagtttatcgcgattagccggttatcgggagcaaccggtttggtgaaccctggtcccctgcgggtccgatcatccctatgaagcatggcagccgaacagcatccacacttgacttgacatggtgcctatgtttcgtgaatagtacgcttgatgcgaatgaaaacagctgcaattgcaaggaaccggttgggctgcaatgaaatttgttttcgctgaatagtagcagttaaaaacaataacatcatgtacaggtgaaagtgcaagaacggcacgtgggtcgtcctttacttgtctgcagaggcgaggctgaaaattgaaacagccaaataacacccatgagatccctcaaatatctcagaccatatggcccaattataacagttctgttactatctattagtacgatccgacatcaggtgaacataagaaatcacgtcaacttgtgcatgatttccccccacttgcttggtccccaaactatgcaaatctaggagtagtttatatcgcaggtcgacgaggacctttcgttgggcgttaagtttatttatctcgggatagactttggcctggaagcacctaagctgtttctactagttgaaattcacttctcctgtcccgtaccgtactccgggaccccactcgtcgtgctcgtgcccgcccttgctcgggggacggggacggccatcgcacgaacaacgccaagcgaggaaatggacgcgtcccaactcccaaggccgctgccccggccgtactgctacccgtagtactgttgcttgatgatggggccacaagcccacaacaggccacgcggcgcacgcgaaacacacgtagcactaccacgtggtccaagttgtcacggccctctctctcccgcgcgccgggcttatttgtaccggccccgcccttgcgttacccaacaagcactcaacgtctcctccagtccttcgaaaaccctgaaaccttggtgaagccgagacgagcaatcatccaagcagctagtgcttagcatct

SEQ ID NO: 7184 - DNA, 1500 bp, Zea mays
taggcgtcgcggtgttgcaccaaagccagaaggcgaaacgtcgagagagtgcctgcgcgtggtgggctagcggcttaccaggtccaggagagcagggggcatctagcaaaaagcaagcaccaggttgggggagataaaggatgaggcgggagggtgtaaacgcaaatatagcagggaacgttggatgtgcaatggatggtttggattgattgattgcatgcgtgcaccgaagtacacgattgcacaggatatggccccaagcttgatcagcgaaactcaggcgatcggacgacgccccaaggaacaagtgaagcgcccggccctcccccctggaacaaagcttcggcgttctcgtcgtcccgtcgcaactcgcaaggtaacagcaaccaaccaatccatcttctctcttcctgatcaatctgcttgcacgtacgccggccgccaccacgctgtagtgtaaggacgccgccgtacgtaccacatttctttacggaacctaggcggcgatcgtaccaacaacctacctactagcgcctttctgctgttagatacttagatgtggtgcataggttcagtcaggattagaagaagaaaaaaaaaggagaggaggcggcggcggcgatggcggctttttccttggtctgaaatgcaccctgtgcggtgccttcgattgcttcttcttgatgccagatggtaatttcagtcggaggggagagcctgggatagacacctgcagcggtgcagcctcgtgtatgattcctggcgacgttagtcaggtttmtgaaatgtgaagcttcrcttcggttatggctcgttcgtcttcctcttggatttttaatttcttaacatcctgccattgttgtgctgtgtcttggatccttattatgtcaggagagtaattctggggttccaaatagccgctacatcctgccttttaccttctttcagccttctgtatatattcactgttgatgatgtcattctgtcggctgttgatgaatgatgatgtcagttcttattccattacctgccactttgtatcggactgttgttacacataccacacagtcaccatttttagttttctttggcgaaacccttacctggctggttttgttggcgtcctgtcctttacagtagccaacagaaaaattgttagccttttcatgtggtcctccagccgcagagtctaatgttgcttcttttcctttatgcagtgcagatcataagtctataacaagaaagacaacaaaactatgctgaaagatgtgcttgcatagaagagacttctgctgcaacaccaccaagggcgctggtggttcttgcgaaaggtctgcaggcctgctcgtctcttgacttcagcggcgatcaccttgcctgcatctactccacgcccttcagactccgacgccaccgatccataaggcgcagtccacctgattgacaacagaaagctagccctgtgtgcatcatcacacaattttcatagagataaaagat

SEQ ID NO: 7185 - DNA, 1137 bp, Zea mays
ggattttcggtttcggtgttcagtttttggtttttatgcccaggcctaggctcggcggcgaacatgccgctctcgggaatcggcggggcgatgtggctaaaattcactggactgtccggtgagacgtcagcgccagcgtccaagtacattgacgaactcatcgctcttggaaaacgaaggaaagcgtcgcagctaaaaatcaccggactgtccggtggtgcaccggagtgtccggtgagccaaaggcgctcgcggccaacggtcggctgcgcaatccgcgggcaacgcgtggcccgcgccaacggtcggttgggcacaccggactgtccggtgtgcatcggacagtgttcggtgcgcgaaccggtcccaaggcccaactgtcggctgcgctcgatatggaaggagatcgcgcaccggacagtccggtgcaccactcgacagaaggcaggaattgccttccaagttggtctccaacggctcctagctaccttggggctataaaagagacccctaggcgcatggagcagtacaccaagccttctctaagaattctaagactcccagactccgcctccacgcacttgatcgatcgtgttagtgatttgagctccgtttgagttgcaaactctctatgatgtgtttcgagctcaagtcttggcttgtgtgcgtgggtgtgctgctgatttgagtcttgcatgtgttgctctcccatccttactcttgtgctttctttgtgatctatattgtaagggcgagaggctccaacttgtggagattcctcgcaaacgggaagagtactcaaaagataaagacagtggtattcaagtcgatcattggatcacttgaaaggggctgagtgcaaccctcgtccattgggacgccacaacgtggaagtaggcaagtgttacttggccgaaccacgggataaaaatcgcgtgtctcttgtgttgcttttttgtgattgttttgttcataagaactcgcttcatagctacttggtcacactaacgcttcgataatcaagtttgtggctatttagtgtttgattttacagggtcacctattcacccccctctaggtgctctcaattggtatcagagtcgtactcttcatctaagggactaaccgcccgaagag

SEQ ID NO: 7186 - DNA, 341 bp, Zea mays
agctcgagtagccccccgcgtgctcgccgcctagtcgcaccacgcctcgcctcctgccgagagctcgttttaggcgaccggatctagacaaaggcccccgccgtcgccgtcctagggtcccgggctggcctccagcggtttcccccgatgacggcgagggaaagcaaagtgggataacgggcggcggctagggttacgcgccgggagtatctttaggatagttggatattttctggtaagctacgataattggttattcgtattccgtataaatataactacgcggcaggttgaacgttttctaaccttggattttccttttttttaggtgcaagctagca

SEQ ID NO: 7187 - DNA, 1422 bp, Zea mays
tgcatgcctgcagctgtgacaacagatgcaacactgctcctgtcaaagttctgaagcccggaaattatctgcacagttcaagagccagtggctatcagctaatcatcgctaagcaaggataactcatccaaacaaaagaaaggctccttcaactgtccactccgaagacgacattacatccacagctctccttccccgccagcagccagcttctccctccccgcaactctctttccctacaaacctcaccacagccgccatgcgccgcaacccgtgcgttgccgccgccttgacccccgtgccaccgccgcctcttcccctcgcctcactctcgtgggcaaggcgacaggatgccttgcctctcctggtcgccttactgcttaagcatctctttagcgacaccttaataactatgcccatatcacagaattttattctgtatttctactaaatgcagaattgaatctgggatacattatacatctattatttactgttacattatggtttcattatactgtcaaattagtgttaacacgagaactttaggtacagggttttaattttctttttggggaactgtaaactgttaccattttacacatttaacttggtagtgtcttattatgaattttgacagtttgtccatggcaatgatcattccaagttttcaaaatatataaaaccttcatattttgcattttacaatgaatttatctgtgatgttctctattgcctggttaaaaataatcatcttttttttttcacgaaattttctctccatattcttgttctcttgccccctatatatgtagatttgcgacatattttcatgtgtaaacttactgttgggcttgggcatgttttgtagggagcaagagctggatgcccaaatttattgtgaaaccgaagtctgcaagcgcagattctcataagagacagaagattgaatccacggctgtccaagacaccgggaaaggccaagatgatgaacaaaaaagtgaacctgcgaagcaaaccaatgttctccagtccctctgccagaactacgatagtgatgatagtgaatgaatgaggacaccgccctcttgaagccataacagtcctggttgccaatgctgtattataccagaggatgttaacacatgtagttccccaaaccactggcattgtgccatcatggcacatgatatttatcacaaatctctgattgtcaatgggccaactacaagtattggctcttacaaatatgggctatccagatagagctgcgttattggataaaatgatagttgcagaaagtcagatctgcggtttgtacatcaaacagccatacacaagcttgtttatgcagcatcactgaattaatcattgtttgtttgaagtgtgtgatatttacttgcttttgcttgtgaaaattca

SEQ ID NO: 7188 - DNA, 1457 bp, Zea mays
gaggtagtagcagtattcaccaacgtactgactggattattctctctcttttaaaagaaaccctgactggatttttcttccttgctcgctcgacatgtatactaattttctttcttacgatgccgtacagtacaggctaatctaatgctaccagttcagtacatggacgccgcgtgctggggctagcccagacgcgattcgcatgggcgaagaaattcggccgacgcgcaccacatggcaccgcacaatgggttcggtgtggcagcactctgtagtctctagtctgcactgcttgcttttggttcctctttctctctggctgttgacctccttgctccttgtgttccatccgaggcccgtccaaacgcaaaaccccacggcgacgtgttccatccatccggacaagctcgttgcacctcacgaccccgtcttaccacatggcctccagtccccgcttcataagggtacgtataaggacaaacgacgggcttttgaatcactgatatttcagcgctgaaaagcatgatgccacgtactttttacattcctttccaaaataacacgacggcaaacacacacacaccacgtattgataggagagaaaaaaagatgtattcaaacaaaggaaaatgaagctagatctacacaagataatctagtcagtggtttggtgtggttcataacacgaaatgttagatacaccgcgtcccatgtattgtaagtgaaacgtttcggtcatagttttcagttatatttagggcttgtttggttcgtggctaaatgtgtcatactttgcctaatgttagtcgtttgaattgaagaattaagtttaaacaaaaaagttagctaaaatgtgacaaattagtgaacggatcaacatgcccttagtgttctctacgccatcgaccatcatgatggcaaacatggactagtttatttcgttgctagaactaagcgacgcccatcgctttcaaggcgttaccagggagcgtgacaaaaaataaactagctgcaccgtattaccagggactagtttatttcactctttttatttatttatcgtgatttagttaaaaaataaactaacggatgacaaatattcgaacggaggtagtaatatctattttatatctaaccctttcaactaaaacctttgaatttagattggacgttttaatggtttatttgtacgattataggctaactgcactgtattttttcaggaaaaaggaaaactaattattactagtatactgttactgctactacaaggttcaactggtaggccctcctgcggtcctgccgatgaccacggccgatacagaagcacataaacacattcgacgaggtcacgactcacgaggggactcccgagcgcacgcgcgaatcgccgcggacctcgccggaggcggcgacgagctcggatcccggcgatctagtcgccggaggcggtcccg

SEQ ID NO: 7189 - DNA, 1500 bp, Zea mays
agtttttttaataaaaaaacttgtttatttgccgcaaagaaagatttgagattagggggggaatctgatgaacccagaagccgcatctctttcatcagctgccccaagcttgcttgcccttaaccggaagctagcccaacgatctaaagaccctgcctttgatttttttctctctctctcttcttctctctcaaacccaccctcccctgtttctgcctctaagctgaagtaactgatttcatggccagttaccagattggcctaatagaagactgaccggaggatgcacgagatgtgaaagaaagaaagaaagtaggcttgctttgccgtgggggtaagtaagggaggcaatgcctcgatcggcacccccacccctgctaatgttgaccaccatttttcttcttcaacaaaactaatcatgccgatcatgaagggcgtgtaaataattggccgtgccgactataaattaaataaaaccccggcagtcaaataatgattcggggcaggggaggctgaggcgaggggcataatttacagccaggcgcctcgaggaaagcgagcgagaggttgcgcttgcgcttgcgcccaccataaacaaatgcccgtgggagttggcactgtcagggatgccggcacggtaatgcccattgcccattgcagtagtaggagtattgctgtgctgtgtgtgccgtgccgtgccgtgaagaagaacctgatcgatcagccagagccagagccagcccccttcctctctacgcttgctcgctggctgtgcgtgtgtgagagggtgagtctcctagctactcgtaggaagtaagtaaacaaaagcaaaggtaaacagcatgattaaagcgctgttaacaaagataaagcgaaggcgagacgcccttcaaaataaggtccatcgaggctagcttaaacaacgcccggccatgatggtggtgattaggaggagtaaagcggctgcctgcagctactaatcggtgtggtggctcgccatgcatgcatgtaccactcactagtcactagtcactactggtgaaactacaacagctactgaacaagtgctagtagaccctataaaatctgacaagcctttgcctacaagcccctctctctctctgtctctctcactctccctcccgtatggtctatgccctcccaccctctttcgtagcgcttcttcctatgcctctcgccggaacggaacagcagatagcatcacaatctccagtggctgtgggcatctttccttttcctgccataggctctaggccgtgacgggagctagcttctcgcttgcgtgcgtgcttgctccggctatcatattgcctgcctgcctgcctatgaacctctccggccaatggaggagctacctcttcttcttcttctctagcctttctcgtctctgatccacccattgaccttcggtgcgcccggccactctgcgccggcctctcgcgtgcgtctctcgtgtgagtgctacaggcaagcgaagcg

SEQ ID NO: 7190 - DNA, 1384 bp, Zea mays
ttttggggttgcttgcacgcaactatagtcttcccttctacactagaactaaaatactatatgtccaaataggtgttagattggacggatataaaatatagcatagttatgtcatggcatacattaaactatgatattataaattatggttttgagaaacaaagtttctaaacatacccttagaaacctcttaagagaccctwattaatgtagttctacatacccttagggcatgtacaacctagatactatgttgcagttctccaagcaatagatacatctaagaagccctttcatacaactcaatgtatgtaagccttgtatcttatcttatttactagaactcgttaagataygtctcatttatgtggtttgtatgagtggaatcgtatttagacttatagaaccgtgctagagacgtttattcatcaagatacgtctcttgtgtattttttgcaattactccttaatacccttaaaggcatgtacaacctagatactacgtttcagttctctaaacactaggtacatttaataaagcccttcatacaatctaatgtatctaagtctttgtattttattcactataatctctcaagatacgacttatttatgtggattgtataagtagaatcgtatctagacttagaaaatcacggtagagatgttttctcaccaagataacatcttttgtgttttttttcatttaacactttaatatctttaagatatgagatatttacgtgagttatatatactctaagatattaagttatttacgtgggttgtacatataactgctcgctgctccagagtgacaacgacgtgacaacctgcacgaaaagacggccaaatgcccaaatctgtgcagccctagtacactgtacacagcacgcggcggataatccggaatcgcaaagcaaaaaaaaaaaaacacccatgttcctgttcccacactcgactgtcatcctgtgatatccgctcgccagtcgccactccgtttcggcattccgcctcctcccgacacacctctttaactcgcttccgtttccaaaaaaatgctccagttaatttaatccagacgaggaatcgcctcgccgcggatctctccgctcgccgacaagacccgctatcggctccggcgggaagactcgcactacggtggggcgcgtcgccgccgctcggcacgtggctcgtcggttcgacgttcgcttgtggaggtcgtcggggccagcggtgccggggcaatgcggtcagtttgtggagccgtctgaggcgcttggctgggatctgagggtgtcaggtagggggcgcgagcgagctctgtcggtggggagttggtggtggttgtagcgtagggcgcgtcgcgtgtttggctgccggg

SEQ ID NO: 7191 - DNA, 1500 bp, Zea mays
tctctgccctctgccggcgctccagctcctccatccatggccatgccctgttgctcgtcggtgctcgccgcgggagacggcgcttggtcgcccaaccttcctgctcctcaccggctgtcgctcccaatcttcagctcatcgactcaccgtcgtgtttcttgttctccctcatcagtcggcctcgccgtggctaagtatgtccgccatgctatgtgcttcggtctttggtcgctgcctattgctcaccatcccctattcgatcttgtcgtcaagcttcgcctcagccttagctcatcggtcacgctcgtcagatgtgcgatcgaggacttcagctgaaggccgtcgtcaggcaactaccaaatcgagttgtgatgtggtgagccgattcactatttttattatcggttttatgatcgtaaaataagacacttcgtatacgtatacgattaagttagaaattctagtaatgcgaggtgtgcacttggtaattatggctagattcgttatatgtcgttagggtgtgtgatattagggagtcgatgatagaagtgaaattctagttgttgggcgatgacgggaaggacgttgttcatcgcgtgcttaatgtttgatggatagtatgaactgaaatcatcgctgttctcacgaattttgtatcgactagtaatagtacactggttcgctagtttttattattagttcaaggcttggattaattagttatattagttgcgtcagttctctggacggtagtaactgtgcgttgtggttgtattaattgtttattaaaatgcttcatcgtatatagtgtattggtttatataaatgtatacatatgagatgtgtaggtgatgagtaggataggtttagtgttctaattaattagctgataagttgtgtttaggctaattatattaaatatgtatcgtttgttgtttcatgatgtttgcgttagattcagttaatctagagaagtacaattattgcgcttagtcgtctgtcgataactagtgttttcgtataaaatggtacgatgcttcgtcactaggtgtttaattcgctatcgcgtagcactatttaggtttgtgatattcttgtctatatgcattcatgtgcataatgcatttcattcaggtacgttaattaatmgcgtgatgcggaagacgagccaagttgaccccaagcgcgggctaatcmgcatggtgatgctgatggacgaacctgcctgatcaagtgctaggacaaggctgatcgccaaatggatgttatctaacaaacactaacatagtgtttattccaggcaagccccagtgcatttgccccttccttccttgtgttttaaatgcttcaccttatctgatgcattaggtgataggagttgtgtgataaacaattgatgcattaccattcctgggaaactccttaatcctgattttataaaaagaactgataatgcttagccctgcttagaaactgaaaaatcatttgttttcaaaaaga

SEQ ID NO: 7192 - DNA, 270 bp, Zea mays
gctgacaataaacttgttgaattccagcaatcagggaagtcaatgcttcgataagaggttactgacgtggacattgctgagattgtgagcaagtggactggtattccagtgtcgaaccttcaacagtctgaaagggaaaagctgctgctgctggaagatgtacttcacaagagggttattggccaagacattgcagttaaatcagtggccaatgccatccgccgttctagggcaggcctatcagatcctaaccgtccgatagcaagcttc

SEQ ID NO: 7193 - DNA, 267 bp, Zea mays
gccctgtggcccgtgccaatgccagcgaaaccatgcaacggacgttttcagctactagttcctgaccaaaagctagttgcggttcgtcggtgcagtgcaggagggatgtcatgagccaccaccgccatgattggagaaatttattcgttcgatttacattgcaggttacgctcataatttacaccacaacaggtggctagctagctaatcctacatacaccgccatgattcatgcatagtacaagcctagcctagcctcgcgtcctt

SEQ ID NO: 7194 - DNA, 1284 bp, Zea mays
tgggtgaccttgactactcctttaagtaggagactggccgcgccggcgcggttcttggcttccaaggacgagagaggtggacaggaaacaatgccttccctcgtattccaccttctgcgggacccgatcggtgggtgcctgccgttcttttccgtcgccgacaagggaaatgtgggtattttttttggcgaagacaataatcttcatccttcttcgcttctttgctgccacagttcgatgccattctatggaccagcggatcgggctggcaaaaattgcgcggttaatatcaagttcacgaatctaagttgcacgtaaattatagtaccatactgattgtagctctataattccataaatgacagccccaatggaaagtacacaagcatgcgcgcttgaacacaaactatacatgcttttgatggttacataggtctggacatacacattgccattcatagctcacttcttcgctgaatatatggatttgcaaaagcttttggcaaacagagatagttaagaacagtgaccagcagtgccacaaaattgcggatctcattaagaaaagagttgcaattttacaacaagagaacccctgaggagttagaggcagccactggtttcttcactagataatacacgaggcatctgtgtttcagtatacgtttgcgacagactatactctcatacaagctatacaactatgattggattaacagccaatagcactcgtcccagatattccaccagcagcagttcggcccggcagaccaaagggaatcaccccaatgcaaatcctcaccacctgcggcgcttcctgccataccaatacccaattgcagcaatcgacacagctgcaatgacaccggctgtggcatgccacgcataagtaggttttccgacaacagcaagcccactgtcaggcacctccttctggctctcctgaatggcgagtgccaggccttgtttctcgagttcacccatgtctgtgaccacagcttcccgccgaacagcgatcgatatggcctcgtactcttcccgacttccgccttcaagaaacgcacccgcgatccgccctttgttgacccaatatgcaccgaacctcggactgctgcttgtgaagtctccaaagtggaccacttccccgacattatccccatagaattgccaggacaacgtgaacactctggagtagaagaacggcaggtaatcgatgtccctcgtctttgaaggatccaagatggaggcaacagcatgtctaccagttctacgagctgagtccac

SEQ ID NO: 7195 - DNA, 110 bp, Zea mays
agtacgccgcggagatccgtgacccggcgcggcacggggcgcggctctggctcggcaccttcgccacggccgaggaggcagccgccgcgtacgaccgcgccgcggtccgc

SEQ ID NO: 7196 - DNA, 343 bp, Zea mays
ccgccgccgtaggtggggtgcccgccggtgtggacgatccgccgtccatggttactttgatttgatgatttgcacgagaaccggaggcggcatgctgcttgtctcccgccacgccaacagggatttggacgaagcggcgggtgggtaggtaaggagagagcttttaacgcggactagttgggtctcaagacataaaaggcccaaacacatgctagtaactactagagcaagcccgcccattttcggctcatgagcccacgaagtagaggcttggcttgagcttatcaagcactctctcgaactcgcgtccgtttgcagcaccctccgccgtcgagccgccgcg

SEQ ID NO: 7197 - DNA, 450 bp, Zea mays
ctgcagtgcctcaatgaccattagctgtatacgtactatggagcaataatagagcgccacctgatttctaattatttggaccataattaagcactcgacattgatttcttaggctcaagggaaatcgaaatgttcgatccaaccattattccaagatgcccagatagattagatagaaagcgagtcaagtaacggatggagcacatatccatccatttgcttgccgcccctgctccaccaccatcaccgtaccatattatcctatcctatcgagcaagagcacagatgccctcagcctgctctcccctcgcgttctcgccacggcctacggcgctatatataaagcagaccaaatgaccaatcatccataccaacacaaagccaaggcgcggcgcagccagagtaagcagagagttgcactaccgtgcttcttcagttcttcttcctagt

SEQ ID NO: 7198 - DNA, 63 bp, Zea mays
ggtgggtgtaggtgtagctagtgctgcgcctgcgcgcccccgcggcctcactcgaccacatgc

SEQ ID NO: 7199 - DNA, 384 bp, Zea mays
tgcagttcttttttatgaagatggtggatttgatgtacaaaatttgatagatgagtgcagtcggttctggacaaaaactgatgtgtgataaatatatttatatgattattgtgtaattaaactattaaaattatgatttttagaaaaaatatgtactttattagttactttaccaaaatattaattttaaattctattttattatatgttaactgatataaaaaagtctttgggattgtggtaacgtgaaggtaaaaactacgaggcgagttgttataactgcctttctcaccataaaccctaatcatcgttcgttctgttgttcgccgaagagattagataccgtacagtagattagaacaaaacagttggtgcaaagccgca

SEQ ID NO: 7200 - DNA, 240 bp, Zea mays
ggtctaggcctccattttgatgcacatgtagtgacaaaggagggaggagacttatccaatttaccaaaggccataccattaattcctcttcaatcactagaagatattgacaggaaggtatatagaaccagagataagcaagaaactattacaaactcgcaagttgaccaatctcaactgatactgcttgaaaaatacgaggttttgaaacttgagaatggcgagattcttagaaagtgt

SEQ ID NO: 7201 - DNA, 219 bp, Zea mays
ccgacccagcaaccaggccaccgctcctttcctctccgatccggatctccccayccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccaccc

SEQ ID NO: 7202 - DNA, 702 bp, Zea mays
gagacgtctatgtgtatgttggagtggttccgtgaggaacgcgctaagggcctaaggctgatgatttaggttcatgttgctgcgtaacacttaaaaattcacatgactagtgactacttttttgttagtccggtttgtaatttctgaaaacatcatttgtagtgatggttgtcttaagaaaacatatatcatataatatttacccttgaggttctctagcaggtgcttgtgtaattaaatttttttgctggcctttattacattgacggttgtcggttccagtaaaaatatgttgtaaaaccatctctagtgggccatttgtcttattcattttgtctaaataacaaaataaataagtcatttttaaagtatatataatgacaaaataattcataataaaataaatagtatttataaaaaattgaataaaacaaaatgttaaataagatgtttaaaacaataaaaaagtgacttatcgtggtacgaagggtaatcagtctcctttacaccaaaatcaatcatacacatggagtctccaccgatagtacatgcgtctattggcatatacgtactgactagtctcattctcatcttgtgtgttccgagagacggatggagtatatataaaccacccattgcccaacgtagctccgcaccgcacacatatacacaagcacaagcacaagcacaagcactctagca

SEQ ID NO: 7203 - DNA, 1500 bp, Zea mays
tccgatacaagcaccacgacatcgtccttatcgtagtccgtgtcataatcctagttggcctgtgctaccctctagtcatcatctcatcgttgtctgtctgagggttgccttccatctcctccatggcacaaccacgaccgacaaacaccagcgtacgtcatggctaattagttaggttgcccactacatggtctgttgctagaccaccagcaccacaaatggtagacttagtagcccttctttaaatcattcgtgcggagagtcaaattgaggacttaaaaagtgttacctaaacgaccttactaattacccgttcaccatcaataagatattgaaacaaaatattcaaaaaatccaacctgaaatacatttaactttcttcctcgactcctcgagcacattttagttaccagaatactgggtggatagcacgctagcgttgacggtttggcgctgatcaaatccaacgggtcagcggcggtaacagatggacatccagcgacgaatacaagcaccttctactatacggcacatagctgaaaacggctaaggcacctgcgccacgcgccaccggcgagcgggccccacaccccggaccgttccacaccacttgcaccaggcaccaagccctgccccacccagtacgccaatgcctgggaagcaaagcgaagcgcgtgacgagccgcgaattctccacgccgcgtgggcccaccgtacatacggggacacgttgctggcccacagtcactcgcgctcgccgcacgcagcacgccgccggcccaaacggacgcagcccgcttccttcccacgcgctcgtcctcgggccaggtccaatcccagagccttttcccccctttcctcgcggagtgtactcgcgggccccacggtccgccaccccaccccaccccgggccagcgcctgcgcgcgggccccgcccgcgtttctgaccgtttcgcccctgccccggggcctctttttttttttcccttctcggggctcctcccttccccttcctcctcgccgcccgcggcgacctcaccgagaaagagaaatctcgctcgcggtcgcggccaaacggcggggtcgccctcgcctctgcctccgataaatacacgcgctcgctccccctcctccctcgagcccagtcgcgtcgagtcgacgctcactctctctctccacgtccttccctctccacatccagctgcgtatccaccaatcgacagcgacctcctcctccacgcgctccgctccccctccctccctttcccttcccttccctctccctccctccctccttagccgttaagcgtcctcccctccgcaccgcgcggcgaggctcgtcggcgccgtcgaggcccagctgcccctccctacaggaagcgcccgtccgacgccgcgagcacgcgcgcctcctccgctcccgatctctccacgcgtgccggagatcggccgcggcgggctcccgatcccgcccgatctacccccgcgctcccggccgag

SEQ ID NO: 7204 - DNA, 886 bp, Zea mays
ataatacttgtttcatatttgtttttatatttctttttgaattcggatcggatataaatattattaagttgagataaaatttaaatgaataacatcttaaataggcaactttaagaatacgaatgataaagagtggatacaaagtatcgatcggccttttttaaatggatcgaatttgaataccaaagaataatatctctactatttacatccctaaaagtatatttgtaatgctattatttgaaagactgttatttggccttcttaactatctattgccttggtcttatttatttgccggctttttctccattggttctcgtctggctagctaagtccgcacgctttctttccttgtttctccaagcccccgccccctccccgagctatgataccaaccgtacaggcagatattgtagatagattgcccctcatgtctcgcgcgcttgcgattagtgttatcaacccgtaggagcagcaggaggccaggagcttatgtgccttcttgtacgctgccatctgtcatgtgaccaattcgtcgagcatcctataggcatcgggcaatgccaaatcctgggcagttgatccagcgtccttgttgttttcctgatgaattcggctgctggtgttagctattgaacctcgttctttcccctcacacactgatgaaacccgaagtctcctgttgctagtcggacagcgcgcgcggcggctgtttttcttgttagttaccatctcatgttacctcatcttacttccgtttccagcaaaaatccatgtgatgtttcgactaatctaccgtttgtgtgcttcaaactgttgcagggttatctcttgattcttggttggaaatataccatacagcagtaaggagaagtcagcgaat

SEQ ID NO: 7205 - DNA, 1500 bp, Zea mays
ccaaagaaaccaactgtttttttctcttgtaaatcatccaatatactgttctataaagacaaaagaactgctgctactatcttgcaccattgtatacatacatatgtgtttcacctaggtctctcttccttagttacgtggactataaataccaaactgaaaactagaactataccatgtatggccacatataataatggataccgcgaacaagaagaatacacgagtaaactaacttcttccgagacaatattcacatagatgtactatctttgttttaaaataaatatgcttgtagcatttatttttttcctaaaataaataacattaataggtatggtccgtctagttacagtagttttttttttacttttactttctctacttgtaaagtgcaatcctgaatagattttgactcgagtaatttttttataccgtagacatttccacaaagttctatgtttcatgtaagttctttttttaccgcgcatgcgcatccgcccaccgcccatgcactagtaaacaaattcaagagactgtttgattatatacttatgctaaaaattaccacatattttatgtcacacttgtctaaggttagtttaaatttttgtcacacttgtttagtttaaatcttgcacacttttataagtcatttacgagtgagactcaatagaaaaatctttctatatctgtggctgcaaactaaacacatgtctaacttgatcaaccatatctaatcttggatgacatcgaactaaacaagtcctaaatacaatcaccacaagcgatgcttgcacgaccgacgggaaccattttttttttccgtatgtgcttcagaggggaaaagacattttatccgtttgttaggttaattataaccatatagcctcagcaacagtttgttactcatcccgcctagaaggctagaaccatgacaccatcatcgggcaagaaatgccaaagctctatttatttattaacttgcaaaaaggcagccggtggggaggcagagcatggtggatgcaaagtagtgttgggccctccgcctttgtccctgaacggccaataccgtctgctctctccccttgccccaccagccccagtccccagcccagcctacaaatagcaccccagctgagcaaccacaccatacatgcctgcaacaaagcctttgttgtgtttgtgcaacagcagcagcacagacatttagctccagagtcgggactactagtagccaagatcacacaatttccaagaccaacgcgcttccaaattcccagcttctgcgcagtgtgcatgctctgcccgcttctctgattctgatctgagtctgaggtaagattaagaagcctgacacgccggttaagttagccggttactcaagactctttgcaacaagagcgccagtcatctgttgctcacgtctctttacgatcgtgcctcttcacagggagcaagcgcgactgccacttcacaccttcctccagcgcggcgaag

SEQ ID NO: 7206 - DNA, 1273 bp, Zea mays
gatgacacaatccatgaaatctgtctagaaggtgattctgaattgaactaaatatatagatttttaggaatatgttgttttattgtacttgttcttgagattttagatttttggtagtgaatttggttcagaaaagtcaaacaaacacacccttaacagactatcgattatataagtgatgatacattccacggtcgatagttataaaaaagctaaaatatgtatggttgaaacaactattaactatagattctgtaaaaacatgatagtttggtaacatggatggcaacaatatagaaaatctgagtacaagttgtttctaaattgaattagagacatatgtagatttttagaaatatattttattgttgtactcgtttggttgagatattggatctttagtagaatctggtttagaaaattgaaccaaacataactttaagcgacgtaaaaaactaaaattgtgcataaaagaaaatttgaactgtgtttgtgctttaaattaaactcacgtccatacttacctaaccaactgaacaaacatatcattatgttttatacgtctcctatcgttttcagccataattctgggtatcgcgagcgacgcgcgaggctgggaatagccgcacggtgcgttgtcacgtccgaatcgcttctgccgtcgggcggcttcgtctcggctcctttttcgctgcacgttttggcccttttccagtagaagaagcgtctaaggggacgcgcacatgcgcccgcgtggcagaggctgacccgaccccaaggccgaacgggggaagggcggcagccccagcctccgggtagcgcagcggggccaggagctcagctccccgcctcggcctggcctggttcggccccgctccgacgcgtggtgggcgcgagcgcgaccagtctgcgacccccggcttcaggtccgttccgcagttccgcaccccgcttcgaccaaccaatcgccgccgcgtcgcgtcgcgtcgcctccttttttttccccgccctcccggacggcggcctcgttcgccagaagaaacccaggctgcagccgaaatcctcaagtctccgtcgtctgaccccacctcgacggcccagatccactcgccctcgccgccctcgtgcccctcagtccctcactccctcgcctcctcagcggcgaagacagctgcgaacggggccatttttaggcgggagcgcgggcggcggtgctagcagattggttggtttgagtggttgggccggctcttcgaaacgccccgcggcggcg

SEQ ID NO: 7207 - DNA, 399 bp, Zea mays
gcgaggtgtatccattccacccctcgccgcgccccggcaccgagccggacggcggacgccctggacctcatgtcctcctgctcacgtaattggagcaacggccattatctgctccgtcgcgcacgcatgttctcatattccacgcgcccccgccggtcgtaaccaccgggcaaccaccgcccggctcactcagtacgccccgccccaccaccagctcagctccagccgtgcgacgctgtaccccgcccccgctttcagccgagcccctatatcaaccaaccccaccactctctaccctctgtacccatcgctcactacgcgaccgctagctactccgatcggatcctgaccacgcccgcctaccaggccaccaccaccaccaccacccacaaatcccca

SEQ ID NO: 7208 - DNA, 218 bp, Zea mays
cctacagctgttaatttgcttcccgtctcctgcgctccccctctctctctgtctttacactgttgcttctttcttcctgctcctctctctaggtatagcagcccattcctccacactcccacctccgctcatcacctctccctctcctaccatctcgtcggctcctcccccgtcggccgacccgcttctttaatggttttaaggtagcgcgctagttc

SEQ ID NO: 7209 - DNA, 287 bp, Zea mays
ccgatcctcacggtacctcacggggataagcatgccgatgatgcgggcacgccagcctccgatccgtttccaccgccgcgcgcgccgcccggccgctcctctcgttcgtcttgtcctctccgcctgtctcgcgtgtcctcacccttcctccgtcctccgtcgtccccttttctttaatgacaaatcggctgcgagccaagtggggcgtgcactcaaacccctcatccccatgagaccgcacgagttggagcaaggctcagtgcccgcctgcccccgcatgccgtgcg

SEQ ID NO: 7210 - DNA, 1500 bp, Zea mays
tactgcaagtagcatggcagacgacgagcaagtgaccacaacctatctgtctctggtagtctggtcccggcgtccaacacgtggtgtcgagatgctctgcatctgccaagccccctgcccccattcccagctgacgagctgctcaacaagtctaccactgtaatgtctgaaacccagaaccagaagccagggccagctgcagctccataactaactagtgggcgaaaaaatttacaagtactactgctagtactggttcatgtctatccatctatctatcaacctatttttcatttctactcatcatgtgggtgtatccgtgtataatgcactccacaggccacagcctctcgatcgcttagctgtctctagctgtctgmtgcctcgccgccccctcctcctctcatcatgtgatctccctcgtctccatccacccttgctcctctcctacttgccaccctttttctccagtaataaatcaaaacaaacaaatggaccctccctaggtacctagctagctacctaactaactaactttgcacagatacctaattactgtacctttggataactaatcataaggctagggagctagctacatgcatcgtcaccaaatccacagcaatgcaacaaagcaccaacagctcacatggtagtagtcaatctcagcgttagtacaaatcttagctcaagagtcatgaaacaatgccagtacaaaggttagctaggagcagttcgttttgcctactaggaaacaaatatgaaattattgccctagacatggtagtagagtactcctactaagagcagtctcaacccaagagtttttataggctccacatcatctagaaactactgttagacactaactctccaatgcaaatcaatattatttaactgactttaatactcatcttcgtgttgaaaccaagtcttatgcaagatccagtttcttaatctttcttcatttaattgcttgctatatcattggcttgccatatcatcttttaatatctatgcaacagctgaattaatgctataaaaactggatgacgtgtagggttgggactgtgctctaaaccacctaacctaccagatctcttggatcttgatatgcatagccctaaacacatgcgtgatgctgcaagacaaacagcctctaaaggctgtcaccaaagcatgcagatgcagatgcagtctctatcacgaactaatgcattgcaagtgcactgtgatttgccccaccaccgccaggccccccatgcatgtgcacctatgcatctccacctacactgcgttcttgcaaccaataaccatatacatacacacacactaataactatatacatacatctccaacacagctagcaaaggcagcagtcgagcactccaccatccagcttcgcatcccgcaagttcccagtcagccgagcagccagcggcggtgccaagaaggccgagctgcgagctccactccccacacctcagaagaaaaaggtg

SEQ ID NO: 7211 - DNA, 425 bp, Zea mays
gttcggttagctctgaatccatgtaaattgagtgggattgaatgagtttaaatctcaagcaagttaaatatcttcttaatttttttccaatcatattcaatccagttataatagaaataaccgaacaagcccttgtcagctatatcgagcggtgttcgcgcgtgccaatccatggcggccagaaactaatcagatcacacggaccacgcacacacctaatcggatatggcgcaactgagtgattagttggctaattaatccaggcgccccgaccggctcgcctgcgtcgtcgtccactcgctgggcgcagggcgctacaagtagccgcgaaatggcgagagcagccgcacagaaaaaagccatcaaagagcaaggcacagtgctatagaggtaaacgggggagaagacgagcgaggccgaggaca

SEQ ID NO: 7212 - DNA, 1500 bp, Zea mays
taatctcgatccacatgcattgaagtggattagatgtaaaattaaactaatttacatctcaatccaccttagtacatgtggattgaggtaaataatagagtatccaaacaaaatcttagggatttcagaatgtatgtgtgtcaaccggctgaaggaaagctcttcttcatttctcaatttgttgaataatcattggtggaacgtagattgccgacataacatacaccaattgactgtcgaccaccgagttgattagaacaactctccgtattgtattgagcaaagaagcttgccaggaagaaaggtatttatctgttctttcaatatatgtattagacattaaggttgatgaaaaccttagtttaattttgctaatttagtgctaaccatttagactaaacttttttgttgaatatgattagatagggtctacctaagggctcgttcgatttgaagtggtttgatgaagattgacgctacgttcggttttctggaattaaaaacagacacggttctgttcctgggccaagttcaatgaatccggttggttcactcaaacttggttggggttggatccagctctaaaataaaacacggtggttcactgaatgttgttcgtttcggctaggatttaggacatgactgatacctaccatgctttgtttccaatataaacatgcgcttgcacatacatacactgcagatggatacatactatactagctaatggatggatccatccttattaaatttcagtactatgcatatgcacaacagatgagacttttgttgcacaactgcagtcccgcaatgggcaatgtttcattgattaaaataaagaaacctgatcaggacttgcatgttcaacagacgcaacagctaagcatcaccaaccaaatagttttaaacagcaaagcaacaaacaaattatagtcttgccaacaaacgcaaagaacaatcttgatagactgacatcttcaacagctaagagatagaacatatgtgctaagaagaaacatcactttagaactaagcatgtcagttcaaaataagaaacctccagatgtgctaagcatcatcgattgatcacccaaacctgtccaaacaaatggaacaattagattggaagataaaggcccaagtgaatatggttgagtggaaggtaaagacacaaatatcatacctactaagccatctcatttcttagccaaatcaaagctgattcttgatccgcttcacatgcacatatgaaagtctctctattctctttgctcttggtgaagactgaatatgcttttgtattctcccagtttggtcacttcttccattgtgttcagaactgatatgcaccttttgatggagaaatcttcactttgagctgcctccttttctcttgtctccttttctcttgcttccttttctcttgcttccttttctcttgcagcttcatcttctacttgcttgctcctcatttctaggtatttgttcatcatattttct

SEQ ID NO: 7213 - DNA, 544 bp, Zea mays
tgactaaagttctaaagcttagtcactttagtccctaaagaagtaaatatggtgactaaaataaggtgactaaactttagttctttagtcaacaaggggtgactaaagtataatttttaccgtattaaccctctctattttcttgttacaacaaacatatactatttaataaaggtaatatagtcattattcacagtaattaatgctctttagtcctgtttagtcactgaaaacaaatgggaccaaacggtgtactttagcgactaaacttttcactaaagtctagtctagtgactacaaaacaaagccttattaacgcagattacattataaaatgaagtttgttgtggttctagataggctaataaaaaagcggataaaggagaggagcgggcacgacggctgcaggagacccgtataaatacgatctggtttccgttcccaatccccttcttccccgactcgcccggcgctgaataagattcccctgtattctgttccagagatgagctgatcgagcagcccgtcgccaagccaaccggac

SEQ ID NO: 7214 - DNA, 492 bp, Zea mays
ggttctgttgttgaattcaattacatgggcgtggtggatggcgtcaaactgtgaacactagtacataatataaaccattcttagttaattatcccaagaaaaggatgtcatgagatagtaactatactgtcgtgaaattttcgcataccaaacggtgcctacgcgtttttttttcttctagaacagaatctgaactgtttttctactcctttttgcagtaytgcagtctgaagaattcagtggcaccacctctgcttcttattgatgataaactgtcagtgaacataagtcaccatctcctggatcacagtttttgtactggagcaagacagtaatggaccgggcagacacatctggctttgttagcggtggatcagatggtacttcactgctgctgatattctttcacttcgtctactcgactctgcacgtataagagatcagtaaaccaccttcactgtatttttcaagtacgtagcctagatgaatacc

SEQ ID NO: 7215 - DNA, 986 bp, Zea mays
atacagatgtttcttttttacatgccgaagcttacccgacattcgcatgcaactttttttttcttggtttcaaaatcgaaatagcattgctaatgttaatccagcggttcatttctccgtgctgtgcctgttaattaacgtatcagttagttaacgtatattctgatgttcaggataatatttatataaataaaaaatatagcgaaaataaaatgatgttcctataaaataaaatttctgggttacgtaaggttagggacgacagcaggcccgggttaggtctgctaaataataagacttcagctcgtgctgatgaggcaaagaacatggttaactgatatgcagatgaaacactacatatataataaagccaggtcggtggcaaaggattttaaacagcgatatgatatagattataaaaattgcaatgtattttttattacattctagaggagaggaggaagtctatcttagtaaccaccggagtatgagagcacttcatagcccaatcatgtgcaagctgtcaaagctgtttatggtatgaagccatctctaagagtttgatattttcaattcaatgataaatttctgtatcaagattttcatgctttaaagacagatatttttctatttttaaacaaggaaagtgtctccatattacatgtacggactcatattgtttaacagaacaagatcttttcttagaaacagccgtacaagatgaatattctcctggaattgcgagtgtgataaactcccttatctactgggccaggtgagccagaaaataaaaaataacgtctgggatgggccagaaaacaaaactggattggatcgaggcccggcggaagggaagaagatattttgcggttttgtgagttgtgatggcttcaggcagtttggtagattgtggcgatagaaggacggccagtttagcctagccacgctcgctctacctcctcaatcctgattagcttcaaaccgcc

SEQ ID NO: 7216 - DNA, 671 bp, Zea mays
taatagtccatgatatggtaaaataccgaaataaaggattaaaaacacaataaaaaatccaactagtgtcaaatcacaagccgtgtttgatatgccttgactttcgcatcgtgtggagtgcactggcttcacatgaacggcgtcgccgcgcaggcacagaaggtcccctgcggctgcggtcactgtgcatggtcgaatttgcccatcctgcattgttctcatggtcatgaccctgacctgcaaggacaagtcgagacgagacatcatctcttctctctccccatctctcgacccgacctcgctcgccgtctctgttgtgccctgcccctgtcccttttctctctccgcctccgccccacctcggatcgagtccaagccgccgagcccactccgctgacccagagcctggaaacccccaatcgagcccgaccggagcccgtcgattccgccggattcgagctcccgccgggtgaggcggtccgcccgaatcggccgattggactcgaattcgggtggtccggatgcgcgcagagcggaggctcgcggatctagggtttcggagggcctagggttagtgccggtgatctggtgatggtggtgcgacgcggcgccggagctcggcgaggaggagggttcggcggcgacgttggggaagatgcagcgagccggat

SEQ ID NO: 7217 - DNA, 439 bp, Zea mays
cccgccagttctctaggtaggctgccgcagtagctctgcagctgctgacctcagatcaggcaattcttgggatgcgctgccctcagagacgccgtacttgccctggaccagctgatgctgatctcgtctcccccgttgcaaaccctagttctttactcctcttttctcgattaagtagcagcaggatccaggaccacgaaatcccgagcttattttttgcaatttgttcgtcttcccactttccgaaagcttctctcccttctgcacaagctcaggattataagtagcacactacaaggagcatgtaatccaactcgctcatgggtgatggcggcgaaaaaacttcagtcttttgaatcgatatttcgtttcccggcgttgccgtcgcactaatcgagcgggctgcatgcagatctgaggcgagtagcaagcgaagaac

SEQ ID NO: 7218 - DNA, 550 bp, Zea mays
tatttcgtgaatcaaacgacacctatagattttaaagctggagaacgaagctatagaacttaaaaataaaatactagagatgtagaaaatgtgtatagagaagaagtatgacatgcatccctgctcccgagcgtcagctgcttgctgccctcccaatcgagcggcagggtcccaccgcccaccgagctaaaggcatccaaaattgtactagctatcttgattcttaaatatttattattcgctagttcatttctgaactaaaatgtgataaataaaaagaacgtcgagagattaatatttaaatattaatatttaagaattaggatataaaattaaattttcaaatattttaaaatatataaatgaaaaagccaaagttccttttcgggccccaatctgctaaatcttggcccatgtttagacaagcgtactacgtgtctgcgtggtccgaatatccgggcatccggcccaggcatgaacggtcggttaaaccggccaatcctcctctcaagcctcgacgcagcacggcgcgccggcgcgggacgacggc

SEQ ID NO: 7219 - DNA, 85 bp, Zea mays
ggtggcatggtagaagttcatatacacaataattctttgatctcgggtgcccgtggttcttggccggtaatggaattgccttgcg

SEQ ID NO: 7220 - DNA, 1500 bp, Zea mays
ggatgtgtagcaaaatagttccatagtagattcactagtatatctagattcaattttttattcgtggagttatttcagatatcccctcaatcttatggtctgatactctgattgtgttgtgcagtcaaaagaatcatagacaccatagatctctggcgattgttgcggttggcgacacaaaattggaacttaatgtgttccaaatagcgacaatgcctcactcgaaacaggtgtggcaattgcagcttcatttgcttccaagcaaagaggaccaatgtttcagtaaggttgtttcactcactattttaaactctataatataatttacaatttaaaataatgttttatatgactatatatatgctcagtcgattacagtctaataacgggacttctaataacaggacttttgattgtctttgtctacaatggtttatcaatttcacccttcctacacatgaaactcgcactaggtacaacagctatgacagagaacaaaaaggtagtcttttgttgactaaggccttgttcgtttctgccggattggtaggtcggaacgattcctgaccggattgtttctctaatttatataaactttgattagctggaacgattccagttataatccgacggaaacgaacaaaggactaagacgtctccaaccgtctcctctcccctcaccgtatttgctattgtggtctccaaccgtctcctctctcctcaccatgtttgccattgcattgcatgtacaacgtcacaatatactctttcaacaactcaccccgctctatgaatgagggagttttaagggcatgtttggttcgtatctaactgtattacactttgcataaggttagtcgttcgaattgaagaactaaccttcgataaaaaaaaagttaggcaaagtgtagcaaattaarcagtgaaccaaacatgtccttaatctccctgyttccattatcttaatttaattacctgataataatgtgttgtcttgttcttgattcatagcggttgaaaataagtgaccaacaatattcgttccaaatttttaactacccgtatccgttcatgtatcctggagaaatatattacgttaggatacagaataactttgtatctagttcctgttttcatccctaagcagacagcactgtcgcaagccataatctgcaataacaacatataattgtgccatccaaaaaacgtaattattgtttgttcgagataatgcgctaataacgtgtggctagttctagcaactggatgtgggtgcctgcagtgtgggcccgagcaaatccatctcttgcgctcgcagacaacrgccttcccgccgccggtacaatcagatgcagatgctaatgatacagtccgtccagaccccacccgccgccgcccacctccgcgctgctgcgcccgccagcacgccaccgctcctcgcgcgcaggctggccggttctcctccagcttccgcctccgccggaacaatcagatgcaggc

SEQ ID NO: 7221 - DNA, 1500 bp, Zea mays
tgactgtcactgtttaaaaagcatattaatacagaaatgtcggtaccttaatttattatagaggtggtaaaattttaaattatttggctttttaagaatcaagaattgagtttttaatagagagtgcttattatgtaggatgaagtgaatctatcatgcgtttgttcgcttcggctgcaattttgaactgctaagtattataggctatagctttgaactgcagcagcttcaaccagctcaagcaaataagcctaatgttatagtaggtcacttaaaaagaagttataataataataattctataattggtcatagaattggccacggagtattatgtgtgtttttttaataaaatctgacgcatatggtcgatcgatacaagagtttcagggttaacacacgcgtgtcttgcaccgatctgttgtccctatatatgaacagtatgctaattctttgatgttgtagctgccccagaggcagtgcgttgtggagcgagaggaagaacgcccatcgcacacgaaagcctcatatcctttccttgggagtcaaacgtggatctcccgcgtccaagccttcctccgcgagtggatgaagcggacctgtatttccattttcaccttttgggaacatgcaagacagcaacccgagtagcagcatgattcacatgattattctccgcgcaccaacggcatccaacgaccagatgaaataatttgtaagctgcaaatataatataatgagcaaacgaaatggttgaaggacatacatatatacgggcccaccttattttcagctcctgtttgaaatcggattaacacaaactcaaaaaagctatctggtgacggccggggtgcgtgcgatactttttttgttgttgtacagtatggttttcagtaggcgcgcatgtcatgcataacgaacttaccagttgatgataaatgttccattgttgtttttgcattttgtgtagcagattatatgtgaaaaaaaagcactcaacaaaaaaaaaaggcgtggttgcacagaaccactcaagacgacgtattgcttggcaggggatggccattggggaatcgccaaatgatcctgcctttggagggacgagaaatttggctccggatcctccacgtaagaatccctcccatcctcatatctcttgctccccgctcattggccgcatccgcatcagcatcacggcgcgcgcgtacttattctcccccgcccgccctagctgatctctctctctctctccctctcttcgttctcctccacacaccgagccgaccgagcacatcatcattctctcgcaaggcaccgcgtgtacgagctagccaagcggccggggcagaagcaaacaagctcacacaaaccacacgcggagagccagaggagtggtggaaggaggaggaagagcgaggggtcaagggctcaagctcaagagagagcgagtgagttcactcaacgtgcggcggcggcgacgtcctacgtcctacgcacagg

SEQ ID NO: 7222 - DNA, 956 bp, Zea mays
tctttttttaatttttttattatagaacctatctatttttgaagaagtggctccaaagataagagattctttgttttaaaacacattttcaattcaaaaattttagatgattttattatgtttccaaaataagattttaggtgttacacagaatcagaaaaaagctgaaacaaatacggtccttatttgccgctcgttttccctgcatatcagtttgttttagtttttgtgtaaccgtatattcacaactgttctcgtttccactgtcctgttttcagtaaaaaaaaataataacagaaatggaagaaagttttttcggacggttttcgtccgttttcatctcttcggaacagtggatccctcccctcgttcaccccacacgtgtctggctccagagccgtggttacgaaacgctccactccgctccgctttcccagttccggccaccgagcatggcaccaccccttccctccgtctcccgtggttcgcgggcgctcgtccaagcatccaaccccagctccgtgcgtcgcggcgcgaccaccggacctataagtacggaacgctcatgtccgcctcttgctttcctacctctccgcccccgttgcctcccaccgccgagacgacgcggacttcgtaccctctcaccgacgtgtgcgccgctgtcttccccggcactcactgctgctggttcggctcccgaaccttcgtcgactccgcatttctgaacagggtttgtgatcctcttcacctttttgtttagcggttgattcaattcctggccagctgaggatttgagatgcttgggttactttgtaattttctaaaaatgatcttaggttctgtattcaccacctgattattcaagcgttgcggttgaaatcttgtttgcagatttttcatacattccaataacctcctaattgtccgaaggtgtcatatgtgacgagagagcacag

SEQ ID NO: 7223 - DNA, 134 bp, Zea mays
gtaaacttactaccgcgctgttcggtatgttttggatctggattttcagtccttctttggcggcgttgctgcatcaggtgcaataaccgcggcgttaaggttcttcacaaaagcggtgtttgagaattccagag

SEQ ID NO: 7224 - DNA, 1500 bp, Zea mays
gtaacttaccactacaggcgttctagcttagctaatactaaattatctaatttcctcctcctaattttttctaggatgggtattgtggccaaagttcgtaccctgcaggagtatatctatgtatctggtgcatctgccacatgatttcaccactccattcagaaagactccaataaaagaatgcccatcttcaaaagtttacatgcagatttagagaagtgaagtcattgctcgccgaggctcataatcacactctgaccccctgaactgctgttgcatgctaaatcaaagacttttacctgtagtgctttctcccctgagcgaggaggcaactcctgtgagtgtgagttgttgcttgatcacaggttaatctcgactaacaaacggaagaggaagacgagactttttttattttttcgtttgatgtttcattccatctgattctgagcccattttcgcaggaaaaaccagagcaacgtgtgatggtcgataccgatacggcaaccatcttgggctctaaactctcggccaccgggacaaggtactacggtaagatggcaggttgctatacctctcgctgacatgccatcttgccctcgcaacgttgacatgccaacacgaggcacacacagcatgatgctaggatgcccttgtcaccatgcacaagcttgaattcagataagcaacatcgatgccataataataataaaaattaaaataaaaggtaaaaccagattcgaacgccatgctctgagtccagaatattgggatgctctcagtctcgtggttaggaacaagcaagaacacggaagtttcaaagctcacagaggcctgccggcaaccgcctattggcccaaaaaaaatggctctgttacttttagatcaaccagctagtggccaaaaaaaaaaggcatgtcgccctccaaagggcgcacatgtccagtaaagctgaacaaaagcggcacccatccattactccagtagcgtgcggcttcagctggagagctcagctcgcgccagaattcaatccgctgaagatgcagcgcagccatcagcgtgatatagcacacccatctttttgtttcagtttcattatcattagtagcacatgaatgagtgaaaaggagaaacgtctcagagagagacgagaccttcccaactttcctccagaattaattattatcgtcactaaggctgctgttactattgattaaaatttcaagatgccaccagatcagctagagtagagagagagagagaggccatgcatgctctcatggcgaacaccaaccacaccacaaatatgctacgtgtcttgcaagcaaaaccagcatctaaagccactagcagcagcagccaccactgtatttcgcagctttcctgtcacatacacatgctaaatccatgccctccacggccaccacctctaagcatgtaacgtaccgcgcgcagctgaactcggccgagcaatttctgctctgagtttgtcaggtccgagag

SEQ ID NO: 7225 - DNA, 1500 bp, Zea mays
attagggaatattcttctcagatccggaaccattccgctccaaaaaatcaaccgggcggagccgctccgttcccatcccgctctcacagtcacgctccgttccgttcactttgcaaccaaacaaaaaacagagccgctccgttccaaattaccaaacacagaacagagcggctccgttcctagaatcagggatggaacggctccgttctacttggctcctcaaccaaacacctactatattccccatatatatttcctgagttgtttatagaattgcgtgaaacgcatgcaacaaactgcacgtacaataaatcagttcctcctaaccgaacaagcaggatgagtgtagaatacagaacggtgtctctttcctgccgtgtatgcgtgcgtgtcttagtacgtattcaacggtgcactgcagaagagcatacgtacggcggcctgaacctgcgatatgggaatgggaaaccaagcgaccaaactgctagttacttaactgttccgtgtgtacttgttcttcttcccatcatcccagtttcatgcttcatttgtgttgactcaccaacttcgttaactagattttctttggagacctcaccagatctctccgctttatataaaccctagaggcctgccataagcaaacacagccaaaacaagccaagtacaagccgatcgagtctccactccagactcctcctgcaaaaggcatagcatcaagaggctgtgtaaaatttgctgtgtccctgcaaaaggtcatgtcatctcccatggccaccataacggctagtgccagtccagccatgcaacaaaccagcaacaaggctacgacgagtgccactgtcgcctcgccggcgccagtgcgctaccggccgtcgctcttggtcatattaagtgcctgcctcgtcctcatgggcgcaggcggcccgctccttctccgcgtctacttcgtccacggcggggagcgcctgttcctgtccgccatgctgcagatctccgggtggcccctcctcctcccgcccatctgcgtctccctctaccggagccgcagccgcagccgcagccacggcgtggcgagcctcctcctcccggccgcgcctcgctggcgccgcggccgtcctcggcgcgttctacgccatctcctgcttcctctatgcgctgggctcgcaggctctgccgctgtccacgtcgtcgctgctgctggccacgcagctcgccttcaccgcggtgttcgcgttcctcttcgtgggcctccgcttcacgcccttctcggccaacgccgtcgtgctcctcaccatcggcccggctgtgctaggcgttggccccggctccgggaagccagctggcgaagcctcgcggacgtactggatagggttctgcgaggcaatcgccgcggccgcgcttgccgggcttgtgctgccgctcgtcgagatcgccacggcgcgctacggccgtcgcaccggacccgcggcgagagtgccaccaccgtacgcgaccgtg

SEQ ID NO: 7226 - DNA, 607 bp, Zea mays
tttggagctccaacggttcgataatagggtttagcatatcaggtcttatatttatggtacgagagaacgagtcatattattatttgatgatttttttgaaatagaactatattaaagcatattttaggtgctagtcatatatttcaaaatacaagtacaacagaaacaaatttcatgcacgactcacagtagatctaagaaaacagcacagcagcagggcatatagttccaaacacgttggttttattcgtcacacgaaaagcgccgcaaaaggtaaagaaagaaaaaaacaaaagaaaaagaaaaggaatggcgaaataacaaaaccacctctgcacctccataactccattgcctttcgtccttcggcttctcgtccctcctcgataagcacgtaataaataaacaaatttcatttttctccctgtcgtcctcctctgcttaactcccttcacctccacctccacctccacctcggcgtcgtcgtgcgcttcgatctctccccccatttccacgcggaggggaggcgtcggcgcaataaaaggcggcgcttttgcatcgcccctccccggcatgcgtagctagcctcgcggctggcccccacgcc

SEQ ID NO: 7227 - DNA, 437 bp, Zea mays
aaccttgaacattagcaaagtaattactgctactgcagagtcaaatatccttcccaatagcaatgatgccaatgatgccctctctctaatcagctttctcaccgacggcgaccgaccgaccagccatataataaagaagcgaagctaagcgagaccggaggggcacgagcgccaccgccttgatcccgcccgctcctccccagatctcctcgccattgccgccgccctgccaggattcgcgccctactcgcccagatccgaccgcggctctgattttccaactgacgcaggagcggtgggtctgaccgggcgcgacccgtcttctcatgggcgagacagcgtgatccctgcggctcgattgtaaattcgtgatctttcggggcattccttggtttgtctgtcggtgctggtggtgctgcgtttggagggccgcggag

SEQ ID NO: 7228 - DNA, 1500 bp, Zea mays
tttgcatggcctcaaatgctgttggaattaactaaagtaattttaaaatgcaattgttaaatggccacgatggtgtatgtattttgtacactagctcattccaaaggtcgttatgttgctgatgccacatcactttggtcaagtggaataatattaataagaactagaatttcgattcgaatgttacggtttcaagtccgaccagatttgtgctctgatgatctccggccaccaagcctggttaaaatatctgttgtaaaatgaaatcaagttgaggtctttcaatccatatagattggaggggattgatacggattgaaggagattttgacttactagggattgaaactcactcaatccatatggatgtagaaccgaacaagccctgaaggggcgtacactgcaacgtctagaatcagttcattttgcgctattccaagagaattgctcgtgatgcttactttaatctagatataagttgtggttttggactgagtgaagagcgtgtcaagattgctaatgtatggcgactcggaaaatgcacaatcagatgcatccataagcaactgtataacagaaatcattaatcatcaagggcaaatacaggtcttctcaattctgtaataatagcggtcatggaaccacatccatcatcatcatcattgcttgcaacattagcagcagcagcaatggattgcataacaccaccagatacatcattacatgtacttccacacaagtacgtagttccagttgtcctgtctcatgccaacacctggtacatgatgacatttcagcaatggatcacggtgccgcgggctgtataacggatgcttcctcggcaaccgcacaaggaacctccaactgctgctgcggtgctcctgccgcgatatctgtctctgtagccacacactgaggaatccaagtaacattctgctccacaagcctttcgacagggaccttgacaacatcacgccggacaccaatatccgacacataccgcccgacacagtacatgccgctggtcacaattgccaggccaccagcactggttgtcaggaaacgcaagggggacgaggccacggcgctgaaggcagcagtcagagacgcaagttgcccgctacggccaacactgaaagcggtctccacaagcagcccagtcttgcagtatatggcgaagtcctcgcagttgttcttgaacagggagtacatgccaaacccattgtccaggaggtaccgtgcacggtggatcacaacgtcactggggtcagaggcagccagggtgcacgttcctccccgtgctttggcgaggaagaaagcaggcgacacagcgtagtcaaagaggtacaggctgcccccatctaagaagcaatcgaggcaagaggtgatgaccccatcggacttgactaggtgcccacatttctggcagggaggaccctcagttgctgccggagaggagctataaaggaaccagtccaagaatgttcctgttccaatctc

SEQ ID NO: 7229 - DNA, 427 bp, Zea mays
gatctagtttaagtgaaagttttggaagttctaattcaccccctcctaggcgtctcccagttttctacactcatcggttcgactcggctcggctcggctcgactcgactcgtttggtttcaagacctataataacatattgggaactaggggataatgtcgtactgaattcgtgtaaattattattatgttaggatagaatagaaatcatttactattggtaggtatgatcccattttcaacttttgttgcctgtttggtttgttggtttggttccgctcagcggcgtcgctagttcgctgctggatccgctagtttaacttggcctcgttctccctgagccagaatccagaggctccgtccttcggctaggcgagatcacgtgtctgaatcaaccaaccaaaccctaacccttgcagaggctgcgg

SEQ ID NO: 7230 - DNA, 262 bp, Zea mays
tcgccgccgggagcagcgacggaggcgctgtagagggtagggtttatgggttttggcggcgggcaggcattcaggcaacgcaacacaacacactttggatttccgcacttcaggagtgtagtaggctttccgcctcccccagcaggacacgtatcacgctctcagttgaaactgaaatgaagggtgggtgggtgggtgcgacccacggtccgccgccgaagccgagctccctcgcaaatctctcgcatcgcgttcacagcag

SEQ ID NO: 7231 - DNA, 262 bp, Zea mays
tctgctgtgaacgcgatgcgagagatttgcgagggagctcggcttcggcggcggaccgtgggtcgcacccacccacccacccttcatttcagtttcaactgagagcgtgatacgtgtcctgctgggggaggcggaaagcctactacactcctgaagtgcggaaatccaaagtgtgttgtgttgcgttgcctgaatgcctgcccgccgccaaaacccataaaccctaccctctacagcgcctccgtcgctgctcccggcggcg

SEQ ID NO: 7232 - DNA, 61 bp, Zea mays
gttaacttctgtttgcgccgccgccgcgtacgtgtcgtgtcgtgcctgtgtcagtagcagc

SEQ ID NO: 7233 - DNA, 870 bp, Zea mays
ttgttaaagacaagaaatttgatcatcatcaccaatttgtaagcattctcatattccgttctctggttcaacttcttcaaagtgggctcccgacggtggcggacagctccagtattcgcgcatcctggcgcaaatgggcggcagaaggggttgaagggcctgggaggaggcgaggcgaggcgaggcgaggcgtgtgcaggcggaggtgaggaacacggacgcgagcgctggatcaaagaaaaaaagttgggtccggagtctgggctcaggatgaaaactgttttcgaaaatcatcgtatcgcttccataaagtcaatatcgtttctgaaaattaccagttttaaaattttcatttcaaatatctgtcaatattatattatagtcgctaagaaatactctcactgtttcgttttagttatcgctagatagtacaaaattaaattatctagcgacaactaaaaaacgaaggaaatatattaatcgggtaaatttctgagcgaccggtaatcgttttgctaccggcgatatcgtttcccaccgttttggattgttttcgtctcttcggcacgcggcgtggcctacaaacgcaccaaacgcggagggacgctgaaagccgagggagttttataaagaaaaaaaatacagaggagagaatctcctgtgctggagttgatccaccgaaccctatttggccatgtggtctgacacacccgtactgagtgccgttttattataagctcagttgagtgagtcgctttcggcgccatgtctcctacaccaaccgagaattcatataaatacttgccgctactgatcatcgtcatgctcgatwaatctctccatcaggcagcacctagctagcagcagcca

SEQ ID NO: 7234 - DNA, 1500 bp, Zea mays
gtggacatgttctgatcacgtaagcttagccttgtcgtttgcacctcctaccagcctaacgacaaagggtttctaattgtaatctgtactatggcaatgaagcctaaccaagctactagtttatctcacgaactcaagccaatgcaaccaatggcgtacgcgcaggtggatctatatccgaacttattagtcgagctagctagaacaattttattaatcgctagttcccactgcacgcgtagtaatattgaactatagacctgcatgcccacgtatttgtaggctagctgatgctctgcactgataagctaagcaagctagctagtagtaagatggtcagcgacgacgtctcgatcgaatgcagccgaacaaatgttcggtattcctcgtctcggttcgtctttaataatcataccacactggatccatcaccagacatatatggtaacacaccgtggccacttcggatccactgctgactgcccagagagctctggataatcgcatgcatgcatgcgcttcatcatatatagccgcggcgcttatccagattactaagcaacgtgctgctatgctaaatttcagatcaatctactacaaacatatacttaacacatttgcaataaaatttggccgaccagccccggtcaaggagggcgtacgcgtacgtccccttctcgcggtacggttccagctaaattctacccgcccaaagcttggtctgccgccgcgtgtccacccagccctgtcccgcccaattaatttgttagcaatttctactacggcgcgacgaccctagcagcaatctgccgggcataatgaatagtttgcgtccaagtcgagccggtaacgcgtccacgtttctgtgcgtaatcgcgtgcattaattatcttccgagataaacatataaactgcaaaccgaagcaaacaaaaataaataaaagcccttcgttcacgtaatccaccacatttagcacgcaagaaacgttttggcatggcaggcaattggctcagctctaacggattttagtctggtttcggtggatcgaactgtttagaactgatatgctcgcgtcgtccacagggatcgaaatatctatctatataatccttttgatgtctcgtcgtttttaagctgcactgttgctcgtggcctaccgagattacaccgcccgccccgggctgctttgccgttatgagcgagccgagcttcaccggcatcccatgtcgtcaccgtgccccacacacgttattagggggggcaacatgccttgtttgttcgcttgcccctgtatatatacagacctccccaccacctcccctaccactaccagcctcaaattaagcagccaacaagacctgtctatagctgcctcgctagccaagcctgactgctacctagcaacgaccagctgggactgggagggggagtccatcgagctcgccccaggctgacgatccgctcgatctcggggacccaagagtttcgatagacgacgc

SEQ ID NO: 7235 - DNA, 318 bp, Zea mays
ggcttccgcttcgtagatgcatgcgtgtcgccgccggaggctctcgccgcgcacgcgtcgcgcgctgcggtggtaacgacttcacggggtgtcccagcgtagcgtccgcgtcggcgcacacgcgccggcgcctgcccttgcggcgcaccgcccatcagctgctataaaagggcggcacaccgggtctgagtagtcgtcatcaacgacagccccagacaacactcaccgatagcaagtagcgccgccgacgtttcgagagcagagtatccaagctagccaagcgcgcacctcggtgacctagctagttcaggcgacgat

SEQ ID NO: 7236 - DNA, 246 bp, Zea mays
tgttacttattacctgtgttcattgctgcagattactgggtgcaatatattaccttctctccatcgaacggcagattacatgctgggatcagcagtgcgttgctgagtacaatgatacacattgcaactttagttttataagctgtgaagaataatggttctaatgattattctgtgtgggcaaataagacaaaagtatttgccaactgtgatgccacgaatagtagtatatcatttaactacggg

SEQ ID NO: 7237 - DNA, 1500 bp, Zea mays
tataacatagatgagcgtgctcaaatggttgcagatgattatggcattattgataagatctttgctattgtacttgataaagcctcatctaacaaaactacaatggatgttctaaaaccattgttttttggttatattggcaatttgattcctatgcctagtagaaatgaatatgatttgaggagtggtgacgatagctgacaacgaacatggtggtggttctctcatgcatcaaagactgggaattggctgaccaacaaaagcaacatactaaagagaaggaaaccaaggagcttaaatcaacttttgatgctatgtacctagatgatgagcaacaattatcaccagggagaaagggaaagaaggacaaggcacatggacaaggagggaggaggaaggaccattgccagaaagttttagagccaaacaagcttgaaatgcttatggtcttatgtctatttatgttgttttgtaatacatatggacatgaactgtgaacgagactatgaaatttataaggagctggttgtactctttttgtttcgagggttttctcacgaggtgtgagtttttacctaggaaggtttttaatgagacagcattgcactaaggccccaattaaattttatattacctatttatcttatgttctgagttctgtgatgttctaagattttcatatggttcttctgagattatgtatactattttggtatcttcaagagctgaattaagttgtatttatgtgtatttcaatgtacaatctctgtgtatttctgtgtataaatgggaagtttctgtgatgctacaatttctgtgtttttttagatggcatgggcccgacacgtactgatgggcttaccgtgctccaagcccgacccggcccatgtaatagctggcgtgccgagtctgagctcctccttcagcccacgtgacggtccgacccggcacgagggtgtatccgtgccgtgcctgggcacgttatagttgggccgggccaatgcgtgttcgggccgggctgtctcggcacgcatagttggacatgtataacgtgagctgctagacgaaacacgtatttgttacacattttgcgtatccgcgatcatatgtgagagctgccggggacatttatcatttgggatgggtcttgtgcaacatgcatgtgagtcctttcttctctttcgcaacaaaaaaataagagtttttttttgttccccaacacaggcgtaaaatgccacgagatttcaaaacctatgaacggggaaacaaggagagaaagagagagagatcgaagaatttggaattgtcatgtgtgcatggtttggatgtacaaacagcgcaaaaattaccatgcgaagaaaaaaaaagatacgcctactctcactcctgtccgaccattcccgtgcccttgaataggaccaattgcccttacacatgcacgcagatcgccaagatcacttgtgtgctagacggaagggaacaaactcgtaggccgagacg

SEQ ID NO: 7238 - DNA, 1500 bp, Zea mays
agtgcagtgtccctcccgcggcacactgccctatgcgccagcacacgagcactgtcaacgcgcgtgctgcattgctgcccaacctaaactcctgccgacggccgcgccgccgacgcgatcgagcactgcggcccgcgcgggctggcctcgccgacggccttgccgtacgtgcacgcacacctgcccagcggcccagccacgattgcccgcgctgttcagagcgacccggcggcgatggggagaaggccgtgtgcgctcggcagctcgtgctagttgctaccagcaccttgcccgccgcttgcattgacctagctgcccgcttgcgccttgctagccggaggagcccgtaccgcgcccgctcgcgtcgtcggccaggcgctctagcttgctcgtcggtcgtcgctcgcggctgcgctggccgcgcgcgtcgtgtcttttgccgtgtgtctgcacgttctcgccggacacacccacaccttcgctcgcactgccacatgctccccttacgactgcgacaggcctaaagatgaggatcggcatgggagaagagaactggacagagacaggcagctagacagcgagatcgagcaagagccatatgggcgagaactaaacgagagccaaaagcaacagaccacacaacaaattaattactactatggacccaccgaagaattcacagctagcgttggttgttacagaaactctcagcctccaatcctcttgctcccaaacaaaacaagtggtaaccgtgtgtgtgtgagcagatcccgcccccagcccccctccacaggccacagcgtacccgtcgaagcgatctccctcgggaaaccaataacaaagtcgtaggcgatctcgaggatttgcttcccatgcaccccaccagaccgggggccgcctaggatttcacatggcacgccagtgcgtggcgccgccacgtgagccccggggcaccgcgcgagtcctggccggccacggcgcatgcagccgcgcagaccgtagcacagcaccgtgcggccgcaccgctcccgtgttccgctccgccacggccccggcccgtccggcgatcacttgggcgaaacggctccgccacccacaccgaccacgcctagcagccccgtagcccggcttgggatcccctgagcctgacgtcgctcgcggtcactgtcgcgtggggccagggcccacgcgtatcacttcgatcgagtcgggcgtagactcacatgcacatgcacggctggatctggaccaggaggaaaatctctcccagcagagcaactacccacacccaccgtataaaaaccctaccacttcctctccctctgggctctggccctcgatcgccggatctctcatcgaatctctcgcatctccaaggtctcctccgaccccctctcacatcacgacattctttggcgaatccttccagctgctcgctccaagctcccagctctctgagactctgactgaccaccgcggacgtggtggtctctagctagc

SEQ ID NO: 7239 - DNA, 419 bp, Zea mays
cgtgtgcggagcaggtagcacacaagggagagggagacagagggaggagggagagaggaatcttcctgtttccttgcctgggactgggactccgtctccgtctccgtctccatccccatcccctgccgttgcgcccatctcatccccgcgtcttttcctctcgactctcctctctctctctctctctctctctctctctctctgcgctgctctcggtttaggtcgaggagttgctagctagctagggggtttggatccctgctggtgctggctgctccgctgctgcgtgctagtcctactccagccccccagccccagcgaagcaggcaagcatagatagaggctggggtgggcagggaggtgcgcggacggagatccatcagatcagaatcagatcacatcatcggccctcggatgcg

SEQ ID NO: 7240 - DNA, 831 bp, Zea mays
ggtcaggtgaagccagcgtgaaggggcagcactgtgctgctggttggagccaatagagattgctccgcggtgctcataagacatgtgcgacaggcacaaggacgttagtctacttgctgtctagctgtgacacatttttctcaggtaagtcggtctgtctacacagtcgtacgagcgcacacaggcacaaacaggtaacacggtggtgctattcttcttgccacatcacgtgccgagaaagtaaatcgcagatccactaaaaaattcataccacatttcttgattcagcggaagtgaagcatgtcacgtaggacagttcggctaggccggagacctgccggcttgacggagcgttgatgcagatctgatatcgcagcaacgtcgaggtagagcgtgctgataacgtgttgagaactacgttaccacggatcaccagatccgctcccttccctcccgtcagcagtagaggcgcaagaaaatgtagagaactcgtctcccttcctataagcacgatagaggaaacacacgagacactggatatagggttgggcctctggcctctttctgatctttttataatgaggggtgtacaggtaccttatatagagatgtgagacccctcaggggcaaagcaggtatttgcccatataaccctaactagggttacttaacaagttgctcaggggagatgacgagcccaatggtggccaccccggtccagctccgcagcaccggccgcctcagcttctgctgcttccccagcagcgcatcggggacagcccccagtcggcggcgattcgggcggtgacggtgagggcgtccgcggagacg

SEQ ID NO: 7241 - DNA, 453 bp, Zea mays
ctaagtacgtcagcacagatcactgtacgttttttaatcttattccgaaggtggtgaaccgtgaaaacccactagcccagtaactaaacaagatccttttggacaaaactgtacattttatcaggatcagtagaccttttctatccggaggagaattgatggtgcatgtttttgttattctagcatgtaccatgtattccccagctccagtgccttttgtcgtgttctacccgacgctgcgttcaacagggcatctgtctcctgaatttggctagcctctattaaacccacccaccaacgcacacccgttccgtttctggcgcacagcacagtcacagtgagtgcacggcatcttttccgctccgctctcccactcccccacagtcccacgccctccagtcaaagcaagccgctgcttggccggccgggaaggctcggtcgcagcgccgagga

SEQ ID NO: 7242 - DNA, 342 bp, Zea mays
cgtagaacagcagatcgtcctgcatcaattcaccgccaagcacagcgttcaggcccgcgcgatgctgggctggagccgggaagacctggcttgccaggccggtgtggcgattgaagcggttcaacagtttgaacaccatcatgacgtaggtgatgaaacccgcctggccttggcgtttcggttggaggctgaagggctggtgttcttcccagggtttgcgccggggtgggggatgagtgtgaggggatcgttgctcacaccccccactgaagttgcatttgagacggcagagtaaattttcagcctgcactcacgcttatccctatttaggtatattctctc

SEQ ID NO: 7243 - DNA, 201 bp, Zea mays
ttctctgtgtttgatcttttgtggttatcgtattgtgcaagactttctctagccatttggcattattacgctaacttttaacaagtttttgtggctataagtttaagttttacaggatcacctattcaccccccccctctaggtgctctcaattggtatcggagccgttctcttcaagaaagggactaaccgcccgaagag

SEQ ID NO: 7244 - DNA, 241 bp, Zea mays
aggcggcgccggatccgccagactgccgaggaaaggtctggttggtcaaggtcccggccctttcgccgacaataatttctttcgccttgttcgttcaggcgctaccgccaccgccaccgctgtttactatagcaccagacctacggattgaattgttgtatggatttgtttggccaaatctttgttctgttgtaaagtaaggggagggattcctgcccctgcgcctgcttaaaatacttat

SEQ ID NO: 7245 - DNA, 359 bp, Zea mays
gccggccaccgccattatcacgggcctggctgtatccatggcacgcacatgtccctgacctttgactagcagcagcagcacagctgtggccagttgtgcgctctgcgccgcgcaccgcgtccgccggctgcaggaggcgccgcgtttgcgttcgccacctccacacgcttctctctcctttatctttgtgtctgcgcctccctcgcacagactctctctcacgagcacaacagggcggccagacagggttcccacaggccatcaccacaacacacaaatacagctcagagcaactcacacacaggctcctctcccccgttgcgcaacgcgctttcccccacttcacccgcctcggcgcc

SEQ ID NO: 7246 - DNA, 1152 bp, Zea mays
tttatacccacgggttaacgggtatgagtgaagacggaacgttctaatacccgtttatccattgagtggacatttttgcccaataacagacccacggctagaatatttatgccatatacatactctaatagagtaaatactcatcgggtatcgggtcgtgagtatccattgccatctctacgtggaaccagtggtatgtcttgctcagcaccgtgcaggtgcagtagagggcgcacgaggatgctgtcgtgcacgccatggccccactggcttagatgggggcgtgtgaggcaaacgcagcgacagtcacccccgcgcgcgacgagactaggcccttgtttgtttcagctttttggagcttctggccaccaaaaactgctgcagactgccaaacgctcagcttttcagtcagtttctataaaattcgtttgggtaaaaaccattcaaaatcaacataaacacataatcggttgagtcgttgcaatagtaggaatccgtcactttctacatcctaagtcctatagactcctttatctttttccgcacgtaatcctaatgatacttagattctttatacaaccagattctccccacagccagattcttaaaaaagctggtcagaaaaaagctgaactcattttgcctcctgtctcgagtctattctaacagacggagacgaaatgctcaaattagctgacacgtgggtccggcgtctcttccgtagtggaccccacgtgtcaacggagattgcgtgctctgttaactaatcgaatcccccaattccgttttcctcttcttcgccaatccaactcccgtcttccttcttcctcttccttgttcgaatccaagtaacctacccaaaccgccaacccccaccccaaggaaggaaccctagtaccctacccgtgagaaccgccgccgcacaaccccggacgtggtggcaggcgaccgatccggatccatcatcccaagcttcctttctgtctcctcttcatccatctccacaagtaagatgcaatttctcccttttcttcctgtcgggcggagatagtagtatattcttcgaggaaacctaggtgattgcaatgtcgttttgatgatgatgattcccgaccattttatctgcacagggataatcaaggaaggaaggcc

SEQ ID NO: 7247 - DNA, 821 bp, Zea mays
ggtggacctcatgatgtttgtcgccaatggctggtgctcaaggaaatgtttgagcccctcggaaatcacggacgcctggctggtgctcaaggaaatgtttgagcactatagtctatagacatgaatgatgtaatgtattttatttttaaaagtcggataacctttttcttatagaaacacgagtagtaatgtaggatacaaaatgtaattatttttattagttcctaattcatttttgctagaaaggttttttattgtgaaatctggcatactgtagatatagaggactaaatttagggaacattgctggagatgacgaaaatatagaggacagaatcttttagagtgtgctgtaaaggacagagaatattcttttagaggatgaattttaggggacgttattggagacagtcttatacccaaaggtgagagaggctgttgcaactgacgccgaggaatctgcggagtttgttgatgggtgctacgagtagggactgtaagctagagtagaatagaagacctgccaaatagaggctgccttgctgctctcgctcgcgtgaatcgactgccttgctgctctcgcgtagctcacatgtagaaccatggagcagattgcttgctgagtgcctaccgcatgcacgacttatatttaaacacccactcgctcactagctcattgtctctctagtgtatttgcaacgtcaattagacagcagaagttgcaggtatgttggtgcatagaaacatcgttgtaccttaattttcttcttcaattgttcatttttcttacaaaaacctgcaggaggtccagccgtccagct

SEQ ID NO: 7248 - DNA, 1240 bp, Zea mays
tttaaatgtcgtcagtggatgtggagcaagtagcatggcgcccactttctaccatgtcatgtggtctgataaataatgctcgcaagcctaacaaattcattctaccacacaccagaattaaacatcaggcaccgatcgctaaaaatatgtatttagcgatatagcattggcctgtaaaaaaaatgccagatcatcggccactaaaaatgatttcaatgactacacatcctagttcagcgtgcacaatctaatgtacttgtgtatgttgtttctccttttgtgaatatagtttaagtcgtgtttaattgtgccaactacttagtggtgccatatttgtgtcagttcagtgtgcacaatctaggcacgatattgaacattgtgccatactggtacgagcactatgtagattgtgtcgtaccaaagcactacagatcatatcgtgtttagtatcaacctatttagggggtgtttggatcctctgactaagttttaattcctgtcacatgtaatgccaactacttaatgttccaatgctagttataaatgttaaatatagtttaattataaacttaattacatagatgagactaaacagcaagatgaaaatctattaaatataattagtttatgattctttacatgccatagaaaacatttgctaattatagctaaactaggcttaaatgaatttattttgtcttttagttttatcttatatataaaatatataatttaaactatatttaatattcgtagtcattttgaacatctaatttaatatgaactcagctttagtcagaaaactaaacacacacctagcatagctcaggtgaccatctatacttaccatgctaccaccgaattccagcctacatatttttgagaggcagccaatgcaacacgtagtcccaccgcacccgactccttcgattatttgaatatagattccgtgggaaccatccgcccgctcgccggggtccagccgtgcaacacataacacgcgcccgcgttggcgtattctattcgccaagagccaaggggattggggaggccgtccatgttgcgtgttgtttagacgcgccaaaaggcaaaagcgtggaggaggctcatcaagcacaagcacgccacgcgatccacacacggcaagcaacgcccagggctcgtgctcgccccgcgacccgcgaaagatctgtgctggttcgctcgctcgctcgcgccgcgccgccgcgtgggggtgccg

SEQ ID NO: 7249 - DNA, 148 bp, Zea mays
agccttgcatgtgcccgcgcacattggctcgggcttcttcctgctgaacttttttctgctatgtgatgtgcctctgcatgccaaagtcgtatcgttttctctgcacccccttcattagactgttaggtttgtggctacctggcgtttt

SEQ ID NO: 7250 - DNA, 774 bp, Zea mays
cggtaatcttatggttgcgaagagttatagggtctcaccttgacctagcataaccggaccgacactgagtatgataataatgtgatgtcaatcatctgcctcttttttttggcttgatgtgcatttaattttggtcttttgttgcttgttcgatatatgttggatgggaagtaataggcaacatatttctcaccgactattgctaccaggtggatgttggagcaatgcatgattctagtacgtgaaaggtgaaatgattgacgaaataaatttgctaaagtatgggcaacctcatcggcagtccgcactaacaagaaaagaaagcgagagttcttgaaggaaacacacgcactgaattgtctatagcaaaaaccattgggcaatacctacagctacagcgctccttgctttccgttacaattcctgaaacagaaggcaccaaccccagttagattagttcactgaagtgaggaacatttgcctattcttgttaggcagaatgggcaagaagtatggacaagagcaacgcattttatttgtccttgatgaattcaaaatcttgccagacgtgggcgcagtgcaaagcctcaccacacggctcgtgtgcagaggagagagatatatacacgactacacgagggcgccaaacacatttcgcaactcaccaagaacagcgcaatttcttaatcgcagagcctaaacccggtcctcctaattatatcgccacagtgctgtcacaaccaggcgcgatcacaaagcttaaaacgcaccggc

SEQ ID NO: 7251 - DNA, 1500 bp, Zea mays
ttattactgacatacaagttgcggctaagaccactggagcttggaaggggaagatgtcgggcatacgctaccgatgttgtggcctatgggttttcgaaaagggcatgagacacagtgtataaagccccactaaagctagaaggggtggctaacagtgggaaattagaagcgttagtcgtggggtttaaggagttagagtttgtcctttgctgtgtaatatgagctaggccaaaacaataaaatacatatcgatttcggatatctaataaataatccgtagatgagaggtaaccgactccatcatattagatatgtgatggatctcaccatgccagtatcctacaggcgcgcacgtaacggcgggtgggggaagaagcctctgccgccggacggcagcggccataccgcgctgcgtcactgcgtggctcactcaccacggccgcgcgcggcagtagcggcgatggggatggcgatggcggtgcacggatgggatatgatggcaagtacaagaaagctacgtccatctgtcttcacacgtcagagaccacgcggtcgcagacaagacactcggcaaagggactggcaaaggggcccactggaggactctttgccgagtgccagtccaccagacactcggcaaagaagactcctttgtcgagtgcctacgagagctctcggcacagggactggcggtggggcccactggacccgtctttgccgagggccgtgatagcagacactcggcaaaattggcctctttgccgagtgccaaagaagacactcggcaaaggatctgtcaccgtcacttggcgccgtgactgtgacttttctttgccgattgtcaaatggcactcggcaaattctgcccgacaaaaagtactcggcaaagaggttgttgccgatgtacagtttgtcgagcgttctttgccgagtgttayactcggcaaagcctttgccgagtgtaaaatagcctttgccgagtgtctgagacactcggcaaaggaactgtgtccggtagtgagtgtttatttctaagtcatccaacatcacaattacataaaaataataaaataaaactatatttcacaattttttaacacccattaaattaaatagatgaattgtacgaatgatttttttggccattttggcgtgcattgggcgggaggccaaattcagctgattcctttttcggtcccgtcgaaagaaagaaaattttggaattttcagtccgaaattataatccctgaatattaattaacggaaagaaatgcgcgtggacagaacacctgaacacgcgcgtcctggtaagagaagacaggcagggtgaagggtccgtccgacaaaatctgttaaccgcttcttcccccgtcgacaaaaccgctacaccctcgatcacccgccgcgccatttctctcacactgcacgcgcgcgcactggccttgatcatcccgcggcgcgctccgcctacgtaccatcgagcatctatatacgtacgta

SEQ ID NO: 7252 - DNA, 190 bp, Zea mays
acaggcccctccgttcagctgttctcggcggttgctgtgtcagttggcaggaagcttcgttcaatgctgccacgaataagcggttcggaatctgtatatgcgacgagttgtttcttttacaggtagtctgtgtatattgcttgtgttcacaaacctgtacatgatatgattcattcatgtattgctgtaa

SEQ ID NO: 7253 - DNA, 622 bp, Zea mays
cacgattcaattcaattcaccacccccagtccccacctcagcatctacggcgctgtacagcattaaggtcgggcggtcgggctcgggccattaccactcctccatacagcaggaacggcagcggtcgaatggcgccccggccggccggccccaacgaaaacagccgggcacgcaaaagggacgaaggcacgaaagacgcggccgccaccggcggtcggcgtagaaaccaaaggcacgaagggacactgcgtggggaggggaagggcggagagcgcccatcccccccggtggggggaaaacccgaaaagagaaagggctgtgtacctttcgctttgttgcctggctctggtattgggttccccgttctgctgctcagctcagcccagccccagagcccctgacctgccgtcctccctccttccctccccgtgagtcgccgtacggcggtacgggatcgccaccgcggcgtccaggttcgtttccgtctactagtttccatccatggctagattagctgcacagcggttggtttggttctcctgggtgcgtgctactgcttccatagttccatggcctgttttcagcggcacgcgccgtcttatctctcgcttgctcctcaggg

SEQ ID NO: 7254 - DNA, 1500 bp, Zea mays
ctcttcaaaattaatatctaaaaccctcttgaacactaagaggaggatttcattaaagggggagttttgtttagtcaaaggaaaagcatttgaaacagggggagaaatttcaaatcttgaaaatgcttctcaaaaatcttattcatatacctttgactatttgcaaaagaattttgaaaaaagaatttccaaaacatttgcaaaaacaaaacaagtggtgtaagcgtggtccaaaatgttaaaatagaagaaagcatccatgcatatcttataagaatatatattggttcaattctaagtaatctttgcacttacattatgcaaactagttcaattatgcacttatacatttgctttggtttgtgttggcatcaatcaccaaaaagggggagattgaaagggaaataggcttacacctttttcctaattgattttggtggttgaattgcctaacacaaataattggactaactagtttgctctagattataagttttacaggtgccaaaggttcacaacaaaccaataaaaagaccaagaaagggttcaaataaaaagaacaaaagacaacagaagtgtgctctggtctggcgcatcggacggtgtccggtgcaccagggaattccagtctgaacttgccaccttcgggaattctgggagctgctccgctataattcaccggactgtctggtgtagcaccggactgtccggtgtgccagcggagcaacgactacttcgcgccaacggtcgtctgcagagaacattaaatgcgctacagtgcgcgcagaagtcagagcaaagccagaaggcgcaccagacagtgaacagtgactgtctggtgcaccaccggactatccggtggcccagaagacagaagctccaacggtcgaaccctaacggtcgggtgacgtggctggcgcaccggactgtccggtgcgccatgcgacaacagccttcaccaacggctattttggtggtttgggctataaatacccccaaccacccaccattcattaaatccaagttttcaaccttcaaacctcatacaagagctctagacttcattcaaagacacatacaagagatcaaatcctctcccaagtccaaagatcattccaatcaaatagtgactagtgagagagacaattgtgttcatttgagttcttgcgcttggattgcttttcttcttccttctttcttgtttctaactcaattgtaatcaaggcaagagacaccaattgtgtggtggtccttgtggggacttagtgtcccgattgattgagaagagaagctcactcggtctaggtgaccgtttgagagagggaaagggttgaaagagacccggtctttgtgaccacctcaacggggagtaggttataagtttataaatactcggtctaagtttataaatttcagatttgcctattcacccccccctctaggcgactttcaattggtatgagaggccgatacttcattagagcctaaccgctcgaagtg

SEQ ID NO: 7255 - DNA, 427 bp, Zea mays
tgcagagtaatattcttttgaataattgtgagaagtattggtatggtgcttatagacaaataaagtccatctcgtaagtatgctttgttctgtgtctacatttattcttttttacatgtgtagttgtgtccatattttgcagattgagtagctgagaatattgtgacaacgtgtcattccatgcatcaccctgtttccatcttttgtattatataaaactaagttgaaatcaatgcaaccaactgattaactttaccaatcttcattgatccagatcgctgtcaagaggttgaagagtgcaaagaatggcacagaagcagaatttgcttcagaagtcgagatattgggaagaataagacacaaaaacctcctgagttttcgtggatattgtgcggatggacccgaacggattctggtgtatgacttt

SEQ ID NO: 7256 - DNA, 704 bp, Zea mays
tcgccgcacaagaacttcgcctggcgcagtcaacggctacggagccggagccccatcgccggcgagcgctgcgtgagagagcaggagccccatcgctaagccgatgtcgtctgcatctcggtggaaccactaggcagcccgagagatattcgcttggaacttatctgtagcgttttggatcaggcaattttgcgatcaattccctccctccctccggttctgcagcctgcaggcatgcatggctccaaaatctacattcatattgtaggttgaagcttcccagccggaggacaagaagcaaacacttgagctttgtcagctttacacagcaaaaacaaatgctagtgattgcaaggtggctgcttcttggagtagttgagatttgatgtgcatgcttgtttaataacttgtggatgtccttattgccttcatactaattttaaagagagaagagggaatggtcggttgaaggtgtgagctaattttgttcgataattgcctattacagattatggtcctctttataaaaatagagacagtattattcactatcacaatacgagtgagctaattttgtttcgacaacaagtgagattgctattttcattctttttagttagcaatggatgtggcactaagagatcaccttagaaagagaagggatgatgatgatgatgatgatgatatgctgatgtttttttcct

SEQ ID NO: 7257 - DNA, 847 bp, Zea mays
cccccccccccccccacccccaaaccaaatctcggaaggcgatcgacgactcgacgtgtgttctacgagtaggagctgttaatcaacagctagtgaatcggtatggaacgttaatagccaccgcacactagtccagttgcccgcacaccacccttcaaccgaatccacctacaccggcacagctaacgcgtctcacaaaccgtatatagatgccgccaaatgcagggcggcggagcaaagtttggcggcgagaaaagctcgcggggacaaactgctgtagcagtcgaatcgaatggaagcacgagtgcaggggctgggaattctacgtgccagcccaggaaggagggtgggtttccttaccgatcgagaggaggagaaggaggtgcgaatcaatccacgccccggctaacggggcgagcggcggcgcgggcagtgggggcggagaggcggcgcctgatctggagggagggagggagcgggcgggcttcgccgtgccgtgatcggcgcgggggggaccggggaaggtggtgggtggatgagtccgtgatagtggaagtggctgctagcgtggagaggaggtgtgaaccagcccagcccacacggcccaacccaaagcctgcaaaaaatggaaaagggtcccacatgtcggcgcgattttaccgtggacgactggagggggcgacggggacgaacgagacgaccgtatttgttatcggactgggaagcagcggcggtacaaagtgtgggagagaaaggagaagagacttgatgtcctcgcagtttgtccaatagatctcctcgccgcctcacccgtctcctcctccgcagcttccccgcgatcccgacc

SEQ ID NO: 7258 - DNA, 1500 bp, Zea mays
aaaaacaacagaaggatgagagcaaccaatctagaggttcacaaaattctccatggaaaacaacggcttggaaaaggagaaaatagtgatatttgtcattctgtatcatagttttatactaatatttaactcccgtagcaacatataggcacatttgtaataagtcatcgtggtattatatgttctcgttgtaacatgcgggcactcacctagttaaattctatgacgttaattgcccatcttgtcattttaaagttaattttagataaaaagaaataggaccaactagacaagatgctattgtcagagaagaattgtattagtgagtggtgtttcctagatgtcttattaactaggagcatttcttagatggtaagttaaagagagtcattgaactattgttcgtgaattattgttccatgtctagtacaaatttttgtttgctattcacttgcaaaatggtcacaaagagaaaattatttttatgttagaaaaatgttgttgtagactcttggtttgtgaaattattatatattattgttagaatgtcttctagtttcagaaaaaagcattccaccttaatcaatacaataagttttatgtttaatttacattgtactatataatcaaaattattattattatttctgttatttaaatcaaatgttgtaatagccattgatagtgtcccatgaatgaagaatatagatatgaaatcaagagtaaaaaatagaagagaaagaaagaaaaagcagaaatttcaagttttttttttttttgaaaaacggccgacacgaaggcccctcgggtgcgttttttttacgctgtcaatgcataacctgcgttggcattccgcctgctggacttcctcgtgctgtgtctctgtctgtcgctctcgctctcagacgactgggccgccgccgcttggtgctgaggctttcgttggtctcttcggcggcgacgagcacccaccaggtactcccgctccttctattcccttccatgcgaagctgagcaccgaaaccttaatcatttagcggcgcgatacgtgcggaacccgcgccgccgccgtatgagtttgctatggcctcgatctggccagatccgtggtgtggtgtagtgtgggtggagatccatttgcaggggcacggatccgcatcccatgagtccggatctgcactccttcgagctggtgagatggttcacgggcagcaacaccggtgcatctcgacgcacgcgggcggcgtggcggctgtgctgtggcgcactcctaacttcgaaattattgggtgtccctttactggatccgcccctgaatgtgatgttgaaaatcttagatgcataaatcaggaactgctgtctttgtgtgaactactgctttcagttaacctgcacattcaaatccagtgtttcttttcaatcacatagtgaactaaaacactctcatcactcagtgatatttgattttatccacatgccacttgcagcagttctgtagaa

SEQ ID NO: 7259 - DNA, 1201 bp, Zea mays
taactattggagagaggtgagacctgctataacccccacaaagtttattgcttgagcaaggttgtgttagaaccaattacttgtttggttagaagaagtttggaagggtcaagagggattgatgggagaaattaatttatttttcccttaggacatcctttgggatcgtaggggattaaatgagcgaaaatatctttttgttcttccaaacatgtttctaatctctaccgatctatttctaactaaacaagtcctaagagttcgatcacgacattgtgtcgtatttgtgtacttaaaccccatatcccactactgtcactttgaaattgatccgatcatacccacctctatttgttgtcgttgtaaatgaacaaaacgacagcaacaaaaaaaggaaaaaaaactcaaacaacttgtccgcatgagtatgaccgtatccaaacaaagcatatccggatgcgtacttgaatataaagaagaattgttttagaaatccgaggagatttgccttgaagaatttgttttgtacatccgaggagatttgtctcgaatataaagtagaaatatcgtggaaatccgaggagatttgcgaacagctagctagctgccttgctcacctagaaagggtcgctcggcggcgtgcaaaaggcgaagcggcaccaactcacagggatgcgcacgcaacgcaaatctggccagaatccgaagatgcaaataccagggggccaaaagaaggcgcgcgtacgtgggtgggcgggcggtgacagcgagaggcgaggcagggaaatcccttgcgtatcgccgcgcgggccccgccgcatgggcccccccgcggatccgcgccccggatcggcctggcccgcgtgccgtgccgtcctatactcgatccgcgcgcctcggatcccctctgagatttgccccgccaccaccaccatccctgcttgctagctacccgctgctgccgtgccgtgccgagtctcctcctgactgactgactcctcccctgcactgcacctgtgtatatatacacgcccgcccgcgcctccgacttcatcgccgcaaccgcccgtctgctcctgcttagtacatacatccacactcgcaagagaaggagaagagatctccgcgtccgcaaccgcatcgcttccctcccggcgcaagaagaagattcggttggattgtttgtctcttgcaaactgca

SEQ ID NO: 7260 - DNA, 385 bp, Zea mays
ggtgacgttccgcggaacgcagcacaccgcctcgttcgagggcgacgactgtctcgacggccccctcacccgttatctcgtcgacctcaccccgcccgccgagggcctcacctgctgatcgcggtcgtgccagagagcgaacggttcgccaccgttcggtcgtctcgcccgcgaagcacgggcgcggtggcgaagggggttcgcatggtgccctgccgttcgcatgtccgcgcatcgttcgcctgctgccgcggacgtgcgaacggttcaccaccacgcgaacgccgagtccgtgcggcggatctttggacctcaccccaaggcggacgacatcggagtggcgtcgtaacacggatttaacagcgcgctcctagcctctgacggt

SEQ ID NO: 7261 - DNA, 1004 bp, Zea mays
tattaccaggttgcaatcgaccttttaatttttcctactaggatgatcacttaacccaagttgatgaaggagttggacaacctatttccaacctaggaagcagtttctgtgcacagtggcacagagacggagtgctccaatagatttgatcctaagcaaagtgtccggcttgctctccgttccccgccatttatgctgattttgacgaatcggaggggaaaaaactcgacatttagccatcattgtctcgcctaatctccttttttcgctttcgcaaaacatgctttaacccataacccacggtctgatgcaggccatgtcgcggttgtccaactgacggcacaccaagcaaccgcacctgtccagtcgcggcggacgccaccgcgatgccagtcggcgcccgcgcggccacctcggacacccagctgggcaagcaagtgccacggccccccctgcgagatcgcgcgagggccccccacgtgatcgcgtgcccccgtgcgccgtcgcggaaatcaacggccgcgcgacgcgaatcgccacggggcccctccgcttttggtgagaaatcgcccggggaacgaaccaacgaacgcagccaggcagagccgcagagccgcagagggcagagggctcccgagtcgcgtcggccgtcgtggcaggctgacagctgatgcctgcctgacagggatcggagggagcgcggggggtggttggtgaggggagtccgcggtgaggggccgtgcgcgagcgcgacacggccgcggcttgtggtgtgtcacctgtcgcgcgctgtcggcgtcgcgcacgtcaagggcgcgacccgcacccgggcatctcaccgcggggccgcgtgcgtgcgtgtatataaacgcctggccctgccactgtcccggttgcagctccgcacagtcccctggcacaggcgaggagcaggagcttcagaggtgtcgccgcgtagcagcaactgcagcttgggggctcggaacgaacgagaacaaacaggc

SEQ ID NO: 7262 - DNA, 292 bp, Zea mays
agtacgtacaccatacactaacatcgaaattgatattgttcatgcctcttgcattctgagtttctgatgactgacggccgttgtttgcacatttcttcttcctccacgcatccccaggacggttgatgaggtgatcgagaaggccaactgcaccaggtacgggctcgccgccgggatcgtgaccaagagcctggacgtcgccaaccgggtgtcccggtcggtgcgcgccggcaccgtgtgggtgaactgctacttcgccttcgacccggacgcgcccttcggcgggtacaag

SEQ ID NO: 7263 - DNA, 504 bp, Zea mays
tattcagttaactctcaatccatattgattgagtaagattggatgagtttgaatcttaaacaaatcaaatttttttaatttttttaatctaatccgatccatatatattgtgaataaaccaacaaatccttaatatagaaatttgtcatagctctaactttttagtcaacttcgtccaaaacccaaactcgcaacgtcgcacacggctcatataaaatgccagagccgtttgcgcattggactcaaagcgaacctcgccgccgcctcttccgtctctctcatctccgtcctcctgcaatctcacccctccctctaaacccgcaggccgcagtagcgccgctacggtttgctcaggattcgaaccccaccttctgattgctccgaatccgaggtaacccgccttctcccccgcgccctcttccaaggttcgagctagggtttctgcgtgtttgctcagatttcattgttttgatctcaggcggcggttgcgcagaagtttgcggc

SEQ ID NO: 7264 - DNA, 193 bp, Zea mays
catacatgtaggagatgatgaactatatggatggatatcttgaccagttcaatgaatatacaattcaaggctcatttcctaccttacatgcctgccaactaatatgacctactgcacttctgccaaagcttcttgccttcgaaggaggaagaagaagatgatgagcagctaagaagaattcggcaacatctcc

SEQ ID NO: 7265 - DNA, 284 bp, Zea mays
ctgctgaaacactatcattggttgctcgaatcttgaaccgctctacagcccatctacactcagtattgtctaaaaataacagttctgttgttgaggagttctttaggacactggtgtgtttctctactttgggaggtttttattgcttatttggtagtacaaagaaaaaaaatgcaatgcagtattgtaattccagaattcaccttctttgtcataggtggactctgttccagatttgacagagcacattcacagaacgagtgcgcgtatgcttttgcatattg

SEQ ID NO: 7266 - DNA, 1085 bp, Zea mays
tgtgaggcttgacaatagcttattatagatgactttagataaaagaacttgtacaattgtgtaaaaggctctaactccttaggctttagattgtcttgatccatggtagtttatcacttaatgtaaggctgaggtgatgaaaatcatatacacttatcatttatatgagaattgacaatcacaatgccttttatttacattgtgaggcgagtactaataccacctaacatcacgaggcgtagccgcttatactttacctacattggatcctattttgttattgaatcgtagacaactctctcatttattgcactattgctcgagatgtcatttctactcttacggaaaaatagttgtagattacccagagccaaatggtaatgccagctagcagacactagttcagaaaaagctattgactacttagattgaagccgaatatgccaatacgacaggtagtcaggtaacgtcggacaattatgactgccagatacaatcatacctttgttttttctactgtcgatttaaatttcaaaatctaggcacatatggagtgtttcgggtttaggtctaccaatactacaaatattttccaatctacattacaaagacggatcaaaaccaaaatttgcacacaccatgaccatgaagtttgaaacctactcagcgagtgtctttggctcttggatcttgactccttgtcatgcaagcaaagcaaaagcaaaaataagcgattcaattttctcaccaaaatttttccccaaacatcgacggagggaaactgaaggagagagaacccgcttttcgtctgcatcgtctacaactacaacaggccaacagcacagctcgcctggctacaacccaaaccccagccagcagtctatttaattcactgtgctgccgtgcagagttttttttttttttttttttttttacaagcgtgcccccacaccgccccgctcctccaactccgccgcttttcattttcaccttcccttcctcccttcgcttccccttgagtgcagcaggacccccacctgataagagcggactgctccgctcttgtcctgccacccacgcacgcc

SEQ ID NO: 7267 - DNA, 737 bp, Zea mays
gccgctgtccatggtctattgcaacgttcagactcgatgtgggatgctggagttcttccctaggaacctaggggaactggactattgatgtcttccaaacaggctctggaatgttagaaagaggcgtttcaactggtgcagctaataatgttcattggaccctgatttgtttcacgaataaacttgagcagaacttactgtgtatatatgcagtgttctcgtattagttatttccctagttgcttctgtaccgattttttggattgcgcatatgcatctaatgtgcttccaacagcctgacatgtatgtgtgaggttttgatggaaaataaaaaaaatggcatcgagcaatgagattttcattggaagcacatgctcattcggatgccatgacccatcagtggatgaagccagagcagcaatgcagtaagaaaaggtcggttttagtccgtgatgacggatagattaaagagatcaaattaactttacttagactatctccagcagtttttgtatctcattttatatctcatcttctattttaaaattcactctacaaacagtcagtgcaaaacagcaaacagccatacaacaagatggaattacgcagcagcgtccatgcaggttctgctagcaacacatcttcagcaaacagacaacaagaagcttgccagtgacaaattctagcatggatcttcagaattacctcctagagctgaattgattggcaacaagcaa

SEQ ID NO: 7268 - DNA, 1221 bp, Zea mays
caggttcttcccctggcatccggcactcggcttcttcttgccccggctcccggcgcggcggcgcccgctcctcctccccccgctcgcccgctgcaggtcctcccccgcggcacgcgcccgctgctgcagcctgcagctcccaccccaactggcgattgcagctcctccggtcctccccctgccggcgccgcctgcgagctgcacagctgcagctccccccctggctggcagagctgcagcttcaactctcttgaaggcaaaaggtatatcaagcacagatttgagaaagcgctctgcagaaccaagcttcgatgtgtcatcattataattagggatattactcctttagtatttgttttcatattttcttttctgattcggatggcatacggatattattgagttatgtcagataagatttaaatggatattgacattttaaatatccagttttgagtatattgatacggatatagaacagatactaaatatcaggactcggatacggatcgaatcgcaaccctcttagacagatcgaattcaaatatggacaccatttatatcctaattataatcttgtagtttgagttccttctactgctgctgttcgggtttcgggttccatgcgggttcaggggcagggcggaatttagcccaaacggggtttgagtcaggttcgagtatttttcttgggttttaggtgtgggtctgcgaacgctccacccggcacccgccccatttccatccctagtttccctttggctctccctctcaatctttctattcttcaatctattggtagaatcgggtttagtaggcctgtttctgtttattaattggactcaatagtaaaagtagagtcatggacctaaaagtgacagatttttcacagttaaaactttaaaagtagaaccataccatgtaatgttattaaacgattttatccttcacggtttctgatcaattttcgcactccctcctcgcatctgacactagtgacattccagaattgaatcgcactctgttgatgggcagcttgcatgctctgcgggcgccgacgccgctcgttgggagcactaggattggcttcagttcggggctccgcttttgctccaacagagtcctcagaggtatatcttttgctttctaaggtttgttggactctgtttcatggaatcacacattgcttcctgattttcagggttaactcccattggcgcg

SEQ ID NO: 7269 - DNA, 1500 bp, Zea mays
ctgaagccattttgcaattttgccatttacaattttgctattattaatttcatctactaagcgatgtttaaaaataagcaatttttcccttcaccagtttgttttaaggaatcagctatgttttatgtttaatttaatctataatttttttagcaagaatgcgatattgcaccaacacaaattcctgcccagaatcaaacaaccctgtgtttacgttcgcgccgagatccacaaaagcctgcaacccggccggcctgcttcgttctcatccatctatcgccagcggccgaggcgacaaccaacctgcgaagcacccgacgccggcggggcggctgatcgatcgacgcggctggccaccgacggccgatcgattggccgaggacgaccgagtgacctggcggtggccgcccgtcgtcaaagccggtggcgctcgggcgcggccgcacggatcgaaacagcaggactacagcgataaaccccgcgtataataaattaataacgcacggttccatttgaycttttttttgcgacgaatacactatgcccacacacacaacagcaacactagttttcctaccctttgaattcatttcttttgcaaattaaagtaggactttgctacggtttaacttgtcaaacaagaagaaacaggtacgtgtatgtgtatcgaacattgacttgccggattgggaccgtgtgccgctgccgcccacggcgcccgtacgtacgtgatgtaaacaatgtgttatccagcatctccaacaatgcctcaaactagtgcctcaaattgaaatatggggctctacacaggaaaaactactccaacagtgccctatttcataattttttgtcaaaaaactataggacactctctcaagtgactcaaatatactacaccgtagtgggctgccctataatctagatttggggctttactgttggagcgaggtgttttgttggtgccctaaattctataaaatatacttattttcaaattatagggcatttttataggtcacgttgttggagatgctctaatgaagtaaaaattataataaagaacatttgacacggctaggtctttcagaaaccgcaagggcgacgacgcggcttcaccatcccactcccctgcaaaaacacaccattcacatttcacaccacagaagctggtgcacatccagaaaaagactcagtgacatcatcgctgatgtcaccagacgaccctcgtgtgccgatacgttttcctggtgactaggacgtcgaacccacgaacgcaacaggcaacacggtataaatagcagactccaccagcggcaacattccacacaaaaaacctcacattctcattccttcaagcgtcagcagcaaaaccagaggttcccttcaacccagcaagaaaaccaagcgacctagttagcgcagcggcagttattcgtgcagaccccgatctgactgatagaggcaggcagcagctcgatcgtcagtgaccgcgcgcgagcc

SEQ ID NO: 7270 - DNA, 488 bp, Zea mays
cgccggtgcagcgctttcaccagcagcacgcggcggcggacctgtcgtagtgcacctccggcggcgagccgccgtgcaagcgcgtcgtgcgtgaccggccggagtaggtgtaggaggaggaggagtgcaggcccagggtgtcgaagctgtacgtgcgcgccgacccggccgacctgagcctggcggtgagggacgggtaccagtggcgcaagtacgggcagaaggtgaccaaggacaacccctgcccgcgggcctacttccgctgctccttcgccccggcctgccccgtcaagaagaaggtgcagcgcagcgcccacgacgcctccgtcctcgtggccacgtacgagggcgaccacacccacggcccgcccccctcgggctcgggctcgggttcgggcgccagcagcaagaacgccgcgaagccgccgtcgccgccgcgccgccaggaggctgctgtcgcggtgactgcggccgcggcggcgtcggag

SEQ ID NO: 7271 - DNA, 1265 bp, Zea mays
ggttgcggcgacggaccactgctccctcacatgtcgcgacgaccatcctcctccgccctatgttattgacccacctccagtcaggtccgataggagcatgcctatcaaaactagatttaaaatcgaactactttctattgaagatcaaactatttttattctcaatagctatttagcgacttggaaatgctcttgtaatgtttggatccatcttacactacagattgatgtggaaactgaagccattttgcaattttgccatttacaattttgctattattaatttcatctactaagcgatgtttaaaaataagcaatttttcccttcaccagtttgttttaaggaatcagctatgttttatgtttaatttaatctataatttttttagcaagaatgcgatattgcaccaacacaaattcctgcccagaatcaaacaaccctgtgtttacgttcgcgccgagatccacaaaagcctgcaacccggccggcctgcttcgttctcatccatctatcgccagcggccgaggcgacaaccaacctgcgaagcacccgacgccggcggggcggctgatcgatcgacgcggctggccaccgacggccgatcgattggccgaggacgaccgagtgacctggcggtggccgcccgtcgtcaaagccggtggcgctcgggcgcggccgcacggatcgaaacagcaggactacagcgataaaccccgcgtataataaattaataacgcacggttccatttgaycttttttttgcgacgaatacactatgcccacacacacaacagcaacactagttttcctaccctttgaattcatttcttttgcaaattaaagtaggactttgctacggtttaacttgtcaaacaagaagaaacaggtacgtgtatgtgtatcgaacattgacttgccggattgggaccgtgtgccgctgccgcccacggcgcccgtacgtacgtgatgtaaacaatgtgttatccagcatctccaacaatgcctcaaactagtgcctcaaattgaaatatggggctctacacaggaaaaactactccaacagtgccctatttcataattttttgtcaaaaaactataggacactctctcaagtgactcaaatatactacaccgtagtgggctgccctataatctagatttggggctttactgttggagcgaggtgttttgttggtgccctaaattctataaaatatacttattttcaaattatagggcatttttataggtcacgttgttggag

SEQ ID NO: 7272 - DNA, 880 bp, Zea mays
ggtcggctgcgctatcagcgggcgacgcgtggcccgcgccaatggtcggttgggcacaccggactgtccggtgcaccaaacggtcccgtggcccaacgattggccgcgcccgatatggaaggagatcgtgcaccggactgctactgtagctggtccggtggtgcaccggactgtccggtgcaccactcgacagaaggcaacaattgccttccaagttgatctccaacggctcctagctgccttggggctataaaagagacccctaggcgcatggagcagaataccaagcattcactaagcatcctaagactcccaaactccgcctccacgcatatgatcgattgtgttatgatttgagctccatttgagttgtgaactctctgtgctatgtttcgagctcaagtcttggcttgtgtgtgtgtgctacggatttgagtcttgcatgtgttactctccctcacttactactgtgcttctcttgtgataaacttgtaagggcgagaggctccaatctatggagattcctcgcaaacggtagaaagattactaaggaagatagttgtggtactcaaagttgatcattggatcacttgagagggattgagtgcaatccttgaccgaaggaggtcaccacaacatggaagtaggcattggccgaaccacgggataaatcactgtgtcttgtgtccatctttttgtgattggcttttttctagaattcacactttagcaacttggtttaaattgcactaacattttacaaccaagtgttggctatttagtgttgaaaatcccaggatcacctattcacccccctctaggtgctctcaattggtatcggagacgtactcttcatctaagagactaaccgcccaaagag

SEQ ID NO: 7273 - DNA, 1500 bp, Zea mays
tctatagtgcaatagatagtcatgtggttaatggtgctttaagattgtcttaaattagtgtcttagtttaaattggtattagtttgaattggtatcttaatgatgaatagtggtaggttgatattcctgtgatatatccactaatttgaatggtgtttaactctgattatgtgcatttgtgtgttatagcatcatggtttgattcttgccacaatgcatactaaaaagtgctaaggtgtagaaatgtttcgatttgcctaagtatgtgcaaattggcgtctgaggccaaaattatgtttttgaagtaagcacttatttagggggagcattctataatcttagaattaaaatttgtgcttcaaatcttattcttatgtaagctttaattgtgttgccatcaatcaccaaaaagggggagattgaaagctctcttgtgagttttggtgtttggatgacaactcaattaaaggactaacaagtgtactaagtgttgaacaggtgcttaaagtaaagcctacagggttcaacacaagtgaacaaatgtgatggtccaagaactggattatggatacatgatggacatcacaagtaagatggacattgcataaagtgagactcgggtgcgtagctcggagacaactgatcaagccaaggacggaggcaagaagagcttcgaggtaccaagtgcacgggagaaggtcaaggaggctgaggaacccaaagccaagggtgaagaagaaggcttgcaaagtcaagggtgatcgagttgagaacagctacggcacatcaaggatcactacataagaacgtgacttacagccaatgaggtaacagctacagttatgtggtgtaagtcataaggctcaagaacaagctctaagaaggagatcaaggtcactagaaggagaacaagtgtcaaaaccagaactggaagcagcccaaaagagctaagttcaccttgatctttagtttgggttgttcctatgtttggagatgttctatgtgacctttacaggatgttggagccaagtaatgtcaatctagatcaagacaagccgacttgatgatttatgagtccaacatcaaagctcaagcatgtggaatgctatagatttaatgattaagagaaggtatgtttctatacttagtacattggttttgtggactaatatacttgtctaagtgttagaaacagaaagaagaagaaaagaagagaggtgcaaagggcttggctatgtacagccaaagcagctcagtctggcacaccggactgtccggtggtgcaccggacagtgtccggtggtgcaccggacagtgtccggtgcgccaggctgaactctggcgaactggccgctctcgggaattcaccggcgacgtacggctataattcaccgggactgtccggtgtgcaccggactgtccggtgagccaacggtcggccgggccaacggtcggccgtgcaatctgcgcgggacacgtggccgagccaacggctagaag

SEQ ID NO: 7274 - DNA, 328 bp, Zea mays
cgtgagctcgttggggggcaagtagtagctgcgagttagcgaaaactgctgccagcgttttaattagttgggcgtagattcagttgcttaattttgctggtattggcttgcttccctgtatttcattaggagatttctctatggattttgtttattcaatctgtcctttactgggaaccgcccagttatgtatgtcagcattctctgctttttatctcattcagtagttagtttggtctttggtcagctgttttcaatgtatattcttccagtgagactctgtgatatcttcctctcacagcaggcatgattcatacaaccggctagg

SEQ ID NO: 7275 - DNA, 447 bp, Zea mays
gcataggttcgttagtcggacctccactattttcttttattagaattattgaaagacgtcttaacagtatgcgatggtatgacattatatattaattttttgggtgacttacaagaaagtacgtgttatgagtccaattttaaagctaatagtaacattgagcatttctgtgttctttgaatctaatttttaagctaattgtaacaccgagcatttttatggcctgacggcacttacctatacgcaagttatagcggtgcgtatcttggcacaatattaaaatagagccagtctgggccgtaactaagtaccaggcctcatccatcatgggccgggccacccaaattttcgtctatataccacgtgtgcgcgctggagtctggaggtgcaggcagcggataacgtgctaaagtgtcctcactgctgctctcctccgctccgcagctc

SEQ ID NO: 7276 - DNA, 253 bp, Zea mays
ggtagaacggctgtgcttgtgcagctgcagcaggagtaggcgagtagcggtaagctcgattcccattcttttcttttcttttggcagcgtgtgtaaataaacagtgtgagcactggctcgttccagtactagaaagcttggttaggttgctgagtgatgagctcctgaggtcgaaatttgtcatgtagtttttattgatagataatttggtgttactattgctgggtcagatcctctgaaacgattgatctta

SEQ ID NO: 7277 - DNA, 371 bp, Zea mays
ggtaaagaagacttccaattttgcggtggtagtgttcgatttggttttgagcactaggaattttgggtcctgtggtttcctgtcgtggaaattgcctggattactgtagaacaactggggggatttcagatgacgatctagatttcggcgattgctatgctagttcactgtggaaccagtgaggattttgaccgactaaaccgttgggactctctgcctgctcgttcgtgcaggttctcgagcttgccgggaacgcggctcgggacaacaagaagacccgcatcgtcccgcgccacatccagctcgccgtccgcaacgacgaggagctctcccgcttgctgggcacggtgaccatcgccagcggtggtgtc

SEQ ID NO: 7278 - DNA, 1500 bp, Zea mays
ttaattaagatgaaaatgtaacataaagcatgattttattctgtttgttaatcgtaacagaaataaatagaataaaaacattttcagttgcgtagaaaatggatcaccagtgcatgcatgcggcagtagtaatcggataatgcttcgtatgattactctctttttttttaacccagccaccattttcggatccgatttctttcatgtcaagcatgcagccatgcatgtggccacatgcatgtatgctttgaccgagcaacttaaggaaatgaaagagctgggagccccacttgcacaggcacaaccgcacaacctcggcgaggtgcgcttctaggacggcgacgttggtgatcgtgaatcatagcgcttggactgcaggcccgagaagacctccttgaggtcgatgacgcgagtcatagcgcggacgcagaactattggtgccgcgaacccgccgatgatgatggcaccttgcccacgacgattgtgcacattcctttccactgtttcgcaagtgccggctacgcgttgccaaaccacgcaaagcaaaaccgccgccgccgcatccattccgatggagcgggggccacaaccaacacgatcgggcgcgcgtcatgcggctaggaaagtcgtcgccgatttctttacacgtgaacagttcccgcgaacatcatccaatttactaacagaaaaattatacctttcgattgtttagagaaaacatcgaagtctgtcgcgtaggacagttcggctaggccggaggacctgccgacttgatgaagagttgatgcagatctgatcccgcagcaacgtcgaggtagagcgtgctgataacgtgttgagaactacgttaccacggatcaccagatccgctttcttccctcccgtcagcagtagaggcgcaagaagatgtagagaacctgtctcccttcccataagcacgacagaggaaacacacgagatactggatatagggttgggcctctggcctctttctgatctatcatatgatggggtgtacaggttccttatatagagatgtgagacccctcaggggcagagccggtatttgcccacataaccctaactagggttacttaacaatccgttctgttgaaaattaaaagacgtgcgtgactcccatctgtagagtacagattcaaaacatkggacttgtactaaaaactagactacctctgcggagagggatagaaaaagatgcaaaacgaccttctcctgtcctgcatctgcatgcaataagcagccgctttagtgctgccgtgcagagagtacttccatgctgctcctggccgtgccggccgtgctggccgggttcctcaaggcgttccgcctcgccttcctgctttggccgctcaacctcgcgctcccgctggcgcgcgacctgccgcgggcctgcatcatggtccgggccatcgcgtccttctacgccgccgggctgcggggctacgtcgccggcgcccgccgcggggtgcagctgctgc

SEQ ID NO: 7279 - DNA, 1500 bp, Zea mays
tatatatatatatatatatatatatatataatattaatgtgtatgtgtatgtgtatactagcctatagctagtcgttgattaatctaatcaagctaagcatgagtgcatgactgtatgtctctagtataaaaatatatatcgagctgcatttacattatacaaaaacaaaatgcacgcagaacatttacattatagaaattaattaatttattaaatggaaaataaataaatcagcagtatcacaacacgacatggctccctgcagcagaacatttaatagacatacatacaaccatgcaggggggccggccgggagcagataattcatcagtccagacatcagttgatctgtggcatttaatttacaggccaaactgtcaaagcttggaactctcttaatttccgtcacacgctatgtctacatccactgagagttaactgtttccaagggccctgacgaactgtacgcatgcatgtgcgtgctccccgtcccacactgcaataagtcgatcgtctctggctttgaaaatgatctgcaatgtttcgaaaaaggatctgcaatttgaaactagcaaatgatgctctaaattttgtttttttgtttttgttttttttaaacttgtgtgcatatcttaaacgcaggcagcatagtgcacagtgcataggatagcagagaaagcaccaattatttatgccccccaggcgggcaggagcaggacagccacccacccatataaacatacgctgatacgcacgcctcaaacccctcactgcgagacagccttcccttccaaaaaaaaaaatctccatcggcctggccagccacccacatacagtaacagtagccatccccaagtccacctctagtccctcctcctctacccgtctctctttttctcaagagctacacgagagagagagagagagaaaaggaggggagagaggcacacaacgctgctgtgctgcacacacaaacaagtagcagtagtggaagaagcgaagggatcggaggaggagaggagaggaagtgtggccggtgacagacagaagagaagaagaagaacaagaagagatgatggtggtggtgaaaagagacggggatgatgcagcacaggcggtggcggcttcagtttgagcagctgcgtgcagaagctgagccaagaaagcaagcagcagctgcaaccgcttccagtcccccccctgactctcccagccagccgccagcaggctcagtcgcccaagcagcaagcaccaaagcgatcgatcgagctgctctccgtccgtgctggtccccctcgcgcgcctctccactcccccctctctctctctctttctctgatccatccacccaattcgccagctccgccgccaccctagctagctagcagctagagtacagaagcggaaggtagaccgctcggaggcgggaggaaggtcgaccgacacgagtagagtcgagcaggccggcacagcagcttgcctctcgaccggcggcggcc

SEQ ID NO: 7280 - DNA, 477 bp, Zea mays
tgattgtaattcctcacaggctgtgtcctgtgcctataaatagtgaacaatattcctttactgttcacgcattcctgtaattgcaaacacatcactcgggaattattgtttgtcaaggcaaaggtataaatgtacctaaacgttatattcaaacatcttagattcatataataagatatgtgaatgatatgtgaatgatgtcatttatttccaatatatttatctttaatgtttcatgttttacattactttgtattatgtttataagtttaattacgaaggtgaaaccttcgtaatattgtgctcgtgaccttcgtccgaagttcattaaatccttgtggagataatgcttcggcggacgaagggcattgatatttaacattttatgttgccttgttcttaattcatagcatttgagaacaagtccccaacattggcgcccacctccggtgaactcacttccacttttttgagctg

SEQ ID NO: 7281 - DNA, 1184 bp, Zea mays
gtatattccaactttaaacataccgagtaatatatagtatgcatatccaatatatgaatttatgtaaagattacttaggtctgtttgaaaacactcagtttctaaaaaactgatttatagaaattgagttggtttcaaatatatcagtttatgacttattttatagaaattagattactaatttcttaaaaataaaaaattggtctctcctaactaaaagataaaaactagttccttaaaaactgagttgcttccaaaatagttcttaattagtatttaaacactttcggacggattaataccgagaaaatacccatcccgtatttatcgcactctcggacactgctagctcatcagtaaaatacgtacgttatcccaattcactatcatttgcatgactaaccaaacccattctgcataaccacgtaattaagcagatgagtacgtccgtacacgtataaatacataagaacactataatctaccagctcgggtgggccctagctaacgagcacttgggtcgccaagctcaggcaggcaccaccaagagagcagaccggctcgctttcactttattttggcttttggtggtgtataaatacggggcaccagcagaggggccttcatctcgcctcctcgcgtccgatcgatccccatccccttccattgcgtgctggagccctcctccgcgcgctttctctggtgacgccgtccatgtctcctcctctcttcctgcacactgattgaggtcttcattcttctctctctctctctcctactgttagctacctagggtttgccatggccatcaccttttttgagccatcacactttactctctctctcttcacccatgacacatccatccagccacccccactagctctctagctagccatcctcctcatcaccctctccgcctctgtctcttgctgtcttgcggcactgttcttagctgcaggtagctccgtccagctcgacggttctctcttagcagctaaggaaggcgacataaattataaaaggcgccacttgagggcagggccaaggaaagttgtggtttccaactcctcacctcacacactctcttcttctctccttcgttctccctcgcaaagtcagggtcactgaaagtagcggaagagcccaagtagttcttcgccaccggtaccgcatcgatcatc

SEQ ID NO: 7282 - DNA, 312 bp, Zea mays
acggaccgcagacggatcggatcgagcggcgtgacacgagattctcgcctcagggctcagggtgtcttcgcacgcacgcggcaatggtcggccgaacaggagacgaggatctgcagcccagcaccagggacgagcagaccggggctgctcgcgcggccggacatggcgtggaccggtgtccagactccggagatcgtcatgccgacgacgtaacatgcgaaacgctactagtacaagaaacaacatccaagtgtacaatcccctgtactttgtagtcttgtttaggcaaactgttctctgtccatccaatcg

SEQ ID NO: 7283 - DNA, 864 bp, Zea mays
ttagttaacaaaatctttttttggaatttgcaagcgaaaaggtaatccctgattccaccatattcttctcttttagaaactcaatttagacagaccactaaatgattttaacaaacaataatgttttgtataaatatttttatagatattctgaatttgaaacgtttctcctgccatcagaattcctacgaaagtacaaaatggtccccgcagcggcgggccaaaatgctaacctacccgactacgcattctattatgtaactagtagctggcggcctagcgcatccttgggcgcgttttgttaagcatctaggctagtttataagtgttgttagaattgatgatgtaaaacataatagagaaagttttctgggtgataatctacgtacttattatggaagagagttgtatcaatatccaaatgttcaaaaggaaacagagcggaatatgtacatatatatggaatctagggaaacaaatgtatacttattagcactttttgtggtgtcatgtgacaccaatgaattttagtaatttttattaaaatgtatgtttgttagcatttaaatgagttgatgattttataatttaatagagatgacactaatagttgttttatctagatccgctctcgagcatcatacaatgaaagctagatatgtgagcaccttatatgtatgagattatgtatgctgtcatatttggcgtagccaattgttttatatatcatattccacttaatataatatagaaacataattaagatgtaccagtcgcgcgcatcttttccagtcgcgcccatctaactacgggtagactcggcaggacggcagcacaggtccacgcgggcgcggaggcaacgct

SEQ ID NO: 7284 - DNA, 1500 bp, Zea mays
aaccaagtggtggcatagagtgatccatatatgtcaaatttgattcaaaacgatttgagttcttacttgaattgattttgtagttgttctacttgctttatattgtgttggcataaatcaccaaaaagggggagattgaaagggaaatgtgcctttgggccatttctaagtattttggtgatttagtgtccaacacaagtgcctaagtgtaaaatggtggacaaagtacaaatcaaggataaaggtatgtttctcagacttagtacattgttttagagactaatgtattgtgtctaagtgctggaaacaggaaaaatcgaattggaaatgagatggctttgttcagccaagtctgctcagtctgggagcaccggactgtccggtggtgcactggacagtgtccggtgcgccaggctggctcgagcagagtggccgctctcgggaattcaccggcgacatatggctataattcaccggactgtccggtggtgcactggactgtccggtgagccgttcacaggcgaactcgtcgctctcgggagatgattaacggcgtacggctaaaattcaccggtctgtccggtggtgcaccggactgtccggtgagtcaacggtcagccggggcaacggtcggtcgaggattccgcgcgtgacgcgtggccgagccaacggtcacattggtgcaccggacagtgtccggtgcgccaacggctctcagactccaacgatcggcttcgccaaataaggaaggatatctgcaccggacagtgtccggtggtgcaccggactgtccggtgcgccagtcgacagaaggcaagatctgccttccaggattgctctcaacggctcctagctgccttggggctataaaagggacccctagacgcatggaggaggagaccaagcattccttgagcaatcttgatcactcacacttcattcttgcgcacttgttcgacattttagtgatttgagctccgttctagtgtgctagtctttcgagcttaagtctgggtcttgtgtgtgtgcttttgctgtgatcttagtgtcttgtgtgagttgctaatccctcccttgctccgtgcttctttgtgaacttcaagtgtaagggcgagaggctccaagttgtggagattcctcgcgaacgggattaagaaaagcaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctctgtgattgatctcttgtggttattgtgttttgttgagactcctctctagccacttggcaattattgtgctaacacttaaccaagtttttgtggcttaagttttaagtgttacaggatcacctattcaccccccctctaggtgctctcaattggtatcggagccgttctcttcacaaagggactaatcgcccgaagag

SEQ ID NO: 7285 - DNA, 674 bp, Zea mays
tatgattcgtgataacgtagttctcaatacaaggaatctgctctttgctggcatttgctatccacgctgagaagaaacgaaccaacaaatgggaattaggaaccacaggcaatacgagcagtttaggacatggaaaaaagaaaggaaaaaagaaataataaaaatagtcagaatactattttagtaataacacttataaatactgttatggacaattttaaattaaaagagtcctataatagcaataaacttatcggactgctaagacggggcagaagcacgtttgaattattgtaagcccatttgcgtcaccaggccgactctgggctatgaactgtgtacgctcggccggaccagcccatacaacggacccaacttcacaaaaccaaccaaaaggggccgaagaccttgttcgtcggcgtatccggattatgctggctaggacctaggagcgtgcggggccaccaaccgatgcgtccgtcccgtccacaccagtacaccaccatcccccaccggccaccacttctgctccgcgtccgcttttcagctctccaccgctatctcgcacgtcgctccccaaatcatcccatcctacgcccgcggccgtggcaccgaatccagaagcgtctagaagggggaggtggtcgcccatgaccgtctgaccggccgtcgcc

SEQ ID NO: 7286 - DNA, 1500 bp, Zea mays
ccgttccccgtttgcgtcagacagcgggaacggcaagcaaggaaaatgaatcccgcgctagggagcattcgagagtttgccatgccgcatgaccatggcggtgcactagattacctgcgggaaaaggaggttcactttgccctcgagcagtcgcttgagcccgaagtttgcgtcgatgacgccccgaataaagcgtaaaaccaatcatttgtttccacggatccccatctccaaatgagacgccatgttttgtcttgtcccctcgcgtcgcctgcacacgcggagcacggagcagttccccaactggcaggtcctccgtccgtcctcgtgcagtcggtggtgctgctgtyccttccacgtcgtttcgtttcgtttcgtttcgggcggcggcgctgccagattcctcgtgcctagtagtccggagtgctgacactcgggcagagtagaatactcctgcttggttcgcatctcatctcgtctgatctgttctgcttgctcgcacttctcaactcatctcgtccaaccagttggtgctctgacagcaagccaggtttatttaatcgggcactttgttcctaagatccctccctctgcccactagtgttctgcaaagtcaaagcacctgaggtccgcccgacccgtcgtcggcgttgaggaacggggaacggacggctctggcacgcacggggcaacaggctcgctcagcgcaaggcgcgcgcgcgcattgcttccctgctctggcccctgggtgacgagagagtgaccgatccctatcaggtttccctggcttccacgccacccacagcgatgcgaacgcgatgtttgtgctctagtgctcaggtcagctgccagccaacgaatcctatcccatctggtattccggtggctggcggtggttgccgtcggaattttccagcggagagcgacggccagcctcagggcttcagccacttgccgggagcaagatctttcccaaaattccagtggaatccgcacagcggagcgctgcctgagtccgtccccgttgcttgggtgcctgtgccggacgcccgcagtcccaccgtcccaactctcaaccccagcgcagcagcctgcaccacaccagaaaccacaccaccacgctcaccgccgtgagcccgtgacccccacgtccccccacactacggcacgtcggcaccagcttaactcccggtccgcggcgacacctcaccatcgcgcgcgcacagccgcacacacacgagcgtgcgccgctccctgttcctcgtgaccccactccccgcctcccctctctctctcacacacacacacacaagtcggtgctgcagcagcagcagtcgcagtccagccgtgagctcttgccgtgcgagcgattcaccgcagggcgcacgggaatccaatcaaatcccccaggaaggtagccccgcggccgcccgttcctcgctccgccccgcgccgacgcttctccccgatcccgatctgtgcgcccgcatcctgcgtggg

SEQ ID NO: 7287 - DNA, 286 bp, Zea mays
ctgcactgggatcctgcagacggtgctgaagcttggtctcaaagaccagttccagaaagcgttgagtcctgaaacttattccctctgcgaggccaagctaggggctgcgtttaccgccttcaaaaagtgatcatgtgggacaccgattaaattcatttcacacagaccgtggatccttggaagttttataagaagaattagtgtatcttctagtttttgagctcggtgagagtaggatcaatcaaattaatgggtgcttgtgctagacttttagccgcagggaggg

SEQ ID NO: 7288 - DNA, 1500 bp, Zea mays
gatgagccagagcgtgttggagtcggagccggtgacgtcgtaaagcgagtggtgcagccagtggacggcgacggcctcccgccgcgtgacgcccagcttctgcgggtcaacgttgccgaccttctcggcgacggcgcagaactcgaagggcaggccgagcgtgtcggcgaagtcggagaggcgcttccccgtcgcctcgagcgcctccatggacgcccccaggccggtgagcctgaccctgggcgggccgccggggcgggaggcgaggatgtggaagaggcccggccactgcaggccctgcatgatgtcgaggtcgatgatgtgcacgcgctcctcccgctcgaacgcctcctggatggcctggttggcggtgaagtgcgagaacttgacgaaggggctgatgccgttgaacacctggaacgcggcggccacgcggccgtggaggcgcgccgcggcgggggagcccggcggcagcggcgcgtacaggcctaggcaggagctgacgacgcgcgccgacatggcctccgcgaagtaggcggccacgcgctgcgtcgaggtgccgaacggcgtggccagctccgcgatctccagcagcgtctggtgcgcgtcgtcgaggttgtccgcgttcacggcctccgcgcactgcagcagcagcgtcagcaggtggaggccctcctcgtcgcgctgcttccgccgctgcacctccttccgctccttggccgcggcggccgaggccgcggcggtctcctcggcggtcgggaccttgggcgactgcggcgccggatgcggctcctcctgctgttgctgctggcaccgcggcgcaggctcgtggcggcgcttgtcaggaagcggtggcgggagagggagcgccagccccgcggcggcggccggagcgccgtgcaggagagcgcgctgctgctgcggcagcggggcggggtcggcggcgagaagggaacggaggcggagctcgaggagggacgcgaggcctgggttgcaggggtggatgatctcgcggacgttgtggatgagctgcgtgatggagacagcgccgccgccgctgctcccgatgatgtcgcggatgatgccgtccacccacgcggtcgtggacgcgggcgcctcgccgcccgcctgcgaatgggccggcgggtgcggttgcgggggcacgtccacctccgccgcgtggtgctggaacgcggggggcagctggtggagctgggtgggcagcgcgggtagctgcgcgctagcggaggacggcgcgccaggaccaccaccggcggcggctgcggccgtaacgtcggagaggtcgcccgtgacgtgacggcgcggcggcgggaggtccatgtcgggcgcggggcgcttgcggaccatggtggcggcttcttgctcgtctagctggtggatgtagtggatgaggacgtggtcttgcgaggaaagaggaggcggggggttggagcagggcagcggcggcaataaggagtgggaggaggcgatggcggtggc

SEQ ID NO: 7289 - DNA, 763 bp, Zea mays
ttttgtagactaaacgagtatgattcaagcataagcgcggttatgtcatattgcgtacaaatacttttgtgaaattgttatgacggagtagtatgaacaagtaaagtgtggcattacgaaattttttttaaacttaaaacttgtattacgtcttttccgtatttgaaaacaaacaaataatatttttttttcatttttgtaataggagcgcacaataccgaacgcatgaaaacatataaaaaatagaaaatgaagttggttatgttagttatattggaaatgtatatttaatgagtagagggatatataagagaaaatttagggggaacggttgcgggacgagtgaatataggagagagaatcttgctgacgtggctgcatagtaatatttaggggggaaaatttagagggaacggttgcggatagtcttatattagttcttgcagtgctttgtcaactcgccttgtcatgccgttagttcttgcacttgttttgtcaactcgcttcgtcacgccgccgtgcgagcccgaaaatctgagcttcaacgaacaacaagtcaacagctgatggcgctatcctatcgtcagaaatttttttgtcagaacagacaagacaagaaccacatttcagtcaagagtggcagaaaagtctgagaactcgccttcttctaatcatctgagttgaattttctgagggatcatccagtgagtcttagctataattctgctcatatctccttgcccagaaccttataccaacgggc

SEQ ID NO: 7290 - DNA, 1500 bp, Zea mays
ctttctagtgtacaacctttatcgtcagtctacagctatattagtgccatatcaaattttcttttacatacttgtatgtaaaagaaaacacgactcttaattcaaataaagaaacaaaatgcgaaaacaaaaaaaaacatagctcgttaaacaaaataaaactacataaattaaataaagtacataaaatgtgacaaatcttaaaaataataaaattgctaagttaataaaactattcttcatccttcacgtcctcctcatcttccttgttttcttggccatctacttttaattgtttgaccaattgtttaacggcaaacatataaagccttctcatgttttcatttatattgttgacgttctgatccatcatattggcgaacaactcgtacaaatttgcataatttaacttctcgctggccttgtagagatgcttcggtatgaccttcttttagccaaggtgttcgttgtcgctcattgttggccctttgcccttgcattgcgctcttgccctatcacgaccaatatggtgtggtgcttcgacactatcgaacaatccaaagctataaccctccttcacattgagacatgattgtttgctcgtgttgcccgagttggacgtcacatgttccctagcttaaatttcatttcgtcggggcctgctaagcaagctattttttgtcgctaggagcaactaagcatcatcgaatctgctcggtcgggccgtagacaagcagttgtatatatgttattgaagaaggtaacctttcgattgcttatggatcactgatccttaagctatttggcggtatgttggcaagaagactcggtggtggagttgtatgtggcctctatttagcccgaaaaaggcaatcttttttggtgttgtcgtcaatagggtcagcggagtgcattagacacacatgcacctacaagtgtacaaactcatatttgttttttttcttccctctctaattatctagaccactcagcaaacattcaatcaagcttgtggagacggaaactcacgacacacatcacaatgagccgagccgcaggacggcgtggacgccgccgccgatcggccggcgaccagattggcatgggaaatggacatcccttggtggcgccggccggcagggcctttcccgtcagaacggcaccaaaagtgctgtgccaccagcccaccactgacaagtcggacccacgacgtgctgatacccatccatccaccaacaactccccgctccggtgtccggtcgccgtcgcgactcacgcaacctcctcggctcgctagccgctacgctactgtctacgccgccacggcgccacgacatctcccataagatggtagccgcagccgcagccgcagctgcagccacagccacagccacagccacagccacagccgccgcgctcctcgcccccggtctaaagctctgcgcgggccgcgcgcgcgtctcctctccctccggcctcccaccccgccgcgtcactgcc

SEQ ID NO: 7291 - DNA, 297 bp, Zea mays
ctccaccatgccgaaagagcaaaggcccagtgtcccagttgaagcccttactttgccagcccaggatccaatcccatttccccaaatcgccacgagaccacataccaggccaccaccatctctagaaccttcctcctcgcctccgtctttccctcccccagctcaggcaggaccgcaggagccagacccaaacccacgaaaccctcctgcctcgccgccgcttcctcatcctcccgccgcttagtcccggacccggaccaaccttcgtgaggacgggaattggactaagggggtagg

SEQ ID NO: 7292 - DNA, 364 bp, Zea mays
ctggacggcacggtaggtcggaagtctgaacatacacgcgctccgttccgttggattcctccgttgtcctagtgccgtgctcctagccgtgagcccgtgacagttcaccccgtcgtatagccaaccgtcgccgtcccatcgtcgtcgccgtcactccgcggtcgacttgtcgtacggtggtcgctatcccttcccgtcccttgaaacgaaagccaaatcgatgccccccccccccaatgccccatccccacctttcggcttgtttacgctacgcctttttaatcccttccgccctctccgctccccgttgcccccacccagaccaaacccaggcttcccgttccctcgcttttgtccggcggcc

SEQ ID NO: 7293 - DNA, 1500 bp, Zea mays
aaagtttttcttaggattacagatcaagcaactcaagacaacaccttcattaaccaagcgaagtacaaccaagacattatgaagaagcttgagatgaaggatgccaaatccatctccaagaagtttcaaaaaacttctctaatttatttttataaggtttaaaacaacaatctctaacaactcttaaccttatctcttaatctttaaaaaacaaaccctctaaaaaaatacatgcacttgtgccgcctgcggtagctctccttctagaccaaagagccaatcatgtttgctgcagcatgcacgcccatgcggccatgcagcacacaatgccccactgcccgagccggagtcgaggtttgctactttacgcagggcgacgccgagcacaccgacgtcgtcgtggacttgtatgcctcgtgtgtcccaccattcatgatgtgtcccatcatgcccgtcaagttcatcgagctattcacttggctttaatctgaaacggcttctactgtttctacagtgttttgtatgtatccaaacaactgattttaatccgaagcgaacattctgatttgccttcgccactactaaagatcgacgtataccaccctccgcaaggtcatgacgatcatcaccggcacgctgtccagtctgaacctagctatagcaaagggtgtgacggagacatgcaagcaacacattatcatggcctatttttcggtactcctaataccttttgtgattaaaaaagtaatgattttatgaataaatgtttaggaattattgtgtatcgtctaaggctgttcccaaaccatactcgtttaatacatgccatataaacatttttgataacactacaagagagttaagagaaaaatataagaaaactatatcacgagggagatactgtttcagctcgagaccttatagcaaaacttaaatcatccaagtaatccacacatcatacactcatatatgctagtatttaatattttatagaggataaaaacaatctatgatactatgattgagatagttgtattttatatacttttatataatataacagcttggatattgtaacaagataccatagactcaaaatagccttatgtcaaatagaggcaaaatcaaacgataaggagtttaggagggcattgtggtcattctcgtcacccacgttgtgccgcgtccggtcgtttcgttaataccaccagtccaccactgcctgcctggccttggattggaatctctgggcgactcgacctgaacaaccccgcccgccgtcctgcccttgtgctctagtcctcccgcgaccgttccaaattcttcctcgcgttcgtattccacgcggcgacgtcgccatcgccatcgcggccgccgctccgcccctcttccttcgcatatacgtaggtaggcgcctccccaaaccctaagcctttatctcccacgcgcgcggctcgctctgctgcgccgcggctcgctcgaccccgcagatcgccggcg

SEQ ID NO: 7294 - DNA, 402 bp, Zea mays
tgggaccttgtcccatagcttgggtgaagtagcactgtgttcttgcgcgcgcctcggagctcgatttacacaccatttctcacgcgcctcataatttcacacgagagagggagagagatcagatgacggcggttaaatgttcaggaccgcgggggctggattgttgctggctccgttctgggatcatgcaaagttggtactgattgaaatccgacgcctttctgaacttctcagagcattgaaatgcgatgacaaaagcgcgcccacgagcaacatgaaaaggacgccatcatggcctctcgttgctttctgcatctcccgagcttttagcgcctatcacactaatcaatctagtctgaatctaatccatgcccccgattcgctaatgcttcgttgcaatgc

SEQ ID NO: 7295 - DNA, 1500 bp, Zea mays
gcaaagtgcgcgtacgttgatacgatttttatttatacttgagtacatagtataaaacataaagactcgtgcgttttgttggttagatgagtgtgaatatgagtttggagtcaataacttgattcaaatctgaatttatgtgtaattttagtttttttactatttaaatgcggaggagcagaagaagacaatgaaactgtggaaactggtagtgtgttcatgagcaatatcaaaactggccggatgcgtcgtttgatatctcgatgatatgataagattggccacaagtaatgagaaaattctctatatatgtcactataattttgtctaataccttatttatcatcacaaatgttataattctttctatacgatggcatggatggataagaaattacatcctcgaaagacatagaagggattatgacatttatgatacaaaatacggtcttggaaaaaaaatgcactggctgcatagaattgcatgagtaatcagcaggactaattgcatcacattcacatctgagaaaaccaacatttggatatcctaatacatccgcaaataggtagtaagaaataaatctatgacacatgcttaaagcattgtttgtaggtggaaaacaatttacacgtgacatataacatatgcctgtatgctgtatgcatgcttgataagtgcaacattttaacttttctagatacatattgattttactatatgcatttagacctagtgtatatctaaatacacaataaaatgtatgtattaaaaaagccaaaatgttttataatttgaaagatgatactatagctgacgatacagtataacttgggattcaagggatacgcgagatagagtaacaagaaatcctatagtgtgtacacttgtatggatttgtcttcaagttgcatggaagcatttcttatatattaatatcatgtattcatgttttcctttcatgcgagtcctaataacacgcacctagaagctagatgtatactactagggtggaatattactacaaaaatagtcagcatagaaatcaaaactttggttatgatatgatgggctatttcatttccttgttcaacaatcagaactaaaaaaataatggggtcgtttagatatatagtagaatgaccaaggcttggcaactgcataggcatagcatagcagcccgtgcaaagcaagcgaaagggacccacgaccacgagcaggaaagtaaacctggccaagtggtaacaccgtcgtcaggtcccacactccagtctcagtatctcccgtgctacacacgtaccccgttcctggaggactgactgcctcgacgtcttctctcccccgtcctcccattgtcctttataaaggaaggtggcaatggcgtctccaccgtgaagttgcaaagctagctcgcttgcaagtcgcaacggtttttagctagctggttgcgcgtgcttttctttatttgcgagcgagaggagtttgttataacgaactgagca

SEQ ID NO: 7296 - DNA, 100 bp, Zea mays
ggtaacgacgcgcccgcccgccccatggtcccatttataggtcgaattcgatttcatatctggagcgtgccacagcgagcctagacgactgcttgatctg

SEQ ID NO: 7297 - DNA, 322 bp, Zea mays
gaagtttgctttgccaccgccttaacaccgcattgccatgcactgaacgccaccattagagcgtcccacgacctagtgacttaaagagatagatgatctcaccactgcactagatctgtcctcctgaataactaactcaatccgtgagttacatgtgtttaggatttttaaggcaaattgtgctttttttatgtttaccgctacaatcactgattgcaccctaagtaaccatgacaattactctatatccgaagattagttcaagaaggcttgtcctctcgttatggtattaggctgaaagtccgttctcttctgatgcagg

SEQ ID NO: 7298 - DNA, 1421 bp, Zea mays
agccccgtatagccaaaattgtgccgtttttagagtatcaactacagtctagaccaaagttttttaaaccatggtattgttgtcacatacaagtgcagaccatgatattctaaaaccatagtattcaaaaacattggtagcaaacagagcctaaataagaatcacatccatacctagtgcaagagtgaagtcaatgtaaccgcttcaaatgattccattataaccgcaatttgaagttgatctattgtggtagaaatcctaaactagaataaaatctttaaagctttcaagtggtgttagattgttcgtatcagatcgtgcaaaatatagaatttgcattgtagacgacactatttaggcaacaactaatatgaattggaccttatgtgcaagcgtgcaagcaaggtttttggttcgtttgattatgatccaatcatgtatctcatttaacatttaaactcttccaccaccggctcgagtagatttatagaaaaccccctaacataccacgttcatgtctacagttagatcatgatctaacggaccaagaggctcgtttgcacgcttgtgcataaggtctgattgcatattagttgttgttcattatttatagacttgtgacttgtattggatttcgacttcctttttaggagggtttcacttgaagaatttcaggtccgttccagcttcttctatccaaacaggtctaactacaccagtcttaacttaaaaaaaccctaaaactaaaggctagtttcatgaattttttgaagctcctcaaagagagcttcaaaaacaatctttttgatagctcctcatgaagttgtacaaaaaaaattacccaacatatcattagttagatgacctactcattcatgtctctttcctcacccgctaatcatcaaggataattaagaaaagtcacaaattaattgtattacagaatytagagtctatgtgcaagctaaacactcttaaaatccaccttactagttcgttcaagctatttcatagtgacagtagaaaaacgaatctgcaacttcaagtgaagtctttccaaacattccaaacatgccttttaaattattgttgtcgtccccgtggtggtctattttggttgtccgtttattccctgccccccatccctgtgggaccaacttgcctcgcgtcactggaatagggagtggtcactctagagtctagaccccactagtcagcgaacctgacagtatggacccactcttctcgatgacgcggcgtgcgtttccgcttctggaatccagttctttgctttgcccttcctccgcccccttcctccccccgcgctgcctgccgtaggtacgggaagggaaaaaagtcggcgccaaatctccgcatccattcgcacgccgcgattcttgtgcgcgatccgccgcgcgatg

SEQ ID NO: 7299 - DNA, 997 bp, Zea mays
tcgtcctgccccgctctctccctgcctcctccctcggagaataccatcagcaatcagtccactccgggctccaaatccaccgcaacccctggatccagtggcccgagcgccgggcgcaggacgacgacgactcccttctcctctctctacgtcctccgaggcgagagagtcgggcgaaaatgacggggggccgcgcgaggcggctcggtgatggggtgggaggcgggcgagcggctcggcgcgggaatttagcatcgatcggggtcggggcagagaaagctggagcgggactgcgggagtggaggagaaccccgggtcgggaggccacctactactccgctcgtctgttgctcggggaggcggacggcctgcgacgcgttccgttccgttgccgtttgtcctttcgtgacgcccatggaaccaggaggtagggactagggaatagccaaaaaggaatggggcaaaaacacaaaacgcactgggtgcaccgtgcacgaggcccatccctccacggcccggcctgctttcctgaggccagttctgcgcccaccacgaagcgcaccaagatccgacggctagaaatctccttccgccgcctatataaccagcagcgaaatgcgcgtggtcaaaccctagccgcctgcctctcctcctccagagctcgtcgccaccggccaccgccaccctcgatcacgccgtccgtcgaggtaaagttagtctccacgcccctttccctccgccctagtcctccgtagctctccgccgcgtcgtccgtcgaggtaaggttagtttccacgttgttggtgattcttaaacatttaaccgcagtgtgccggcgttttctcgtcagatgtgttatcagctgagtttctcgtggagtcgtggttagattagacggtgcaatgttcatgaatcttagtttttgttgatcaaagcaggctaacttcgaactagatgatgttagcgcggaatattagtagggtctttggtttcagga

SEQ ID NO: 7300 - DNA, 142 bp, Zea mays
aatagcaaagcaagcagagatctgggctggtgctttaaccgagggaggcgcgccatgttgctgcggctggctgctgcgcctcccagttccgtatatattattattgttattattatggtataataactttgctcgcgagaca

SEQ ID NO: 7301 - DNA, 197 bp, Zea mays
gtcccaaacccataagccacgcaagcaagcagcgactccgtccgcgcacggcaccttcccctcccccgcacggccgcacacaccagacaccaccaccactcgcaagtctcttcgccgtctcgccgagttattagaaggcggggaaaaaaatcaactcgaacgggcgggtggcaaccaaccaccaagcggcgagggcg

SEQ ID NO: 7302 - DNA, 600 bp, Zea mays
ggatgaagatatgatttagatgaggttgcccaaatccggcacttcaactctcaagccactactatacttctcgcctctctaagtcgagaggagtataataaggtgcaagggttgaagagcgccaaagagatttgggatgtgctcaagaccgcgcacgagggagatgaggtgaccaagatcaccaagcgggaaacgatcgagggggagctcggtcgattcatgctcaaccaaggagaggagccacaagccatgtacaaccagctcaaaaccttggtgaaccaagtgcgcaaccttgggagcacaaaatgggatgaccataaaatggtcaaggttattctaagatcacttgtttttcttaatcctacacaagttcaattaattcatggtgatcctagatacaagctaatgtctcccgaggaggtcataggaaagtttgtgagctttgaattgatgatcaaaggctccaaacaaatcatcaagcgaggcgccacctcaacacccgaggtgcaacccattgccttcaaagcaacggaggagaagaaataagagtctacatcaagtaggctccccatcgacgcctccaagctcgacaacgaggag

SEQ ID NO: 7303 - DNA, 1500 bp, Zea mays
tgattttgaacaggccaagaacatcaaattcacattggagcaacatatgttctttgcaatattagtttggtaatttgaggtggcagacgatattactccaatcaagattgagaacttcgattgatctctgagagagtggtgtctggttcgaggttttgtacacttaacccgattatatgttcagtacattagccattgtagtgtctttttggaatataacttcattttattttagaggattgatcgaaaactcattttgccatgtaactatattgttatgccatatggaaaacatcacacaacgacctagattttacatatcatagtgatgtttatcgtttcgtatctatattttatactaatttaacttacgtggcaacacacgagcacatacctattataataatatttgccgtccgtatatatgtatcatactattttttcacttccgtggcaacgcacgggcactgacctagttgctttgaaaaatgggaaggagtgaaacgggaagagaaaagagagtaatgcctgaatttggtgaatatcagagacgaaaaatttatacctccaaattcagggcgttacagtggtgtgactgaacctcggtaaaaatcgtgtgtcttgtgtgcttttgtggctgtgattttctctcatcatctcatatctttgatctatctaattggttttaattcaactcttctgttgcatttattgttggtagatttgagtagttttatttaagttaggagttgaacagttgaattgcggttgaaccggcctcaagaccggttgaaccgacctcccctgttgaactgtcgtttctcacagaagttcgaagtttgtgttgagaattgcaggtgtagcctgttcaccccctttaggctactttcacaaacacacaaaagcaaaaggcagccacacaacacaagaaaaaagatcacaagaacacgttctcacaaaatggctagaaccgcccaaaaccgtgctcgaatctcactataatgagatgaatatgttgtggcagagtatgggattaatcgatagctcttgaagtacttgtgtattgaaggagatcgaaatggagagcttttaaaatattaaatttattatataattcggatgtttaggattyattatagttaaactcttctacttcgtgtttaattttttaattgaaaatgagaaccgataattatcatcaagtcagtaaaaaaaggaaaagtgaacgaaagaggagcaatctacagcagcaaatatggaagcaggcctcactgtcacaaaggacccggcgccacaggcccagaggccacgaccctctcgatccgcgagccgttgcctatttatcggggtccgccgggccgagcgccgcagctttgaacctggttctcctgtcgctcttcgtgcgggcgtgcggcacaccaccagaagagcggccgagcggcgcagagaagagagaaccagccgagcggagcggctgcgcttccggagggaggaaggagg

SEQ ID NO: 7304 - DNA, 346 bp, Zea mays
tggcggcggcggcgaaggtgctgtgttgctggaggatctgacgagcgactcgggatgttgcggcggcggggctgtccgaacggtgccctagacgggtgggagaatttataaacgccacgctttactgggccggctgttttgaggcacatgcacatgtaaaatgcccaggccccgctagcagcccagtaactactaactagccatatccgcgagagaaacccctcgatagcccgcagcattgcggcgcgcgagcacaccgaaccacccacctcggcggcggcggcggcggcttttctgcctgcgaagagagaaaccaaggagaggggcaactcggaagagggcgagg

SEQ ID NO: 7305 - DNA, 377 bp, Zea mays
ggtcagtgcattttctgttgccaagtcataaatgttgaatgtctgactgttcagggtggatttgtatttgctagccatgaatttgtcagagtgaaattccatatggattacctcaatttgttcacacaaacatctacaactagataatagttgcagttcactgaatatcttttgtacacaacattgcatacttaatcaagacttttggagttgcttaccgaacatctcttattaccatgctgtatgtggttttcggttgatgtaatagtatagcatgttttttttgtggctattccagctgtgctgattgtgaggaatttggtagcacctctatcagggttttaaaactagagtgctgccgccccagcatacataat

SEQ ID NO: 7306 - DNA, 56 bp, Zea mays
agtacgtcctggacagggagctcggccgcggggagttcggggtgacgtacctgtgt

SEQ ID NO: 7307 - DNA, 1500 bp, Zea mays
tttttatttggagcaatttggcccggaacattcggaatcgttggctcacacgtatcgcacgggtccgtcgtctgttcgtgcagggattttctctgtccactcatcgttggtgggttaagagtgtgtacaagtcttacggcgagaggccgggaaacaggaaatttccaagtcaccagcgagtatgaaccaagaaagcatggaattgtagcctggtgtgcgtagaatttgatcacggcggtgtctccgtcccacaagcgttgagtgtacacaatggctttcccactctatcaggataggtcacggagtaagtattgtttttttagtgtgatactccatactgtatgcacgtatatgaatatgatatgaagtggtgtggacacactcggggctaaggaaaaaaagagaatcagggttctagacaccagaaaaggtgggtacgtggttgttgggtggatattccggtttcctaactaattcccaacgcaccacccccccaagcaagaaaccttttacttacacatacgcatacgcaccgctaaaacgtttctcgatctgccgaaactaccctccccagcttcccccatccctccacgcactgacagatcacgtaatccgtcaggggtatcttggtcgtttaatgctggccaggactactaaccgtgtggcccggtgtgtaccaaagttcccaaaaaaagcgacatttgcggaatccagcgcctagttttacgaaatcgcaggtggcctagcgtgtcgtgatcggtttccgtggatcggctcgaaatgcgtcgaaactgaggggcggttcccgcaaaaccggtagtggcggcggccaccggcaggcgtcgcgtcggcgggtgaaaggcgccaggccacgccacccgggagccagccagcccccaggtcgtcccgacgcctcctcgcagcgggaaggagcgcgacggcgtcatcgcgggcgaagttgcgtgacgtgacgcgatcacgcgacggcgcccggtctcggtctcagctggtaacccgcgctgcccgtttccattccttcacactgcccggcctgcccatcacggattcaccctgcagcccccgccctcgcattaaaatctactatagtaccaaagcgagccggggccccgccacaacgcctcccgataaacaccaccatcgattccccgccaccggctggctggcccacgccgtcagcgggagtgccgccgaatcggtgtcggatcccaaacgccggtctcacttttataaacgtaaccgcagcagcggagatgggggaggggtggcggttttattatcggagaagcaaattgaattgaatggcaccggctcccattagctggacccgtagctgttgttgtagccatagcatttggaggtagccatagcccatagcattccattcctccctccctccctccctcctcggtagattcgtctcgtcaccttcctcctcctcctctctttctgctctttttgccccgacctgccccgccctgc

SEQ ID NO: 7308 - DNA, 856 bp, Zea mays
tttttaacaggagacgtaaacggttggaaatagctttgttggtttacctctatcgctccgctagcaaatcataatgcgtgacttcaaaaaatgtgctttagggacgtgacttcaaccgtttcaaaaaagttgtgctttagggacgtgacttcaatccgtgttaaaaaatgtgctacgtgactttaatccgtgttaaaaaaatgtgctttatccctaacctgttttctttaccaagtctgcatcgtcataaaactccaattctaaaaccgacgagaagagaccaccgtgaaaaaaaagagatactcttttgtttgatttggtccctaacctgtctgctgtaccaagttcacatcgcgtcattatcacattatgtacactctagattcacgtgataccaaaggaattctcatgtgattctctgtcaaatcctccgactgaactctgaaactcttttcttttctttcctgacgacgaaaaaaaaaccgaagacatatatcctcctctctgttggcgtggcgctcctactccccaaccataaataacctcacccgctctccctccgccctcttcccatgcaccgcccgctgccgtgcccgccctgccctccaccttctcccggcgcaataaacaagtcgaggcgaggcgaggcggcagcggcggcggcggcattgccgagatttccgtgattcttgcgcttgttagttgtgctgtgtataggtatatactacgacctggttgtctcaactyttcctttcgtttctcttattggctgctgtccttgggagttcgcttcagttgggccggccgggggtggttccgttcagttccttatctgttggagtagtcgtcggcggcg

SEQ ID NO: 7309 - DNA, 258 bp, Zea mays
ctgggctgcttggcccatgggcattatgccaaaaacataaatgtgtaaaagtgtacttacagaagacataaatggccaaaagggggagctatttggtgccttgaaataaataaaataaaaaatatgttctttggcttctgcctactatttaaaatttacaaatgatttgcaggtgagtcattagaagatgctttgaggcaattatacctcattgatgcaattgatgaaaacggacaaataacggatgttggacgagtt

SEQ ID NO: 7310 - DNA, 1500 bp, Zea mays
ggtcttggaccgctttgagaggggttgattgcaaccctcgtccgttgggatgccacaacgtggagtaggcaagtgttgacttggccgaaccacgggataaaccactgtgcctctctgtgttgatatctttgtggttattgtgttttgcaagaactcctttctagccacttggctttattgtgctaactcctaatcaagttttgtggcattaagtttcaagtttttataggatcactgaaagggaaatgtgcccttgggccatttctaagtattttggtgatttagtgtccaacacaagtgccttagtgataaatggtggacaaagtacaaatcaagtatagaggtatgtttctcagacttagtacattgttttagagactaatgtattgtgtctaagtgctggaaacaggaaaaatcaaagttggaattaaagatggctttgttcagccaaagtcagctttgtctaggtgcaccgaactgtccggtggtgcaccggacagtgtccggtgcgccaggctggctcaggcgaacttgctgctctcgggaagtgattaacggcgtacggctataattcaccggactgtccggtgtgcaccggactgtccggtgagccaacggtcggccgcgcgatccgcgcgggacacgtggccgagccaacggctagtagggggcaccggactgtccggtgtgcaccggactgtgttcggtgcgccaacggctccaaagcgccaacggtcggcttcgtcaaagaaggaaagaaatccgcaccggacagtgtccggtgcgccaggcgacagaaggcaagaattgccttcctggaatgcactcaacggctcctagctgccttggggctataaaagggacccctaggcgcatggaggagtacaccaagcattctctaagcattcctaaacaccaagacttcgattccgcgcatttgattctttgtgatagcaactagagctccatttgagttgtgaactcgttgagttgtgttgtgagctcttgttgcgacctgtatgcgtgttggtactctgatttcgtgtcttgtgtgtgttgctcatccctcccttactctgtgcttctttgtgaacttcaaagtgtaagggcgagaggctccaagttgtggagattcctcgcaagcgggatattataaagtgaaagcaaaacaccgtggtattcaagtgggtctttggaccgcttgaaaggggttgattgcaaccctcgtccattgggacaccacaacgtggagtaggcaagtgttggacttggccgaaccacgggataaaccaccgtgccatctctgtgttgatatctttgtggtcatcgtgttgtgcaagttctcctctctagccacttggcttattcgtgctaactcctaatcaagttttgcggattaagtttcaagtttttacaggatcacctattcacccccctctaggtgctctcaattggtatcagagccgttctcttcaagaaagggactaatcgcccgaagag

SEQ ID NO: 7311 - DNA, 173 bp, Zea mays
actggcccgaaccaacagtagaacggtatataaatacatatatttaacataattaatcatatataataacatattatttatatatattaagacaacaaaatatttatgtatgcattttatatttatgtatgcattttatatatgtttggccgcgtatttagtatttacatact

SEQ ID NO: 7312 - DNA, 1500 bp, Zea mays
aaggaaaggaatatgaatcaatctagagactacggtgtttagttccggcatgactgaggttgactcgcccccagcacagtcgggatacgtcgggaccgtacgcggtggcgtgtcgtcgtgctgatagggacttctcggcgtccctttggtgtgccgcacgtatgtccgaacgtggcttgatgatgacacgtcttagcatagttgacgtgggttaacagtgctggatcargaccttcgccttgctgagttgctcggacgttccggttcacaggatcgctcgacagagtcttggtcgttatggacttagtcacccgttccacctcatagagttactcggcagaggacctggtcgagcgctacgcctcgcagtcgcagggttgctcagcagagggtctggtcggcaagtgagccgctaaaaaggtttactggtctagcgagtgacaattgtgaggccacttgcttgatcaggtgacgatgtggactgcatgttggcgtgtaatagattttgaaaggaaacagggacggtcatattttaccatacgtacaggtacattgtcggtacaggtactagtaccggccaagggcgtaaatgcagcaagagatgcgaggcagtaggagacgcgcatggatgtacttggagtcaatgtggggttataccacacagctgcacttattgcggtgtggtgagtaggtcacactggcactgcccacaactgggactgggagctaaacagagagccgcggcgacggcgagtacgattaagcaaagctaagctagggcagcggagagaggaaatgacaatggccatggaggaggaggagtgtggtgatggtggctggccggtaggccatagtgcaggtgtgggagggggtgaaacatggcgctgtcggtggacaagggcttctcctccctcacaccggtcaccacccgcaagtcactctcaccactgccttgtgtgggggagcggtagactggctagactcattcaaaatacacacccaaaacaagccaggcctaggcctgcctagccgggttcccctcttcactcttcaactctccctttgtcgttgttcccttcttcctcctccytgctctcggtaagggtgcaagcatagatggatgatggatggaaaagatggatatgttttttcctctataactagctagtagctctctatctctctcaaggaaacattccccactttatttgggccaaaactgttattgcgattgctatggttagtgtatttttatcggttcttcgtaacgtagctcaactttaccgagaaatataatccacatcaccatctccttctcccttcacccttgaggccaacacaacacccctatttcttccccaaaacctacatgtagagcgcacagcgacagcaacacagcctcgcaagagaaagcaaagcaaagtcaggagggaaagaaagaaatccttttcctacacctaaagagaccaccaaaccctgcgagccaaaaaaaaaaaagcc

SEQ ID NO: 7313 - DNA, 1500 bp, Zea mays
gcccttattaatggaaaccaatgattgattttcaaaggacgatcaagaaggatcagtaagttctaattatcaatggagttgttagacacttagggcctgtttatttcaacttataaattatataatccggattataagctaaattatataatctacattataatctagacatattataatctacatgtagttgtttggtagtctagattatacagatgtagattattcataaagacagtaatacctttatttgtttatttgaggtgaggaaaaaaaaatgtcatatattataatttctatttacataaccatgtgtagtaggtctattgccaaaataatctcaaataagctactctcgagaagattataagataaacataatctgagctttagattatataatctaaactcataatgtagatgttttgtttatctattggattatttatgcaggattatataatctaaagagattataatccaaaacaaacggggcctaaatgtcgacgtcaaacaaagttacccctatatttgtgcaacaacaactgtaaaagaccgtctcagtctttatccatttttcgacacaggaatagccacgacatgtcgtgccactgcaattctgcaaaagcaaaaaatgtgatgatatcaccaatgtgtatccaccgtacatagggtttgcacggcccaggtgtcggtgatggttgaagaaagagagctgttcgtccaccggggacacagacacagttgctggcagttgaccttgcaacctccacgcggatgacagcaccgtactacacgaatctccaacaggcccgcgaccgcgaggcatccccgtcctggcgtccggaatctcagctggggtccgaccgtccacgtgggacaagaccccccgctttgaatgcggcatccctcgtctaattaccttctgattcgagctcaaggccccgacgcaatctccgctgcctccctgatctgtggccccgagacggtaggaaccacctgtcagcctgtactggctaccacgacgcgccaccgactgtttggtgacccatttcttgcgcgagcagagtcgctaatcgatttccatcctccaactaatctcacaccaatcgggtaattagcgaatatatatatatccatatttactagacaagccccccgggtccccagatccgtccacccccacgctccgatccagcccgtccagttcgacgcgaagcggatcgtagccgtccgaatccgaggggtggacccgtgaattccgggaaggacgaggggtagttggctaccggttaaaacgcccgtgccagtggcccccgtcttcctcctctcctacgcgggcggggaagccaaggaagaagaagtagtagttcgctggaggagttggggcctcgtcctcggatccagagcgcggaaacccgtgcgcgcgtccggatcgacccgctcgctcgacggccgcgggcgcgaggctagggatcaggatcggcggcggcggcggcg

SEQ ID NO: 7314 - DNA, 402 bp, Zea mays
gctgtaatcccatggacccagccatctcttgatatccagagttctctggcatatccagagttctctttgcagagttcatgggatatccagagtcacgcctccacacccatgcactctctggcatatccagagttctctttgctgtaatcccatgaacccagccatctcttgatcttttcactgcctatttaagaataaccgagggggaagaagtgggagtaaaggagagatccttacctatgtcatcaaccacggtgtgtagcttcaacatagttttgttgcctccccttacccaaactataccctggacacgcccaaattctctggtcaagtgactcaacgtgtctggtgaccacgtcgccgacgcctcaacctcatactggaggaggagcagagagcaag

SEQ ID NO: 7315 - DNA, 963 bp, Zea mays
atatcattacggatggctcgtgaatgttgtcatccatatcataatcgtataacacatatgcatatataaattatcgagatattccatgtccccgttgcaacgcacgagcactgacctagtaatcaataaaagagagaaaaagatacttacattattttctctctctctcaaatacgaaaggagagtaagaattaacagagtgtttggtttaagtaatgagatattccattattttctcacttcgcattttttagttatataataaaatgagttgattcattatcgtctcattctttacaattaattagttagtattaatattaaaaataacaaatttatagaatagacctatgatgtaccgtcttattttatattaaataatttttgaaaccaaacatccttttaaaaattaattatgttactctgttttttttttcagaattactatagatcccaacacagccgaatctgtccctgtcattagagctacccagaagcttcctttgtctctgtcgatgctgactccttcaccccaacagctcccaatcttcccaccttcccctctccacgctgcttcctttcccagcaatcctgcgttgcctgcccgacggagctgcttccctcgttgctgcgttgcactgcggcggcctcgcgcttgttgtcgattccagctccatgcgcccatgatttactttacttgtgtaagatcaccaatctcgactgctatttcccctttgcgttgctggaaaataattggtttgtcaatttagattcactaattttacgcgtctttccaattctaggttttctcgagtctgtagcggtttttatcagctgcttgccttctgcagaagaaaaagaaaaaaaaaagaacagctttgttactacttcccatcgttcacccattcatatttttttttcttggttcacaaagtaagaggaagcacaaactactccaacttc

SEQ ID NO: 7316 - DNA, 127 bp, Zea mays
ttgatcattcagtacaagttgatgtggcaagatcagcaaatgctgctcaggcaaatatggagctgagtttccatcgtaacaaggaaaggttgggttcttgaaatgggggtcctctgcattccgtaac

SEQ ID NO: 7317 - DNA, 1500 bp, Zea mays
tttgttgttctgttctttgcctcgctcttgccggtgcgctgtaatctgactgctggccgactcgtggccgtggccgtggccggagaagagcccgggacgcgatgctccggcgaaatatctattatttttatctcctttgaatcgatagcaaaatagcttttttatctcgattattttaaaaggtacaaaaccaaaagtcaaaaatagatctaaagtgcttcaaaaatatattacttaaaagtaaccaccaaacaacccatttactagtttttttttagcttttgaactgaaaaataaacagcccaaaacctgactaaacggagccttttgagatgtttgaatgaacgaatgaaccggatataatagttagctaactaaaaaatgtcaatggacttagctaaaagtagctaataattggatatgctcttaggcatgtgataagtactctcttagagttagccttaagctcttaactggggtgtttggatatgtctagctaaaagtagctaataacagaagtagaactattaactaagttgttaggatgttcccatgtaatttagcagctaactattatctctaatctatttacacattgacattactctgcccaaagcaactattttttaacgtttggcaatttattttagtcaatctaaacttagcctaggtgttagaatataacacttgtatgcagtattattaggttatacttgtaacaagagcgtgtatatgagcgcgtaaagtaccattttacactatatattgtataatctacaaaaagatgagtttgaagtagatagttagataggcgatgggatatggaagctggtggagatagtctaaaatgttcagtttttttatcaaactatgcttatactccagccgtctaaaaatagtagtcgttttagctctaaattgttatgtctatattcatgaatatagatgattataaacctagacatatatacaacacatgtataacacatgtattaattattgtatacatttaataatataatcttccgaaatcttgaatgacgctaactcgatttactcacatggcctaatattatacccatttatacactaaagatcgcatccctttaaaataaggattcgctccggaccgggccggaccggccagtggggcggctgtggcctgtgggagccaggcggccgctcccggacttgagattctcaaaactcagctgaattccccctggcgtccggcgggccacaggagcacaacccacaggcaacaggccacaaccacagcacagcagcacgagaagggcagaccgcagacgccagacgcctataaatacccccgccttcccacccagcattctccatcctcacatcgtccacagaatttcacgcatcgcacggggaacagaacaccgatcgatcgatccctcgagaagcagagacaagtagcccgcccgtccgcccgcacacatagagacagagagaatcaagccgccgccgaccagtgac

SEQ ID NO: 7318 - DNA, 363 bp, Zea mays
cctgcactagcgtttggcttcctagtgcatgtcctgctctgccacgcactcacaccttcccgctgtagcatcggcagcagtaggcgcccagtcttcaagctcggacgttttagggtcctgtgccgttgtcaacctcgcgtccctttttgtcatcagcagacacgtcgcccttgctccctccccagctgtgtctgtggtcgtcgagcatgccagctgccgcgggctcgcctcacccggctgtcgtctccaaccttcgcctcgacgctgtcgttccttgtactcaacacggggttcgccattggtccctgctacaacatcggctcgccgtggcctggtcgagttttcctcagcatcgcgccggcc

SEQ ID NO: 7319 - DNA, 1500 bp, Zea mays
ccgcacggttcggtgtgcaccggaaagcccatgctcacttgtcgtatttttggccataacttttagctccggactccgatttcgatgatcttgtactttttggaaagattatgaaattctctacatcccagagttggagtaataccaatttgagaaaatttggcacaccagacagtccgatgtgcaccggacatcccatatgctgctgcagttttttcagcaatttcgacttcgtattgtgggcataacttttagctccgaactccgattttgatgatcttggacttcttgtaaagcttataaaattatctacatctcagagttgaagccatgtcagtttgagtagatttgattttgtgaaacactttcaattcagtcagcccttcctctcaattttgtcaatttcacttttgttttgtagctttgtatctcacttctacttcttgatgtgttggactcttagcatgtacaaactgtcttcaatatgactttgtaatgtcttctatgggtcttataatgtcttctttgaggtgttgcatcctcagagcctcagtctaatccacttcgcatcatgtaaactacaacacacaaacacttaggaaatacattagtccacaggttatgttgatcatcaaataccaaaacctattgagataaatggcctgggtccattttccttataatcggtgtgggcgtcgaggtcctctagcgtgtcgacagggaagggtgagtcgatgacacgcaggcatcgagccccggtggggctacgcttgaggctgagcaccagcatgggcgagggcgtggctccagtggctgttgatgataacatgggttcgttggtatcaacatgcatcgtcttgagcgcgcgccaccttagggtttagggtaatttatgggggagaaattatcgtatgataaaagggggagaatttggtgtttgatcaaaacaagtcttgaaaaccgatttgattagcactgttggattagtttgttctgtatagagtcctatatttcaaggtgaggcaccagtttgaggcattgttgagatgctcttatagtctagagtcctatatttaagacatgtttaaatcccagaagctaaagcaaaagtgattaaaatttagtcactacttaggagctaaagatttaaacgggaaaagctaaaaataactaaattgtttttaccattttaatcacttttggctctttctgttttattttttagcttctaagtaactaaattttagttatttttattttaaccctaggatccgaacaactttttaaaaatagggctttgtttgagacctttgataaaattgcttttatactatttttaacagcttacttatattatcttttatctaattttttattttaaatttcactttaataatagtgtctataatgtaaaacaatattttggacagataacttgcggaactcctaataacgtaataatggcaaaatagcaaatgcccctatcaccgcctccgaccc

SEQ ID NO: 7320 - DNA, 1453 bp, Zea mays
gttggatgcaactgggtccatttatctggaaatatttacatttaaaaaatctcgaaaaccattacatttaaaattttataggtagtcttcttccattctgtggagatcattttcactaataactgaaacaacaattacttcattatattcattcaaggacaagcgccacacaatcaacatcatgtttaaacccaaatcaagacatgttgagtaaatcatccttttacatgttaccaggagtctaaagaactacagtttgggttgttccagatttgagtgtcatacctaaatttggctacttgtaactccatatttgagtgtcatccttttacttagatgtcattaatttggagcactccttttcttgctctatccatttcctgtttgtaattttcgtcgagcttcggcaaaaaaactgacaaacgagttgtgctccaacttctaatctctgattcaatgtgaaatggaattattccttttgttttgcttgtatgcagttagcggcttctgattgtagaaattgtcattccgtgtactcaaatcacaccgagcattccatgtatttgaaggaaggggagctggctacctcttctagagagacaagcagtaggcggtggattgctgctagcaagttttctaagttcatgatgtcagagtatattctttaaaaagtgacttactctggcacgtaccttactatatcttttaagatatgaaaacatctacttttagtgatgctaacaaaagtatagaataataattagtatttttgcatatcaatgtatcttatcatattgattccatagcaacagacgaatatacacctatatcttttaaggtatgtaaacatttacttttagtgatactaacaaaaatatagaataataattagtgtttttgtatattaatgtatgggtatgatcacaaataaattatgaaaccttttcctataatattataacacatttgtacatgagttatcgtggtattttatcttcctgttgcaacgcacgggcattcacttagttataaatcaagactgatagagtaatatattatgaaaatattataatttaaactaaagcaactatttcaataaaagataatatgattcattcaccaaaatattcaccaaaaccctatatatatatatatatatatataagttaacggtagactgatttggtggacatgaatcatatgggggagaaattcccttactatgtaaaattaaatagcaactagattcctctattatggatctaccaaatcagcccttaaaccagagtatttggccgttgacgttttgcaaaggtcattgactacatctacggtgcagggtaggccaattcatgtgctatctttaaaaggcgggccgcaacctatcttcagctcacccgcgcacgccgcaaaaacgaatccggaatccctgccggagcacaaatagagaaag

SEQ ID NO: 7321 - DNA, 245 bp, Zea mays
tgtaaggaaatctggcagatctactctgtgcatattatgctgataagaaaacaatgtacaagcatctcctgcaattctgatgagacaccgtccctctcgccatgcgcccccacgcccaccactctcgctcatcaccgctcgatctgaggaaggcggagcgcgtgatagatgcgggttctggcagattcgcgaggaggctgtagtggttaggttctggtgtcccctggcccggccgatcgtgggag

SEQ ID NO: 7322 - DNA, 1500 bp, Zea mays
ggagacaaggtacgtgcggcgacgagtgaagaacgaggataggatgtcgtgccgaagaaccgctggggcggagaagggcggatcgaggcttgcgtttgagggacatgcgatcgtgcggtgtatgtctactgtacctggctacacggcgggaggacgtcgggggaggtttccagattatgccacaaaatccggggttcgctggttaagccacaaagccatgcatcgtaccgggacgctcgtgcggcgggcattggccgaagatggaaattccggcgatcgygatacgatttcggatggtcatgcggtgacatcgcraggatcacatcgcggagatggagggatcgcrgacatcgcggaaattaccatggaagattagacataattagaatttacgctcctacgttaaatttatttagcgtagggggttgtgtgtaaaaggtagagccacccttggggttataaatatgtggcacctagggttgagatggttaaggcctttttgctacagtgccgcgattactattcacgggtgtgaacagtaacggcgttgctacagcaacagggaaccacctttctcccattttgtctagcctagggtttcaaatcatagcgagagatttttagttgatctctccaatcaagagagggaggacgatcgggcggaggctagatgcaattttgtagaacaatcacttgatttaatcatttttctttgagttgttcgtttgcatctcgttgatccgatctgcaaggtttgtctcgtggttgtcgtgtttgttctttggatctcgctgtctatttgtgtagggcgcatcgtcagatcgaaaggcaggttctttgttgttgatcgccgccggcccgtgatctagtttgtcgcagccgcgtcgctgcttgaattccacgcgggggacagaacgraataaccggcctgcacagcccttcatccgctgcagcagcagggactgcacttgractgccaccrttggcctctattgcagttcaccaggcttaccagtcagaacgcagggtcaaggtgctgaaaaggatctgctgccrgccaactattgtgatccacgatacaccaagagcaagtaattcattttaattttcatcaggtgtcactttcagaaaatagtgttcaatcattagcctcgtgactgcttacttgtttacttattttacttatttgtctctgtcactagttatatttaatgactctggttggttaattggtctagcttattaattagtttatatgcatggtcagccgagattatttgtgttaattatttaattaaacacctatacatatcatttgtgttctacttccttattttatagttagttatttccgttgcttgtttagggtgatattcggttctgcttgcatcgagaaattttattgggctcccattcacccccctctggtcgccgtttcggtcctacaattggtatcagagccggtttaggttttctataccttaatcggtgctgaaaact

SEQ ID NO: 7323 - DNA, 375 bp, Zea mays
tcttttttattaaattattgttacgtcactatactcgcttatatggtggagtatttaataaaaaaaaccactgaaaaataacctatgagaacgagcgattcgtgttcccatcctttgtggctttgtttggcacgtgtgcaaggagggcacttctctgcccgccacgccgctgcctgaaccggcgagctggccatagcgcccggctctatccttactcacgtcacgtgacgaccctttataaatgaaggcgcgatcacgtcgtgtcggatcacagaacatcgggcaagcgcgcytactagctattaacagtaaaagtccacgagaaagggagggaacaaccgcgagcagcgaatcaagccaagggtacatacggcg

SEQ ID NO: 7324 - DNA, 393 bp, Zea mays
ggttttgtcaccgagcgctttggcgtccgtaatttcaggccacttgtcctttcttgcatttccccttttcctttcatgtggcctcacgttttcgaacccacaccttttccattctattttcctcgcagagtagttttttttcctcactgcaagtgtaccggaaccatggtttttaatggatgatgatgatgctgctgctgcttgcgtcctcagaatagtcttgactcttgagctaggcatgtgctgacattggacttatggggaaggagtaccagtacttggacgaacttgttagttcagcttcactaatcctcaaccgtgcttcttcaatccagggcaagtagaaggaaaaggaaacaagcttgctgcgtgtgacctgcagaccccaagagg

SEQ ID NO: 7325 - DNA, 130 bp, Zea mays
agtcttactatattgtaaaatatgtctcattcgttgcacattcttgaaataagtctttgtatgcgaggctagatacgaggctagggcggatgtggtggccaccacgagctgtaagaagctcgtcgtggac

SEQ ID NO: 7326 - DNA, 831 bp, Zea mays; identical to SEQ ID NO: 4387

SEQ ID NO: 7327 - DNA, 965 bp, Zea mays
tatttgaaaacattactccaaatgggagaagtagcaagctgccaaaaaaaataaggggtggggtctctgctgatccattacatttgctcccaaccaaacaaataccgtattgtcttgatttgtttccattctaatcgatttcattatcccattttaaccaaatatactttggtagccattaactaaagatgataatgtgattttaggagtttcagtttcttattgaagtgttgattttgagacatggtttgtgtgtaccacttaatcgagttctctggttgcttgtggctgatggtccaatgcgagaagtagaaatctgccagaggagaaaaggcagagtttcaactgtttctgttacatttgctcccaaccaaacaaatccctgttatcttgattagtttccatccaggttcttttatgctaccattttgaaccaaatacttatcttgattagtttccatccaggtccttttatgctaccattttgaaccaaatactacctcagtagtaataatgaactaaagagaagaaatgtagttctaggggttacagtctacattaccttgttaccaggatacaaatacacgatatgttgataccccgatacaacaatttctcaaaaactaggatatggttttgtatatacctgagggccaacaacacacacactgtcatagcaccgtagaaccgattaccttagtactgctttgcgaatcagagtcgaacttcttttctcagggtcctttcactgcagattagtctgcacgaggccatctcttatcttgttcgcgacatccttgacaactctaggacgatgggggatgaacactaaagaggacttggaggaggccccaatctccttcatggtgtccttggctgcagtgcctagaaacattctctgagaagggaagcatgttgtaagctgaatgcaccatragcttgcataggtgagggacctccagatc

SEQ ID NO: 7328 - DNA, 1060 bp, Zea mays
ccatatgatatccctagattttcttaatgatctgaacagcgtcctcatcctgagctcatcatgctcctgcacgaaggcgaaatgaatcagtgaaaggaacctaacacggtgtgagtgtgctcttttttttttctccctatgcttgcttccaaacaagactggatagactgggccgtagaatgtttcaatttttctgccccaagaaaagagagaagataaggtaaaaagaaaaaaagaatccggtgtaatcggggatttgaacccgacgtgaatcgaacacgcaaccttctgatctggagtcagacgcgctaccattgcgccacggatccggacgatgataaatcatattattttgtttctatatatatctgtaatataaggacataatcacataaaggctgcaccgcggcccagttgcgaatgagagtggcgggaccataaagacagcatatgccagactttcatgttgacgctgacgcctcagcctgcagtgcaaacaagaccttcattcatattcaacgaaccaaccagagcacaaaacgtttgagcaagctcttcctagtttgagtttgatttgtgctgcaccgcagactgcagtctgcagtcgaaagaaaatccatctcgcatgtcgaacaagtttttttttttttgaaagagagacaagtacatgtacatcttcgtcaacgactattcagtttgttttggactaggagcgtgaatagatcttttttgaacaataatatgcccatgacctgaggtcctgagctgtgacttgttaaagaagaaacaaaaacgccactgctatttcagaatccagaaaaaaggaggaaatgtcatggctatagctgcgatcaactgatcaatcaaatcaactgatcaatcaattaaactggtccgacgtggcgcaagttagcccacacacctaacagatagagattcttacgtgagggtcccacaagtcatccggagttcccaactcggtaaggtacgaaagcccaacgggccccaaacagtccagaaggggctctcacaccggatccgctctggctccaacaacgtg

SEQ ID NO: 7329 - DNA, 142 bp, Zea mays
ggaacgtaggcaccaccgcaccatgccaccatgtatgcatccgtcgatgcagcgttgcatcgttggttttgtacaacccctgattccctcaccaggactaattaactgttaggtattcccattctcgagctagtggttttgc

SEQ ID NO: 7330 - DNA, 1500 bp, Zea mays
ttcttccctgcttgcggcctgcgctgcgtactcgttctcgtagtagtaccaaaatgggactgtctctactcggatccggccatccgagtgctgtagcttgttaattttgctccgatccctgccctatacatgcgtgatgcgtactcattcttcgtatactgccgttgcccatttggtcagtttttgcacctactgcatgcgtgtacgcgacgcaaatgcaaggcgtccagctccgagcggcccactgcaattgcaacggcgcatatttttatgcggatgcaccactggttttaaaaacttgagttggctggctcgcactggttgggcagctaagcatcattttagtacttgccttgcttgcagcctggaaatgctcgtaaagtgtgaaaacacgtagttttttttttcttctatctggcaatgtgttccacacctacagcacaccgcttgttcacaactcatgaatcctgatcatggtttaattcactcgaatgggagttcattgttgtaattgttaattattcaccgttcatacacacttaattagagggcaaaaatcgttatatgatcaagatttctatacaatttgtcgtgcaatcgagctttttgaataatcaccacgtaatttattaacagtttgatgtgggtttagatttgtttttgtaaaaaactgttatacattcaagctttctatacaatcgtgcttttcgtataattgctgtgtgtaattcaatatttatactaacaatataacatatttcaagttctatttatattagaagatataaaaatagaattatattatttttaatccttcaaatcgggtagtgttattcttatatctattaattaatatagaacgaatcgagactttaaattttatatactgatatatagaatgagttggagtttgaaattttatatgttaatagaataaataataagtacatgtatatgataaggtgtacgagaaattctaattgcacaatagtttttgtctaattagataagctacattcttttcaagggtgtactacgctttgcatccgcacttacgatcggggagagtatttctgtaatagaagccatacggatttcaggataatatttgttcagcagcgcaaaaaggaaacgaaaactgaagacaagggggtacaaggacaagaccgtaatctggcagaaacttttttccaagggacccagaggcaaagttgctcccatcctccgcctacaaatacgcaggcgcccccacctctcttccactctcctctcctctccgcctcaccttgccctgcccgcacacaccacctgtccccgcacggccgcaccgctccgctcccgaggcttagggctccggccgcgctcccttcccttcccggcattcccgatctctcgccgccgcccgcctggccttgatctcgatcgccctcccctctccgctctcgctccggcaggccggcccgggtttgtctcgccgctattgggcctcggcacgctgcg

SEQ ID NO: 7331 - DNA, 1500 bp, Zea mays
aagagatcagccaaataaatgaaacaatttaataatatgttgtatgtagctcactagaggcgggaatcagtttcctttatctaaaaaacttaaattacaaataattccaattacataattaaacgaatacaattatataaattataaaaaaattaaaaattacatatttcataaaatataactatacattactagtcctctttcttgatgccatagtgccatcatctacttgaacaagagctttcaacatcacttattcttcctcaactatatcctatagccccatcagtccatctctctacgatgcaaatactatctttctctttcagtgatcaaaacaagtaccgctcaaccaaatatttttctccttttattatccacaagtgtaagcaaagtggagtttcagcttcgagatagttgttgtgtcagaaccttttcttcttctctatgctcactgctcacgcttgtacctcagtcatttctttcttccaatcaaattatcaatgtttggctaaataatcgtatgtgtttccgtttgttcttttattttccacactaccattgtatggccaaaaaagctactacattcatgtcgttaactgatcatgtgtgtcccctgtctactaagcatcctagtatattatcatgctgagatcttctttcttgctttctctcatctaggtcccatggatagagattgttgtgttgaacaaactcttgaatatgatgtggcgcatcgattaaggtgtcgttcggttgtatgagattggtgggtctgaacgatttttaaccggattgcttctctaatttatataaactttgattagctgaaacgattccggctgcaatccgacgcaaacgaacaaggcctaatgataccataaacttagcagtctattaatcgtgttccagggattgtcgccttagcgggggaaaaacaaatctttcttaaccaatactagctgarcgcgggtggacctgaattgatacagaaacacacattgaattcccctgcaatgcaacgcttggtccgctgacagtaggtagctcacaaaggctgacagatttcaaccacaataactcaatcgtaatcatatgcgatgcaatgatcctcgacaaaaaaaatgatgccatgtcccgtttgcaaattcatagcacattacttgaaggccccactgggattagataacgcaaagttgttcaggaagagaatgcagtggactctcctcagtaggcccatggttgtcctccttgccctgctcgtcacccagttgccctgcagcctgactcaagaaacaaaaggaaaggagaggagagggaatcgaatacgataccttctcttctccctccattcctttcctttgccccaaccatgccatattggagaggcgtcgagatcttatccctcgatccaattccaaacagaaaccgccggagctggaacaagagccgctcgcagcttgctggactctcccgctcctggccccggagccgccggcc

SEQ ID NO: 7332 - DNA, 886 bp, Zea mays
atccatcgatgagcacgtgcaggaggaggaaggattgactgtctatcagctagtcagagtaggtattttgcagggcgcgagtagcagtactgcattagtagcaaccaagtcactgttataagttataaccagtacgacgtctatctgacaatgccctgacgacaagtcgacaactaaggccctgtttggttcctttagtcactaaactaaattttagtgactaacgtttactcgctaaagcatcccgtttgtttcccagtgactaaaccggactaaagagcattaattgttgtaaataatgactgttttatccctattaattaatggatgtttgctataagaagaaagtgtagagggcaaatatggtaaaaatactactttagtcccttttagtcactcatttggtgactaaagaactaaagtttagtcaccccactttagtcaatatgtttgcttctttagtgactaaaagtgactaaattttagtcactaaactttagttagcccaaaccaaacggggccttagtttagtccaattatattgtttttgggcagatcttatagtgtctgcatttattcatacagctggggcagttgttgcatttcatgcatttttttatcatttttttaatattgtggcactccgagagttgttttttttctttctatttttagttgtgcgtggatactgtatgattgacagctacgtgccgcaagcctggcacacttgtggccaacttcatttaggaataccaagaaaggcgcttcagactaggcgagattatggagctaagattagtgcttgacgacgaatttcaatagccccaaacttttgtgctggagtttttggcgaccaagggaagccatcaaataataatctcgacca

SEQ ID NO: 7333 - DNA, 1114 bp, Zea mays
gctctaaacatgtaccgtagtatatacagggggaagaaagcctaggtgattcagtgcatatagcataatcagagccccgatcctactcggacaagcaacctctgccccttcgctctcctttctgacgccaacaataagttccacccagtacgtagatcgtaacatatgaaaagccattgccaaaaccagcttcgtgtgtcaacccatcctacaaacggcgaacgttcatcgatcgccgctgccgctctatagaaacgaggaggatacatgtcttgagtatcaggttgactgtgacgcctcaacaaatgtcaataaaaaaacaggttgtttaggactgtttttttttcctcatcaaaggtagcatgttacttgctccatcctaaagtaaatatacaccccgcttgtcaagaaagtattttttgaagcataactgaaaacataaaaaatagtatcgctatttgtgtctttaaataagaatactataaaagtatacttcaaactcgtttattatctataaataaatattagtacgtttttatataaatttagtctagtttggaaaaatgattttttgagaggtgagacaagtatttattttgagactggaagaataagagtttagtgtagtcggcattcttacagtttcagatatggggatatatgttgcaaaatcggctggtctgcgttccgtcagaggcatctttcaagatgtcattttcgcgagaaataaagaatgcgaaagtttttctgggatgtcttcagcgtggtgtagttccaggaaggagcagaaagggcaaaagaacagagggggatttgttttaattaataaaaaaggagagggagaaaataaattggcagtgctcctaattgatgctaagaggaaacagcgtcgctcagtccactgccaagaatgcaacgaccccagaaccggtagcggtcttgtttataaataggcctcttcacttgcaacactcatcggagcgctcgcaaaacctccacacaccttcctgaaatagtagccactagcttcagctgctccccgaggggtcgatcgagctcctcagccttcctcacgcatagctagaaccggctagctcaatcaacaccacaaccg

SEQ ID NO: 7334 - DNA, 1500 bp, Zea mays
ccccagccactccactggtccgtaccatagttacagaaaaccccagccactccactggtccgtaccaacgaccaggtgcatgcggtcgggcacgtcatcttatcatacaccaagtcaaaccttaccacgagcgtcagttaaacccctagtcaaacaacgaaccctcgcgtgggacacaaaacgtaaatttgcagttctgttttttgcgtaaattacgtacatagttcatataaatagcgtaaacagtttatagcgacaacataaaaactccgtctagacactggaccacgtccacacgcgtaggcgcatgcatgtagaacctatttttatggtagatctgataattatggcacgttgtgtgagttttcattgcatgtgcgtaaaatttggatgacatttttgtttctactgcatgtgtgcaaaaattagatgacatgaatcgcacaaagcattaattcttgtataaagttgcataaatacctacaccgtgtatcataattaatgaaaaacgtcctaatatatggccaaccaacaacccatgcataaactatgatggagtaggttgtcgttgccgcactcgcctaggatggcatccttcgtggtgcatttggcacgaggccacttgtcatgccagtcgttgctatgaacggaagacatgacgtacgtgggtttgtgtcattgtgtgggtgacttaggcactcacacgccgtgcggggcgcgaatccgtcgaggacgaggagtggatagacgaattagattagatacgatcagtgtgaaaagaatgtgtcttgtgagttattttcaaataattgaaggagttatttgtaaaaatatgacgtgagacgaccgttgaaactgataatttaatagagagatatagaagagatagagaaatacagagtgaactattaaacacaaaatctcacactagtccgtggcactgctcaagtaaagaaaaccagctagacaggaaaaaaaatagggaacacaagtgcgtcgtggtggtgctggcggttttgagttttgacccaccattcccgcattccttctcttctgcagtggcggcagcggcagccaggaaacgcaaacgaggaagaggagcggtcgattcccaatctttatacggtattaatcccttgcccaaatttctaatcacgccggagaaaaataaggctccgtctttgattcctttccctttcctctggttgcagattgattctttaccaattgtatcgccattccttcctgttcattgggcgtggggtttcaacctaataaatcggtccttttccgcgcaactagtggggagtggagccgctgagaaatagcaccccttttcctgccccaagatgcctgtttccgcttcttttccacgccacaccttttgaaaatccttcgccgtcagctccccttttgcagcactagttgtttctcagcctgcttggagtttggagggggcagagaacaccatcctgtcgattcaagaaaaaggctgagccg

SEQ ID NO: 7335 - DNA, 1166 bp, Zea mays
taggcgccgttgtgacggctccgtcgatcaaacccccacaccaaggatagctggctgagtacaactagagccagtcgcgagcgacaccgagcaaacttgagaagcaagttgaaaatgtttttacccagtccccacgcacaccacttggctaaatagccggtttacaacatgataatttcatctctacaccacttggtaaatatagagatgaaattaggttttgagtgagtttgtaaatttagtaacttggtttacataattgttcgagaaagtctttttgaaatttcttaaattcttatttagagagttatttacacagctactaaaaatgctcttaggtatataaggtcattctcaatgatagttttataggagtttcactcattaaatggtgtgctatgtcagcattttggatgatgtggcaactaattaatgaagaaaggggtagattttttcatggggatgaaaacatgtatatagtgttacctagacatattatctcttgtatggtacctataaaaccatgtcaaatgaaactctccactacgggagacagtttcaaccaaaactccagttatttattaattatgcggtatcttataaatttaagaggtatttggtttctagtgactaatttttagtctatctattttattccattttaattactaaaatattaaatacggaaattgacaaaaaaatagtcactaaaaagcaaacatccacttaccaaaccaaacacgccctccctgtcagtcgagcaagggtcctcccggtaacctaaaacccaagacaaaccatccaacggtccattagcacggtcccgttcagccaacggccagatgggccaccgagtacctttgtgctctccgatatattagtccagccccaagccctagaagagctaaaacccttgcggcggctaccttttccccagctccctctcgtctcgcggccgccgcaggcgaaaccccctcatcgcttcgcgctgtccaccgacgaatcttccccaggttcgagggattttaccgtctcaacagctcgattctgttggcgcacgcgttgctatgtctaatttggttccgtgatccttcgctcgatgcatgttaagagcgtgtgtatctgttgtttcagctgagttaatcggggactggtcgtgtgcggag

SEQ ID NO: 7336 - DNA, 1166 bp, Zea mays
tctccgcacacgaccagtccccgattaactcagctgaaacaacagatacacacgctcttaacatgcatcgagcgaaggatcacggaaccaaattagacatagcaacgcgtgcgccaacagaatcgagctgttgagacggtaaaatccctcgaacctggggaagattcgtcggtggacagcgcgaagcgatgagggggtttcgcctgcggcggccgcgagacgagagggagctggggaaaaggtagccgccgcaagggttttagctcttctagggcttggggctggactaatatatcggagagcacaaaggtactcggtggcccatctggccgttggctgaacgggaccgtgctaatggaccgttggatggtttgtcttgggttttaggttaccgggaggacccttgctcgactgacagggagggcgtgtttggtttggtaagtggatgtttgctttttagtgactatttttttgtcaatttccgtatttaatattttagtaattaaaatggaataaaatagatagactaaaaattagtcactagaaaccaaatacctcttaaatttataagataccgcataattaataaataactggagttttggttgaaactgtctcccgtagtggagagtttcatttgacatggttttataggtaccatacaagagataatatgtctaggtaacactatatacatgttttcatccccatgaaaaaatctacccctttcttcattaattagttgccacatcatccaaaatgctgacatagcacaccatttaatgagtgaaactcctataaaactatcattgagaatgaccttatatacctaagagcatttttagtagctgtgtaaataactctctaaataagaatttaagaaatttcaaaaagactttctcgaacaattatgtaaaccaagttactaaatttacaaactcactcaaaacctaatttcatctctatatttaccaagtggtgtagagatgaaattatcatgttgtaaaccggctatttagccaagtggtgtgcgtggggactgggtaaaaacattttcaacttgcttctcaagtttgctcggtgtcgctcgcgactggctctagttgtactcagccagctatccttggtgtgggggtttgatcgacggagccgtcacaacggcgcct

SEQ ID NO: 7337 - DNA, 349 bp, Zea mays
agtgacaagcatcgcattcgcaatgcatcgcaccgcttccgttcgtttccctcgaaaagtccggtgcctatccctgtcgtgccgtgtcgctgacgtaatgctgggacccatgcgtcagcgattggaggtcggccagtcgactcgggtctccaaacccatagaagccgtccatctccctccgtcggacgatcacggccatcaagtgcgcaaaccgcgtggtctgctcggctgctcctcgtcttcttccgcttcgtttcggtttctcctcgaaaagtccaaaccaaaccccaacagaaggagcaccggcagaagaagcagcagcaggactgcgcccggcccgcccgacgcc

SEQ ID NO: 7338 - DNA, 399 bp, Zea mays
ctcctccaaaaggtagtaaatcgcgatcgcacgtaccacactacccacgatggggaactaagtccaaagctgggcccaatgccgcaacggaacgctggtccacgggccgggatctcacgacgacggatcgagcccaccagcagggcacgatcaggcgaggggccggggccgcggcggtgtccacgtggcgtccaccggcgcggcagaatccgatggcgcgcgctcgccattggccggcgcgctatccgtcctaccgccgcggagatttcccgcggccgcggccgccctgtgccgcggcgcggctattattattaatctgacgtcctgctgctgttccctccaatccaacgaactgaccacaaccacctaagctaaaagctaaccaccagacccccggcc

SEQ ID NO: 7339 - DNA, 1247 bp, Zea mays
gctgccgacgcaggggtgtgtgttggagcccacccaatccccctcgtggatccgccactgctttcagggtagacgttttctatctcctccagttgactgacgggcccaaattgctagaggcttttccctagtgtgctcccctggtcccaaggacatccttgacaactagctttgagttctaacggctatatgacatggcgacacatatggcatggtctggtggtacactagaccgctccggtgccactagcacttgatagctcgagtagagctgtcactaaaatagcaggcgttgcagaaatatatgaagttggagccatatggagagggtcatttgagtaaaaatacgcttctatcttctaacataacatttatatttataagtattgtggagagctagcacgactctttaactgtagttagcgaaaaataaataaatagataacaataatatttaaagatctagttggaaggacggttagacaagttttcgaacattgtttttgtttttattaaatacgaaaagataaaaataattagagcagcagctacgtgccgagaaacggttgccgactcctgcaaaaacctgttgatctggaataaggaaacgtacgcgtgcctgcgtgcttcgtctccgtggcaacagtacttgcggcgctcgacgttgcaagtgctgccttcgtttcgcagcgtgaactgaaaggccggtggtgaagtcgcctggtgacgaacgtacgaaaaggagatcgcggccgcggagagagagagagagaggcccctctccagcggcgcgaaaacgacggggccttggacgaccgcgacgcgacgggcccaaagtgcttcgttcgctagctttgaccacccaaacccaaccccaaatggctgcctccgtcgcttcgctcccgtaagccccgtcccgtcccgtgccacgccctccgacgccgcgtgccaccccactccggcttggctccatgccccccctccatcgctatcacttctcctcccctcgcctctatatatagcagcgcgctgcggggaacggggtacgcctcctccactcccatctagccaataatctcctccagaccgactcactcgccgcggtgcgcttgcccgtccggccggccggccggcccgcgtacgtacagacaccgctccgtacggaggaccggagcgggggacggatcgctcgcccgcccgccgggagaagcatctgggagcgagggaattgcggaggcgagatagag

SEQ ID NO: 7340 - DNA, 859 bp, Zea mays
aaagtcgaccattaaacaaagtcaaattgacgccatgaagggaaggtactttcgtgacatgtctattgtgagggttggaggggacagcaccgcccctgctcctgaagaaaatgaggttgtcgtctatagaagctttatgaaggcgggtctttggttcccgttgagcaaatttttggttgaagtgttaaagatatttcagatctttcttcatcaaattactcccgaagctataatcagaatgggtttgtttgtttgggctgtgagaagccaaggactggaaccgagcgcgaagtgtttttgcaatatgcacgaactgttgtacgagacgaaggctaccgacaaagagcagtatcacaacaactttggttgttatggattcattgctcgttctaatgcaagctgtccggttccaacatttcggaaaaggtggcctggggcctggatggaggaatggttttatgtcaaaaatgatctggttaaaagggaagacataaaggggattatccaacgcccctatctggtctcacttcagccttcgaaggctgaccgtggtgattgataatgatgccgaagcatgtgaaaaggctttcagcaatgtctgtgctttcagtggtacaagagacctgatacaagagcacatagcctacagggtatggccacttgtggataactgggagatgccgaaggagactgctgttgggtccagccaaggtggattaattcgtttgaaatataccttcagatacaaagaccggtttgacgaaccaaatgatgactggctaaaatgtattgagttgcttggcgcctatcaattggtatcaaagcccggtgcttcattagagcctaaccgctcgaagtg

SEQ ID NO: 7341 - DNA, 544 bp, Zea mays
ggtacacaggagcatgggcgagcacacaggagcatcatcacctccagccccaatcatacccacctcgcctgtcgtgttgaacatcacccgcacggaatgaccaaactgcaccctgtcgaccatatactatactagtaccattcttcttccctcaccacggaagagtaaaacagtaatttcagagctggtaccagtcgcgtgctattttaacgactggttcccgctcgttcgtcggcgagcgccacccacacgccacgcccgagagcgcccgcgaaaatgacgccgccggcgagaacatcaggcaaacgcgcggacgccggcgccagcgcgggcgcgatagacgagccgctgctgccggagtcctcggcgggtgggcggcacggcggcggggcgtcggtctcgggcgccgtgttcaacgtgtcgacgagcatcgtcggcgccggcatcatgtcgatcccggcagcgatgcgggtgctcgggggtggtccccgcggcgctcctcatcgcctcagtcgccgcgctcgccgacgtctccgtggagttc

SEQ ID NO: 7342 - DNA, 899 bp, Zea mays
tataagtctacacagtgtaggaacaaaccacaaaaattttgttggaaaaagaaaaaaaaataaaaatatatttttgctgagtgtccaaggtagtcactcgaagtatagtttgccgagtgtcaggcaggcgacacacgacaaagtagcttctttgtcgagagccaacttctggcgctcgacaaagataacgaccgtcagttatagacgaatgctgatggctctttgccaagcgccgcttttcgccgagcgtttggcactcggtaaagtggtatttgtcgagtatctatctatgtgattgtcctactctccaagagtatgactttgtcgagtgcggtgctcggcaaagcctcgagcactctgcaaagagccggattccagtagtagtggataatgaggtggttgtaagttgacaataaagattgcactgaaacattagaattgatacaaactgaccatgatcaatatcacaatctacagtatagtcggttgctgacattatggtaaatacagaccagctgaccttaaaccaggctagtcgactaccacttggctggtgcacttgatgctgcgggccacttggtttagcgagaacaaatattgttttggtcatattaacaacctttctccgttttatcgtaaactttatttattctaattttatgctaagttaaatatttacaattttttttgtcaattccattaggttggtagtgtgatttatcaacatgcaaattctattgtgaaagtaattctcacggttaatctagaagcttgtaaatctcattatgatgtcacattagtatataaattctctgtgtgcatgtctttctgtgacacacaggagctattacaagtgcacgagctcccggtgcggcgcgaagaagcacgtggagaaatct

SEQ ID NO: 7343 - DNA, 142 bp, Zea mays
ggtaaccctccaagcagtgacgcttttgactctactgtgcctgtgaggatacgagttgaggagatcaattctcttaacaacagattcagggtcgatcctctgataaagaccccgtgctgtttttgaactggacgatgatatc

SEQ ID NO: 7344 - DNA, 85 bp, Zea mays; identical to SEQ ID NO: 5268

SEQ ID NO: 7345 - DNA, 190 bp, Zea mays
atggtgtgacttggcctccatccctgccaccgggatagacggtcgagtgggttattgcttccgcaggagaggaccaggaggagtagtgtggccaggcttcgccatgttactcggttcttctccgttagttatttccgctgcattaaaatttatggttattatttctgaaactccgataatgtaatcacta

SEQ ID NO: 7346 - DNA, 1500 bp, Zea mays
ccctataactaaatatgttagggactaaactttaatcccctaactaaactttagtccctagactaaagaaatcaaacatagtcttagttcactaaagagcatacgggtaaaacacctgaaatgacgtgcgttatctattatctctgctagctcgcggaccatccagatccagtgccacctctgatgttcttatctgacggctcagtgctcacgtagatggtgcgggctgaagaggactccatggcccggttgagcttcctaaacagagggctgacggcgtcctccttccttgtcctcctgttgttctttcattcaggtctctctcatctttcatctgcatgaacggccgctgtgcttccatgcctgcgctgcgctgcgctggttaaatagaaaatacgcggtcgtgtggaaataagctgatgcctctgcgccctgcttcttccattttgtcaaggtccgtccgacactgaatgaattctatagtttttggagaaagaatgaatatatcctgattcctgaaccccgatccacaaccgggaaagggcaccttagctgatgtattgacgtcaggcgacataagcaaacggatcaaagaagcacgccgccagttacgagacgtgctggtgaccacccttacacacacacaaactaaaaacaccacgcgagcagcggatccagaaagatacggaggatggacttattccttttattttctgtatttaaaatcgcatttttaaatttcaagtataaaattatagcagaaacttaagaggggcttccggcttccggcctccggggaccgtagcgggggctcgatcgagcccggacagcggccgccccggtgctggatgcgcccctctcatctcatgagaagtaagctagaatgaattggtgttacagagatagtgcggaggagggagggctaataaccttggcaaaatcagggactcagggtggacggctgcgctgccgcttgccgatgcctggcgtccggcgacgatccacgggccacggtgtagggtaaagcacttgcgacacgcgaggggaagccggcgaggaggaagaagtgcctcttctcttctacgcgcgccgagcgagagagaataggtaggtgaagaagagaggagaggaggagaagggtggccgcgcgtgcggtccaaacaaggcgggtgcagccgtgcaggtgctgcagcgacggtagattcgctcgtccgggcaaaatattcgcgcgcgcgcgaggaatattccaattggcaactctgaatatgccgtcagcctatcggttggacctcactccctcagcccatcaacaaaatggatcgtgccccactggaccgcggatgtaaatgggctaggcgtcgaagcctctccgcataagacacgggcctacgtccagtcgtccacagatcggaggagagagcactgactcgtctcccttctcgtctccagcgacggcgaaggcgaagcggaggagcgggagcagaaacagaagaggcagcc

SEQ ID NO: 7347 - DNA, 307 bp, Zea mays
ataacatggatgtggagcgttggatttgagctggtccagattttgtgccagggcaccgcgctgcccaacgagtacccaagtctcgcagaaaatatcaatacttgcttcgtatgattttttgccaaatgactagcaaattcctagctcacgcggctgttatgcgtaaaaccagaagagctgctgcttttagactacgcctgttatatattagtaggcgaagtaatatgtcagtggggctgatgtgataagatggatggtgttaaagactagcgtgtgcgcgatttgacgaagacgactacgagacggg

SEQ ID NO: 7348 - DNA, 182 bp, Zea mays
gtcaaagcaacgcacggcggctgcctcactttgcataggacgcatccgccagaccgccactttcttccgcatttcctcaaacaattcgcgcgccgccgccgccgctctccggcgtctgctactcggctccgtgcccccaccaggcagcaggccaccaccccaatccctctcttccttcagag

SEQ ID NO: 7349 - DNA, 1431 bp, Zea mays
aatgtcttattttttacaactagttagcaagaattatatatagtcactttgtcttaatgtagatgttctaaatttgtaactctgaatttaggagaaaaataaaaaagttgtgatacaagaaaacaattggattttgtttggttagaaagtatatgaaggcccttctaaccaaacaagtaagtctgtctatctccagcagattcactattttattctctatcttatcccctatttcaaacttctatgtgtatcagtgtcatctgtggcaacgactgttatgcaagcagtctttctgtgcaagcgtgcaagcaaaccatctgatctattagattaatgatccaaccacagatacaaccatggtttgttagggagttttttttataaagattattgagttggtggtggaagagtttaagtgttaaatgtgatctacggttggatcacgatctaatgaattagatgttttgcttgcacgcttgtacagaaggactgcttacatagcagtcgttgccgtcatctacacctctacgttttctatttttaacgctctagtgctctactgacagtctaatatgatagagagaagtagaggtaaaaatgatggtaaaaatatattaaaaaaataaatacattagaaagtgaaagcactaactgttttataacaaatttaaacaatatattattaaatattttagaataaaaggagtaaaagaaacacatccatcccagaaaagtgggtggacgcatgtggccaagcataaccaagccagccaaccaccaaaaataaaaaggtggtcaaccgcccttctgcccaccgccagtaacgcagacgtgccagaatcaaacgctttcgccgcgctgaatagaaatagaaaacgcaaaaatttaaatccgtataataattgcaaggcgataataccaacggaccaacctacccacccgcaccctctcttgtgcacctccggctcccagtccactgcctcctgccaaaataaatccgtccgctctccagcttggtggcacaatcccatcgaaagctagggtttcaagcctcttccgacttctccttcccttcccttccccaccacaacgcggccgccatagacgcggtaccgcgcgaactcccatagatctgagcgagccaccctgcgaatcatcccctgacgcaccaaatctggtcagaaacggtgaagagttcggacacgatcttaagcgtcgttgatttaagaccacacacaaacacatctgtttgcccttcccccctatttttttcctgtttcggacgattcataagaacagacctgcaaggtttgcagatctacctgttcaagaaccagggaccttgttttggacgcccagaacgaacccttgaccctgcggatctgctcgatccgttttggatctgcttgcttttttctggatctagagaga

SEQ ID NO: 7350 - DNA, 915 bp, Zea mays
cattaaaagctatctagaaaaaaacgagaggtttccgtccgtttttatgatttcacccgccggcccgcagcccactgctggcggggcctgagcctgtcattcgttgccaagagtgtcccacgacgggcgctccgagatcccaggcgtactccaggccccacatggtggtgggtgcgcagcttacgagggggtgacggaaggcacatcacaccagccattggccaacttgcgctgcctgcttgcagagcgacaggctgcagaccaccggaggacggcaagttggccgaccgttcctggtcccaccggcatgactcgattgcccgggggttctcccgctcccgcgggacccgagcggccaaagccctcgccttcgttttgcgggttcacccggacacccctttttgcactgcttccgctcgtacacccggtcaggttacgtcacgtaggaggcacatagtacagtcattgacttgtgggcctatacaatcttggcccaatctgtcatctagagtaagtggaaagtgaccagccgccacccgccagccgagtgcctttccatattaattaattactcgctgtttaggaccaatcacactctaaccccgaatttgagttctcaatcgcatgcgtcagctcgtcgagcgtcgtagcctcgtcggggaggatgaagggagcggaccagaggtgggtgaagcccggaccgggagaataggagcgagagcgaagcaggcgcaacgcaactggcgaccagcgggcgaagcaattaacgggaatattttaatgcggcttcgggtacacgcgggcaggtcaatcctcgcactccacctcctgcctgcccccgcacccgtagccatgttggatccaccgccccaccacgggtagctgaaggggcggcggcggcggcgcggcagaggg

SEQ ID NO: 7351 - DNA, 852 bp, Zea mays
ggtattgtgcttaccagttccttgacagtagaagctgtttctttcattacttgaatattatggattagaatagttttttctggatttctgattctagcccctagtaccagcaatgggtaatgaaagttgtcattgcaatactgcctaataattgtaccgtacctcatttttgcagggagtgcattgttgatctcatgatagatcctggtactcttatttcatcagatgrtgctgacctgggtagagaattggaagacagcttagtcgtagataatcaacatgttaacaaagatgacactagcactcagttactttcctctttcagtgaagcttcaagttccatgcacagttcatttgaaaatggatcgcttgaaaaaggatttatttgcaatgctgggcattttggtccatatgaagcaacaactgcccatagtgacaatgatgtgcttgggtctggggtatcaagttcatttgatgagctatcggtcagcacatatgcatgtgaaaacatacctattattcatgaatctaatacagatcataccatgactgaaaaaagcaaagataagtcgatcacatcaaataattcgtcatcatgttcgcctccatcttctgagataggcagtactcctgctgtacgaaggaaaaaggtcaaagacgtctcggagtatatgattagtgctgcaaaagagaaccctcagatagcagaaaggatccatgctgtgttacttgaaagtggtgttgtgtcaccacctgacttgttttcagaagaatctaaggaacaaccaaaggacctgattgtttacgacacatctctgtttcaaacaacagatgaaatgataaggacaatga

SEQ ID NO: 7352 - DNA, 113 bp, Zea mays
ggcaagctatcccgccattgctcaccagacccctaaaccctagtcccctgccctccatttgtttgtgcaggacgggagagggtgtgacatctgcggcatggagatcatcgacg

SEQ ID NO: 7353 - DNA, 911 bp, Zea mays
ctagttgagttcgtcggtgtccacgtggcccacgaacttaacctaggttaagttcgtcggtttctgggctggcctaactttagcgatatctatagcagtacttcaatagttctaacatacaatcaaagactagatcaatcaaatatagatatattttatatttcaagggatgcattttttctaaaaatatcatgagtatataacagcttggaggctcatacggagagtaattagttccataggtaagagtatttatttctatgcatctatagagatgaaaattacatttttttagaaaggcaacatagggtgaaaccacttttttgacactcagcaaatcacctagcacccgacaacgagctcgtctccggtagtgtggctactagttttgtaggtaaattaaaaattgcatatctttatttctctggaagaattaagctgcagattttgttaggtctaggtttgttgagtaaacctgctggcacggagacttggacagctcctgaccaaatatgtggatggttggcatgcatctcctgctcctgtatatatgtcagcatcgtatctagtggcctactactactgcccattattgtagtgcaagatttatccctggatccaacttgcctcacctatatatcttccaagcaagacttgtgcacatagctggaccttctcttcttggtcatgcccttccctcccatcaattcttcaatgctgcgtaatccctactgaaagaggcaccaatcagccattctgcaacttgccttcccgtgcttgcctcactgacatgaactcatcgtctttcttcctctgatccataagatctggccaacaagatcggtggcgcacaggtatcgggtcatcacttggtctctgaattctcaggattggagttgaagaagagcatc

SEQ ID NO: 7354 - DNA, 1500 bp, Zea mays
tcaatgttcagcaaagggtagacctgaaagtttgggctggaccatttagggtcgacacgacacgacacgaaaataagagccyaaaagcacgacacgacacgaaggaaaacgggtcaggccgatacgtctcgtgcctcaaacttaggtacgatgggcggcacggcacatcacaattagataggtcgtgcttgggccgacacaacacgaaatgagacacacatgagaaaactatcatttaaattgttattttatacttcaatatttttttatctcttcacaaaggttgcagaaaaaattgatttctctttctcatatgattttttagtctatagcaaaattatattatggatattttaaggatgtatatttttttagatatatacaagtttttttccgtgccctgcttaggctcgcacgatacgattatcggtccactgtgcttcgggctaggctaaacctagcttttagtatctaggcacgacatgatgcagcccaaaattatttcgtgttgtactggtctaaaaaagttagcccaaaacacgatgggtctaggccgtgccggcacggcacgacccaactttcagatctagtaaagggtaaggctatgtgaagagcgagctggaaccaacatgtgatcctatgttcactacttacaatttacatgtatacaaagatagtttagcgtactcaggaaatcaaatcacttatatttgatttttttttttgaaaaaagtgcaaattcatagcagaacaataaacaagtataaccgttgtagagacaaagcattgtataagcagtagaactggattaaacccaaacgaacaggggtgtacttaggagattatggagatcattgaacaacaagtacaacccctttcccttacagaaagaaataatggagatcatgttttctatgtcagacaacacaacaaaagagagcatatatatagtagatgaagacgtaggaggatctgcaatatcttcttattatgtactccattatgaggatggtataggtccacatatacagctccgtcaaaggcatacttttgttattagggctgacatttcttaaggtttcctaatactttttttcaacttccaaattatatcaatagtccacatgttttaggctttccaaacggttaataaatgttcttggaacctctgtactgcatgttcttatatattcctttttttttgcaataatgtgtaccaatgcctccctaataatgggcctctagcgcactcagcccatctgggcgttcaagtttcggcacaaattacaggccccgtgcaacgcactgacacgcgcccgcccacctgcatcgcgcactgctcttttttttttcttccctttcttgcggaccaacgcgagacaccgaggcgaagggcggtcggggccagggaagtgcggaaggcgtcggtcggcggcagctctgctcggtcacagcgcttgaggggcggtgtagaggccgccggagggagtgaagagggag

SEQ ID NO: 7355 - DNA, 91 bp, Zea mays
aaaggttgcatggaattatgaaaatacataaaagggcagctgaagtctgcactctgcactcgtgtagaatgtaaaaagaatgtaaagaagt

SEQ ID NO: 7356 - DNA, 1450 bp, Zea mays
gctgtttcggccagggtttccaaattcttttctttctttttttcttttcttttctatttaaaaatataaatatattttaaaaatcataataattataccaaaattatttatgattaaaatatttatttttggaccaatatttctatattaattaattggattttcaatataaaataaattctacgtaacaaccataaatcaaatatgagcaaacaaaattattctaaatgcaattaaaaatcaaacacttggaagaaaaaaatcattactatatttaccactaataaactaattgcattatttttagttgatagttttgtggtgttacactaaataactgaaaccgtatgtaaaaattagtcttcaccacaggtatagagttgttttgcactagtgaaacaaaaatcgtgctctaaaaatgagtgcaccgatcactgatttaaattttatgttacccaaaagttaattatattttatatcattattttttttattttgaaattaaccttttccgttctaattaatttaacaactaaaattaaatttcttttaatttgatggacttgagttgttatgtttagagggcctagccacatcaggttgtggcaccctacaaataggccctatgtttgttagggtggtagaaaatgaacatgcaccatttgattaacataaccggcccaaacatgggatgcccaaaatcctcaaaatactccgaatctgcagatagacaacccatatctaaaatgcgactttagtcggaactatagaatatatcttatcctgtattttttcataaatattctttggagaccaaatctttcattatatttggcatgaaaacttttcatctccaaagaatcggagaaggggcactgcctgactgcgctggtagtatcccaagatcacaagcatccatgccagtccaaaagaacggatctcgcgtctccgagtggggaacaatgtgggggaagaaaaataaggttcttgcggtagccggtagttggtcaacagtagcacacatgcacataatgtcgtgattgtgacaatcccatgggcagggcatatccatctaacccagcgcagacgaaatgaaggtgtacgtcgttgctgttgcacaccactagttgcaacagtttaagtagccttggcctcgtcgcctcctccactcactcgctcatcttcttgcaccaccgacaggccagccttcgattctcgtagtcaaaggtacggccaatgcatgcaattcctcgtcaaaatttggccaacatttgtccatccaattgcctatatatctctccattctcttgtccttgctgattcaagagagttcctgtgtttactttctttgcggagatgtatgtgctgccttttttttcttgcagcttttgaggtaccactagtgaaatgagcgaggacaaggtgtcttagaagttactacttagaagag

SEQ ID NO: 7357 - DNA, 1016 bp, Zea mays
tttgagttttagaaacggcttgactcatggtttatcgtggagaaagccagcataccattggccccaatcgaatggaggcagtaaatgagttggcaccatgaagtatgagaacggttaccagttaactccgtgcttggctcctggaaaaggaaccagggcttcacccggattacccgtttgtaactcatcaatctctataaactcgatcatcgagggaagtatgataccgctcatcttttttcctttcgagcggatgggacacatgagaaggatctgtcatgacattttaaaatcatagtattctgaaactatggttttgaaatgctttgctttcaaagacggcctaaattattgatgtaaaatatcaacgcaataaatagagtttgtataatctttctgaaaatctttagagaggacggaatgattgatttgaaaaataatacttttagaaagatccactcatctacattcttgtattgcacattccggatccagcagttctgaaggcggcagggcatggaagcactcgtggatccaatctcccattctcgcctatcgtcatcccatacatcctgtcctcccctccggccctcccggatgtgcgatggcagtcccgatcttctgtggccaccacgccctgcaactcgtgccaggcgcggttcgcgttcacgatacagaggcaaaccgtgccgtgacgtcacccgtgacaccgcaggcttgcatccccgtgcgaacttttccccgccgagacgcactagccacagcccacagacaggggagactagttgagactggactggagaccaacttccggaacctcctcgagcgtggttgaagctctgctccaccctctcgctatcggttcctataaataaagcaagagcccctcgtcgatcctcacctccacagctagcatcgatccgccattgctcaccgcacaagtgcacgctcacctgtcacctcacacacgcagctaagtagctaacgccgtaggcgagaacaagaaaaggctcgac

SEQ ID NO: 7358 - DNA, 1500 bp, Zea mays
atccagatcaactccggtatgcagatccacggagatcaatctgtggagactggagacacgagccaagcaaggatcactacccaatcccacccccgtcgccgtgatataaccactaggataaagttctcccggtatcttattcccattcgcgaccatacagaccgtttgccaaatgcaaacacgggttagggtataaacgttctccttgtatcccattcccaaaactcatttcccacctcccaaacccccacctgctgtttgcctgtttgggcgtactctagaccgaggaaatcctaaccagcttctaccccatccctctctctccgagtttccgttccttggcggccatgcgctttgctgccaccggaaccgagcaagaagatggagatcggacgaggtagagcggcgcggctcgaggaggccgtggcgagaggtggggcgagccgctcatagagcccgtacttgtgagggcgggcgggggtctcgcgccgctcgggaagggtcagaaccggcctccctcgatccggcatcacctcgccggaccaggggccacctcacctcgtctacctcgcggtcaaggctgcgggatggttgagcgttgcaacctggggacggcaagccgcaagcggcgtcgccattttcgtgagattacgacctcgccggagcgccgcttccagccttccactaggctccctccgatgaccggatctgttgttatgaaactcttgcgtgcgtgcgttctcgagcgaccggaaaatttggattttgtcaaagagttaatgaactagtactattaatctggattttgtcaaagagttcatataaatttctcaacgagttttgaactagtactagactttctctttaatgcaattatgcaaacgcaccctgcatcgatttcactagcctacgttaacgcagtgatgataataacggaaaaagccttgccccggctacacactccacgcaaaacacgatccagtgtcgtgcgcgcagaggatccgcgctccgaaaactcacctaggaaaatgccaaaaacaaaacaaccccaaagaagtcgcaggcatgttttacagaaaaccccctcgtttctataccatatcctctctaccatcactaggcacagagcccggccgccctacataaaccccgctctccactggtctctctcctcctgtttccgcactgcagtggcctagccggcgtcgtcctccccctctctcgctcctctgtcctcccctctccacttgagaagaacacaattaggaaaaaaaggcaaaaaacatttaccttttttctatctgtatattatctgaataaatcaagaggaggaagaggggagggagcgagggagggggaggagtagcaaatccagactccatagcaaccagctcgcgagaaggggaaaagggggaggaagagcttcgcttgtgtattgattgctcgctgctccagtccctgcattcgtgccgtttttggcaagtaggtggcgtggcaagc

SEQ ID NO: 7359 - DNA, 784 bp, Zea mays
gaaacggagggagtacaatattcacccgcaccggctatccttagtcacataaagacacatatatttcaatgcacatgatgcacatacggggtagagagcatgcatgaggaccgtgtggtttgtgagaaataaacttgtgtttttttttcttacagactgtcatattggccactgtggttacgtgtatatgtacaagattagtgcacgtagagctcaaacgatagaataataaacaggccggtgcaatatatcctatgcatgagatcccggtactatatatatatatcgtgtttagccatctatacaagcagagagatcagatcacatatataaacaagctacacgaactgaagcaacgacaagtcggtctatggtgcacaaagaccaggttcaggaaatggtcggctgacactgctgatgggagattctaatccaagagaagaaacaacacttagaaagagagaaacccagatcaccaccaccaccaccaccgctgaaacagtattttattactactaccagagcagccgccttttttccatgccaatgccaataatacgcctctcccttttcggggcataaacacaccgcccgcccagcagaccgtcatcgtcgtgactaaccaagtctagctaggccctaatcggcgcttttgttcgatccaccacactcgctcacaagtgaagagagagccgccgccccagccccagagcagctcagagacctcaagagtcaagaggggagaaataaaggaagacgacgacgacgtacgtacgccatcgcc

SEQ ID NO: 7360 - DNA, 1500 bp, Zea mays
cttgtacgaactgtattgttccatctgttactttatctgatgtgaatatagtatttgtaccgagtgctaacccttgaactctgagtccatataacactgtctgtcaactaactcccaagacagtttgttccgatcctaacactatagacagtctatttacaaattatggtatcgaagacatgatctgcatgcacttcatgtgatattaaggaattaactgggggcctggggcgggcacgcacacaaattggatcattctaatcttttttttttcaaaatgagaattaagatcaaactgattcaaatcgaatccttgtatcacttagagattttgtttttgtaattctgtatcttatatttatatagtaataaatctctactaggcattttgacagcgacgaatttttccaaccgagagtagcacaagattcatttgatcgaaggcatagtacgaaatgtcattgctataaacctgctcacgcattgtgttggaacttctttgcgttgacaaattatatttgaagctagagtgtgaaatgaagaaatgatcattatctcttttctgtgccgccataagaaatgatcaaaaggktgcttccatttcacttgtttgattccatatacttcgtttgcgcttcccgtgttcatactcgaaatgagttccgtcacttgtcaccggccaatttagtacatgcagtttaatgtattccccccaaaataacatattcacggcttgacttctgctttaatatactccctccgtcttagtatataaggcacaaccacctctagttcaaagaccaagaaatgtatttaattgtgtctataccattgcatcgatgtacgtatgcatagagaaagcacaccttatatcgtgggacaagaacaaaaagtggttacgccttatatcctgggacggagggagtaaaagataaacatatttaaataaccaaataaagaaacattgaataatatttatttattaaaattcctatgaaaggaaagagtgtcttaaaattgtcatttggccaaacgaacgcacgtatattcggggtccatcgcaagaagcagttatggcccggcggtgaactgcaacccgtgaggccgtgacctgacgtccgtccgacggcggcggcggcacgtgccaagttccggagtccggactccacgtctccgccacctcttggagttctcgtcgctcgtgcaaaaacaaaccgtagccgtacacatcccaccatgcggtagcgccggtaggcacaggcacaagaatcacaacaggcggcggccgcctggagctgcctcgcatgcgtccacggctacgtggccaggcgctccgacgccacgtccagggaggggatcggccgggccgggtccctgcctttacgcgtccccggcttcttataagcagacagcggcgggctcccgatcagaacaaacggccgtccctatctatcggattgcttccagttccagctcgagcactggggcttcgcaggcgag

SEQ ID NO: 7361 - DNA, 1500 bp, Zea mays
ccattagagcatctctaatggggtgtttggtttgagaaatgagctagtctatcatcttctcacttctcactatttttgtttggtttgtggaatagaatgagttgatccatcaccaccccatttcttatagttagttagtactaatatgaggaatagagtcattccaccaaatttgaggaatgaactcatgatgcaccacctcaatttgaatggtttaattcctcaatccaaacacctcgtatagttcggaagcatagggcccacatgcgacagagtccgggtggtgtgggcacgtcgttgcgacatccacagggaactctagaacagtctagatcaggagaggaagaaagaatcgatcactggggcccacctgtcatcggtactaacaagcctaaggccccgttcggctgtctaggatgtattccacgttggaaacagttctagaccaggaaacagtggcccactcattccagcctaggaaccaatccggaggacacgagactgggtttcgtaccgggccgtgaacaacggacaatctccaaacctggtggcttctgtttttgatccaagttcaaacgaacggttgcttcaatccgggctgaattccaatccagattatttctttccacctggaaggaggctaggaacggtccaaaccagccgaaacaacggggcctaagggcccgttcgtttgttatatttttaaaacaggcctgtttttattcctggcccaaatagagtggatccagctggtttacttaaacctggtgaatttgcgttaccatggcgatgattctatccagaggagacaacacaaggctttgttccgggccatggaaggaggagaaagtttaaaccgggcctgttttgcttccagtttaaagctaaacgaacggttgaaatgactccaactaaattccaaaccggaccaatttattccacctggaaacaggccaatccgatccatacgaacgggccctaagtggtttcttaaccaggactcagcgttggattgccgtattgctcagcgtacgaacttggcaacaaattagagagtcgatgtgcttaaaagcaaaggcaccgcgtgacactattattagtattacatagtagtttttttaattataggacgtttttatagcacgtagattttactatacatctagatatatgtaacatacaagtatttatactttaaataagacgtcttaatacataaactttacaatgtattagatatggagtaaaattaacgcattcaaaaagacaaaatactttatcatttaaaaccgaaaaaatatatttcattaactatttttttcgcttccagaagatctggcatctggggcattgcatctgcatccggccggccatcccactgttttataggtagctcctccgaaagcgaagtccatcgccccccgctcctccattcgcgcaaagacgccaagcccacccagcgaaatctctccccaaactacccctcgccagcgcccggcg

SEQ ID NO: 7362 - DNA, 1174 bp, Zea mays
ggcccaaggaaactctatctttagcgtacgtacgtttctacccaatcgaatgtgtttcagtgggactttgcaccacacggcttaggtagcaggtgacagttgagatgggaaatgaaagagaaattgaaaagaaataatataatatgtgatagttggtatagagttgagatatagagtaaacatgactacagaggattgtgatatagagtaaacatgactgctgacggggatagaatattccttttagagtagaaatttagagtagtatgagtacggatagcctgagactcttttttgtcgctgccgtgaccattctcttgagctggacactggcgactactcggtccatgccacgtggagggcgcacgagcgcgcgtggtgcgcctagttcacctggccatctcataaatcccccgccctctcctgaccacggccccgactggagactgctgttcccctcgaccctcgtccgtccgtccgtccgtcacctgacggctcccaaaccctaccccgcagatccctccccttcctctacccccgcctcgccgccggtcttcgtcacccgtcgccgtgcccgtcggcgcggtgttaagggtccgctacgctgcacctcgcggggagaaaggggtgggcctcggagacctccgccctccgcgcaaggtagggtccctcccatcccactgtgttttccccgggtgagaggtggtcccgctcgctcagcgcgcgagccttctcgggctgggtcccgcgcggctcctgagagcgtggcatggtggaagtgggctagggctcgtgaaccctacttggttccggatgtgtgcagtgtgctcttagcggcgtcggctcgcgtcgattccgtccttccgtgctctatggcttagacatcgctcagcacgcgctgttttggctaattcttgaatgattgtttttctattggcttctaatgattgcctggggcgcctccatacttgcgtgtattcacacaaggcttgcctgccctgtactgccgccgcacaagttctttgaatgcctgccattttattggcttctggttttggtagcttgggacatctctaatatgcattctttgtccacatacaagtgtctgagcatatcattttctgttaggtgcaagtccaaaagaactgactacatcatatatgtaggtcattga

SEQ ID NO: 7363 - DNA, 993 bp, Zea mays
tttgatacccggtgtcatcgctagcgattttcataatggatggtcaacctaatagtgagcgatcatgcgaataaaaggccatgttgggtggctaacaaggtggcaactaccaatctaatcttgcaaagctaatgtcaccttgtaccatctgctacatggattcccaaccctacaaagactatttggctgtcaagtgtcaaatgtactctccacgaatcattaaccagacaaggactctctaagatacatctccaagactctcaaggcgttgaaatctttgatcacatgggttttcatttctcctgtggttgaggttgagaggttaagggagagaatgagggaggggaagatgcatgtggacagtggactccatgctggattttgccaacgactcagtatgcatgtgagatggatgctaacctaagtgtactatgcagtttaataaagggcgtttgacatgtataattcaatcacattttatgatgatataaaaacatgaaggcactactagtgccccttttttcattctttttccaaagtaaaccaaggtagctcaggtctactggttaagtgagggagctgaggtttcattctggtgaccactagcggtgtcgacacggcgggatggccccacgtgggcgccagcggtgtcagtgacggagagctcctcagatctgaactccagtgggcggcgacccttcaccgcggaggttgacccccaaaccgccgtctcgcactctcccgcctccctataactaatctcctcctttccactccccgccgcgcgaaaccacacgcggcggccgcctcctccaccacgccgatggcgacccctcactcacccagacccagctgaacaactccctccaccaagcacacgcaagcaggagaaggagcaggagcaggagcaggagccgagggcggcgacagagaatagaggtagaggaaggcgatcgacgaggagctcggtctcacctgctagcggcggcgacc

SEQ ID NO: 7364 - DNA, 1099 bp, Zea mays
ccatatgatccaatgaacatacctgatgttgacaagtaagatctgtcacattgcccttcacactgttgtttctgtagagatgtttctttaatccatgktcctctttctcctgcaatcttaggttgaatgcttcatacatggctgttcatggtagagccatgctagggcggtccttgtggttgaagaccaacccgctgccccaaccgacataagcatgtttcctcccccgaagactacagccagtgctggtgggcgcagctgggtttcatcgcgcagatgattttgcccttcccagtagtcacgttaaactctgaaattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattctgctgttcgatactcaactcccgactcccgttcacttggcaggacaatggcatatctgatatttctatcgttgaattacctttacttagtatctttgggtacatttctgcctgctttagatctaaagtcacgtctcaggtgactgacgcctgccggcgtgatggttgtgtagtggaacgttccatagacacagaatcctacgctttgaccattctgtgccatgtctcctgctccaagcctgctgccctgtcagtgccagtcagtacctctgggctctggccgtgtcgcaaggatcaatgtgggctccttctccagtgagtcaccgccattattgtatcggtgacgtccaacggtcgaaaattggccaggacccgggagccaacgggccgggtcggcgggtagtcttccccttccctcggcactgcctctgctcacacataacacgcgcaacggctctcgccctcgccagtgccccggcacgtctcacgagtgcgacaaaggaggagcggcgaccaagcaatccctctctttctatcgctcgggrctcctcctccaccgcgcccgcacggcaggacgcaggagataacagaggggagcgcgcgggagcaaaggggaggacggc

SEQ ID NO: 7365 - DNA, 652 bp, Zea mays
tgcgcagctgtaggttcagtcttttgctgctgcaaaatgaaattgttgcgagtttgtgcactgtrgcctggcaacggattcgtattgatttgttatgtgaagaggcagatcagggatctcaatcgttttgaacgtgttattttccatcgttttccttttttgttcatgttgaatctatgctgcttgccatttctctattaaaataaaatcagatggaaaaccttagcatcaatcgacaagtctaaaagcttgcagtagagtagggctatttgaaatctttttgagtatcaactttgtggcacctgataaaagaaactcaagtgacattcagagacgagagagagagcctggatttccttcagctccaggatgaaccagggggcaaattgcaaagtcttggactgggataatagtcgcaatcccaactttgggtatattcgcaaactgtctcctccgttaggtcaagagacgtacggcccagattgatggatatttgcagattactctacacgagtcacgataggaggaagactggaagaggaggcgagcacgtttgcggtgcccaccctcaccgtccactccagaaccccaaatccagttccgttccaatcgccgagaagggcagcaaaggggagaaaaaaaaaggaaatct

SEQ ID NO: 7366 - DNA, 982 bp, Zea mays
cgtaagaatcctggtttttgttcaccacatgctttatagtctaaatcttatcactgcctgtgaaaattgtaagttcctacttcctatcattgagcatgctcaargcttgtcatcaattgttattgattagtcacatagcgtgaaagggcctctaattgagttggttaggtgggctacggtgctgcggtatatgggtggggcaggggtttggaggttttctcgacctgcgtgaggtcttcttaatataatgttatggaggcggtcttacctccacaggtcgagtttttttattagtcacatagcattttctcgacagttttacagttttaacttcaataaatatttctaagtatgaatctttgaggctgtagattgaacactcttgattcattccttaccacttgataaaaactggcaatataacaattgcatatgtcgcacacttataggagcaagagcaatcttatttactatgttatatatttatcttccgtacttcacttgaaaatcatttttcaatcctaaaataatatttgttgcaacattgtgagtagttttgagctgataaaatacaagtatgtgatttggtttgcatctttgtatgatgtgctctgagttggctaattataattgtatgctttgggtgggggattcatctatatttaatacagggacatacttctgcattaggttgtcttaaaaatgcattacgtagagcatgtaccaaaatttttattagctataattgatgtttagtacatatagtataaaaggcaaggtttttgttacaaagaaaatactctctgtttgtgtgtgtgtttgcttaagtgttatggattattcattttttgtaaatttagtgatatttttatttgacctgctgcacacctagctaatagttcatttctctgttggcatagcaagaagtggtacacaggttgcatttggacaaggaaactcttattatgcaagaaattttccc

SEQ ID NO: 7367 - DNA, 849 bp, Zea mays
gctacacaatacttgatgcgtctgacaaatgactttcccacggatacatatgtggcggtctagtcttcagattgattattattagagtatgtgagttatcaagtttatttgtttcaaagttgtgtgctttttaagtagagaccgaaagaaattttaaaggctttatctctagatgtaacgtgcttaaagttattaataaaatattcttttatcaaaaaaattataaactatagttttgtattggagctagaattggagcaattttaaacacccctttacttgggccatagcacaacgtatctacgtgccatgcttaggtctgggggcctacatggccacctgccacgagtttggcccagaccggcccatgcagacaraagcggtggggcaagagtgtattcggtctcctccccacgtcatcgctgacgcttgcagaaaacggaagctcccctatgccctatggcctatggccgctccattgaccgtggaggtggtgtggaatattgcgttgcttgcgcgagctcttacgcatcttcttctcttcgagccttccacagttctacctcccgcccgctggtccctagccgtcaagagattccacgctactggctttcttgccccacgccgtatggttatcgtccagcacgagcggagaaactgaaacacgatcccaaccaattcagaacccgatttggtgatcacctccattctcggtagcacttaattccagggacagcaataagaattgctcctctccaagttcttttggagcgtaatcttatccgtttgggtcggattgatatttgataacttgattgccatttggggagttgcgggagagagagagag

SEQ ID NO: 7368 - DNA, 481 bp, Zea mays
ggttattatagtcaataagccctagtctcatataaaatcactaatcaggaagtaccaaccactgttaaatattccctccgttcttttttatttgtcgcgttttagttcaaaaatgaactagccggcgacaaatattcgagaacggagctagtattagcttgtgaaggataagtcgttcatggatcaactcgtttttattttacaaactaaacaaaaaaagggcatgcgaagatgatgaaccactccattttctttaaaccaaacacgccatttgttgttcaagtttgtctataggtggcaataatatgttaataatggtaaccaatttttgatggatttagtttgtttcatactatctaatcagcatatttcccccaactatgcatgcccactgatcgcagttactgatttttttaataaaaaaaaaatccatgagcagggttcaggggtctggatatcctgacgaaactgactcgagccg

SEQ ID NO: 7369 - DNA, 1043 bp, Zea mays
ctgtcgggtctctccccttcgtcatcttcagatcggagctagcaccggcgacctcgtgacgaactcagcgcgccaaggaaatctcgcgtggtcgttacgtgccgagctcgcctcctcgcgcctatataacctggccatctggtcctcctccttgtctcatgaggtcgcgatcgaagccaccatctaccgggagcagagggtgtcgccgccgatgaacttgcgatgggccaacgcaaggaccccggcgtgctgctcggggggttttccggctccgagggccgaaaagggtgtcttcatgaagccgatgcattggaacgccctagggtggcctgattcctcacaggacttggtgtccgccggggaaccgcgctccgccccagtaaggtaaggactccctacgccaccatctctggtctgatcatatgtcattgattcgcttcactctgcactccgcagtaaggtccaaacctgaaattccttacaggaataaaagaaagttgtaaataagaaatttcccggcccaaagtcaaactaaaaatctctaggttacgtatacggtatacggaaggaaattgatcacgcgtctccatttccaaattccatgctggggtcactgcttaagccaacatatggttaattctcaagctcccgaccagcttgccctgtgtgtgtatattacattatctgctcgatccgcttgtgtgttggtgtttctagcttttttttttgataaaagaagtttttattaatcagatattcagatctctatgacttcagctgcatcaatcagtaaccacgactgtaggttgtaggtttgcattcaacgattctgtgggttgaagcagctaagcaacttcttctgctgaatccaccacacagtcgtcgaaagaaaggagcagaaacgagaaaacgctgaccatagtttcttgcagaggaagcagtgcgcctgccttcaatctaactacatatcctatagacgatataaataataatggtctaggcgtctagcaagcaggaagccacaaccaaacagcagaagaaac

SEQ ID NO: 7370 - DNA, 98 bp, Zea mays
ggtgagtcaccgaacagtgtccgatgcacaccggactgtccggtgtaacggcggagcaacgacttcttcaagtgcaacggtcgtctacaacgcattaa

SEQ ID NO: 7371 - DNA, 224 bp, Zea mays
ttctcccacgtccccacctcagccatcgtccattcgtccatttcaaaaccgcgcaggatcgtcgcgtcgcgtcgcgtctcttctcttccttcccctctcccccccgctcctctccgctccgccccgctcaaaaaccctaggcggcgcccgaatcccggatcccgcgtccggctccccccagcgcctccgcccgtgctcggcgtccatcgttgccggcctccccg

SEQ ID NO: 7372 - DNA, 535 bp, Zea mays
tatgtggacaaagccttgatgtttgggactaagtgccttgctgacaaacgccaaggggtgaccatcctgcatcagcaccgctcctatccctgtgcctgaagcgttggtttctagggagaatggtctgtcaaagttgggtagagctaagactagagtagacgacagagcggacttcaattcctggaacgatgtttcttgtgccgaggtccagatgaacagggagtgcttcttcaagagactagtgaggggcttggcaatgagtccaaaattcttgacaaacttgcagtaataaccagcaagtcctaagaagccacgtaattctttgcaatttgctggtactggccatgaagttactgcagctactttggctggatctgttgacacacattgctgggaaatcacatggcctaagaaagctatttgttactgagcaaaggtacacttggaaagtttgatttgccagtggtcattggacagaagagtaagtacaagctctagatgatgcaagtgatcttcccaagtcttgttgtacacc

SEQ ID NO: 7373 - DNA, 511 bp, Zea mays
gatcttttagaatgcagatgctgtaacttgtaaccacaaccgaaactgaggctggaccgagtgtagcgtttaacaatcgagttggtgctcatgcctcgttttgcaatcacaatcagcaggcacgtttgtcagatgtgctactcttttatcatcatttctgtgcgtctgtaatgaacactcgggccaaatatttggagtaaaaacatcaactcaccaggcggtagttgattgaacgatcaaacaatacataacagtaagggtgtgctgagtctgggaagcttagcaccaaacatttgaattgctgcaaaatcatgttaactcatcaatgatcacatgaaataaattatacatctcctgaactgaaacaggaggaaatcaggtcactcaggtactgcacatctttcagtggctacagctagaggccaccacagcaaactgacaaaccgcagcaacagatccatttctgcggccagtgctctcctatctcctccattcccctcgtctcttcgcc

SEQ ID NO: 7374 - DNA, 1318 bp, Zea mays
ggaagcagtgctcatcgactttctctgcgcaaacgccaaagtttttgcgtggagtccttcggacatgcccggcataccgagggatatcgccaagcactcactggatatccgagccggtgcccgacccgtgaagcagcctctgcaccgtttcgacgaagaaaagcgcagagccataggtgaggaggtccacaagctgatggctgcagggttcatcaaagaggtattccatcccgaatggttagccaaccctgtgcttgtgaaaaagaaaggtgggaagtggaggatgtgcgtagactacactggtctaaacaaggcatgtccgaaggttccctaccctctgcctcgcgtcgaccaaattgtggattccactgctgggtgcgaaaccctatcattcctcgacgcctattcaggttatcaccaaatcaagatgaaagagtccgaccagctcgcgacttctttcatcacaccttttggcatgtactgctatactactatgccatttggcattaggaatgcaggtgcgacataccaaaggtgcatgaaccacgtgttcggagagcacatcggctgaacggtcgaggcttacgtcgatgacatcgttgttaagacgaggaaagcctccgacctcctctcagaccttgaaacgacattcaagtgtctgagagcaaagggtgtgaagctcaatcccgagaagtgtgtcttcaaagtcccccgaggcatgctcctagggttcatcgtctccgagcgaggcatcgaggccaacccggagaaaatcgcggccatcaccaacatggggcctatcaaagatttgaaaggagtacaaagggtcatgggatgccttgcggctctgagccgcttcatctcgtgcctcggcgaaaaaggcctacccttgtaccgcctcttaaggaagaccgagcgcttcacttggacccccgaggccgaggaagccctcggaaacttaaaggcgctccttacaaacgcgcccatcttggtgccccccgctgcaggagaagccctcttgatctatgtagctgcaaccactcaggtggtcagcgtcgcgatcgtagtcgagagacgataagaagggcatgcactgctcgtccagaggccggtctacttcattagtgaagtgttgtccgagaccaagatccgctacccgcaaattcagaagctactgtacgcagtaattctgacgcggtgaaagttgcaacactacttcgagtctcatccggtgactgtggtgtcatccttccccctgggggagatcatccagtgccgagaggcctcgggtaggatagcaaagtgggcagtggagctc

SEQ ID NO: 7375 - DNA, 1369 bp, Zea mays
gtcatttacctctctagctgctcgctcctcaagcagtcaagcttctcaatggaacagtatctatctatccctacagtgggcagtggtgccatacatggccaaaagttttagcagtatatgacaccaaagagcaagtttaataatatagctaatgacaggttttatgatattaatatgtcgtatatagttaactaaatacctactcatataataactctccatagagacaaactattgtagaaaccgtagtcgaattaaagctgcagcaagccgcaaccgaacatagaagctacctattttctctctctctccactcctcttgtttttatgtcaccataaatctgacgtgatatctcttatacttcgtttatatcaatttattatacttgctctaacacctagtattgtcggtgcctatctatacagtcaaaaaaatatgaaatagtgtaaagattacaaatataatgtaaaaatataaatatttataccaatatagaccggatctatcatatttaaaattataagaaatcataattcataatcacatgtacacaacataaatcacctttacataccatcggttagtctaagcatgttgtcgtgttgtgttcgtgctaggcggctaggccattgtgatggggtgacaacctcgatacgacattggatcttttactgtattgacacatatgtactatgtgaatcgtgtagtatcatgctacaacagtatgaatcgtgttgtatttagtgtcgacttatttagcacgactcattggaccatctataagcgggggtggagaagagaatttgttttgactgatgggttatgtattaaaaaaaattagctggctaaaaactaacagatactagctactccttactaatcctgggcagggcaggaggaggggccgggggccccctccctttcctagacgagctagcaaacagcggtcagcagcagggacagtccatttccgtctgacccgcccgcggccgttcccccaccccgcctttccttgcacccacccagcaagcagagcccaccggatggacggacgccccgcgcgccggccggccggtcgattcccccactccactcgccgcccgcggctgggctgcgctgcgcatcgacgacggacgacgacacaatcacccccaccccccgtccaatcagcagcggacgagggacgaccacggccccccgtctgccgcacgcgcgcccgctctgccagctgctgctactactgctaaacctcgcccaccagtcgcgtgaggaaatagcaacctgctgagctcgctcgttcgctcgctcgcctgccttcttccctgggcaagctagctagctaggatcgaggaggagctctgcccggcc

SEQ ID NO: 7376 - DNA, 247 bp, Zea mays
agtgagtgatgatgttaaggccaagtgcaagaaagatttggaatcagcaattcaaaaaaaagagagaagctgcaacatgatagagatgttagagacaatgtgcaattgattgatgatgaacccacatatgtgcagtctcttgttgggagctcagactcagtaagcaaacttggccccatggacagttttgctcgtcgcattgatcctaaagcaaatcaggctgaagccagaaggcaacaaaacatta

SEQ ID NO: 7377 - DNA, 1120 bp, Zea mays
ttagtctctagtatcttactctctttgtgaccatttctgtaatgggactgtaatattatgcacctggactggactttgttgtaaggacaataaactttttaatgagctgggttgtactcttttttcctgtctagggtttctcacaagggtgagttttacctagacaggtttttaacgaggcagccattgcactacagctcataaaattgttgtttgattagtctcttattactctctttgtgaccatttttatgttgtttgaaattatcttgtatctgtttgattgctagaagtcataataaaattatctgttattctgtttgagtgtttgattgctgttgctgggattttatgcatagtgcccgtgctggcactagcactggcgtgccggcgtgcctgttggcacggcacgacatggctaagcactgatagtgtcgtgcctgggccgagggcccagcacgctggcactaacaggcacgacacagatcttttaccgtgcctaaccgtgtcgtgtcctttcgtgccgtgcctagccgtgctagtgccagtgccgtgccgtgcggcccggttggccatctataaagcaaagcatcatcatgcatcgtgaaagcaaaaggcgtgctcctcctctttacatttggtaaagaacacgaccacaaaatgtatactagtagcagtcatggagtatattgcatctcagatcgcactgaaccagtggaaactaaatgtagcaaaagtcagcagcaggaaaagatagatgaaaaaaaaacaaagagggctgcctggaggttaggcgtgggcgcgtaacacacacatggcagctagccggcgacgatccaagagcgggtgcgtggcgacaggctggtaccctgttgccgtcgcctccgccatgttacgttccaccacctctcctctccactccacccacccaacagctgcccccaccaatcacatcacacccagacacctcctacttatcttgcgcgccaagggccagcgcgcgagcgacctcacttgatccgctcccttcgccgcgacgacgttcctacgcagctgcggtcgacgcgcgcacggcagctcgctcgctagctgatcacgacagctcgctcggctcgaccga

SEQ ID NO: 7378 - DNA, 1074 bp, Zea mays
tcttaccagataagttaggagcaccaggatctccgcaggcaaccctaatatgccggacccagttggtgtatatgacaccggagggggagaagaagacagaagagaggagacatatgagggagaacggagctagggttatggatctgagttacccggttcacaaatgcgcagatctgttgcggtgcttgaggatggagcaggggagaggatctccgacgagcgacgatcgatccgagcggaggcggagagccggagaccggagaggcggagagggagaccgcagaccggagcgctgagcggaggcggagggaacgagggagaggagagtttgccrcccaatcgcccgcagctgagagcagagagcctgagagcgagtgagtgacttagggtttgagtttgacgcaagcgcagccgctcggtttacacgcgcagccgcagacggatggctgggctrggccacgcacgctgtgctgggccgtgccatagccgtgccagcccatttaaccgtgtcgggcgtgggctgacactacgggccgagttggtggcccagcacgacactatgtacgggccgggcccgacactggcactatatggaacgggttgtgtcgtgtctrggacgtgctttttagtgccgtgcccggaccggcccaccgtgttagtgccatatggccatctacagtcatgtaagacctctggtcaacagtctatattgaccggtcaatgatcaatgttgatttagcccatgttgagtgagatctgaaggaccatcaccgttcagagagatagagagcccgttgttccttatcgttagcttccacccaacacgatcattgtcatccaagaattggagtggagccttgtcctttttgttgaccgggaacgggacgacgacttgctcgacaaccaggtccacgctgcctccatcagtcgtgatcgtcacggacacggtcacaccgtcaccacacacgggttctactccaaagattatttttacatgtcgcccttcttcatcctcccaacactcaaggccacaaaccaaatgctgctaactactccagctagctagcaacaata

SEQ ID NO: 7379 - DNA, 1500 bp, Zea mays
tccatatatgccaaatatgaatcaaaactatattgagttttcatttgcattgatattgcacttgttctagttgctttatgttgtgttggcataaatcaccaaaaagggggagattgaaagggaaatgtgcccttgggccatttctaagtattttggtgattgagtgccaacgcaagtgcttttgtgttgatctatgcaatgtggtggacaaagtgcaaatcaagtcaaaaggtatgtttctagacttagtacattgttttatggactaatgtatggtgtctaagtgctggaaacaggaaaaatcaagttagagaagagatggctttgttcagccaaagtctgctcagtctgggtgcaccggactgtccggtgatgcaccggacagtgtccggtgcgccaggctggctctggtgaacttgctactcttgggacttcgacggcggtgtacggctataaatcaccagactgttcggtggtgcaccggactatccggtgagccgttcacaggcgaactcgtcgctctcgggagttgattaacgacgtacggctaaaattcaccggactgtctggtggtgcaccggactgtccggtgagccaacggtcagccggggcaacggtcggtcgaggattccgcgcgtgacgcgtggccgagccaacgttcacattggtgcatcggactgtccggtgtgcaccggacagtgtccggtgcgccaacggctctcagactccaacggtcggcttcgccaaataaggaaggatatctgcaccggacagtgtccggtgcgccagtcgacagaaggcaagatctgccttccaggaatgttctcaacggctcctagctgccttggggctataaaagagacccctaggcggatggaggagcatatcaagcatactcaaagcattcctaagcaccaagacttcgattccacgcatttgtttcttcgtgatagcatctagagctcttgttgagttgtgaactcgttgggttgtgttgcgagctcttgttgcgacttgtgtgcgtgttgacattctgattcttgtgtcttgtgtgcgttgctcatccctcccttactccgtgcttctttgtgaacttcaagtgtaagggcgagaggctccaagttgtggagattcctcgcgaacgggattaagaaaagcaaagcaaaacaccgtggtattcaagtgggtctttggaccgcttgagaggggttgattgcaaccctcgtccgttgggacgccacaacgtggagtaggcaagcgttggtcttggccgaaccacgggataaccaccgtgccatctatgtgattgatatctttgtggttgttgtgttttgttgagactcctctctagccacttggcgattattgtgctaacgcttaaccaagtttttgtggcttaagtttcaagtttatttaggatcacctattcaccccccctctaggtgctctcaattggtatcggagccgttctcttcacaaagggactaatcgcccgaagag

SEQ ID NO: 7380 - DNA, 414 bp, Zea mays
tattaaattattattattacatcacacttgtatgacgagatattttataaagataaagcttaaacgaaatcaccgccaaaaacatccttaaccggcagtcgttctccacaaagccacgacaaacggttgcggttgcggcttcctgctagtttgcgctggccgctggcttatagttagtgctcgcttctagaacgcgtccagaattcgtggactcgcccccgctccgccccagctcacacgccaagtcccagtacaaagcctacagaactttccccaccttcgattcgagttgtccgcttccagtcagtcgccgccgccactgaactggaagttgaaaccagctcgcccggggtccggtcgatttaccccaaatttcgctgctgctgctgctgataggaggccgcggcgaccacc

SEQ ID NO: 7381 - DNA, 496 bp, Zea mays
atttgaatcatgtgtactaaatttttatgtacacgagatatgttctcataaataaaatattgcttgcggccagacacggttgcttagaggttgacgaacgagatccatcccaaatcccaatcgggtagccatcaatcttgtgcaatggtctgcaggagcttttctggaagatgatgaaagcaaagcagggaaggaggcgctggtagggtcggctcggcaggtctgactgaatttatgtgaggtgtgcccgccacgccatcgtcgtcttgctcttgcattgcatccctgtgaccctgtcctgcccctgctccgctctgccagccttagtcgtctccgcccaccaaggcaccaacgcattaaacccccattcattaattcattcttcccttcctgctacggtgctaccctgcctctgcggctctgcctctgctacagcggcgtcggtatgggcggatcgaattccacggggaggaggtccgggtccgtcccgcgcgcc

SEQ ID NO: 7382 - DNA, 649 bp, Zea mays
cccctgaagccaaaagtcagcacagtactaggcactaggcagcgcagacagtccagagattccctgcaatcgctcggcttttggactagcggggtcgtggatgcccggagctgcagaggccacttgcgtccgtccgatctgcccagtggacggtccagaccaagttggagaaatcgatgcggacaacatcaccaaccttcttctacccgccctgcagttgccgagagttaattcgagctttaatcacctcaacaagatcctcggttctgacttccgagcattgattaattactccaggctagtttaatccaagatccgcctgtcagaggagacgagcccacaggcacagaaacggacaacccagctcaactttcccgggcccacaggaagccagcccatctgctgctaaacttcctgtcctgtatcatctcgtgctcgtcggtcgtcactagtcctcgctcatagcaggcgccaggcggcagtgactcatcactactagtgatcagaccagtgagctagcgactgtaccatgcagcagctgtaggagagcctggtggtaggtaggataggagtagcgccagccgccaagtgcgcgtccgggctggctgcttcggcgagcaggagggagccgcaccgccgggctcccgca

SEQ ID NO: 7383 - DNA, 1446 bp, Zea mays
aaggaattggcccctttaaatttgtgcccccccccccccccccggtcgtaatcgtatttcgtgtgtctcgtcgcattgcgtttccgtctctgttgcggcatttggtcggttcagcttcagcacgttctttcgttcttgctcatggattcatctttttttactgtggccctataaaacaatcagacagcagcccacgacgcggaatcttggcaaggccgcccccccaccccacccccgcttgctcttgcgacccgcgattcgtgaagctgcatttcgtctgctctccgctgaagcagcagcagcagccgcctaccttttagctccgtctccgagatggtggatccctcgcttccgcgtcaccaactcaccaccaccaccacgacgcctttatcacacgattttagcgctaaaggttctggcccggcgctcttgcgtgctgattcggtgttctaaccaccacttcccttgtgtctcttgtttcaaccggggttcttaaactgtctagttcttatttgtttggtagtggttcaacgtggagcggtttcttactcggcgaacgaccgacagctttggaaattggccacctactgtgtttcttaattagtggagtaatataataaacaaaagcagtgcgcggcttttgtttttgctgttgctaattttaacacaaaaaaaacgtttacctgaaactcgtttgccgtaggaagattctattcagtttggactagtgcctgagtaaacgggtgaaaaattttaagtgtagtttacaagccccttttcgatgtggatttctctaataacttccaatggtatgcttgtgagccggcagtcaaatcattcctcagtacaatatttattgtggagcaatcatctgcagttcgaatcgtgttatgcatcactcctgtttgctgtcctggaaggcaacggctgtggaacgatcacctttaggaccacttcatcatgatgaaactattgtattatccttctcttccggcagcatcttgtcagccttttagtattattatatatatacatacagataaaacagagatccttccatcattaagtcatcacctttgcgtcatttgggagaaacacttgcctttcaagcgtcggtgaaggactgctaataagtctgctcccctgaaacaagtattggaaatagcgactcacctaatgtccttcttgaccgggtttaaaggaccatttctctttgcatggcgtttctgggctgtaccaccacagcttccaccgacagcttagttgcagcatgaattttgacacggaaagcgcatgacagcctaaccgttaagcattatatggatttaaatagctttactttggttgatgcactgctgggccacggtataacctagaacccacgtcttcaaatagactgtcatatggtgcatttaccaccctcgaaccatagatgatttggcagag

SEQ ID NO: 7384 - DNA, 285 bp, Zea mays
tgtaagcttctttgtttcatcacagttgttgttctataaattcatcttgtcttcacgttgaaaattttaggtcgacaaatgcagcttagctctagtcataaacatctatggtctaaacaacaacgctcactgaataaggaaaggacaatgagtacaatagatcaccatatacagccttcagtatttatgtgatgattcgatttgcctccgataaacagatgagtattgcccaaatgatttaattttccaggcacgactacaacagtgaagacaaggtacactgtt

SEQ ID NO: 7385 - DNA, 442 bp, Zea mays
aactacctacaaaggtataggctgatcacacatgttcatttgaggcttggcctctggtttcgtagctatgcctttgtatggattagtgatctacttgtcatttgtgtgatgtctataatgactttgtagatgttaagatgcgtatggtgcacacgcatgctttaatggaggtgattttatagatacctgcacctaatgagcatatctgagaaagatgttcatcataaatgttagcatatcttcaaccccccyccccccacccmcacccccacccccacccacacacacacacatgcatatcgcttgtattgtgcatggaggatcgcaggcattaactaaactctggagtccttgtgacttccccttccctataaattccactaacgtatgcttgaactgccaatagaacatcaagtttagattcttgttcacgcgttcaaag

SEQ ID NO: 7386 - DNA, 1370 bp, Zea mays
ggggtatcgttgcattctggccgcacgatcaccatccgacggccacagttagatcgaatcacttcacgaaccggtacgacaccaggggatatgcgcgattaaatctgcaccgtccatttaagatcctgcggctgccacatgcactactctccgtctaatcacgagcgtacgttaacagatcaacggtcccgtgataccagcgcaacgcgagcccctttcttcccctgcgcaggacggcgcgcgcccttcacggcggaggttcgccggcgcggacccagctcaccccgaccgacgcccaaacgtgaattaacctggtgctaaacgaagcacagacgacggtgaacagatctgggcatttcttacccggattggtgacggtggtggcgctgctcacacgttcttgcgtgttccattttgttttgtgcatgttcaagttatacatgactacatttatgtagatatattcagaaaataagattcacttaaaagatgatagttgactgacctattatttagagcttatttatggggaaatgttttttttttaaatttcaccaaacaagtgaattgtgttttgtttgctgcgaattcatgttctgtgtgcaataattaatgtaacgtaaactagcataccttgaccctcttttctttctgctgcttcatcacctgtatgcatgtacttaagatcgaagcaactacacgtggcaagttttgaggatgtcaatttgacctgttatgttgtatttatgttgtatgatacaaaatattagtctacaaaacgataacatgttcaacagataaatatacggaaatacatatgggaccgagtcttgagcgacgatataacatttgtttagatgggaagaggtggctgcaggatgtttgtcgagtcatgcaggcgtctgaggatcatgaagagttctgaagccataggtcttggttagtgtctccagataaaattatcttccatagttccattataagatttacatgtcaactctaaccgcctatgttttcttcatttttttaaaaaatacagcaccaagaacgaaggacaagtgcaagaacaggagctgaagaagatacagcgttaaagacgctgcccattgtgtcaaaagaatggtgcccttgcagtgtgctgcggttttttctagaaatataatgcgttttaattactagttggagggagacctgtcttgttcaatttgttcatggaccagaagcaataatctatctgtgtgtagctggattggtgttatgcgatgtcccctaccgtgtgtcccagaatctacttggtgattttatcccagtgttgttaatcaagcttgtgtgattgttaagtaaagggcatcaatgagactattattatt

SEQ ID NO: 7387 - DNA, 82 bp, Zea mays
ttagccgtgcacatccgcgcgcgtagcgtaggtcggtgttattaattgttagcttgcggagatttccgtttatttaggaaga

SEQ ID NO: 7388 - DNA, 652 bp, Zea mays
caatagctccaagaaagttccttcgcactatcctatcgggctactactatcgttaacatatagtgtgtgttggcgacgacgtgagtgagagggaggggacgacgaagacgtgagagagatggggtcacaagggaggaagagaaggaggagtgagagataatccaaataatattgtctattgaatttgagtgagtaatgaagagtagattatacaaaaatctaaatcattgatcttgatggtgtgttaagttagattgcaatttgttttgtggttttagtgaatgttacagacacgagagtaatttagttggtttaaaccggtagattatattatggtattagtttactctttatcatagctatatttaaaattactatataaataatatagtttataatataaaatagtgtaaaacaatgttttggatgaacgagtgaaagattagccattaggcgcctcggcctcacgctctcgttctcgtggacctgcacctgctatacaaaattcccaaatatagatcgaacgacccccgcggccctgccccagaaacaaagctagggtttgcctcccaaccctcctcccgttctcccgcctcctcctgtgaaccgcgcgagccaaggaccgcccgtcgtctcttgtctcgccgtcgcc

SEQ ID NO: 7389 - DNA, 139 bp, Zea mays
ctaccggggatgtggtggtggatgctcgggcattcgtcaaaccactcatcatcccatcccatcccatccaagggaatccgatcaatcccggactcgtcctcccggccaaccctagcttcccttctcttcccctcccccg

SEQ ID NO: 7390 - DNA, 380 bp, Zea mays
ggtgaaagagcaatcccaatactagattagtttttaggtactgatccagttcttatgaatacagttgattcgttccaaaaaaaaaatgatgagttctgagagattgacttacttgtaaaagcagatcaaactatcagatttttactaacttgctagcttcaaaatgcctgaagttatggtgctatcagatcttagactttgatttaaatcatctgaaacttctgctgctgttctgtcaggtctggacactttacgagtccgacgatctcgagagcatcattgacaggacactgaagcgcgatttcgacaccgaggaagcacgccggttgctgaagataggtcttctgtgcatccaggatagccccaagatcaggccctcc

SEQ ID NO: 7391 - DNA, 1500 bp, Zea mays
aagcaagagcaaatgatgacaaatgagtagggtttggatccagccttcacggagactaatcagtggatgccataaatcccaactaagaaatttcatccacgttgctttcaaaaaaaaaaaccatccatggaccgccttccaacctccaagactggatttcataaatatttaggtacaatgcaagcgtgtggacagagtcaatggttgtactgtggagctgatgatagcacagaagtcatttcctgtttacaaagaccattagtaatttctttgagtacacatgacacctaaggacctgagctgcacagttgtactcggtaaacatgtgtttggtcggtgatcagcctgtcattggcataactaaaccaggatctaatattaagaactcctacttaagatgtgaacttacactgcagcttcacaaaccacagtcaacagctcacctgtcaaattacaaaatagctcaaacttgtctatcaccttggcatcttctgatccttgcttattttatggtgcatggtcctccatgctgtaccctgccgactttaaaaaaactcgacctgcggctgccggacattatattaagaagaataatttctcacgcattttaactaaaccgggatcttatattaggaactccttaagatgtgaacagaaacgctgcagcttcacaaaccacagtcaacagctccatagcatccacacctgtcaaacttggcatcttctgatccttacttttatggttccagccttgtgaccagtgagcaagtcctccttactgtaccctgtcactgtactctctaaggtcagaagagaactagcctgatcagtcccagtggggtccttgcctggattgccatgtatttatggcacaaccatgctggtcttctccttctgccactgcaggtcttgcagaaacatgtctcttctctatcttctctaactaccttccgagaatttcttgctgggcgctcgatgctcttggaccctttatgcagacttcatcccgtgacaagtcttccactgatcagtttaatctgcaggtgagtttctttttctcggtttccttctctagttttctgagtcagctctgttctctgactagacatgtgagtttattgatttctcgtagttcacagtttctcctgcaaatttttgtttacggaatgtttcagagttcagggctacaattgacattcttgtttcatggaattttgttggttaaacatgaaattcatgaatcagttttgttttcaccatacacttttttagttcattccgaggtgtgagcttcgtattaatctgcaagcttggatgcgatctactactctttattttcctagctctcatagaaagaataaagttgctaaaaccaacagttttgacttctgattggcctcttcaagcccactgactagtttgtcgctcaggtagataccagcatctcttttccatatctgaaggcctgaattccaaacaagagagctcgaaacaacagta

SEQ ID NO: 7392 - DNA, 1500 bp, Zea mays
ccagccgccaaactaaactgccagacgcacagccgcggagccgccagagacagacgctgccgccgtcggccgtcctccgccctccaggtacgccgccgccccctcctccatcctccggtcccccctcctccctcctccggtcctccctccacctatagccgccgccagtgcgcagtccaggagcaaccgcccagtgcgcagtgcgcctgctccagcgagccgccaatgcgcaaccgcccaggtcggcaggtccaaccgctgttcgtattcacattctgctgctgttcgtatccaaaacacggtgcactgcgcagccagccagtgcgccagccaccttgcatatgcaatattgacgaatgctgctgaagctgaagtgctgatgctgtttttaatcatgctacagtagaatcgtccatcctgctcgcttgtctttctgagctgtgcatgcacaacgatttgggcttgagtggtggtgctaaagtctccatgggatgagcttgaggtgcactactgtttatccggcttctgaagggcgccttcggttttgtgcataggcacattgggttgctaactggtagttttttttggttataagattcttcatatctttttcatttagattaaaactttgtgccgtgcccttgattccaaccatgaagctgcagtttctgctgtagtgattttggtctgatgctcaaatataatgttgaggtgtgtctgcgtgctattgcttcaagcacactgtttttactgggttccttctgaagaagccacacatggttttcttttcgtttcttcttttacctgtttgaatattcccattgaaacttgtatatgtgtctcatctaccttccggaaaagaggttaaaagagtatatcatgttttatgttartctgaaaagacgtttcaacgttcgtttaaacgttgaaaagttggttcataacgttttaacgttttaccgctttaataaccacgttggatgtattatgtcaatattcatagcataggctcgtggaaatattacacttgtggtgctagaaccctggtccttatatttatgtatagcctctggtcgttagataagaggagacaggagacagtatgtgcatgtatttctaatttgcaggagcattcagatttttaagttccagtgaacacttctgcagagcaatcacattaatttgcatttctcaaactgtaaataagcagaggataaagaaaagctctttatcattggaacttagaacactggttttccatagcactagcagcgtcaataatttggaaaaatatcattgctcagccttataaaaataaaactcaacgccacatggaatgatggaaaagtaaatatttgcttacctatgggagatgatttattccctgtttttatattcatttctctctagacctttcattgttaatcatgtttctctatacctatacgaatcctcttactttctctaatcctatgcagttgagcggttcaagcagagctg

SEQ ID NO: 7393 - DNA, 1188 bp, Zea mays
gctcgccgcggcgccgaccgccggcgcgtctggggtgagctcagtttcgcttggacgagtctcactaagatgtcgacggtgaccagagcgaggtagacctcgagttggaatgagatggcctccagttcacgaatgcggctggagatttgcaccatctgaggagttcgggcggaaatctccctcgactgcgaaaccctgagatgatcgcatacgaggtcaatggccacatacaaactggagcgctcagtgtcaacaacacgaaggcgctcctccgcacacgaaagctcctccagtaccatcgctagcgaaaaacagaaaacccataaagacatgatgtgctttagagccagactaggctattatttctacactttggactgtcacgatacagtcaaaaaaaatttagaccttcttgacccgaacctatttagctcgaagaacgatggtcccgacctataccggcccaattcaccatagtagtagttgccgtgactcttttggtcgtggctactctttggatctttgaacgggatggccttgcattgggaccccactagatccacagcaaaaggaggccggccgggacaagccaagaatgatttaaagaagtgaatgaagagcataaagataaagcaacagctccggcacaagaaactacagactgctacaggctgtgttgtctttgtgcatggagaggcgtgctgatgatttttcctctcttgagacagaagcttccgccgcatacacgtcacacgaagatgatacctgctggcggaccataaagcgatggccagaatctccatggacagactttagcttgcagggtgcccttattggagcacatataactgcattttgttgtatgccaccacattggcaattgcaagaccggattacattgcatttgcagacgagcatgaatgcacgatggtataaagcgacatctcggtgccaattgctttgagctttacgctttgggagtttggacccaaaatcttctcactaccaagcgccgctatatctgcagacacaagcgacagccgacaggacacagagttcctgagcctcccactcggcagttttcgtcaagctcagatagagagagacgccatcgcatagacacaaaccgctgctttccaaattcttcggagagcgtagctagtggtcggaagagacgggcgagagaga

SEQ ID NO: 7394 - DNA, 1500 bp, Zea mays
ggagttcgggcggaaatctccctcgactgcgaaaccctgagatgatcgcatacgaggtcaatggccacatacaaactggagcgctcagtgtcaacaacacgaaggcgctcctccgcacacgaaagctcctccagtaccatcgctagcgaaaaacagaaaacccataaagacatgatgtgctttagagccagactaggctattatttctacactttggactgtcacgatacagtcaaaaaaaatttagaccttcttgacccgaacctatttagctcgaagaacgatggtcccgacctataccggcccaattcaccatagtagtagttgccgtgactcttttggtcgtggctactctttggatctttgaacgggatggccttgcattgggaccccactagatccacagcaaaaggaggccggccgggacaagccaagaatgatttaaagaagtgaatgaagagcataaagataaagcaacagctccggcacaagaaactacagactgctacaggctgtgttgtctttgtgcatggagaggcgtgctgatgatttttcctctcttgagacagaagcttccgccgcatacacgtcacacgaagatgatacctgctggcggaccataaagcgatggccagaatctccatggacagactttagcttgcagggtgcccttattggagcacatataactgcattttgttgtatgccaccacattggcaattgcaagaccggattacattgcatttgcagacgagcatgaatgcacgatggtataaagcgacatctcggtgccaattgctttgagctttacgctttgggagtttggacccaaaatcttctcactaccaagcgccgctatatctgcagacacaagcgacagccgacaggacacagagttcctgagcctcccactcggcagttttcgtcaagctcagatagagagagacgccatcgcatagacacaaaccgctgctttccaaattcttcggagagcgtagctagtggtcggaagagacgggcgagagagaatggacgctcactggcaccgactggccattgtggccgcgcttgttcttctggcctccgcggcagaagaggcccttgccgttcgaagcccgggagccctgctggcgccacgaagcagtccggacgccttgccatccgcgagacttggtacgccggagaaggagcgcacaggcacagcggcggccggtgccggggctggctctgccccgtcggccgtcttcgaccccgacaggatgagcaagcgccgggtaagaagaggatctgacccgattcacaacaaatgctgaggtcgagcgtccaagaaacgagagaaggtctggttctttcagtagtttcctcctttttttcttcttcttctttctcggtcgagttgttcagtgagacgtctaaggagatccaaggatttcgctacagagataaattgtacagagacgctttgttagggggagagagtgccatggctgtggcaaata

SEQ ID NO: 7395 - DNA, 477 bp, Zea mays
cccttgttcggagtgtgcagattttaggtgagccattgattttatatcggaccagttcgtcttgtgtggtgtcagggtttagttttagcacaactgcacaagcggagcgagccctcccgttcccggccggttctggacttgccctccgctccaccaccgccggatccgtatcgcccgcgcgctccgcagccacaagcgcaaaggcagcgcacagagctgtgcctagcagtgcccaccacctgccgtccccgtccaccgggcccggacgcggacgcctcgcggtctcgctcgcccggctcttccctcgatcgtcacccatctataaataccttggccgcgcgctgcggagctgagagcaagcaagcacacagcgagcacgcaccagcatccttggcacttggcagcgatctgcttgcttctcccagcgcgcgcggccaagctagtaggggtctaggggatcgatcagatatccacgcc

SEQ ID NO: 7396 - DNA, 1500 bp, Zea mays
ttttagagggctatcttgacataggttaaaactaaagtagtaatttagaattttttccttttcgtttcataattattaacttttaagtgcaacaaatgtgtccaccatcatggaggacatctcttctccctttcgtcctaggaggtagtactacaattttaagtgcgagtgatcaaggaagatctggactgtagtgtatggtggtgccactatcattaagaatggcataggcaccttcaaaagtgctagggacggtagcctttggtgctagcaaaagcaagagctaatctcgtaatttgtgccatcactaagattcttcttcctctttcctagcaagttgtccgtgcaacaagttatacgtactttgctacggtttttatatatcatataaatagataataaaatatttatttaaatataattattatttatttttaaatactaaggtacgtgtggtctggttattagctccaaattttcggagctaggggtgtagattcgagtgctcgctttacactttttttggcgctgagcaggctcaacagctggctgtatgggcaccgggatccaaagggtagtagatgagaggggcgggagaaccagtcaaagagcgtgggacgacctagagtatcagtgtgtccacaggacagtagctgagagagggatgagagaacgtgcgtgaggcggactyactgtgtcagcaaatggtgaagctatggtaacaccagatacgtttataatagagtagtaacagatatagcactcctgctttatttaaagacccatttaaataaaaatatatatctctcttcgttccccaacaatttactaatatatattagacacgatttagaaaactaaatttactattgaaatttctttggcaagaaatttagaatagaaataactatatttaaaggtttaaataaaaagaagttgtagaggatttttttactgaatttttttgttgcttacgaattactagtaggaargatatcaagaagcagcgtatcaaaactgaaaaccgaaaaatytggtgcattggcttttcgttttccgttctgatccgcagcttccttatatgccgaaggycgctctggtcgaacaggactccgactcgttcgggctattccatctctgctctctccctatatacgactaggctaccgccgccgccagatgcgcaggtcttcgtcggctccttctacttctcaggcaacgagcacccggcaggtatgcccgccccatcgcttccctttctcctctgcgaaaccgagcagcattcgaagcctagtctaatctaatctatttggctttttgtaatcgggcctgatctaatcgcaagtgtatatgtacgtgaattatgcctactaacttcgatttctttttgttttcaccaaaaaaagtaccgatcgggtgttcttcactgggtccgctcctgcgtgctagaactagaagaatcctctgctcggctcgaacttggaaggggggaggcgaggg

SEQ ID NO: 7397 - DNA, 882 bp, Zea mays
agtggagatttggaaatgtagttgaaaggacatagataattagatgggggtgaatagccactaaaaattattctacgaaacttacagttataattagaaccaatgaatatgtcgaagcgaatattttctctagttttattctagaaaaaactctaagggctagtttgggaaccccatttttccaagggatttccattttcccaagggaaattagttcattttcccttgggaaaataggaatcccttgggaaaatggagttcccaaactagctctagtttggattttactgaatctcatatttggtctgactacttgttttgtgtgtataactcgggaaggtagttcttaggttagaattagatagatggaaaggtatggattcctatattttcaagaaaactcggaggcaatttctatagcgagtaggaactagagatgtaataataattgatagtgtgaatactaaatcgctgactattgaacacagagctgactgtgattctgtatgaaatcatgtatctattcagcctttattggtgaaatgaaaatcgcaattgtcagttgttaagttgagagagtaattactcatgagaagctgagctcacttattttgttcaacactctgccctctgtttgtgatttacagtaagtcaaccctccctccttgcttatctccaatatttaggaggattcatcaattcaaaaaccaatatttcccttggtttctagcttatgaagtatgtagaggacaaagcctggagttcagttatagtatctgtgtcctgtgatcttgtaatcagtcctagttgtagtttgattgatggattctaatattttatcctcgtatacaggaacgaggattctctgtgatactgtcagac

SEQ ID NO: 7398 - DNA, 249 bp, Zea mays
ggtacaaagtcatacgtgaattgaattctatgtcttcgagtttatctcttattctgttgagatcttactatatctgcgcttctagaatcctcctggtggttgtaggctcccctggtcctattgccgagtccttcggcttgtggccgagcccatgagctcttttgctcaggctcttctttacgaagcttggatagatgccctagtatatattattgataggacatagcatgtcataatgtctggcttggc

SEQ ID NO: 7399 - DNA, 1047 bp, Zea mays
tgacatgggtccacccgtcggcgagggagaggcataatgaaggaaatggcagaaccatggtgcacggatggtctacattagactcttatagagtagtagagataaaagatttcattttctaaatcttctcgatcttcgataactgctttttaaatttgatcctctatatctattatagtaatagaattcataaactacattgctttttctccattttgcatataaagactatttaaatttccgaacgtaatttaaaatcaagtcgttttttaaaaagttcacaatttagacatcgtatgttaattacaaaaacattaaccggatatttgtgttcgtgcaccaaaacaaataattgttcatgtatgacgaaattgaactattgagtatttaattgcatttggctaaaatgtgataagggcacgtagatactatgttgtggttctccaaatatgatacacctaagaaactcgttaatacaacccaacatatagaatccctcaagatacagctcatgacttgttcgcttcaacgttaatccatgtgaattgagtgatattgagtcgatttaaatctatagcaagtcaaaatatatctcaatccatttcaatacactccaatgcacatagaattggaataacggaataaaacctaaatacaactcaacacatgtagattgagatcaatattaaagtacctaaataaaaaataaagacttaaaattttgggttctcgttagagatagttatactgaaattttaaaaatatttataaaatatattatcatagcatatattcaaataatacagcattgacaggaatataagattgcacccatcatgaattcaccgtcacagaaaagaaaccggaacccaaaaggctctccgccgacacgccggctacggcgattctccaatctgaaacccttcctgccgacgattcctttccaccttccgctccatcgcgtggccgccgccgctctccacccgattggttcccgtgcctgccgccccaccgattcactccgcgcccgcgcgacccctgccgtcc

SEQ ID NO: 7400 - DNA, 471 bp, Zea mays
ctgcatcagaaatcgtcgacgaccaaggcaccgacgccccgcgtatccgggctccgccgagatccgcacgcaaaagcggtgggccctggcacagtcgccgacacttacgcggtttgtagagccaacgcggacgccccaaggcaccagtcgccgatgagcttcgcggcggcagtgcacgcgatcgcgacgcgtctgtgcctctgttgaccgacttcaatttgccgcgacgatccagatcagacagggtctctccgttgccgtttgtggaaggccaggcgacacgtcgccacgcccgtcttgacaaatacagacagggcacgcacgcgccgccataccgacagttccgtctcaaactctctacctgctccgctgcccacacggcacacgagctgtcagctatatactccatcgcacgtccaaccccagggaaacacccatccaagataccgacgagcaggccagagcgaagga

SEQ ID NO: 7401 - DNA, 228 bp, Zea mays
ggaaaatgaactaaatttccttaggaaaatgaaaattccttggaataatatggttccaaactaacctttaagagaaattagttcattttttcatagaaaaatagaaatctcttgtgagattgaggttcccaactagcacttaaattgaaaaaaatataacccgccttatccttacggcgaaactgaagcagataagccgtacgccgtccccttgcacagcaaacatcc

SEQ ID NO: 7402 - DNA, 566 bp, Zea mays
gagtggtggcgcggtgcccgtgcaggccgcacgcgtcatagctacatggtcgcagggacgctggaggcggaccgacagaggtggaggtcggactaacggtagtggatgcctgagtcagagcctgctcgtccgcctcggaggttgctaccttgtgcccttatcggattcgtagagcctgaagacgtgcagagcgatagaggactgaatggaggcggccgcgccactgacaacataggaagcgcaaccgcgcaggtttgcaaaataattggaagagcctatgttctcgtgacttgaatcgctgagggagaccgtcagcgctaggctcaatcggtgcaattaggagttcttttgggccatattttttggctgaaatgtattttggactacattttttggttaaaaaaaacctatgtacaagatgatttttgggttgcacccctggccacggcccaggtggcccggggcccaaatctgcccctgcttatacaaacaaaaaaacaccctagagttttaaatgcagggagaataacatagatgtatatatatacacactcatctgaatttac

SEQ ID NO: 7403 - DNA, 705 bp, Zea mays
cggcgtgccgtcgcgtgcgcacgacaacgaccccggtccgcccgtcgaccgtcgtctgctcgtgtcgtgccccgtgcctagcgcaacgactgctcctgctcctgctccttttactactaatagtagaccacgcacggtcatcgtcacgcgaggtagcttcacgccgaagaagagcatctctgccgcgtcacccgcgggctccacgccgcactgcaatgcagcatgctgtccggtccggcggcgcggcggcctgcccctcccatgtctgcaactgcgaatctgcaatgcaaccaacgaccccgtcgtctcgagagacaccagaccggccaaccaacgccgcgcgagctgattgccgtccaggtcggacctgacagcgacggctgctgctacgtctctctcgctgctgccgcggccgctgccactggcattggcatggcatcccatcccattccattccattccattccaccggctacaaatagcctggccggcggctaggcggctagcactagcagccctctcggtcgcattctcttcctctcctagtccttcccatgatcccatcccatatatcccagccaggtcacccagagagcgagaagctgattgcgccgcgccctagctagcgctctcggccgcatcgccggacgtctattaacccgccgccgctcgtcctcggcatgcgcggttctgctcgcctgcgag

SEQ ID NO: 7404 - DNA, 191 bp, Zea mays
agtagttgccaaatatgctgggggcaaacacaaggggtcaaagacttgtgtttgggtacccaaggtgcttgtttctaatgtgaaaggacccaagaccatttgggtacctaagaacaaggcctaaatttgttttgtaggtttatgcatccgggggctcaagttagatcattgatagcgggtgcacaaaccac

SEQ ID NO: 7405 - DNA, 205 bp, Zea mays
cgatagaacgagctagcggggcaagcgctctctctggattctataaatccagcattttgctcacattctgctctcgccacctttgaacgatagcctttctcactccgacacttgaaacacgttcatcaggagctcgtcctcaggcttgctagtagcttatattacctacctagctagctagctagtcaagactcaagatccatcc

SEQ ID NO: 7406 - DNA, 468 bp, Zea mays
gtttttcctttgttgcgacttgcgactctccttcatcttcatgcaggatttagggttcacagatcgccttacaacttataggagagatgagacgaggaagtatcaaataataaagctttatgccaacgataatttacgcagatgacttagacgctatgacttaacatgtcatctatagagagaacctataaagttactagtgctaagacagatcgtaattgtaaccagcagttcgttacttgcataccagttgcatgtatacttaatggtcaagtcaagaagctccattaattccagtaaacttaaaaagcctccacttggccttcaattgaaacaccactattattaatactctatgctattaagataaagaatcacactgcataggcgcaagcactataaataccccagcagacttcaccggaactcatcccaactactactactactcactagcggtagctcaca

SEQ ID NO: 7407 - DNA, 377 bp, Zea mays
tgttggagatgctcttagtaagtcgacgaagctttgctccaagttagcgtgaaacatgggaaaagcatgtgaggaaagggctggagaaagttcgatcaccgctgccggcgtatgactggaaaaagagagattaataagccacgcagagaacgtgcagagctaaaacttgtcattttcactacaaattcatactgttgtgactacgatcttttgtattatatataaatagctgcccagagccagcgaatgcagagcacaagatccaagaaacacaactgcaaaagcgaggatcggagcactccgatccttaattccttcttggattctcttctactctagagctctgctagaccgatctccagttaagtttcagacac

SEQ ID NO: 7408 - DNA, 157 bp, Zea mays
tgaagaatcgaattaaccaaagagttggtgaacggactctctgctgtatcgatctgttgttgtatcgctacagggaaagaacagctagctaatgggaactctagctttggtactaaaactaagagctgattgagtgaaagatgatgacaacaattct

SEQ ID NO: 7409 - DNA, 1086 bp, Zea mays
gggtaaaacactcggtttatcatcgcccggggactcctcgaggaagcaatcgatggctgaccccctccttggcctataaaaggaggaggtcggctacgagagagacggacgaaccgacgaaagattgaaggacgcattgacgaggcccggagaccggagctctgtcgccaagccaagacttaggactccagctctgtatccctaagctccacttcctctacacaagagattgtgagcttcttctccctctcttgctcgattgtaacccctactctaagcattgatcaacaaaggtaccagtagcgcaagctaccgaagattggatgtaagaacgttctgcctgaaccaatataaatcttgcacccaccgcgtctaccgtccggagcctagaacacacacgtattcaatattcaattcgtgttcgatctatattcgtatctgtgtacttaaagttgaatatttaaaataaaaatacttatttaaatttaatccgacataactctacaatatctacttatgataattcaaagaaaaaaaatatgaaaataattttagcatgagtaatattggttcgtatccgatttaattagtccctagccgctgcaatggacyctagaggcctaatgtaaagcagtccacagaccaggcccacaggccgcacccgacggcccatccggcctttcccactcgtcactcttgatcggcccagcagcgagcggaactgcgaaacgcaggatcgcgactccgggaaaaaaaaaacgccgggcgcaatcgggaacggggaaccctagggcagccggcagcgtcgctccgccccggccgtcgtcgtcgcgcgtcgccgtccactcgcttcctgctcgggccttcgcccctcggccacgtctctgccctcgccccttggtcgggaccgacgtcctcgctccatctagcaagctgatcagctcgactgcttgagctcgtcctcgccatcgccgctttgatttcttcctttcagcccgacccggctcaaagcagccagatcacggcactccgtccgaccctcgaagcgatcaccttcaccgcctctcctcctcgtcacaggtgaag

SEQ ID NO: 7410 - DNA, 609 bp, Zea mays
gtggtggacgtcctccttggtctcttaagaaatagtaaagatagcagttgtttttcacaaccacagtctaaccaaacaaacactaagattatcttcagtggactgtgtaaaatagaagacgcagaactgtagaaatattgtttagtattgtttgtaaagtgaagttcaaaattaacctaagattggccttaactctgcaaaacctagagccggcccggcgtaaatcagaagggtccaggcgtccagccgggcaaccgccaaccggccgaggactcgaagcacaagcaccacactaccacagtcatcacggattcatggcagcacgtgagtacatggcgagggcaccccacaaccacaccggacgcggcacgctggcgggtggttggcaaaagccaaagggtaggctttcatcgcctccgcgtcgcgtcgcgtcgcgtcgctttggatgcgactgacagcacgagtctcccgagacctgagtcctgagatgagaagaaagcactaaagcagagtgggatgccgcggtgaggactgaggactgaggactggacgcgcggcgcgggtgcgcggcttcggagtccgctagactacaccacgcgggttcggcaa

SEQ ID NO: 7411 - DNA, 669 bp, Zea mays
aatccaatacatcgatccgtggcctgtctagatttttgttcttgaaaacgggcaaggtcgacatgagttgacagtgtacgagttcttgctttcttgttatctaatcaaggtgttggtgcagcttgtttaccaaaatttagggggtcacgtgctgctcggctgctcggcttcattcatgtgtgtaatagctagtagtctggtactgctatgtggcattgtggctgtactatataatagggttattacttcttattattgtattagtgacttgtgatgtaccatgccatagttgcaatagctgctatgatttgtgttgtttatatatttgcaaatgtaatatgctactgatttattgtgctggacatgatttttaactgggctgttggcggggatttttccccatcggatccccgtatacccgacggggacggggacggggacggggaacagggaatttttattttggtgggtacgggtacggggagcagtccccracggggagcagccccgttgacatccctacccgtgataagcccatcatggttcattttcactatagagtttcactgtatctttcgaacttagtcttatttcttattttgccagcattcagcgacgcatttgcctatatcagcactgtggtcataactctagtagagaaaggagaag

SEQ ID NO: 7412 - DNA, 282 bp, Zea mays
cgtacgtccacttcttttatttgcttccagccagctatagcctcttcttccccccgctccatcatatctatcctcttcttcatatcgcgtaagtatatgcaacaacgcgtactactactagactagcttagtatatcatgacgagctccatgcatctctcttcagccgctttattttcttcttccgtatgtatagtatagtattactggtgtgtggtactgttcttgtcattatacgcacccccacactgctccaccggcgcggcggtgctggcatggcggc

SEQ ID NO: 7413 - DNA, 457 bp, Zea mays
cgtacgtccacttcttttatttgcttccagccagctatagcctcttcttccccccgctccatcatatctatcctcttcttcatatcgcgtaagtatatgcaacaacgcgtactactactagactagcttagtatatcatgacgagctccatgcatctctcttcagccgctttattttcttcttccgtatgtatagtatagtattactggtgtgtggtactgttcttgtcattatacgcacccccacactgctccaccggcgcggcggtgctggcatggcggcatgcatgcatgcaggtactgcaccaactactacggcgacagcgcacccgcctcggctggctcggacgacatgtgcgactggtgcctgagcgacgtggccggcgggaaggcgagcaggtggtcgtcgtccttgtctccggccgggaagcagcagcacgccagcaccggccggaacc

SEQ ID NO: 7414 - DNA, 208 bp, Zea mays
agtctgtataattcgggagaatttgagggtagctcagaccagacaaaagagctatgtggataatagaagaagaccacttgaacttgaggaaggagattatgtgtacctcaaggtgtcaccacttcgtggaatgaggagatttaaagtcaagggcaaattgtcccctcactttattggactattctgagtttttaggcgagttgcagag

SEQ ID NO: 7415 - DNA, 1500 bp, Zea mays
tttatatatcactatataatccatcagtttaatctttctaaaactcagccaaccaaatcactccacactcataactttcactaaatccaccaaacaaattacactgaaacttaacacactatcaaaaccaacggttcatatcgctagataaacctctctcccttacacacttaggtgttgtttggttccatgcgaggagcggtaatgtcaatgggagccgttgtcgatgctatgcattgcatattaacaactaacacgctttgtttggtggtcggttgggaacaaaggttacaatgagagatgggacgggatcgaataacttcgggtgggtcgcggtaacaagattgtactactctgtatctgatagcgccgcgttccgctgcaggctcggtcaaccaaacgatatgtaaccggaccgggtcacaccgtaaatcgatcgcgggggtaaataacgcaaacccaacatcaccttaaatccaatgaataatattatttagatcattcatcctcctcctccacccacgaccacgacgtcccctcccctcactcgtttcgtcgccgttgtcaactcatcctcttctttccttgggatcatagcattaacatgagctatatatattagttagcagtaattgttgatccaaaagtagaggctccactaaaagccctctgctcagtaaaatattacttcattcattttgaactataataagaatatttaaattttctgtggtgtaagtcactacaggttcaggttcgtcggattcattttgatgaatgtcatgaattcactttcactatgtgtcaagtcacctctcactaccttccacgaacgcgtggtcggcgtgttggcaagcccgctcgggaggagcctctgcccctgcattcaaggcctgctcgacgcaggtccctatcgggttttgcttgtctgtcctagcttgtatttgcatacgtggtgtaggagtatgagttgtttgtggttaagttcgaatagatacgcggctagcaactcagttgctgcagtagctgtagcctgtagcgccatagacacgtcacacaagcggtcaaaagacccaggacacgtcaggctcagtccctccacgtcctcactcctacgtggaagccacccaggggcccaccccgtggatcacgcacctgatcccgcgtgccctggcccacgcggtgggcggacggccccggccccgccagcgtggcggaaacggacggcatcggtggatgccggctggcccccagacttatcgacaaacaaacggccggggccgcgacacgtcgccccctggatgcgttcttatccccacgatgcatccgacgaccgctgccccattctccactccgctctctcaaactccccggctccccgctctcccccgcccgtccagctcgtgctccgcctccgctgctctgccctcttcctcctctgcgtttctcctcagagctgtttgacttgaccggacagtgctgttcggtggctcggccgcg

SEQ ID NO: 7416 - DNA, 1500 bp, Zea mays
ggtcagtacttgccgaaggtggtcgaaaagggttcaccggaggtgagcaccaatgttggggacttgttctcaaatgctatgagttaagaacaaggcaacacaaaatgttaaatgttaatgtccttcgcccttcgaagcattatttcccttgggatacaatgattttcggacgaaggttatgaaggacaaaccttcatcagcacaacatataatatgaagaaggaatcatatgcagtataaaagataacataaacaattatgtattatcatcaactcatttctattttattattatggaaaaatagaaatgatatcaaattacaaatataccttcggcttggaagaaggtaaaagtacaagcgtgacgcaaaagcaaatgccaagtcagcgtgaatagtatgggaacaatgttcacctatttataggcacgggacgcagcccatgtaaaattacactcatgccctttacatttgctaatgactctatagtaatccatcgaggtctgaatagccctttcccttttaagtcggttcccccttttctgatgtcacaccgaaggtcccctgagcatagcttcggctctgcgccaaccttcgcatccttcgtacttcgtcatattgtggttctgaaccgaatccgaaggtacctgttcatatattatactccagaaatgttgttaaatcatgtttttgaggaccttcggaagacgaaggctcccaacagtagcccctcgcaaggttaatttgtttagaataacgaattcagattgcgatatggacgaaggtcctaagccgaaggtcctaacgaattcagaatagcaacagtcaatgacagccagggccctccaacttggagcgcgctgggcgtataaataggaactcaccccgagcacatttgatacgcttactttgctttgcttgatttcttagctcttgctttccaatagttgctttgtttcttaagttttctgagcttctgagcttcggattcaaggacatattttcatcagttccgaagataaaatgtctcaagacaagaaaacagttgctgaagcgaagctgaccgaagaggagaagcttcttgaggaaaaaactgctggattcatcgagtcagttgcaacgaccaacacagaaaagattacaaaagaaattctagaaggcttatctgaagataccgatgacagcgatagttatgatgcggaaagtggggtcgaagactccgaagatcggccctagaggccaagtcacgcagtcttcgggaaatcgactttcagacaaagtcatcttgataacatgagaggaaggtattttcgagacatatctattgtgagggctgacaatggagacaggactgttcctgttcctgaagagaatgaagtcgtgatctaacgaagctttttcaaagctaggcttcgtttccccttaagcaaatttgtggttgaagttttaaagatataccccgattttccttcaccaaattactcccgaagcaatcataaga

SEQ ID NO: 7417 - DNA, 1500 bp, Zea mays
ctgaggagaatattccctaattggagccatttcgttctagttactttataaccaaataacaacaaaactgggaggacgactccgttgtatttggctcttcaaccgaacactaccttaaaatatatggtttaactaaaaaaaaacagcttcaacattgttccatttcataaaatattaatgccctatctttgttttctacatcattctcaatattttatttcttaataacataaattactttctaaaatccatgatttagagtttaactattagagctaaatttgcctaaacattttaaatgatgtagtattttaatatttaagatactattttaagacacattgttggagatactctaatatcattcttttttttttgaaatttagatcgttctattttccctgtcctagtagtacttttattatatcatatagtgggattgattttttatgaatctgtgtcacattatgctgcaggccctacgtatcatgtttaaattatggtyccttttggtatgactctttgaacggctctaggtctgactagttttttatcaaaagccctccaaaaatgagagctgtttttttatgttgggagccatatcaccaataaggcaataatatggcttcggctcctacattttaatcacacgttttttaagataacataagagaaactgtttgctaaacaaattgcaaaatagctagccgaagctccgagtcggtcaatctatttccaccagtccccatccagtacaggccagcactgccgctgccgtgtcgccaccggcccccggctggctctccagcgactccgtcggcggcttgccttcccgcgccgcgccgggcccggatcgctcgccctttccgactgtcctgctcaacgccgccaccagcacgtcctttcccgcgccggaggtcccgctcgcctgccacagcggtgcggcgcaagctcccccaagcgtttctcaagtgacgagaagaagaaagagggggagaaggaggttggcgtcagtgggtcccgcggaccaatcagctagagagctgagtgatgtctcgcaagcgatgaggtctttctttcaccctttcctctctcctgcattggattggaaaccggctgaggacgccgtagcgattagggagtgctagtattgtacgtgtaatggttggagagtgcttgacagcctcatgagatcggatcggaggccatcattccacgcactggtgatgaaaagctcgcttggtgcccctagctagctagtggcgaagcaaggaagctagccagccaagatcctgcttgtgagaaaaaaaagggagtagatccagtaattttaaggttggtgtgcttccttcttgataatggaaaagttctagctttagaatttagaattttgtagtatctttcttccttaatgagttcataactcacttgcccctgacctgatctgatgcgccttgatccaatgatgtcgcagaatctggtcaacatacctacggcaag

SEQ ID NO: 7418 - DNA, 1500 bp, Zea mays
ttgacgtagagtcgaagagaagcggaggatttggggattggaagactaacctagaactagactagaactactcctaagaataaatataaattgttttgattgaaggttcgattgattgattaaatcggtcgtattcttctgcttttatagaggaggggggctggacccgttaccaacaaaatttcgagttaatcccgtgattctcgctaacaaacacagtaagaaactcggaaccctaatctgttctgcgcgcacgtggaccgtcaagcctcagggctgaaccgtccggtactctttttggtgctctacagacacgctttccatattttatgtgctatgtttgggccggctcaatagaccgtgggctggtgcggcccagacacgggcctagcatccagcattgtgttgtgcctgcacgcgggtaactgtgttgtgtctgaccgtggacatgtatagtagcaaatggaataacacaggaatgagtggtgggtgggttgggggcactaattttgactctagcatgcaacgacgtggatctcaataattttgactgcgggaagcgcgagcggcgcggcggccggtcgatcggtccaacactcttcaacccgctcgccgccgttggtggtggtggcggcgtagaccgtggacgcatgcatagcatcgaggatgcagagggaatccacgtacgccaaacaatggggcggcggcggcggcgggtgcgtggctctcatgcagcggcggcgcgcaccaccacatgcaccaccctccgccccactgggtgaagggcatcccggcatgtgtcggtgagtcggtcgctcgagatagccaccctcagcttcagaatctgtcgtataggagtatgtatgtatataaaacgagataaaatctgcatcgaattttctcattccacacccagaacgagaagagaggaggggattttaaaactcgaattccggaagaaaaaaaaggacttttagatcctctcgatctccatgcatgtaatcttccaccattttgtttgtctgttcgttcgttattgtagctactgcgtgcatggtgaatgccaatattcttcctctgctgcctctctctcatcatgcagagcagatgcagactccatcgatctccattccatccaaccccaccagcagctacagcaccactgctttctctctatctctctcaatctccttcgaattcacatgcctacagtggttcggcacacacactgctgtccggcgtctccctccctccctccctccatccttcccttctctatataatcacgactagtccaacccccaaaccaccaacacaacaacatctcctccattctcctagctccagcaacgaacaggcagcttctccggcccccctcctcctcattcttctatcatagctagctagctagctagcttcacatcagcagctacatactcacactcaccgatagatacagacctcagagcaccacactcctagctcagagcacgcatccgc

SEQ ID NO: 7419 - DNA, 1377 bp, Zea mays
agttggttgttaaccgatctgacccgaaaaggggacatgacaacaacttccttaaaaaaaagcttcttcttttttcttattattatcattggatcaatcgaaaaggtttggctttccagcaggaacatagctctgagcttgtctccgatatcatacattatcatatctatatctggacacctgatcacaacttaaggcccgggagggccatcctggtgacaggcaaaacctgaagcgagcgtgtatccgcgaggacagagctagaaaagacacggcgacactagttttactcagttagtaacagtaggtcaacgactgatcagagacgctgccagccagccagccagccatgttgcagtatggcctagcctaacgactttgtggccgcagcattcagaaacggccggtgaggacgaaggagagtaagcgaattacctgctttcgcgcgggcgcggggcgtccagcggtgtcgagcgctgctacgcgaggttgctggtgctgctggtggtggctaggcttcggtcgggggcgacgtttgcggcggcggctgcgtcactgtggtggtggtggctatttgtaggagggagggggaggcggaggaggaggaggagcaggagtaggcgaagcggggggggccagggcagggagagggtggccggtggtggtgatggtgtgggttcgtccgttcgctcgttcatttgaacggggttcgctcggcggtagctttcccttttctggtccggcgtggggcccccggtcgtctcgtcccggtttccttttccgcatgggcccctctcggcccgcctgcctttcgcttccgtggcggtgcgcggtacggacaccgcggttgttgttggttcgaacgtttcgggcgccaccgcaccgcaccgatcgtcgtcgaccgacccagcacctgctgctccccttcctttttccttcttcctgcctgctgtgctgctgcggtggtcgtcctctcctcctggcagtggcaggacagccagaggattttctctcttctttttttccccatttcctctcatttctcgccttcttttcctctgtacggtactggtggtttttaagatagaggaggattatggatgagccttgaggctttcatccgacgattggtcaatggaacccgataaatatagtgtggaacaaacaaatcgatatagaacccgattaagctgatgtagatactatttttcaccggtacagtctcaagcacctcacagaaaaagacccattggaagggacacttgagttgtcctaagactagtgaagtcaccgagaatgccgacaaatctcatagaaagatttgacgaacaataagatagagaggggaaaaagataaaaaagatagtagacacattt

SEQ ID NO: 7420 - DNA, 72 bp, Zea mays
tttcatgtagacactggcttagcattctaggatttagctgactgctcttctttgaattgaaattgatacttg

SEQ ID NO: 7421 - DNA, 486 bp, Zea mays
tgtaagaacttgtgtacaagcatatttcagtacaataataatggtgtttttttcaaacaaagaaattgcatctaacaaatagtcactgagttgaaaagcatcatcataactcatttacaccaacatgcctgtctgtgacatctgtgctgagttggttaggcggcaccgtagcctatgtgagaacgaccatgattaggagcaggccttagacgtgttttgacatgggatagactgtagatgtgaggattttttaactctagcctaaaattcgctcccattggaagttgaacgatggacctaaggagtgctaatcaaaccacctaaccaattcagctatctcagcttgaggccctttcccttctttggtaaaatatatatttatattttataattgcttcttagatgaatagtttgaacattctgataatcaacagtgactccaacacctgaaatattatagctctaacctcaataatataatataat

SEQ ID NO: 7422 - DNA, 1500 bp, Zea mays
tacactagagctagtcagctagacaggcatgccgcagtctgccaaaccctagttgcttgatgacgaggtcctatatatatgcgcatgcatgttgcggccaaaactggtcgagttgtttgacgacaacggaaaatatcaacaggccgggcatcttattttcttaattttgctttcggccgcgaattcaagaaagtgtttcgtgcacctctcaaattctacaaaggtcattattattctagatggcaactacgtcgtgtcctgtaacaaatcaaaaattaaatctctctcttaattaagattcccatttttcaggaacaacaaaaatcaaactattttttcttttgtaaagttaataacgtacatgttgatttccaggagtcgctgaagtttttcacttggcatatttatcatgcgaatatgatatcataaatcataagcaataataaacacgtagcgcatctaaagaagagttgcccagctagcatatattatagcctcactgcacgtttgccacaatgccaaacgtacatggatggaataccatgcgccattgtgcacgcagatccccattatgcatgttcgatctgatacaagacatcacatacttaattaactaatatactctctttgctccaaattataagtcgcttaagtaattctgaaatatattgcttttactatgtctaggtatactgtatatttaaatgcatatatagcaaaaactagaaaagtcaaagcgtcttacaattttggaacgaaggaagaacatgttataaggcctcatcaaggaccagcatggaaaatatatatgtgtgatggctaatctacaagccagctcggtatatctcatgtaaagaagccatcacccccatagcaagcttgcattccaattagcaaggttaattttcagaattgcaaacaatagatctagagaatgtgggtagagctgacttaaagcatatgaattacatcgtttggcttaggccccgtttcaatctcgcgggataaactttagcttcctactaaactttagctatatgaattgaagtgctaaagtttaactttaattactaaccattagctctcttgtttagattacaaatagctaaaagtaacttaaaataagctgctaaagtttatgtcgcgagattggaatagagcctaagacatcatgactgctccaattgctaatttgctattgctaaacctctaataactgcgtacacacgcacggcgacacggccgccgcgacaccgcgtccgctgcgtgagcaaatacagcgggcagttggtgaaaaatttgctatttgatcaccgtggacgtggagcctgcagtggactggacagtggacacccggctactgctactctgcagtctgcaccctccaagaaggcaaagaaaggaagaacgaagctcaccccgcccaccctgcccatcagcctcatcacttacccggtgggcactggaggattagggtttggttgaagagggagcaacgaa

SEQ ID NO: 7423 - DNA, 411 bp, Zea mays
ggtcgcagttagggttgtggcctggccgccgtatcagtgccagtggaacaggctcccccatctagagccgtctcttcccctgtatttatgactcttggtcctctcacatgacactaacaagatcagcagcaaacggtctactcttgcctctccttctctctctcctccgatcctctcactttttcgagcttgtgcataaaaggagatcgagcaagcaaaattttcctcacttttcgcatacttcctcagctcccaccccttcttctatgatcagattcatcagaggctatatttagcacacgattgagacagcaagtacgtgcataggccgcagctacagcctgcgtatattcctgtgccagccgtgcactacggcactttcttccctgcgcgcggcggcggcggccacca

SEQ ID NO: 7424 - DNA, 1208 bp, Zea mays
agtataagacggtacaaattaaagccaagcgaacagactagtcttactaaaaaattgtgagtcatcgtttattgttgtgatttgttttttatcacttaaggttgtttcagcaattgagcatgatttaaaattttatacttttcaataaatatcgtctgatcgcttgatttcgctcttcaacctattgggtccagtagttcagattcaaatctcgctggtggcaatggtgggtgttgattgttgaactgctgatgcagcaacgagcgtggtgcagcccccacctgccacgcaaaccaaccggctccctccaacggctcagctagataggccccagctgtcatagagccacacctcgtacgtactcccagcacaatgatttcaaactagtcgggctcagttctcaccatctcgcctccgcagtccacacagagctctgtcgaatcgctagccgggtcacccaatcgcgtgaggccacgccagtggccacactgtttactgttccaaatcgtagtagactagtagagcgacagcttttctcgtacggagacaacccaaccactccgctataccacccgtcacaaccgtccatcgcacgcatcaagatccgcgcggcgtgtgccctctcgtgagtcgcatgccgcgtcgaccagaatttgaaaatgccgtgtttaaaaagagccgttgcccgtttccaaaccacagccaggtggggcccagtccagctcctggcccgcgcctcagcctcccgtgccgcttggatcgaacggcagaacggggcccaccggctccccaagttcgaaagcaccaattctagcgtgcgtttttaatgtaccactctcggatcgactctcccagcaggcagcataaatgtccggcctttagcggcgtccccgatccgatgctcccggccgcctccgcccctcctctccgccgcctccgcttcgtccgcgctgcgcggctgcctcgagctcgagaccgcgtcggtgagcttcacgagtagacgaatgctttcgattcgagggcgccgtaccctgccattaaccttaagattcatgagttcatagtctgttccgctcaggtatattttcttgttcgatctgaagcaggctgtataggtgattttctcttccttttggggggatgctgcggagcgaacgctgaggagcgacgacgagttttgattcaggtgtagagggtttctagaatcg

SEQ ID NO: 7425 - DNA, 134 bp, Zea mays
ggtaatttgatttttaggttgatttgctttagttccttgggtcagttgctttaccattttattacctgacctcactgtcatgtagctaaagagttgaagtaactgatacgatgatttttgatggcttgagcagg

SEQ ID NO: 7426 - DNA, 1420 bp, Zea mays
gcacatgctttgatcaacatatgattctggcataatagttgatttcatgatgagagggaaaaggatccgtggccatgctcaaactcaatgcgtagggggggtaaaattcttctgtcaccttcattcataggccatgtacatttgcgtgctctttatttcaccataaagataaacagtgctgcaagaatatcgcctccttattgccttcattatttttggaaattgtgtgtggacttgaacttaggacaattagctataaatatctctcgactattactagacatgcttttaggaagtttggtcacgatcaaaaattatgtagatgtaccattactcacaggcaatggcggacgcagaacagaaatttatggagggccgaaaaatctgcaggacgaaatcaagcaagatcgtaaaaaactagtgttgcataggattcaagtttcatatcaatatataagacaaatttaaagaagaaaactatataaacaaaagaagcaaataaacctctaaatttttgctgacagaataaaaaccatgtgtaacttgccaaatatcgatgtcattgaagggcgggggcgccaggaaaggggccgcgtcaaacgatgtctctggctaagagctagtacaggagttgggaggactggaccgaaccgatgaagagacctaggacataactgttttagcccactcacatattcaattttttctacacataatagtaaatgacatttgtataaaaggtcataagaatttgagcggcggcatggccctttttgcctcccctcttggtccacccctgctcgcaggctccaaaccttcatagaccctggttagctctctgcaccacctctgtcattctcttgcacctctaagtgtaatattctataaacaaaaccataaccataaatgcataatggtatgtcatatggacgaccaaatactgtagatgcatatagctcatcraggcgattttgattgattgttcacttattcctcttggattccggataagctttttgagtgctaggtgatatgagctgtctttttctccattcctcctggcagtcaccgccctactttctcccatgcatctagagtcgcacctcctctaacttcctccttgtggtcatgtatcctcccccctctccctctttcctccccaccacaagaaaccctagccaccctctatcccccaccattgctacctttggcattgcactcttcctctccctcgcccactcttgcacgatggcacctatatctttgcyctacagtgacctccctgcaatggaactctcaatccaagggattgaagtacaagagaaggaaggattcatgataaaatcgattgtccgttgtaatctcgacactaggcatagtttaaaatctcaaatggatcggttgagaatttgcyaatctc

SEQ ID NO: 7427 - DNA, 1500 bp, Zea mays
ctatggacgtggagagagctgggcgcagcggacgcggattcctcgatctccttccatggagagcatgggcgaggaccgagagtcggggcggcgatttggggcgaggccgcgggattgcgggagagagagttgggcgaggagagccgggcgggagagagagtgagggggctggttcgcggacgcgacgctgggcacgaggggagcagaggaggtgatcgtggagcagagaggaggatggcacggcgggacacgacgggatgatggagctaggggcgaagacacgacgacagtcatgggatgggatctggggtcgcggacgggagcgtgtggagggggctcgcggacgggggcgggggcatatggtgaagccrtggtggacgcccacactacgtacatatggtatagtagagatataacgagatatagaggatgttattggarataaatgagatatagagaataaaatattttagagacatctataaaggagagatataaaaaaaagatggttggagataattttaggtcctattgggaacctctagacctagtagttaaccatctaacaaatggttagctgggttgagccagctaataaactaaatgttagctgtgagttggctaataattagttgggaatgtatgaaacctatacaataaactattagctctataggttccaaacagtaactagtccactctagcagtgcatactaaagaaaaataaaacaaaacctaggaaagaaagacgaatgtgccaggcctacggtacgtgaaaaaaccaaagattagtcaatcggcggcaggcccatcattccatcggtacctgctctgtcctatatcttrttacctaggttcagtctagcaacgaaaattggggaatgcggcctattttggtactgggcttcaaagtccatgatggcccaagaaacttcaggaccttagtccagacgggccataaaggcatgcggtccgttattaacgagccgcgactcactcactcatgccagtaagccagtccatgccggttgcttcgccttggccatggaggataacacaagggttaatggtgtagagtaactcctggacgcgctggttaaagctcagcatcagtaacggctgtcacagctagctccgcgtcactaatgcacgccatatgcatgaccccggtccaacggtaacatcaccaggccggccctcgtgtataaatacacccatctcggctagctcctccgatccacagagagtcgtcctgcacacaccgtaccggcggccgcctcagatttggacgacgccggcagggttcgtcatcgatctctagactctactactatatatatagcaacactgcacgacgctagattgctagctagataggcgatagatattatatatctcgctagctattggcagtggcactggtttgtggtcactagctagtatatagtaggacccacagcgatccatcggcgggatcgggtccgtgttcttggtgcaagg

SEQ ID NO: 7428 - DNA, 356 bp, Zea mays
acctattttagattatataatccatctaataatccacatcgtttgtttaactctctaatcttatttaagttaaattatataatctggaggataaataaataagccttctataaattgcaaaacacagtccctggctccctgcaaccaaacaccccaggaaactgctcccctgacaccggacagttccgtactcgcccgccgacccaaccctctatcctcgtcgtcttccacctcacgccctctttttactctccagttttttttttctctgctttgccgtacgttggtgcgcctctcccctcctcagctcctctccacggctccaacccacctcggcatygacgccgatttgttac

SEQ ID NO: 7429 - DNA, 100 bp, Zea mays
tcaggtcgccctcctcctccgacctcgtcccgcagcaacgcagcagcagcgtcagcggtaccgccgggtgcggctcctcctccctcctagccattcggcc

SEQ ID NO: 7430 - DNA, 750 bp, Zea mays
catcattggcagaactaacaatattttttctctatctaattctatccaatctagattaaaataaaattgagtagaaaagagagtgcaagcaaagtatcaaatggagtacaaagaacaacagcttgagaaaaagcttgaaagagatgtgacgatgacggctaggccgcagctagaggaaaaagctaaaagatgtgacgatgacggctaggccggtgatgtgcgtgcgacccatgccgttgtgcatctcatctacttatcctattatctccttcccttctttgttaaagatttgataaataaaaagtattataagtaaaatgtgcaacagatctaaggattctccaacagctactctattttatccatatttcaaactttattgatgtatatgttaaaatgttcatacaatatttgatatatatgttttatatatgtatctagttttatctttatttatttaaatgtacacataaaaagcaaaagctaaaacgaccagtactattttagtacagagacagtataattttttatgtaatgcatttcttgaggaaactaatttctctgctgcaatggcattggaagaagggcacagttagcaatcaaagcggtgggcctccacgcctccatgtcccatgacgtcgctactcttccgggatggaccaataacattttatatctggacgccccttatcgccctcgttatttacatctctgccaccctcctctccgccgtcgccgccgccgccgggg

SEQ ID NO: 7431 - DNA, 541 bp, Zea mays
tgctgttttctataaatttagtcagaccaataaaagtttaaattaggatatctttaaaggttgatttattgggggaaaaacacatactagatctaccttgattctatctgaaagaaatcaatgttgattttcatgcccccctggaaataaatgaatcttgattcaaatcccacgagtttgcatccgcgtcaaatgggctgcgcgtctccgtcgtttcttccgagcacacggcagcccaccggatcggtcgatctagagatggtgtttgtttgtcgcagtcgcaaccgaatcacactgctcccatataaatagaatggcgccggcgaccggcgttgcccacttcacattcacaagaccggaggagcccactcctgcatgtaactcagatactccacccgagagtccgcaccaactcacatcacacctcaccttccactccagaagaagaagccagaccggaatcccgagagccctgcccctgctccctcggttcctcctccgttgggcgtttggccgccgggggtggtgggccgagaccgag

SEQ ID NO: 7432 - DNA, 1108 bp, Zea mays
tacccgagtgcggaaacgaacgtaataaatatatttgaaaacagcaaaaacaataagacaacgacggttatggaagcatgccttctgtgcaagcgtataagcagacaatttgatccattagatcgtgatctaactgtaagtcatccattagatcgtgatctaactgtaagtcacatttaacacttaaactcttccaccactagtttaataatctttataaaaaccctctaacaaactataattatatttatagttgaatcacgatttaatgaattagataatttatttatatgtttacacagaaggactagaaggaccagtcgttgccgaacaacaaacccccgagtggaacacacaaaagcgccccaccaccgcggaccattcctttcctttgtatctctatctatccctcctcggctcctcgccctttcccctcttgcccgagtcgctagcctccctgcccctgcccctgccccgcctcctcccgtggaccacttcctccaccttcgcttccatagcaggctagcagctgagcgaggtcaactcttccgccggcggagagagagggagggagcggggaagagacgggagggtctccgcgcacctgccatcagccaccacccgatacccaggtcttgtcgtcccgcgcagatctgctgctgcccttgaggtataccatcgatttgtttgaaccgtacccggtagatccggtatgcttcggcgagctgagggcagttcggttgtttagttgctagcttcgcggctagacctgctctaagcaccggctagtatatctaccagccaccctatatttggtagattcacaaaatggagtgatatccggtctgccggctccgcagatctctcgaactccgttgattctttgattcctttccatagaacctgcgaaattgcggggatctgcgtgtgctaaagcacctaactgattagatactattaccgagagtgaacatcgctgattttttttactaatctctagaaactcatcatatggttcctttttgttcagatctaaatcaaagcttccgctccggttgttgtcggttggtcggtacctgggcggcggcggcacgggaggacagcgaac

SEQ ID NO: 7433 - DNA, 1500 bp, Zea mays
attaaataaatgagttgtattatatggagagagcgtatgggatggaaccttttaagaaaaaacagtaaaatatattaaaaagtatagataaaagaagatatatatggggaatggttggagagagcatgagggttgttcgtttcaaattaaaaccagctgtttggaatattgcggctgcaatcgacaaaaactctgtagaaaccgatacgaattaaatccaaacgaacatgcttatgctctgtttggttcatttagtcactagactaaagtatctcgtttggttccggtgactaaatcggactaaagagaattaattgatgcgaataatggttgtattacccctattaattagtaaatgtttgttccaaaaagaaagtggagaggacaaataagacaaaaatcctactctagtcccttgtagtcaccaagaagtaaagtttagtcgttccactttagtcatcatgtttgcttctttagggactaaaattaactagattttagttagccaaaccaaacagggccttagcagcaggagaggagatggatggaggaagcaacactgcaggtatccaggaaggttcagcagaagaggtaccccacggaggcaggtagcagaggtcgtggcaaatgatatgatggcgcctaacctaacccaacgactctctctcctttcctctgtcggccggtcaaaccggtctcggatgaaaacagtcgtcggatcggacgattcggcaaatccatcgtttaccctatccagcagtggtcaatgcctttctttcttttttttagtttgtcagctcagctgctgtatagtagcagcagcagcatatactagtttgggcagggtagagggtggtatactggtatcatgtagcgccaaaattaagggtctatttggttcatagataaaagtgtcacactttatctaaaattaatcgttctaattgaataattaattttagacagaaaagttagacaaagtgtgtcaagttagttagcgaaccaaacatgtcttaaatatgcaggccgatctcttgccatcttcacagcatcaagtaacaggatcgatttcgctgatgccagattggtacagagatcatctggatcaagattgaccatgatatcatgccaatctcctctccctcacagaagctaatttctttttttttttttgttgacagtgagtatcacttgttgtgtgtctctctctgtctgagtctctgccaccaaacgtttcttttttagctcaccatacaattgtgaccccgcttgctatataaacagtcaatcatgcattcttggcagcaaagccaaaaacacaaagcccggaccggacgggaagggaggcccaaccatccatctgtccagccgcacctcccagcagcagccatataagctactccctactagctacgaggggatacgagaggcgaggagagacgccgccggactgccgtgcccagcgcccgtgaccatcccatcccatccggtcggtcgtac

SEQ ID NO: 7434 - DNA, 1500 bp, Zea mays
cttgtcgtcgtcggtggagcgccgtcgtagtcgaccatgagcgccggcggcgccgcaacagcgtttggtggaggagcagcagccgagctcgacgcgtcgtcgtccgacgaggagtcgtcggtggaggtggacttgtggacggccgtccgcacgggcttgaggccctcggtgaagatccggatcgcctcctcctycgtcttggtgctcacccaaccggcacaccaggtacggacgacttccaactatagatgtccaaacgggcggcacggcccggcccagcccgagcccgactcggcccggcccgtttgagcccggcacggttaggcccggccacttaaccgtgccgtgccgtgccgcccgacgggcccaaacatcttcccgagcacggcacggtgtaggcccgatcgtgccgggccggcccgaatagcacggcctatttagtggctcgtgccagcccgagcccgcaaatgcgtcctgtcagtccgggtgtgcgacgagccgacgagcatgagcaacgtccacgacagcgcagcgccgtggtctcgtgcccgccgaagaagaaggtcttgtcccgtccaccagctccttcgtggtgagccgccggtcggtggcctcctccgtcccggccagcagcagcgacaggaggtccttcccctggcccgacgaggcggttggacaggagccgctttggtctccttgcgcagctgctccctgaagctagtacatgcgccgccgcatgcatgtaggaacgggccagcgcttccccagcatggctcccgcatgcacgtataggaacggaccgaacgactccccagcgcttccccagcacggctcctgcatgcacgtacagccgtacaggaacggctccgtgcccagacgcgccgccgcagggaagagagagccagccgccaggagcaagagggactgagggaggaagagtgggttaggttttgccggtgggtgttaatgttatatgcgaacaactgtgactggggttgggccgtcggggacttgtggccttgtgccttgcggttaaaataaatgggtcgggtaaaaggcccggcatataccgtgccatgctcgggccagcccaacgggctcaaatgtctgtcaggcccggcacgctatccgggccaggctgagcccgggctcgcttcaacccgtgctgtgccgtgctcgtgtcgtgctaaaataatgtgcttcgtgctgggctaacaggccacgtgcttgacatctatagccgtatctatttcagactggctcagccaaccggccggtccagtccatttcctactgacgagtcttgaagccgtgtgccgtgaagcgaccggccagccgatctgatatctgactgacccgcgccgcctgtcgccgtctgcccccacccttcccctccaaatccaacagcgggagcaaagccaaaccaaaccagcttactgctccgctccgctttgttgccaatttccgctccaagcgtcgcggtcgtgaagtctcgttgcg

SEQ ID NO: 7435 - DNA, 254 bp, Zea mays
ttaggtttacacgacatatagagtttggagtttcagtgaatttaagtcatatatacgatactatgatacgttttatggaggttgagttgagatttgtacattatagcaacactgttttctggacactatcgtgctgtgctagtttgggcgtacaattcttttgttctcttgtatcctcatatactcaatagaatcatattgtaaagactttaatttcctgttagtgattattaataagcacggcatgttggcat

SEQ ID NO: 7436 - DNA, 960 bp, Zea mays
ggtcgtactacttttatatttatatggggaggtctgaattcgttcttaggcgagatccaacagactctcacggatagattaggataatcacgcgcggataaatactcccgaccgagttaatcaacgtgattggttgccggcgtctagagcgtgtggctcgcgctagcccaaatcggtagaacacatctccgtttcttctccacgcatatagacaggtggatgaaaaaatacctccgctgtctattgcatgctagaatcatttcatgcacgtagtcaacgctcgcggtcaggctggatagagacagcctgccaaccaatcaaatgaaatctgatctagatcgtccaggttatcccacgcaccgttaaggctacatgcctacatatcaaatatggtgctcagcagaaataaaaagatttcaaactgattcatcaaacaaaccgctcttgtatacatgcttcagcgaaataaaacttgaggaaacaaagaacttgattacagcacagtgaaatttggattccatttttagtttcctactccaccgtcacgatgataccaaacttctctttgctgccgcttctgcttctgcttctccaacctcgcacgcgacgaccacgattaacacggtgaacatggtccccacccgcctctatctgcctcatttccacgtggtccccacacgtcgggaggcccatacacgacggcccgggcctccaggagattccagaatgatcactgccatgtgggccgtacaccggcccaggccccgcgagtcagtgacgtacccgtgacgcggccctccgagtcccaaacccctgctgcaagaaagaagctataaggaaagctaatccccctcgtcgagtgctccgcatctcgcattctcgccggtgctgctgcaattaacgccgcccccggccaaccacccgaaacctacctccgccgccgttgtcgccaccgtcaac

SEQ ID NO: 7437 - DNA, 1500 bp, Zea mays
tctcaaattcttattcatatacctttgactatttgcaaaagaatttaaaaaaaaattccaaaacattgcaaaacaaaacaagtggtgcaagcgtggtccaaaattttaataagaagaaagccatccatgcatatctagtaaaaataattattggtttcattccaaagaaaccctttgcacttacattatgcaaactagttcaattttgcacttttatatttgttttggtttgtgttggcatcaatcaccaaaaagggggagattgaaagggaaataggcttacacctttttctatatgaattttggtggttgaattgcccaacacaaattaattggactaactagtttgctctagaatataagttttacaggtgccaaaggttcacaacaaaccaataaaaagaccaagaaagggttcaaacaaagagagcaaaagacaaccgaagtatgccctggtctggcgcaccggactgtccggtgtgccaccggacagtgtccggtgcaccagggaacccaactccaaactgctcaccttcgggaattctaggagccgctccgctataattcaccggactgtccggtgtagcaccagactgtccgatgctccagcagaacaacggctacttcgcgccaacggtcgtctgcgagagcagttaatgcgctacagtgcgcgcagaagtcagagcagagccagaaggcacaccggacagtgaacagtgactgtccggtgcaccaccagactgtccggtggcccagctatcagaagctccatccgtcagaacccaacggccgggtgacgtggctggcgcaccggacagtgtccggtgcgccatgcgacagcagcctccaccaaacggctagtttggtggttggggctataaatacccccaaccacccaccattcattgcatccaagtcttcagccttcacacctcatacaagagctataacattcaatacaagacacaaacaaagagatcaaatcctctcccaagtccggaatcactccaaccaaattagtgactagagagagagacatttgtgttcatttgagctcttgcgcttggattgcttttcttcttcctctatttcttgtgctcaattcacttgtaatcaaaacaagagacaccaagttgtggtggtccttgtagtggactcagtgtcccatttgattgaagagaaaggctcactcgatctaagtgaccgtttgagagagggaaagggttgaaagagacccgatctttgtgaccacctcaacggggagtaggtttgcaagaaccgaacctcggtaaaacaaatcaccgtgtcatccgctcttatttgcttgtgatttgttttcaccctctctttcggactcgtttatatttctaacgctaaccccggcttgtagttgtgcttaaagtttgtaaatttcagattcgccctattcaccccccctctaggcgactttcaattggtatcagagtccggtacttcattacagcctaaccgcttgaagtg

SEQ ID NO: 7438 - DNA, 397 bp, Zea mays
gtcggtgtgctaaatcgatttggagagtagcgatttgtaaataaaatgtgtaagtggacggcttttaatccttggtcgtacactcgtactccggcccggcccggtccggcctaaacacgcattcttccttctcccaacgacggaagaaacttcctgcctggatatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgagg

SEQ ID NO: 7439 - DNA, 333 bp, Zea mays
ggtgaagcgtcgcctgctttgcctgccaaaggtgccgcctgtcctgccgcagagttaatgcgacgggacgagtggttcgcggggcagacgttgtgcgtgcgcgagccgttcgaggaacgggcgtttcaccttcgagttttgaatttcgcggcgggttcgggcgaagtgttgaacgggtctcgcctgggcctttatatattcggaagagggaccggtgacggttctttactccgctgctcgcctcccgcttaggtttctgcaacccgagggaaatagccagagaaagaaagtcgtgcacctcgtccgctccaccgccacctccttcgcttggtg

SEQ ID NO: 7440 - DNA, 1279 bp, Zea mays
tttttttagctgacatattccctttctattctacctacaattctttacctgcttattctacattttcattctcagtatgggataagtattgaactgaagtagaatctggataagggataagtagaataagatcatggggatagggacttgagtatgggatagtggacatctgatagtggacattcatagcagccctcattattttcattctcagtatgggataacgaggataaccctgttgtcgtacattttcataaggggtgccccatgtccttattctactttagttcaatacttatcccatactgatttgcacaaagaacgatgtgtgcacaaaatgatgccaaaaatagcaatttagtacatatatacttatatagaaaataagtttaaagggaaccaaccaaaacctagcctgccatctacttcatataaagtaatatggaattaattggttgagtataagaggtatggattcttttatactatatatgcatggctgaatgactcacacatgggtgctctttatctttgactttatcagatctgaccaaacttgaaccagttgcttactgatttctcccgagcatatgagctgctcgcaacttaccacatggggtgtttcgaccatggtgttgaaacatgtaattcaactaatgttgttggctgaatagtttcataagtaaagcaaaaaaaacaatagtcatgtactaatttcaggacaagaatgattgtagaagtaggatctaggcatatttttcgtagtttggtggtgatcatccaatgaaaaggggggcaagaaatttgggcagggaatacaatcaacatgctccagattattccaacccaagcggtcgaactcggaacatttgacgttctggcaggatcacttgactgtcaatcgagaggcttatccaagcattagccttgcctttcacaggatctttcagactgatggtataggtacactcatttacatttgtgagttctataaattatttcttcatggatgtttggatctactatgctattattttttcttgtattttttctcactggagcgtcatcccagtggttctattttgctgcacatcatctgttatagaattaaaggtcttagtgttatttcccctacatatactaacagttcctataggttgaataaaacgatatatttgccttgcccccctcctcttttgtttgcatacataccatctctgtgtttactactcgatgtagcattggcgtctgtggtaaatctgattgcctgtggtgaact

SEQ ID NO: 7441 - DNA, 568 bp, Zea mays
agcttcccccactgcccccgccccgataacgcgcgtgtagggtggtgccctgtcgatctcgcgccgggagccggctaactacctgccgtttttgtggatttgtgtgcgtgcttgattttggtgcgtgtggtggcgtggagtcgccggcgggggggggggggagctagggttttggtttgggctttcgggatgacgcgccgggtgcggcggcggacgtgcagggaacgggagggtagggtggtgcggggcgcgtggtgtgttgtttcggcgaggccggaaggcgaggacgatgcggcagcggtggaggtggactggagggcgctgccggacgacacggtgctgcagcttttcgcgcggctgaactaccgcgaccgcgccagcatggcctcagcgtgccgggcttggcgagcgctgggctcgtcatcctgcctgtggagcacgctcgacctccgtgcacaccgctacgaccgggaggtggcgtcatcgcttgcctcgcggtgcgggagccttcgtcggttacgcctgcgcggccacgaggcagcagaggccgtcccggccctctgcgcgc

SEQ ID NO: 7442 - DNA, 347 bp, Zea mays
ctgtcacggctgcaacagtagcaacatctctctcaactggattggcacgattgcatatttcttttaataagcttttccttgaaggtcccagtaatattggcacatgtgaagcacctatactcattttacccatcttccttctaatggattccaatcccataattacttcaaggttatgtccagatttcttggagaagccaatgccaggatcaagaaccagcctccacaatggaatcccagataactctgcttctctcacctgtgtgtatagctccaaagcaacttccttgcagacattatcatagtgtacattttgctcgctttgcataattgacggatcttccctc

SEQ ID NO: 7443 - DNA, 324 bp, Zea mays
attcggctttgccgacgagccggaaatagcattggggcccaagtgtttcgttgcctacccagtaccaacaagtccacaaccacaatgctcgggttactaaaaggtcgataaaataccaaaaaaaaacagtcaaagacagtgttcgtcgaaataaactaaagaaaaacaattagtagtaaaactgaaaatacctttaatactacatggcaccttgaacggcatgttgttgtcctttatagatcacgattactgtggtattggggctattcaattattcttccacgaaggtgtgtaagcgtagtgtgtctcttcgatgttctagta

SEQ ID NO: 7444 - DNA, 174 bp, Zea mays
accctatagagaaaccaaagcatagcccgacgcttcataatcataaataaataatatctataattctatatatatagcagtctcttgttgagcagaatcagcagaaaggtgcagcttcaggaggagctctcatggcgtcataagtctctggaaggtccaaattaagattagaag

SEQ ID NO: 7445 - DNA, 119 bp, Zea mays
tcattcatatatttttaccatataaaatggtgcatttggtatgataaattccgcatgctgtaattttaattgaggtactctgatacctgtggcaattccatcttttcttgcgcagctgt

SEQ ID NO: 7446 - DNA, 1076 bp, Zea mays
gatttttttgcattatcacttgaaatgtgaatggccggtctggtgctgtctcactgactgactaagtctactaagtcaccaggtcacgaattcgaaacaatactgaggggtgtttaaatgtactaaarttagtttgttggttataaaattgctagcttactagtagctagcttattaaaaatagttaatacctaaactattagctagtgtgtttgaatgtctatagctaattttagttactaaccattagctttagtgcattaaaaaacccctaaggcttagtttgggtactttagtattgagtttaatccacatgtattgaggttaattggggtgtaatttaaactaatttacacaacaatccacatcaacataagtgaattgggttcaatacttgaataaccaaataaagcctaagtcactggtcatgaattcgaaactatctttctgtatttatggtgggcttgtcttgtgaaggtttgtctcagcttactaatttgttggtttatcctttgctagcccaaaatagagtttcttttcttttcgagatcaaaatgactgaaattgctcggacagtctgactgcttaattcactctgttaaatcttatgaaatatttaaatgtactggagctaatagttagtgactaaaattagttagagacattaaatactctatctaatagttcaaatattaactaatgtatcgtggatcgtcaaaatagacaaaaatagtatttctacgtaaaacactcataaagggtatttccatttaactacccaaacaggatattcgtttttttcttatttttgatgatattgtgatggaacgacgagcctatttcttcgctttttcgccaacaaatcttttagtaaattagttaattacactgacaattttttatctaactaactattacgttcaaacatccttagtctagctcagtcctgccgaacctgactgaacccatctcatctgagggggttatcgggccgaaatttctacatgggcctaaccccagatccaagcttccaaactcatcgccctccccacggccagaaccctagcctcgtcgcc

SEQ ID NO: 7447 - DNA, 342 bp, Zea mays
aatgttttttagttaaaagcaaaactatactggacagtaaagccatcaatacaaagcaacaaatattacgaggggctgtcctatgctcatataattctactttttttaaaaaaaaaaggaactaacactcttttcaaacgagtaaaaaataaattcaaagtatgcagttagttactctgtctcggtagcaaagtgttgaacagtcaaattcctgcttgaattgctctcttgcttggtctgaaaggcatacattttgttgatgaagatggtaacgatttttgtttggtttcagtggacgacgagtacatcatcattgggtccgccaacatcaaccagaggtcc

SEQ ID NO: 7448 - DNA, 638 bp, Zea mays
gcagatgacaatatatatatatatatatattatgagtttattaattattaaaacaaactcagtttgggacggaggaattatataaaagaaggaaaaaaacactcgarcgagatttttgtgtttacccgataacgcacaaaaatttgatacgcggaactataaattgaccgaaacacacacctgctgtcgcgtcccttcctcccccaccttcctctcttctcccctcacccctttctggctttctcctccgccgaggccccgagtcctgccggaattctagatcccggaggcaacttgccacgggctcctccgctccggtcgctgaatcgtactatcgtgctctcgacagaaagcccggccgaaacccagccggaccaagccctgttcgccgtgcgcgcggtgccccgggccagatctgcgagatctgcaccgacaccgctacgcctatcacgaggtacagaggccgagtggagcccctcggatctgctcgctcaggcagtcctctctgacgtattgccgctgatttgctgaaaatgggctgtagcctgtaggtggatgctctcgtgatctctcggagtcccctggactgagcggcatctcggcggaggcgtagcctgcttagctggtggcctgccgag

SEQ ID NO: 7449 - DNA, 1108 bp, Zea mays
gtttgatacacgagaaggggtaacttcttgttttcagtttatttggagcaataatacaccatccaatttgttccaacatccaaccaccggagtcgaatcgatgcttcgattgtcccagaaatcgtggtgggttcagatatgaactgctgaaaggaacgcatatcgtcattgtccttaattactctcatcgtgcattgccaaaaagtctttgggttgactcgaaagacttgtgagctgtgccacggagtggcccatgtatgtatgtatgtggagcgagcggaagcgtccaaagagcctcatcagtcctccttctgacacacagtttatacctgcaagatcgctgattatttctcgacatgccatgctgccacggccttgcgcttgtgcaggttcacatcgcgatagtcaatagtactggaacaagaaatctgcagaaatcctatacctgacttaatttgttgccacatctgggccggggatgcgtgatctaggggattctcagctctccttggcaatggcatgaaaggatctggtggtacactaccctttcatctattcgacccagatcagacgtactacacatggaaactaaactagtactagtaaataatctggtgagaagagaaggtgatatgcgtgagagagaccttgataccagttaataaagctttgcttcgctttgctttgcttgtgggaaaccaatccaacagatacacgacggctagctagtttatcctccacgcgggattgcttgcttaattagcttttttgatgatttatttgcgtggcagagacggtgagcatgcatgcatggccgagggaggggggagcgtattaggaatgggcgcctggcgcagggcccgaggcaacgtgtagggtatccaacaggggttaggtggcactggcagcaggcggcggcggcgtctcctccccctttcttccttcctttctttgttgtactactactacttaagctcgccgcttctgttcacagtccatgtgattgattctctcctgctccttctttcttccatctctcctgtctctcttctctctctctctctgtctgtctgtctggcaaagggcactgacggccgcggcggtgtcg

SEQ ID NO: 7450 - DNA, 723 bp, Zea mays
tattttagaaaataatttaaaagacaakaaaatcactattaaaatacattttaatttaattttttttaaaagtttttctaaatcgtttaaataggattttagggtgttacagtagaggagtctgtaaaaaggaaatggttggagactttgctggaggtatttcgaggtatgaccctggggcctgggccctgggccctggcacaatacaacgcgcccgttgactgactttgctgtgctccgtgctcagctgtgttcggttcggagttcggacaatctcctggaaattctgatcgaacctcctgcttggagcttcgcagcaacaccgtcctcacccgcgctgaaaaagcacccatcttcctattgcgcctttcttgtagagtcaagtcagctcacttttctcgtttcgatccagatcccgtattcccgttggattcgtttatcccgcgtcccgcaagcaatatcagatccttagcttctgtggttctgcacttattcagcgtctctccagcttggaccccttaaagtgttctccaggtcagccgtcagtgctgcttagttcttacaagctggcttatgttcgattgatttcagaactttcaagctcgtgcaaactctgtcttttattgcgataattcgttgaagagcctcattgtttcgtagaacttgcaataatagctcctgaagagttctcgtgtacaggtacagctacttgaatcgtcagaa

SEQ ID NO: 7451 - DNA, 92 bp, Zea mays
ggcgccgagccacgcatagacactgctgccacactttaaccacagggcagacaattgtggtacattacacttttcagtattctcatgtttgc

SEQ ID NO: 7452 - DNA, 1500 bp, Zea mays
ttaggggatggtctggaagacatgcatctctgaacgtcgggcattccacatgttgccatacgagaagccagatgagaaggctggtgaggctgccaccaccgagcattttgttgttgtaggggaccttggcaaaattggtaggcgcctaatgagtgaaggcaccgttgggctgagcactggcacaaggtaatcagacttttggaattggaattttaatctcttgcaattaattttgtttttttcgaaaactgaactgctgaatcagttcagttgacaactgtgtcgaatgaactcaaaatcttttttttgttcagtgcaaaactgtttgtggatgctgcccactcttgcacgactagggtattgtaaccatgaaagcaacacataagactatctctagcagcttacctattctcatgctcatatttaactttcactttccgaatctattctcgtactcatatttaaactttattttgcgaataatgtagtctatagtgtaaatcagtgttttggacgatcatataaatgatgtgttagacacgatccaagtaactcttggccgactgggtattgtaactcgaccgctttgctagcggcggcgcgagcacgcctaggtgcagcagtagcactgcctgcggacaactatgcattctccgactccatggcggcaggggaatggaaaccggaaaaactgtgtttatatccaccgggaagactatatttatatcccccgtcagcaagtgcatgctaatatgtttagttctattgtattctacttgtgtaaacttgctagctactattgtatattggatgtacgcactatatgttgtttgtacgatacacttgcattcctctctatttcacttcttcttttacgcacttctattcatgtttttttggatataccaatgaacataaaacaaataaacataagaacactaacattttgttgaatattttatataccgttgtagcgcgcagattactaactagttgtgtcttaaaaaatgtgtcctcgtccgtacaaggttttatctctatgttttgggttttggcacggcgagaagaaacgagagcacgtggggcttgcgctgcggaccgcttatgggctacggcctcggcgctcgtgctcgtgccgccccatgcccccatgtgccgctggccgctgctgcctctgcaggctctgcaaggctgctagctgaccaaactccccctcctccgaccttcccgaatttctgatgctgttgccacttgaatgctctcctctcgcgcggtgcctgccgttgctgctctgatgccgatggatcccgcgccgacccaaccgcatccgcatgccacccacctcccctccgcctcgatccgcattaattactccgacctcaccacttcctcgccgcttccaaatcccaataataccatcgcgtaaatccagatatcagggcagctggaactgaaggtggcgggagccgagtgatccggcggtgagctgagcggggcggg

SEQ ID NO: 7453 - DNA, 277 bp, Zea mays
ggtaccactcgctccaaatctctcttcttcccttgcctccaagcttaaacccgtgtgacactatttggttcttttctaaaattgcaggtatctctactacttattaagactgtaagggtagcctccctttttttgttctgtctttttcattttcctgttttgccctttccattcccacccgcgcattgcattgatcaccaatcgcatcgcagcagcacaagcagcacgccgtgccgctccaaccgtcttgcttccccgcttagcttcccgccgcgcc

SEQ ID NO: 7454 - DNA, 1491 bp, Zea mays
actccgccagcgccagtgccaagagtggcgatgggaacaccaacggcggcccggtgtcgtgaccatggttagtagcagtagcacagcacggcacctgaaataaagaatgcattttttaagagtggtgctagactagctgctctgtcagtttgataatatttgaacacatcaaacagtcgaatccgtgacctgrgcttgtcgtatccaataagaattttacaagattgatttcagcagataaaagaaaaaaactcttgaagttgaagtgtattgatatcctcaaacagtcgaattcgcgacctacgcttgccgtatctaataagaatttacaagaaaatctcataattctataatatcatgtttggatgtagatattcaagacccaaattattgggaattggaataaggatttctgaattccgatgtttggttgtctaatgaatccagagctaaaattaaagctcaatttcatggatttggactttaactaaaaagcgtcccttccaattcagatccaagactctatgtttttggtggaattaaaacatccaaacaatatatttgtattgaaactcatttccaatactagaaagatttggtattagatctaattcgatcctaacatctccaatatctacatcaaacagaccctaatcgctttcaagcatcgtagatagaggcgataatggatcaccatccaaacgtttcttcgcaatttatttgtgcgcttaaataattgtagttcaaaaataaatataaatagagctcgattttaatctgatccggtccttaaattttgtagtataaattttagagctcattgccaccttcaatcgtaggatcctataaaattctaacatgtaaacatggaaatataagatgttttttattcaaaatcatgattttacaatctcaaccaaaaaatgaccttattcgtgttgcattaccaccccccaatcatgcaagtatccaatgacggcctgcgacgcaaaaggcccaagcagggtgccagcaagccacgcgccgaccgggagcaataccacgaagcccgtggcccagcacggtacagtagcagtgtttcttttttttcattttattattgtatgtcttttcccttttttctatggccatttattattattttataaatacaaaccacaccagaattataaagaagcggatacatcactttagggcttgttcagttacgtgttttttaaatataaattggaagtgatttaatctcgttcaatcgccctcaatccactctaaaccgaaaaggggttatgtgtactaatcgggatacagcgccgggaaaacytgttgctctgcccgcgcgtgatcttgtcaggacgttgttggttgctagttggctgtcaagatccaaactttagatatataccatggaccccacatgtcattgactcatgtggacccacatgtaagtgagatagtaatggtatggatccaaagtggtgatcttttaatggt

SEQ ID NO: 7455 - DNA, 635 bp, Zea mays
gtttgtctctgcttgaattagcatgttatgtttgtgctgtcataattatccttgttatgttactgatgttgggagtatctttgtatgttgaacagcttcatacatatggaattatatattcccttttctaaaaaaatacacgtaccatcttcgtgcttgacgtcaagtcaaacaaaatgagcaagtttggcaaaagaaagagtggccagttcgagtacatcttaccttacttgagattctacgccccaatctaaggtatgtagttgtagctttgcagtgtacccattttacatatatcagatatttttaaatgtcaaactatagctttgcatgtgtacgtactgtgccatacaaggattatagataaaatctcttctaagagctaactaaccacggaaagatagagattacaattctgttcgttttctcttaatcctagataaagataaccagcggcgacgcaagcaccgagaacgactccgataaaatagagaatccgtttttcaaatgatatattcgtatatatctatataagagagtatatatagataccccatagtatatatctattctatagcgactcgttccgggtcatagtcatatagcatctagtctagagatccaaacatcatatc

SEQ ID NO: 7456 - DNA, 1500 bp, Zea mays
ccgtactacaaaaagatggctcgaatcgactcgttacaataagagttagaatacttgctcaattcggttcgttagacaacttaagtcagctcgactgactcgtaagctagaccaaaattacaccccggtaacattgcaaatcaatctatcattttctttgtccatcagattttgacgtataaaatttcactacgcattgcacagttacattaaggctagcaacaggcaaatacaagtcgacatttgaaaaatactatgcaactatggtccttgaacgcgtcttagcggttgccgaaggtgtgttcatcacctgatgacgctgacaagtttaaatctgaaacacaagcacaatggcaatttagattgagggcccttaattaaatttaattcaaaaataaataagaatagagtctggtcctaattcgatttggcatttaaatgttattgtgtaaaatttagaactcattaccatcctcagtggctagtggaaagcaaaaggcctgattacgataaaactacatgcgtcagtactaaccgtccttttgggcgttttgtgaagcagaggcagcagagtttcagaaattctgctgccatgttcctcagtccttcaaaggtgcaactgctatatactatagaaagaagaaaacagtacatcttaagctataacaaattcagttctattataaacacataatttaagctacgaattggcagaccattgcttgatttgtttttctcggtggctggacttacatgcctacataaaaaaacaaaaggaatatatatatatagtttactgataatcaaaccaaaggggagatgctgacacaagaactagttctttcctatcactggataccatgtgctaaactttatggtgctaaagtttaacataccttgaggagttaaactgttattggatgttaaagtttttcacttcacttttaacattcatgtttggatcttaagtactaaaagtataatgctaaactttagcatacttaagaaactaaactggtattgggtactaaagtgctaaaaggtcataaaatgaaatgctagactttagcacagtgtatcaaataggtccttagtctcccaaaacaaaaagagagagagagagagataaggaaatagtactcctgctaggcttattgtagtagggtgccccatgcggtgcagggagggtgtcaccaaaaaaaaacttagcggtaaggagcgagggcgattggaagctcaaaataatggagctggttgtccaccgggcagacacgcctggtttgtttaatcctttggccctaatcccccagccctgctgccgtctccttctcctccttataagcattgccgccccgcccccatcctccaccgcaccacagccgcagtcagcagggcaagaacacgaagtgatcgtcgccaccgatcgatccagctcgagctgagcgagctatcacgtgcagcacagtgcagtacagaacagctgtgcttgcagtcttgcag

SEQ ID NO: 7457 - DNA, 1344 bp, Zea mays
gattataaattgctccaaacatctcatgatttgatctcttgtacttttatgccttttttaatacaacacgcttttttaaatacaacacatagtacatataaggctgtgggcggccatctccaacagccgtgtaaacggtcgcacaaaatattgttttacgctatagattacgctgcttgtataatagagtttaaaacagagagtgagatatagagtgaaacataaagttattaaaatgagaaagtggtattttatatggctatatgcatgctctctaattggttaggacatctccagtaagtttgacttaacttgtcttattaaaaaaacataattattattaattttgttgttgttgtttatcatataatgaactttaaatatgactttaaatttttcattttaaaaaatgaataaaataagccatcaaacatagtaaaaaatcaaatgaaatataaattggctaatgatgattctcattttaaactacactytataaacaatgtagcctatgatatagtattttacatagttataaatgatctattggctacagtctaattatctctataaacacataaaccatatgtttcttggtgccagattggcaaaatcagtatagagctgtagtatcgctgtaaataagggctaatgaggtaattgttgtcacgtgatgtagagataaataagacagtatgattgaaatccggtcatgactaaaatttccgtatcgtgttttgaatgacgactataaatattaaaaaaagtctaattataagactaattacgtaagtgaagattaaatggtgaggtgaacttattaagtctgtcaaactaatccttgattaacatttttttaccgtagcattgcatgtgtgaattatgggttaattaagtttaatagatttgtcttgccgcttagttttttaattagattatatttaatacaacattatatataatgtgacacgagtaaaattccaaacaccccgttacatcagcactgacgtatctcgtcaacgaaaacgcctatcgtgtaggaatcgtcaaccaagacgggtgctccaggctagggtgtggccttcgctgcggcttaatctgagccgtggacctctgaatggacggggcggatgcagcgaacggcacgcgctcgtctcctcaaaagcggaaggccaaaggcgcaaggtgactggcgaaacgcgttgttttcctcttttccccaaggcaaccaaaccatctcgattctcgactcgtggggaagtttcgctctcgccggcgtcgacggcctagggttcgaggaacgtccgtccgtccgtccggggaaggagcggtagggaggcggag

SEQ ID NO: 7458 - DNA, 708 bp, Zea mays
gaagaacatgaatgtacggagagaagggatggaaaaagtcacagaacatgtaatcacggaatggcagtctaacttgtctataagtagtaatttttttttatctcattcacggtttcagactccactgtatgatctcggcatcgaagagcaccacttattgtcatactcatagcgatacctctacccaacccgtacaaaccttgagcccccatcccagcacaaacacaaaaaacacaccctttcacaaacctcaaaatttatcccacaaatcaaagtcatctttccaatttccaaatccccagcacccatctgactttgaattccagcggaactcgaaattccccaaccaaatcactgaaagtcatgcagaattcgtcttccaaaccacccacccaaaaacacgcgaaaacacaccctcctggagccgaggcgtccgtccacgcgaggccgcgcgagaagtcgagaaccatcggtgcgtcgggcggggtgggggcaggcgaccgcatcgcgcggccacgtgtacgctccggatgcaccgaccgaggatgctgatccgcgggcggccgcgggcggccaatcggatcgcgccgtcggaggctacaaatacggcgccacggaccaccgatcactcgtcacagcgagtaccgagtaggagcaaccgcttgcgtcagacgcacactgacggagagtgatcactgatttctggtc

SEQ ID NO: 7459 - DNA, 1228 bp, Zea mays
tagatatgagtaatggagtctgatacgcatttattttacgacagacctgcgttgtttctatcactatatttgaccaaccctatattccaaaagaaaacatgacccattagtgatggaggcaacacacgccggaacgaaggctgattctcctcccttgtcctttcttgtcattggttctctaataaaaagggtgcttaaccgtctgcattatcttgccgcgttccttatcttctaacctctacctctttatcaaaatatagttttatggatgtatggggtctggagccaccagccccttgatatcggccctgcacgttcacacacaacaaagagtggaagaccatgcagttaaggccgactccagcagctcaaccaaagtttatccatataagcactgtattacattattttgtactgtagactgtatagttcgtagagtggtgtttgaatataagtatatatgtgtaagctgttgtatatagtctaagacttgttttagttgatggccgcaaaacgttgctcggcccaggcagcaatgccagtcgtccgcctggggttggatgcgtgtgcctggcaatcactcggttcgtattaaaatcaattgttggaatatgtaactgcaatttatagataaaaaacaattcgtttcggattaaatcctaaacccacatggccacatgcatatcagtacgtaccttgatcagacagtcggcgaacatgcaaaaaaaacctattgccgttcatcggggacaacatgtcagtcccacataaaataaagatactctacatgcatggaggaaggcaaaggcatgaagacgagcggtccagccagcagcagctgcggctgtcatttcctgtctgcgtgggtgcctgggtgggattgggagtttgggactgtggcaacaatagcagcagccgggcgggagctcccgcctcccgcttccccccctccatcagatgatcagatcagtccgtccctgcccatctgccctgctctctaatggcattaactgccgcccacccacccgccatctcctcccctacccagctgcacgctcctcttctcctgctagcagtactgctatatatcaataatactagctggaccctttccactcccctcacctctcactaccaccaccactgccccggatccataccagctgcagcagcagcgcgcgcgagctagcttcggtcggtcgatagatcgatcgatcgctcggccatc

SEQ ID NO: 7460 - DNA, 907 bp, Zea mays
aatctctattgtgtggcttattgttcatcccataaattttgggagaagatggtggaccacctccttcctcaaaccaaatagctcataagtttctttcttgatatcataaaatgtagcattgtatgctatgcccctagccatttgaactgagtttttttgtttcaaaagcaaaaggtagtgtgacatggagtccaatataaaatgtgtgtgtggtaacattcgacatcctgtgtttttggtttacaaggcaaaatatggcaaccaaggagggtgtcgtatcccagcagttagcagttgtacaagtcactcacgaccagatgggaaatgtggaggactgratgggttggagcatgcaacttaatcaatagcgggttctccatagatattggcttggcggatccccatattatttggctatcctcagcaggtcctctatcgcatctactatctcatcccatatttcaaacttcactttgcaaattctttatttttcacgatccactattttgattccattgctagttttgccccttataggctcattcatagacaaattcacatggtgcgcaatgttttttctcaaatgtttctcaaataaaataaaattcggcttaggtatcagtggcaccggcaaagtggcaccatgtacttgcagctcgtctagtgggcccggtcgccgaacagaattgccctgtacaggggcccacacggcaggcagggtgagcggggtgggcctctgtacccgtccaggccatcttggcagaggagagaattcaaatttgcggcgcctccctatccacagcattaattacgctgttcctgttcggctgttcctgttcctgttcctgttctgttcctgctcctctctcaccgcaccggcgatcaccacgggatgacgggagcaggc

SEQ ID NO: 7461 - DNA, 587 bp, Zea mays
gtgatgtgctcctaatgacaaaatttgacacggcaggcgtgcagccttgaactcggaagagatcgttcagtttgggacctgcagcatggttcacctgagagaattccatgaatgtgtagtactagttaactagctagctagttgtgttattaaataaaacgttgtgattgtgatgctgctcattttgctatctgaatcttaccgtccaattctcctccatgttcatgcaaaggctgacaggtggcgtctgaatttatctgtgcagcagtatgctactatttgttagattgatctcatctagttcggttaaagggccgaaccttaactcccgcgttctgatggaggcgtaattaacttatagttgtggccctcttttacatcaaatatatatatatagtataatgtacagtataatgtatagtataaatagtgttttgcacggtgatatacatgatttgctagccacaacatgagagagtgttttcagggacattattccttctccccaccaataagccattgctgtaaatttgagagacacatctgcgttgggactagaattcacattatcatgtctgatgtgattg

SEQ ID NO: 7462 - DNA, 1186 bp, Zea mays
ctttagcagcagcaaccaaacacccccttagtcagtcaaaccagtcaaatcaaacctgaacccagctcaagcgcaagtcagactgagagagagagagagagagagagagagagagagagagagagagagagagagagagagagagagagagagagagagagagagagagagagagagagagagagagagagagagagagagagagagagcaaagggaagtcatcataggtattttgagaacattccatgcatacttgcctggctcgcatttgcctgcgagatcaccaatcaaacaagccacccgtgcttcctgctaccctgctacgctgcacaatcatcctgcggaatttagtaacggcgagttattccaaagttccgatccccaagttgtttattctcctatagtttgtcggtttgtgtggttcagattcctcccgctctcgcgcaagtggtacactgtgtttccagctaccattttctccactaactaattttattttcagtgtctctcgtttcttttatttgcgcgtcaagtttcagccattccttgctcaaaggaaaagtttgagccattccctgggaaggtaggtgagggtactggacaaatccgaaatgcaaatgggcatatgctacatataaccgtaggcttgcttgctactgccagagactcgggtacatggtatcgggttacagtccaaacaggaaattctaaggccgatggaagataaggatatgggtacagtcacccagtcctgccatgacgcgaaagcttatagaaatcaggtggcataaatactgtgcagggctaaaggttggtgggtcgaacggaccaggccatcaggttatctagaaagctctcatgctcttccatttctaggctagcctaggtctggaccagttagagtagacacgcaagtatcaatcgattcataagaggaggaggccattgagggagccaagtagaaggcagtcactgcaaacaacggtatgcattgcaaggaggaaatatagctttcagccgttgcttttcatatgcgtttcagaaagtttgatcatctccctttcgatttttttaaagaaagtttaatcatcattcttgctcagaatcaagttcttagctcttagacacatttagtatcttgttgttagaaagctggtgagcaactttgtcaagcctcaagagctc

SEQ ID NO: 7463 - DNA, 264 bp, Zea mays
cgagctttttgtcgcgcacttggtgaacccatgctgctggctccatcttcactcgactcttggaatttcttgacgacacgtggaacgacgatgacacaggagagtgacgtatatagagctacacacgcgacgcgacgacgaatgacgctaaccggtggaatcgacgacacgattgggaattaaagccgagcgagccgagagggcgcgctggcgaacaggaaagaggacgcgcggtaagactgagcatctataagaaaaaacgcg

SEQ ID NO: 7464 - DNA, 75 bp, Zea mays
ggtgtgtagctggtgagccgggtagtgaaggaggtgtgtaccaggcctccagtgagcaaatgggcatggtgccag

SEQ ID NO: 7465 - DNA, 90 bp, Zea mays
ctgcatcctcctcagtcccatagggaggaagttgagagttctaataagagcaacggccattaccattagcgagttatttttctgcaatat

SEQ ID NO: 7466 - DNA, 1372 bp, Zea mays
tgttgtaacaccctgaatttggaggtataaaatttattttctaatatccaccaaattgaggtgttatcctcttcttcctttgcctttctttctcttttcaaaataatgaaggaatattttgcttttatgtaagtattatatatattaatgaaactctaaaagggtttttgattgtttgcatcacattctggagcattaattttgtttgttgttgattgagttgaaagagttttattatttaatttattctctttttacgaggcccaattaattaataagggcccgtttgtttcgttggaattgaatttcattttaataattataatttagataaaactaattaagttaatatatttatatatgtaatatatttgtatattatcttaaatcatatgagagagatagttatatattatatttatgttataacgaagcaagtagaaaattgtgctataagttgtacatcggaaaaatagcatgtaaatctatagaatcaatttccatctctcaccccatgaatttgagataggtttatatgataactttagaaagtggtggaatgtcacattctaaaaaaatagcctattccaatagtaagattctaattcctcaaaatgaaaggaaacaaacggggcctaagggtccgtttgtttctctaatttgaggaattgaaatctaactaatgtagtagactattttttagaatataatatttcacaacttttcaaagtttatttatatataattctatcttaatttcatgggataagagatataaattgattttatagatataacttataaaacactcttctaaatatagtgtataactatatatttcatatgatttagaataatatataaagaaattgtatatattaacttgattaatttatgtctaaattatgattattagaataaaattcaattccaacataataaacggagcttagatcgcatttaccgttaccgtaagggagcctagatcgcattcaccgtaggtatgtatcagaaatacgctatgccagtgttctagaagatggggagaccgggagagggaagcgaaatgcgaaaggcagccgaggccgcgagccgacgcacgcggctcgttgcttcctccatcccctttcctcacgccgacgccaaagtataccaacgaattcctcctcgggctcccacctaatcgtgttcgccgcctgcctctcccaaaccctagcaacccacgatcgaacccaaatccgctcctcccacccgaggaattatgcgaaattccccgagatcctagcccagcactagcagatcgatccatcgcttgcccacctgccggccaccaacccttgtagtctcagtcaatctgtagattgagactacg

SEQ ID NO: 7467 - DNA, 625 bp, Zea mays
atatatatatatatatatatatatatatatatactaatttgttgtgagtaggatattttgagtatgtaaagcagtgtactaggagaacatacttgtttgttgctcgtttgaaagaaggggatactatatttatactagtttttagaagggcgtatttattcatagttaatgtttaggtcttttaattagagtttaaaatatgaactaaactttagtttagtctgtctaaacaggccaatggaatgtttcaaaaatacaaagtacctccatggttatgttcatacgtcgaacggagaggatgaacgagtacctcgtcttaaaggagtgcgtgatcaatcaatcgctgtcgatgaaccagtactctatcttgaacctgaagatcaacgtgcatcaactaccgcaacgccacatcagaaaaggaggcgtgtcctttgaaaatgtcgcacataactgtcggcatcgtgtgacgtgcagtgaagtcaattcgtcttgtgtgcgaatgaaattacctgcgattttgttctcttcaaattagccgcggcatgtggccaggaagcagtagcactgccgccaagccatgcctcctaattacgccgccgcgagaggctgggagagcgcaagaacc

SEQ ID NO: 7468 - DNA, 1500 bp, Zea mays
gggacggccgctgatggccctttgccgagagccccctttgccgagtgtttgacactcggcaaacctgtctttgccgagtggggtcctgtgccgagtgtccaacactcggtaaagaggctctttgccgagagcctaactttaccgagtgcggctctcggcaaagccttctttgccgagtgcccgacaaaaggcactcggcagagaatccaacactcggcaaagcctcggatttcggtagtgcttgggcctttcgtgaggtcttttatccttccagtggacccgggggatatctgtcccccacaagccccgatctttgggttgattttgaaataatcggcccaaagatcctaagtccagcttgcggtctttgtttgtaacaggaagtactttctgggtaatccggtaaaaacgatttcttattgtctccttctgcttttatcactcgaaaattggtgttctgtctcagactcttgcttcggaggtcagcatttcgtactgcaggacttcgaacttcattgggcgcaccaaaggtgcacccaatgggtgtagcctccgagcttcgagtggatttttgaaaataatccactcgaaggtcttcactttgagtattatcagaaatcactttcatcttccacttgtattttgttggaggtcaaccttgtattgatcttaccctatgctttagaggtcagcattgtcttgatctgagatgatgattcattgggtgcgtcgaaggtgctcccaatgggtgtagcccccgagtttcgagtggacttttgaaaataattcactcgaagatcttcattttatgcctttttctagtaatcttcttccctttttgccgaatgccttggaggtcagcactatgttattgatattatgctttagaggtcagcgtatattttgtctttgaggccgagttcgtgatctgcccatatcttgctagacagtgcaatttatttgatctgtgactgattggacgttcgacaggtgacccttggctagtcttcgttatcacttcttgcttcaatgcttctgtcgattagacttgtaccttgttggctatatttagctttcctttgatccttgttgatatctcacttttgtcttgaagtattcattgcacgtgctgcacggatgtgacagtttctgggcgtcccccccaatgggtgtaggcaagggacggcttggtacactgagtgttttagcaaactgtctatgagtagtaacttgatgtgaccgcgggtgtaatcatatcgcccgcgcagttgactggagtcccaatgggtgtagtgttgcatgaaacggcgtccgccgtctgacgtgtcttcagatgggtggaagtgcttattgaatgccttgcgactgttcagtgaccgcggttagaagtgagcggttgcctttcccttctataaataacctctttgcttctctggtttctccacatctcttcgctgctccttactgccttcttttcctccccttctgtctgcttccgcc

SEQ ID NO: 7469 - DNA, 1500 bp, Zea mays
cccgacccgtcaagcagcctctgcgccgattcgacgaagaaaagcacagagccataggcgaggagatccacaagctaatggcggcagggttcatcaaagaggtatgtgggggatagatatcccctgggtccactaaagagataaaagacctcacgaaaggcccaagggcccaataaatcgtaaggtcgttctttcgtgggcctggggaaagacaatcaacgaagcagagaagacgtaagactggattggagcaaacccggacggcccacaacgtcgaacgagtaaatcgcaacagagacccgactttcccgcgctgaagcccccatgcaacagagccatgcgaggataagtcggcaagggttacgtagggataaactcaagaggtttactatctttcagctacttgttgttatcatatccacgtgtactgccccacggtcgagtatataaggcctagggggcacccccttcagaacgatcgaccctactttacttagccacccacgtaaactctctgtgccttcaatccagagagccctcttgtaaccacactcgaatactcatcaggacgtagggtgttacgcatctctaagcggcccgaacctgcaaatcttgtccactgtccctcgtgcaatcggcacgaaccattttgctacagtcgttgacaccgtcctactcctaaaaacaccttgaggggtaaccccaggtgtgcggtcggacccaaaacaccgacagctggcgcgccaggtagggggtgtgtcgacgatccaagctagctcaatggccgtcaccttccacagcaagatcaccgtgcgtcccggatctgtattctgcttcgggacaatctcatctgtagcggatgaagagggaattctacaccgcctcgcagatctgccggaaaagaagtctcctccaacaaactccgaaaatgctggaaagacgctacctccggctcttcggaaaaagattatctccggaaaggctggagctggaagctcgctgacccggaagactccgctgtctacttccccaacaaaagaatggacacggatcgcgaggaagaaggagaccagggaaaggcaagtcgttctttccgttcctccggcctcaaaggagaacggaaagaaagtcgccacgacagcagcaccattctaccccgacgtcctcttcatcgggagagtggagtcgcccgccgtctctgacgacgaaccgaccgcgcctggagaagaaccacctcaatgagaatcccgccgacggaggaaccgacgcaggaacgttcgacgacatcacgcggccggagaacgggatccggagcagcctgtctcgcgagacgaggtctcggagataggagaaactccggaagaacgcgtcttcagggaacgaaggaactcccgacgacgtgatcgccgacggactcaggagcaagccgagcaagatgcaaggcaacgccgggagaatccgctcttcgagcgcaacctgaaccccgacttcgcccgagct

SEQ ID NO: 7470 - DNA, 1500 bp, Zea mays
actcctaatctcagctggtaaccccccatcagcacaaagctgcaaagtcctgatgggtgcgattaagtcaaggctcggtccactcaagggacacgatctcgcctcgcccgagccctgcctcgggcaagggcagccgaccccgaaggatttacgtctcgcccgagggccccctcaagcaacggacacaccttcggctcacccgaggcccagtcttcgccaagaagcaaccttggccaaatcgccacgacgaccgaccgtatcgcaggggcatttaatgcaagggtggcctaacaccttatcctgacacacgcccttcagttgacagagccgaagtgaccgcagtcacttcgccgctccactgaccgacctgacaagaggacagcgccgcccgcgtcgcttcgactgctgtgccactcgacagagtgaggctgacagcggccaagtccggcctcgggcgccataggaagctccgcctcgcccgacccagggctcggactcgggctcggccccggaagacgacgaactccgcctcagggctcggactcgggctcagccccggaagacgacgaactccgcctcgcccgacccagggctcggactcgggctcggcctcggaagacgacgaactccgcctcgcccgaccctagggctcggactcggcctcagccccggaagacgacgacctccgcctcgcccgaccctagggctcggactcggcctcggccccggaagacgacgaactccgcctcgcccgaccccagggctcggaccgaccatgtcacaggaggggccatcattaccctacccctagtcaactctggctacggggaacaagaccggcgtcccatctggctcgccccggtaaaacagacaatgatggcgccccgcatgctccatgacgacggtggctctcagcctccttacggaagcaaggagacgtcagctaggactcgacagccccgacagctgtccatccgctaggctccagcgctcctccgacggccatgacaccacacgaacagggtgccaaaacctctccggctgccacggcggcatgtacttagggcactagctcttctctgctagacacgttagcacactgctacacctcccattgtacacctggatcctctccttacgcctattaaaggaaggtccagggccctcttacagagggttggccgcgcggggaaaggacgggacggcgcgcataagcctctcgctctctcccacgcggacgcttgtaaccccctactgcaagcgcacccgacctaggcgcgggacaaacacgaaggtcgtgggtttccccttttacgcctgtctccctccggcttctcttccccccttcgcgctccgtctcgcgccgacccatctgggctggggcacgcgacgacaatttactcgtcggtctagggaccccctgggttcgaaacgccgacagttggcgcgccaggtaggggcctgttgcgtgttgacgaacagcttcccgtcaagctccag

SEQ ID NO: 7471 - DNA, 70 bp, Zea mays
gctttttaggtattattatttagtacctttgttttgttatttttttatcgaaaatggtgtaatcgatatt

SEQ ID NO: 7472 - DNA, 198 bp, Zea mays
ctgtttacggtctggatcacgtcaaggacacaaacctggagatgccggcggtttcgtcactgacttgtgggccatgttttgcagtgacacaaaaactccgccgcaacaagggccaacatggcgaggcggcaaaccatttctttcccttaaaccctagccaaaaacccttctgctgctccccgcccgccgcccgccacc

SEQ ID NO: 7473 - DNA, 519 bp, Zea mays
ttaggtagctattcaaaattgaatctagacggccgatcatttagcagccataaattggccacatgcatcatatatgcatggggccctggagtctaggatacatcttatcgttgaatgtgagttctctaaacggatttgtgaggacattgttgtttagatgactattgaggaccttaagccgttccacgctcattgttgtcctggtgggagagatcggccatgttggcgggatgcaaaaggaaagtcctgagatcgttgtggacttgtggcgtggcaaaatgaatccaagaaataacgaactcccaaacatagcctccacaaacgtctccccacccttctttccccggaacaatccacagtccccaaataaacctgtctcgccattgcctcccgcccttgctccatcctctctgccttgggcgatggaaggcagagggtgacggccaggaggaagcggtcaataaaagacaaaaaaaaatttgcccaaaaaaggactagaataacagctccgatccgacc

SEQ ID NO: 7474 - DNA, 72 bp, Zea mays
ctgtcgcacgggtctggcaaggcttcctcgcggccggggtcggggacgctgggatccccggaggagcaaccg

SEQ ID NO: 7475 - DNA, 743 bp, Zea mays
agggcgatgaatatggtaatggatagtggtgggtgagttgttcccataatttaaaaaaataatttgctgtttttgggggttttttattcttaatttgcattgccgagtgtgcgaaaaaaagtactcggcaaagaaccatttatcgataaaatatttgttaagcctttaccgagtgtaaaatggtttttatagtagtactgggttcgagcttatatgatacgcgtgtatacttttaggaataggttgtagttctaacttagggcatgtttggtttgatgactaacttgctccgctttgctacacttttctgcttaaggttagttcttaaattcgaacgactaaccttaggcaaagtgtggcacgtttagccacaaaccaaacagccccttagtctcgtgtttgaatagtgaggcaataaaaaacatcaagtaaatgcaactgaaatcttgatactgatccgatggccatgattcattatatacctggacctagataatatatagataattttttttatctgtcctaattaatcaaaaccgtgtgaagactttccttcctcggcaagccaccgcagcgctataaaactcggcttccttctcccacttcttaacgattcctccatctttcttgtgcccacaagcttcctcctccattttttttatctgctttttccccctcggctgttcctactcaggctgggcagcagagctagcagtggtccctggtgcttcaggcgaccggcc

SEQ ID NO: 7476 - DNA, 207 bp, Zea mays
gggacacttttattgacaagttgtgcttatgcttgatttatgcatgcaccaaatgtacatgttatttactgtctattcattgcactatttctgatcaagccgatgttatcaagatacatgttgcataacccaattattagaggtataattggtaagtgagcttatgcactcataaaatatgactaggcttatgaaccattgaaatct

SEQ ID NO: 7477 - DNA, 1363 bp, Zea mays
gtacaaaaacgacttagtggccgtcaagcatgcagatgacggttcaggagtcaagtatgcagaagacaagcgtgcagatgacggatcagaaataggtgctgccctgattgctgcctcgcaatctcagtagagagatgtccgagtggtatagaggtagcaagtagctatgatttgtttccaacgtcttaactgtccagcgtctgcagtttagcatgctagagctggatgcgatctgtaaccaaaaccaggcttggccaactggctgttcataattccaataacagcagggttgcagatgtctcctaaccccctacgatcttaaaaacttttgaatgtttaaccatcagagcttcttctatgcactgaaccatcggctgttagacttgtgaacaaggtagtttctatgtcatctttctcatccttaccaaagctccacaaacgaggccgtgtaagagctaatacgatggtgaggaagaggatttggaaacggattttgcacagcggtcacagatacagaaagatcaatggagttatcttcgttgacaacacctctgcgaacgtaagtgtccctgggcaaatctttatccgttggagctgacgcgactacacgagcccttggatctggcaactggtggttccaaaagcttcgggggcagtctcaggcatccccaagtccccccctgtatatctttgcatttacacgctacggctggatattggcaattgcatagcgttgtgcatgttcatagctctagcaagggaactgtgtccattcatgattaacgaccggaatacttcaatgttgctgtaatcttgtagtgcgtcagcagtacttgcattagttgcacgtagatgcattagtctatcgcgtgtgttactgcatggcatatttgttttagtgtagatcacggcgagctggagactgcatggcatatttgttttagcgtagatcacggcgagctggagactgcacagtctgcgtcgtgaccgcgtcgttcgggtattcgccgccaccacctgtaccgctgtacgccgtgcatgtcgcacgggccaccgaaagatgaggggcttcgtgcagctacggggagtggcggggaagtcggatcactctgtgtaataagactctgttaatgcatcagaaaactgcgcgtgagttgcagcccaaaaatacctctgtctcagcgttcgtccgtcggctccgctgatcgcgctctgtcgtcgcgctgccacagttcgtgttcatcgccgaccgtcgtgtttcagttccaacaaatagcactccatcgcggacgcggggaaagaaccgaaagatacaatataggcgaccgaaccgagaggcttactagtgcatacaagtagcgca

SEQ ID NO: 7478 - DNA, 1226 bp, Zea mays
tgagcctttagcggctcttgttggagacagccttacaaccttgcatctgattgaacctggacattcattcgctgatgtcactatcaatgtcgccttgttttgtagggccgtcgcccctatatcaggtaaaaaaaatttctctacatcacatatacaaaaccacaccatcgcagcctctcacatccatccgctaaaaaaagaccaaacggtcaagtggtggggcttcgatttctgttcgtggtggcgctggagcatttgtagggctgtgtagtcgtggagattgagaacatattccaaactgtctaatctcgggccgggtgtgcaatcgtgctactacacatggttcctctccatgacaagaaacttaatcattcttatgtgatggaataacggatagacgggtgacgattattattattattattgctggacttgaattcgagttcggcccagagccagaggatgacgcaagccagagctttgtattgttcccaaacgccgcccacgggtcgtctcgtctcgtctccttcctccacgcaatcgcaacgggctctgttttgttgtgcacccgttcggcaaaacgacacgtcggagggcggtcacgccaagttcatgcgtgcgtgcgggcgctgccgaaatcaaaagcctctcctctccccctccggccctcagttcaggatctgtgcacgcacacgaaacgcctgatccagatacgtgccagtgcgcacccatccagattatctaatctaatcttaatcatcttaaattcttaataaccatccaatccaaacttatcattaaccgatagttatcgcttcgcagattcgaaaaacccgcgagaggcatccagattacagcgcatgacccgcgccgccagctcagctgcaccgcgaccgcgccgggagcccaacgaacccacacacgccgccgtggggcccgcgagtcagcgagctgagagctgagccgcgcagctctcttcggctccgtaggcgtaggggacggggaaagctgtttgtgttgttgagcttgagcagcagctgcggcctgcggggtagatcagaggagaagataagcccacggccgcagttaacccctatcctctcaccagctacagctacaaatagccgccctgagccctccgccgcatcacaaacacctccgatccgtccccgatcatcgcaccacctgtagcccacctcgctctcgagtctcgacccagcgacgag

SEQ ID NO: 7479 - DNA, 470 bp, Zea mays
ttcgaggcccgcgcggccggcaggaagagcactggcggtcgcggtttacgcggcaaacggtcgaacgccttggcgacracggygagggggaggagctcgtagtcaccagcctcgatgtgttcgaggtcaaaaasggcaggagagatcgtggtcttgttcccgaagtgctcgacgacggcgacgacgtcgtggtgttcgacccggactacggcgtcgacagcgacgacgaggaggaggagttcgagatgttcccgttcgacaaaagtcatcatgaagaagctgatgccgttccacgcgcggagatcggtgaggtagagtatggcgacgagaacgatgacaacgacggtgacgaggttgtagtgttctacgcagactacgacgaggaggaggactctgaggaagacggctacgaggttgagaacgcggaggaaggggaaggtgatgtgaaggagaagggagtgccggcagtg

SEQ ID NO: 7480 - DNA, 179 bp, Zea mays
cgtatgttgtggtgtacaataagatggaccttccagaggcatctgatagatggaatgcatttagggaaaagctatagtctgaaggcatcgaacctttctgcattagtgcaataaacaggcagggcacacaggacgtcattcatgctgcttacaagcttctgcagaaatagaggcaaagg

SEQ ID NO: 7481 - DNA, 898 bp, Zea mays
cgagcccaccatgacacgaagccacatacaacacaacactcctggataataccacctcgttagatgaagagaacgagacatcgagcgagctataaaaaagaacatgtctcattttgaactcatacctccttgaccttctagctaagataaagtgtaaattctgtagtttaataactggtacgtgggtcatatgtccactttaattttaaatttatttttatgaggagggttcactttaattttaaatttattttatggggagggtctattacattgtcttgccactagatccgactcttgggtgtcgcacaattgttgcactatactatcgaatatgattgatgtactgycacagcgcacaagcattttatagtataaaggcatgtacaacccatataaatgattcatattttaagcggtatttaagaaataagtgcaataaaaacaccatacatgtatttggtggagaaacgtctctagtatggttctctaagcgtaagatacgattccatctataaaacccatataaagccttgccttaagtgattctagtaaataatatatttgattgtataaacgaatttgttagatgtatttagtgcttctagaaccgctaggttgtacgtgtcctaaggagctgagagcctcgtagcctcaaagctgacagaccttaccgtaattccagcaatttccgttacgcctcagcgcctcagaggagagaagcttccctgcatggctgcattacgggcgaggcgagtggtatagctggtaggtagtccgttacaccgctcgcctaatcttgcaactcctctgacctctctaaccgccattcaggactcggggtaaacgcaaaccagcagctacactctcgtctccctctcctccgatccattgtgac

SEQ ID NO: 7482 - DNA, 403 bp, Zea mays
gcatgcctgcaggccttacagaactgttttctttttagtggaataacatgtattgatgacttagttgtttggtgtagcattcaactctgtggtgaatacaaagaagggaaatacaagaacaaaaccactccctctttctaaaagacttcgcctagaagcacagagggtcctgaaggagcgtgttcaggacattgcagataagaaaggcatcaagctgagattttgtaatctcagagaatgtgaaagccacatctggtcgttggatagtccgtgtgagaagactagagctgaaattggatggccacaaggggttccatttgtccatccacatgacctcccaaacaaggcaaagcttgggtttttcgaagcttacgaacctggatggacggcctcccaacaagaa

SEQ ID NO: 7483 - DNA, 861 bp, Zea mays
ggtgcgggagcaggaggtggcgaaacgctaggggcacaagcgagcgcgtgacgacggggaggtagagcgagagcgagtgggccgccatccggctcagcgcatctccctcccgctttattttggaaggggccggcagggacaggggcaggggcgcagggcgcaggggcagccggggccgggcagctcgcgtggaggttcgcttgcaggtgccactggtggcagcaggcaagctggcaaaggaacagtacagaacagcggcgtgcgggccggacgggtgcggtttgggagacaattgtatatttaggactctaaacaatacgcttcgcaataatgtcatccgaaagatttaatccgtacaaaaggtactacaaatcttctctaattgattatactaccattcaacgtatattcttcctttttataatctgatctcaatgtattttctccctaacaaggcagttttaccccttaattaattatacacatttattatttggagatccagaaaccaactaacagaaccgacttccccaatcgccatggatcccgctcccgcacatgatgcagccgccgcccagtgaactcgtggccttgacctgaagaaaaatcattttctctctctcactcatagtgtatttttttaatctttgcagccaaagctactgattgccttgtcctgaccagcgaaagagggatctttgggaggcaatcagaggtgttcggtttggtcaaacaaagctcagctctcttgggatgcttgctgcgagctgcttgtgttcatacttgagagaataaaacagtgcatcatcttgctgtcttgtccttcgtgattggaagagaaaacgtgctgctgttcttgct

SEQ ID NO: 7484 - DNA, 50 bp, Zea mays
ctgcagttctccttactcctagcgtctaggcgagtatctaggagaccata

SEQ ID NO: 7485 - DNA, 1438 bp, Zea mays
agcccaccaggcagaggaatttggccagcgcacgatagtgactgatcggtggggtctccaagtcagcagacgcgcggctggagtactgctggatcgcactggtgatgcggttctgggccggaatgtaggtttcggcccagacaaggtagtctctctctatatatattttttattttcattttttcctgttttctttttcttgttttatcatttctcctatttcaaatatagtttgaacacccaattaaatgcacaatcaacaaaaaaggctccgcatgcaatgcatggttgattttacttatataccaattattcatttagtcaaatgcctcatatgcaacccttagagaatagaaatggttatctaataatattaactcctcgtgtagaactttcattaagagatgttgttttttaaaaaatatagtttaacaaaaagtggataaattaactcatttggtgtaatattttattagaaaatatatttactttgggataagtaacttgaaaggtaataagatacttattaaaagatatttcaatttaaaacttttaaaaaacttttataaatcctaaaatataattttagggtgttatacgttgtcatcgctagttcagcgagccatactcgagtgcacttgatacttgatcggtaaagaaagcgggaagtttatgatgatatacgaaacttacaagccacgtgtcgtcatagggttacgtcgatccgaactaactgagaaaatgaaaaaggatatccacccgaacgttgttgcttggaagcttcaggtttcggcaccagcatgctagcatgtctgctatccgtctcacaatccacacatgacaccgcatccccttttgccttcccaaggctatatctgatccggaaatcgactgcctttgacgtgcacagatcattcaccctaacttcacatccaacaattccttgcaagctaacgaatggacacgctttcaatcctcacgccgttgcgcgtggcgaggtgtccatgttgtacatatacgcgctcgttccacgttgttgatcgatgtgcataaggacccagcgatcaggagctgactgttttgtcctccagcaatcggccatgtcgtccctggtcaggtcgttcgggtctctctactcccagaagctccgctccaccacccgtctcggatccgcgacggcggcgccaccgcgtttccaggcgttggtccgatcgggattctcgggctccagccacgggggagacgtgagacgtccgccggctcggccgagccagcatcagtctcaggacaaggagcggacgcctttcttcatcttgtgattgctcgactgttctgtccgttgtacagttattagtgggtcccggtgcggctcctaattcctctgctgcactgcagggcaaggctggccgtcggttctattcttgctgctgcagcgcca

SEQ ID NO: 7486 - DNA, 1467 bp, Zea mays
cggcgctcatcctcttctcagctgctggctcagatccggaacacccaaggaccgccggtttctgggggtggcttttgggtggtttgtagctgccaaaagccgtgtgccgtgccgtgccgcgctgcggagctgggtcgggtgtttatagccagtcagctgccagctgaactagacgggggctcggacggattttctgtgggcgccgcgccacgttgcgttgtgtgggtggtttgattgggtctaaattattgcgtgggtcccaccggcaccggcgggacctgccggcagagtggaagggaggaagtttccgcgcgataagaatgaaagcaggaggacagggacgcacaagcacaacgtgtaaaaggaaaccgtggcgcgccaacagtctccactccggccggtccagtgaatccaacccaacccacccacgctagagacaacgaatgtcacgatcctcgtaatacgcatgtaataaccaatacttaatttgcaaattgggtcggcgagacgtcccactcctcgttccttgaagaaaacaaatgcataaaaaaaggacaacatatctagcatagaaacgatttgggttttaacgtgccgatatcgaatcttgtacattagacttattatctacgaccgagtgaaatcacacctgagaacgtagtgtcctgctccctctgtctgtaaatattagtcgttctcattttttaaggagtcaatcatttttaactttgaccacatttatataaaaaaatattaatatttatagtttatataaaaaaattaatatttatagtacataattattatcgctatgtagatatttaaatctatatttgtagtaaaattatttcgaagatacaaatgttgctaatatattctataaatctagttaaacttaagaaattttgactgacacgaataccataacgacaaacattttgtgaacggatggagtatttaagtaaaaaaacattgagttctttagaaaacagtgtgacactgtgtctagcagtttacccatatggttacctaaaacactgttttgcactgtagactgcattgttcgcagagtggagtttgaatatgggtatgtgaatgggtaagctactgtagatatcctaaatgagctagtccacatgatatgcgaacgacatgtgatatatattcatatatattctcaaattgcgggtacccgcaggtaaaatttgatatgtgtactctacctgtatatttgcgggtacccgaccctcatgtacatgcgggtgagatttcatacccatgccaacacccatcgggtaggaaactcgtggatacacacacccgcgggtaagattgtyatccctatctattttgtagtatattgatcccgtgtgatgaccattcactcaagctacacgtccaggacaattattttaacttagtatgcttgcttccatttctaatcattcctatctttaacagagaaac

SEQ ID NO: 7487 - DNA, 587 bp, Zea mays
gaaaaagactgtctgtcagtctgtcactctcctccggccgcgtcaccsgcgcgtgcagccacgtccgccgatccccgatcggacgagagtcgcgggacgcctcccaaccgccggatccagccgcgcgtacggcaacgcccgcctttcccctgcacccgtcgcgaccgtccgcctcctccgctggcgctccggatgtctccagtttcggcgtaccgccgcgtgcgcttcccaaaacactcccgtctccccgtgcccgatacaaagcgcgagggggcgaaagcacgccacaactgcaccgcactctctgcctccctccgtccgtccgtcctcccgtcctcttccttgtgccttgtcctgcttctccactcgccactgccgcattctgcccaagtttgccgtactgccgcattccaccagccacccaccaggccaccacccagcactccagccgccagaacagagtctacggcgccgccgtcgcacgacaggagagggagagggagagagacgcgggctttgacttgccgccggtgcgtccgtgcgtgcctggtgggaggagtgggagacgccggtacagtacaggagcc

SEQ ID NO: 7488 - DNA, 290 bp, Zea mays
cggcctcttaaacgcttgcttgtgtagttgcaaagactttgcaagaagcaactgctgcttctcatttcccaccaacaatgctgtgcctgtgcgtacgtaggcgatccaggtggggcccggccggcaatcaggtgaaaagttgagctgtgttgtcaagacagactgacagagacatcagtttctcgctcgcatcacatgcgtgcattctacgcgggcaagaagggcgatgagagcagtccgtcagctgatgtattagcaaccacaagagagagagggaagagaagagaaca

SEQ ID NO: 7489 - DNA, 1085 bp, Zea mays
aaaatggtccgtacgcgtgtatgtgcatggctgtggccctgatcttaaattgatgaaggaaatatagaattttagaaacagacgcagctgcccatatctttcttaaacgtatgcgcatgcatgggatagagtcagacacacacacacattccttctcttacgcaaacagaagtgggagagctcgcgcaaccgtgagcgtgtgcgggcgcgctggctgaaccagtgtgaagggggggtcggcctcggcttcctttagcgaggggaaggccggggcccccgtttacatatatatatatatatatatatattcaacgttcagttgttgaagtgaatctgcagtgccagatctcactgtcgtccgagcacagtggacaccggacctcaccgtcgtctcaacgcagacaacctctgcgcgattaccagaacctgaaagctgggctcctctttagtccccccatggactcctcggaaagcacgctaccgcggatacagctccgacaatggtggccatccacggggtggaacagcaccactggagcagctgaaagagatcgtgctgccgagggcgatagactacttccagcagaacaccgaagcgacagttgtaccagatactttgaaaggctccatgaaggcactacaaatttatccaatcaagaatcatcgcaatcttattatttctaaatggatcacaatacgatttcactagcgcactacagaacggtttaataggcgtcacatttcatctgagtcaaatcagaacaacgttcacgttcatctgaactctgaagttgccagccgaatcgtcacatttcatctgagtcaaatcagaacaacgttcacgttcatctgaactctgaagttgccagccgaatctgttcagacgtgttcaccagtctcactcaatcaaaagaaattacagtagaataagtgcccaaaccgtcacgcaggatcataaacaataatggcagtaactagtttcacacctccaatctgtccaatatatagagcagcccttgcatccgaatctcacaacacagagcaaaacgatcaccgctgcaggtagagcaaaacaatcaccacac

SEQ ID NO: 7490 - DNA, 1500 bp, Zea mays
ctgtgtctcactcactcacccacgtcgtcgttccagttgattgatacacatgaacaggataatacatgacgagtatactacgtacgtagaccgctgctgcggcgccggcactctactccggccgggcaattaatacggggagttagtagtcgccattggtgcgcagcagcgggcaggcaggccgcggccggcggtgtggctcgctcgcctgagttgggtgcggcctttaaggcggcgattactacacgcccccccgtaccgatctgatcgaccccggcgagccggccctcattacacacaccagctgcccgctctgcctgccgcctgccagttcgtgtgcacagcgcgaagcgctgctcctacggttcggatacggctctctctgctgctgccctgcagcctgctcctctgcctgccgctgtgaactacgtcaccctccgacctccgtggtagcgcggcgcaggtgtaggtgttggcttgcttgaccgttgctatcgttctactatttactgccactgcgttcggctaacgtcgccatttaattaatttgctttatataccttttgttttatatatagcgtacgcacgtcgttgttatgtgaataggtggacatggcatctgcctctgcgttcagttcgattcgagcgtgtggatggcaggatgggtgaattgtagaggcagctgttaatgttatcgactcaccgcacagctcatttaccggagttgatgtgaagcgagtgctgtgctcaggtgcatgtgcatccgttgcgtgcatgggctgcacgtgcaagctgtggcccagcaaaacaaggccatttcttctgatgcgggcctactgggcactgcactttgctccgctacaatctggcccaaacgcacatttaaaagaaagttggactagcccaacaacaagggcctgcggttgagggctggtagcagccaatgcccatatgctcctcgcacaaagtcaaaccggcgtgtttggtatggacttaggagcttggactcgccctcgcacaaggcgtgtttaccgtgtttgggatggctcatgttacagctttaacatagagctgtaatctaaatagtttaaaaaatatttttttaatctaaataataaataaaatgacgtatctaaatgccttctaaaagtttataattttagtttcacattttttttgaagccgctaatgatctgctccaccaactccactaatttttttagagcgggagctgtcctaaacagggccttagttgtaagcgtgcaagcaggctcatgtaattttatataaaacatcctaacaaactagaacaattggatcagaccatagagtacttagcaattagcatgaagttgtttttgctgaagagggtcgaacaaaagaaatgcttcactgagcaaaatatagcatttcgatcccgacaccccaaaatccctcagccctctggcctcggcggcgctcaaaccttcgccgtcccgccgtctccaaaaccctcttacc

SEQ ID NO: 7491 - DNA, 826 bp, Zea mays
ggctctgtttagaggtaatcactgggctcatattctgaacgtacccgtagaagcgaggatgcgccaaagctaataaggaatacttgcagatgtcttaagtcggtggccatgtaaatttttgtatctcatgattggaggttttttattaggaatgtgttgtattgaatttttttattgtgtatggaatgtgtgtcgtttgagtgtgtttatgtatttttggcttggaggtttgtcccttttttggattgctagttgcgtaaaaagatgtttgaatgcactatagctaatagttagtggctaaaattaattggagacatccaaacatcctagttaatagttcaattattagttatttttagtaaattagttaaagataactatctatttgttagttagctaattttactagcaaacttttaaccaactaattattagctctattacattcaaacaccccataagttttggtcggaccataaaatacgtgaaagcctgatttatatctattatctaaaaaaacacatgtaactactcatttttaaaataactcatagaaaattacaatcttttataatgaccggcagcgaaactccaaatatcaagatgattatagcaaggtaaaactgtgccacttccttggcaaggtgaaactgctcggattcgagtgagcttcccaagtgtatatttgcttgaaaaaatgttttcttgtgttccttttctccttcctgtttttaccattagcagattcattaacatgcctatcctaccactataaaggtacacaaagcttccgaagggaagaagctcttgagaagatactgcaatg

SEQ ID NO: 7492 - DNA, 1331 bp, Zea mays
cggaacgattttggtctcttcctgtcgtttccggaaattaccgtttttattcggtattttcagaaaatattaaatctaaactgatctttataaattcataataaattcatcttagcttataaaaatgtgaaactaattttattattttcctaaaatcaagatctatctaatgatatatagtttagaatcgtttgaaactttcataaatcttatttatgttttcttatgtgatattactcttgatacatatattcataatttgcacgagaacttaagaaggaccaagatgacgctaaatatattgactatgtcaagtagtaggagtacaaatagaatgtaagtgtcatatcattatacatatcttgattctattttatttaaatacataataatgattttattattgtatgacttcttactttatatattattgtgacctcctaccttatatattattactaattttatatgaacgtatgacttcgtgaatttttgaagtcaattgagggtacatgttacaatttttaccgatcgaattttagattccgatcgtaataagtgtaattttcgtaccgaactttcgtttccgatgtttccaaattaccgatgtcatttccgtttccagagttaccgttttcgatattgtttccgaggaaaaatatgaaaacgaaaatggttttagtgttaaccgatcgttttcggccgttttcacccctaccgtacccataaacgttcgtgggtatggatctgtatccatacccgtacctgacgtgtatccgctatccggtggatacccattacccgcccgcccactacaattttagcatttaacaccaaacaacaattttatcacatttcaaaataatcatcattctggcaacatcaaatgataatttcagcaccaaacaacatgtcatagataaaaattgaaaaataagaatttatgataatatattaaatctggttggcccacatgttagatatccattgggtaacgggtatggatactgaatatccatatccgcggataacttattatatccataaccgtacccgcggataccaaattccaccatacccatatccaatggataattatctgcggttatttacccatacctgtacccattgccatccctacgccgctgcagccattttcctcttgttcccaaaccgatagctttgactcacaacagcaaagctgaataacagatcactcccgtctcccatccccttcctctcctagcaatcctctgccggagtccaagctccaatcagatccggacccacccctccccctccgaagaagccctaggcatgccccgcagccg

SEQ ID NO: 7493 - DNA, 1500 bp, Zea mays
tgagcatgcatggcgagctggcgccgggaagctggttggccgggggatcagtttactaatcaggctggctcgtggattctgacgcgctctagttggggtggggtgggcgtgggcgggcgtcacgtgggcggagaggacgggaactgcgtaagcacgagtgagcacgtgccgcggggattccgggaggcccagctttattgctcgccgagaccggcaaagacgagcggccaggcccaggccgccctctggaaacggcagtcacttccgtcgagtggagctggagctggagctggagccgggacgagacgagacgacggacataggaaattgacctattaaccattctcggtgcatgcgtggcggactttccctcccctgcctgcctgccttcgtactagtacgtatgctcctgcaaggtgagcagcattgatttccgcccaggatgcttcggcatccacttccatggacacttgcgcaggctacagctcatggagtcacgtggtcgcgtgcatgcagcatgcattgcggttaaagtaaacaggattctttcttccatctctcgttctcccatttttcccacttctctctgttttttttataaaaatactggactggtacaagcagtagctgctaacggaattatgccaaggggagagagcactgcggtgcgcgtgagacgtacgagtggtggtggagcatatgaatgtgggtggacaggccagggagagggagtgggggacggatgcagtgcatgggacggggtcacgttgcctcctgctgccgtgctgggctgcagcttccgcgccgctctccactctaatttaattgtatttgtatataccccttaatcgcaagcttgttcggttacatctggaccaagagaaattagatgaaattaagggcatgtttggttcatgactaattatatcatactttttctaagttcagccgctcaaaatgaagaaactaacccttagaccgaaaaaattagacaaaatatgaaaagttagtcagcgaaccaaataaaccctaaatctctttctaatcaaaattgaatataaactgactcaattccccttaattattcctttagaacagacccctattggtaccttatatgcacaagcacaactttgtcaaacatagttttgtgccccggccacgagccccgtctctctccacccataacctctagatattaattacttcgcaacaacccccatcctggtgatcaagtgactggagccccgagagcccagcactatttcttcccccgtcgtcactcctctccctctctcgtcactccactccagcccctcctctagatctctctcccccccctcctcacacgcactcactctcgtcactgaggctagctactagctggtactggaagcctggaacacgcactgtcacttgctcgtttcaaggacctgccctgtgccaattaagtagtacgccgtcgtacggtttgctctgagctagctcttcgtgttcgcg

SEQ ID NO: 7494 - DNA, 541 bp, Zea mays
cgacagggttatgataggtgatgacacaccatatattccctaactgcctgtctagtgtctactaattactaacgggaaaattgcgtatgctcattgacgtctcagctgtgcagaagaatctcggaacatttaattcacatatattgatactacgtgctagctggtgccatcttcctagctggatactacttattgcatcaattaatttctttttttgttttctttcaattgcttccaaggtcaaactgaatgcaaaccattacttgttacaacggtcctctccatcctacgctacgcctgatgtgatgtaatgtaaatatgtaatcgaagcaagagccttattattgtatatttctgttcctaccagggcttgcatggaaaactgccagcctctcattatattataaatatacatatactgatacacatacatacacaccaaaagtactcaggactgtcatctctcagttgcaattgcaaaaaaaatacagagagagagagagagagagagagatccctaccctgcaaagagagactgaca

SEQ ID NO: 7495 - DNA, 1500 bp, Zea mays
gtggtttgtcccgtcggctccagccaaggctcaaggacaaacaagcgaactactccgcgggcggcgcgaatcgaaccagcccaacgtagaaaggcagccaccaggtaaaagtaaccgaccaggttccaacggtcccgcaccgcacctacatcattctgttgggcccaccggcagactgggccgggagtagaagccacgcgtcggcgccgcacgtggaacaagtgccgaagcccgcgcctgggtggcagccgcttataagctggccgtgccaccggctgtttttttcccaacctgcaaccctccctccctccctcctcgagctctgctcagcacacaaggacacccaaaacgcgcaggtgagagaggcgagggaatccctccccctcccgttccaattcctttcctccgctcgcggctcgcctcctcgaccgacccccccaaagcggcgctctccttttcggccattgcgccacccgcccacaagcgattcggattctcccccccacatcgtcctttccaggtgcgcgagcgtgcgtgcgtgcgagcgatccctaagctattcctctgcttttaatctctcttattattgctctcatgaggtttcgaatcctggtttatgcgataattacgagcgggggagatttgcgcacttcttccaaaaaaaaatccccccctgttgttgtttaaactcgagaatagctctgcggattggagcgcttctggtcggcctgtaagggcttggggtttccgccgcgttcttctacaatgatttggttctagctgtgtggcgtgcattttcactagctctagcgctccgagcgtcacgatctcgtcacggttcgtttcgggttcctggtgctggcgttggttgtgtttctccacctgtgctctgtatatctaccatctattttgatcagttattagtttctaggtcgccacgatcggtgcgtctaggtctgattcctgaatttaactcgattggttggtgacttcagtttgatcactttgaatggtttggtttcaaattattcggtccttgtctcaaaacaaacgattcgccgtcagacttatccttaagaaaagggtaaaagtaacggctacctgttttagattgttctaggatgctggcaggtgaggtgatttgttggcaagcgaacagcggcactaattctgttttacataattggtacgagtagtaggccttatgtcacaccgatagcgactgacatctgtttccgtggacttgaagaagggatgggcgtcatgagcaagcctctttctaaagcagcttcacctagttttggttatgatcccatttgaagccgtttcacttggaatggaatggaatggagtcacagtcacaccctttgccaaaaaataaataaatgctgtgctgtgctgcgtttgccctttgccagtgaaagaacatagaatgtctagccttacagtgtataaccatctaactaacattagcattaatgatgcaggttgcaggcttaa

SEQ ID NO: 7496 - DNA, 1338 bp, Zea mays
tggggcctgtagtgactagtgaggcgattctgtgtatctgaaagatgggactggctgtttatcttcgcttctgtatatcaactgcgtgtcatgatcagtggctgcttcgcgtttgagtttcatatcggagtcctagatcatcgaagtctttgttggtttgcttgtgagatgtttatgttgtgaacaccatgtagagtactcttctcgtaggtagaagctgccttgaagatgcttatgcagttatgctggggtctgggctctcttgtcttgttttgcggagccggtgatgagctttatgttctcaaatggtagttatctacacggtattatgtgctctgttcagcctgtttactgtattgcatattcgtcaatggagaatcactacttattattccctgtatactggataaaacaattgtttagagctagtttgaaaatcttatttttctatgggattttcattttctcttgggaaaattggaatcctttgggaaaacggtgttttcaaactagccctatctatgtttgcatgctctatatttgtattttgtaagactggtatctgaagaatttttagaaataaatttgtcaaaaacaaatgtcatatccatattgcaatgctcttcaaccttactcatgatttgcaagccgcttctagggtcggtttggtttggttgggatttggccgtgaaaaaaagctgccgtgagtgagttgtgaaaaaaaaactgtgggctatgaggtgttaaaaaactaaaaaccgttctgtagaaccattaaaaactactaaaagttcttccgaatatatactacaagaaagttgttctgtatatatactactaaaaaccgttctttagaatcattaaaagccactaaaaaattgttttctgaatccagtcttttactttgatttttggtctttaaggggcaaaagccagagccaaaaattaaaccacacatatctatagatcagtactccccctttgtaaaatgagtgcacagccaggagttaattgattttagatttagctgaatttataaaaaaaaacagtatgcatatctaaatatgtttattataaatacattttaatttgatactataaatattagtgtatgtgtatatatagtcaaatttgagattagtgaactcttaaaatgcgagttgtgtttgaagggcagaagggtgagtacacgtcagcagtgaaattttcgatttggcgcgcctcgcgcacgtgccactttacccaggcccgcagcgcaggaacacctgagggaagcgaggagacgacgaggtgaggactgaggagagctggagaggcttccagcaaaggcggcgagcc

SEQ ID NO: 7497 - DNA, 635 bp, Zea mays
tgcagcgacaccagaggcgctgagatggtgacatccgatgctggtctggcactggcacataagtatgaattatggttacgactctgtgtatgtgtcctatatgtttatgctaaaatcaattttaatatatctagtggtgtcatcatatatatttgatttgatgaaaaatctggaggtatatatagagagaactatggtgcagatatatatgttgaagacaaggaaccacttgacgataactgcaaattaacttcaagggtcatttttccaccttttctagaacgctacgcgtcgtctcttctcgaattgcttcttctcctgcttccatgcatcctctttgtacctgtcttctggttgaatattaattaattaatcttttctaaaaggaaaacaaggatcttcttcggtggtgactctgcatgtttgacagcgagcatggaattcgctgaccaagactagtcataccataaccagtgcagcatactgccttgtgcctactgcaagtgaagggccgccccaatccccgagcaaatgctatatatatgtgaacctcaagaagttgttggagagcttcccatcccaccttcaattgagcgcagctgagcaaaagccttcaccggtcggcaagaacacca

SEQ ID NO: 7498 - DNA, 917 bp, Zea mays
ggtgggatacaggttaatgtttataaattccgagggctcttttgcaagaccaacctcggatgccggtttaggaacatgtggctctccacgactggctggaaccgagccatacccaggtacacacgaggggggggatccaatctgcaccagatccccaccaccggtgcatgtgtgtttaaacggaaatcctgcaggaccgccggatcgacgatcaaggatcagaggtttatgcgccgaaggtgtgacctaccgatctatatctgtttccgtatactcaaacttatatatttaaaatgtcaatattcattcaaatcttatccgacacaactcgataatatctgtatccaatttgaacgaagagaaaatatgaaaagaaaaatatgttcgtatccgattcaattacacttctagtatcaattacatttctagtacagacgttttggagaagccaatttttttttatttttcttagaaagctgttaccgttactactttattacttagatgagagagagaaagcgcgcaagaaagacagaaagacgacactgtagtgactagtgtgagagagagctagatacagatagagatggaggtggagtggaggtgggcttggtgggacccgatagatgtccgcgggtccggccacggcgaggccagtgactcatgatcctcctctatttaagctggcgtccttcactcgctcgtcactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgacc

SEQ ID NO: 7499 - DNA, 368 bp, Zea mays
tagttactattcagtgaagagatgtcagcgcgatgcatttgtgtatatatatatatatatatatatatatatatatatatggcgtatttttcattgttcatatatactttttgttagtgccccactagcccactttaggagtacttagcaagcacaaagccacctagctttctttctcatcatctctgtgccctttaattgttccatccatccatcacagttgcctcaacaccataaagagccacaagctagctcctctcccacaaacactcgcatgctctgcacacacaccacacacacagacacactgacacacccacacactagttgtatgtgctagagctgcagttggcttggcatcagaggcc

SEQ ID NO: 7500 - DNA, 268 bp, Zea mays
ggtccagacaaaaaaggaaaagatgcttcgtctcaccgatcttcagaagaagattgatgaggctgctgaagaaatgcgtcatctcactcaagatgaccaggaccaaaggcctcagtacaaagagcttcgtcaagagagctcattcaacgaagatgaatggtatgatgactttcatcattgtaactttacttttgatgatgcttctcccctggcagcagaattgtaggctatcccatggccacaatcctacaaaccaccccagttgccc

SEQ ID NO: 7501 - DNA, 131 bp, Zea mays
ggtggctcagtggctgtggatcgccgtccacaggttcttgtacaacaacatcaagaccatcgccactgtcttctccatcgtcggcgtgctcgcgggactcttcaagaccatcctttctgtgaagcagcccc

SEQ ID NO: 7502 - DNA, 172 bp, Zea mays
ggtaactgcaaccaaacaatccggtacacccatacattgtagtcagatttgaaccaccaagggtaattatttgcgcaacatcacgaaattttataacagtaccaagcaacgaatgtccaataaacataaatcctcatagctgtatgctatataaagctctttactttcgttc

SEQ ID NO: 7503 - DNA, 186 bp, Zea mays
atgatcggcggccgccgccgccgccgccgccgcatgagaccagcgggatcgggacagggacagcaggagtgacacagggtagtcgcagcaacagtgtagttcgcgcgtggcgccgggggccggctactcagcaatcactttttgtcttgtaaaccttttttgtttttgttttggtgcttcctctgc

SEQ ID NO: 7504 - DNA, 1500 bp, Zea mays
gaaacaatccatgcatatcttgtaagtatttatattggctcaattccaagcaacctttgcacttacattatgcaaactagttcaattatgcatttctatacttgctttggtttgtgttggcatcaatcaccaaaaagggggagattgaaagggaattaggcttacacctagtccctagttaattttggtggttgaattgtccaacacaaataattggactaactagtttgcccaagtgtatagattatacaggtgtaaaaggttcacactcagccaataaaaagatcaagttttggattcaacaaaggagcaaagaggcaaccgaaggcacctctggtctgggggcaccggactgtccggtgtacaccggacagtgtccggtgcaccagaggactcaaactcaaactcgccaccttcgggaatttccagaggcaactccgctataattcaccggactgtccggtgtacaccggacatgtccggtgctccaaggaagaacggcctcatgaactcgccagcctcggtttttcacttcggctgctccgctaaaattcaccggactgtccggtgtacaccggactgtccggtgtaacagcggggcaacggctatttcggcgccaacggctacctgcgacgcatttaatgcgcgccagaagcgcgcagtcgtcaggcacgcgggagcaggcgcaccggacaatctacagttcatgtccggtgtgcaccggacatcctggcgggcccagaagtcagaactccaacggtcaaattgcaacggctttagtgacgtggctgtcgcaccagacatgtccggtgtgcaccggactgtccggtgcgccatcgaacagacagctccaccaaacggctagtttggtggttggggctataaatacccccaaccacccaccattcattgcatccaagttttccacttcccaactacttacaagagctctagcattcaattctagacacaccaaagagatcaaatcctctccaaattccacacaacgccctagtgattagagagagagatttgcttgtgttctttcgagctcttgcgcttggattgctttcttctttcttgattctttcattgcgatcaaactcacttgtaattgaggcaagagacaccaaacttgtggtggtccttgtgggaactttgtgttccaagtgattgagaagagaaagctcactcggtccgagggaccgtttgagagagggtaagggttgaaagagacccggcctttgtggcctcctcaacggggagtaggtttgcaagaaccgaacctcggtaaaacaaatccgcgtgtcacactccttattcgcttgcgatttgttttgcaccctctctcgcggactctattatatttctaacgctaacccggcttgtagttgtgattatttttgagaatttcagtttcgccctattcacccccctctaggcgactttcaattggtatcagagcccggtgcttcattagagcctaaccgctcgaagtg

SEQ ID NO: 7505 - DNA, 103 bp, Zea mays
cctgttgggtttctattttactcattaacaagctcatggataaagaaattaacctaaacctaagtaaaattctaccgactttcgggtaactggtacccatgcc

SEQ ID NO: 7506 - DNA, 801 bp, Zea mays
gtccgcgcagctaaagcctacctttggcattagtcccgtaacatatgaaacaagataaaagatagttgttgaattagtgttttgaggacattcatgaggtgaaatttaaaatatggagtgtaataaagagtgacatagagagtatgataaacgagggagcgcgacctggcccgtgataactatgagatcagtgatgcccaggaggacaagttggggaggatcggagcccggcccgtgtccgagaagcaaaggccgtccggcccattatgggcgtgtttggtgcggagcgagcgcctgtggttctgtgtgtacgaaggctagctttgtacggatatggaacatgtaaaagaagaagagattcatccctccgccactccccaacatgtaaaccagaccattctcctctccgaattcaataattcctccgccgcaccacgcttcctcctcctctgctccgcctcttcatccagcgagcgtcctccgattgctgacggatccctcctcgccgccgccgcgggccgaccggtaagcgtcccgacccccctcctgctcttcgtacggggctctgccacgatcggcgccggtccgccggatcgcgccggggccagccggatctggtacggatctcgcccgccccgcgcgtaattccgcgatcgccgcgtcgcgctcggctaggatccagccgcgcgcggcgggaatgtggacaacccgccgcttcgtttctcgttcggcgttgcctggctgacgcagtgacgtgcgtctgtggtggttgcagtggggagaggaggggaggcgggagtg

SEQ ID NO: 7507 - DNA, 298 bp, Zea mays
aggaggggggcgtgacttacagatggctggtgtgccctggcaccggcgaggagaaagaccatggggagttttgctcttttttggtcgtcgtgttgttgagtcctggcgctgattattcttggtgatcgtcagagggagttattcctgatgtcggtgttgattgctgttggttgggaagtgacggtgaaccggggggaggggggaggggttgtgtcgtgtaattttggatgctactgttgtgcatgtatagcttgtgtgctaccctgttccatgctgtttgttactcctatgccagtag

SEQ ID NO: 7508 - DNA, 217 bp, Zea mays
ccgcggaacctcaggagcccggcttttggacggcagatcgggcttttggacgcttttctcgagccgtttctggggggttctgctggtcgaggcactcggccacctatttatttattgaggacgatgcttccgcccagcagcggttgagcttcgcgttgctgatccttcgctttggtgcgtgctttgcttgctcctgacttgtgcttgtcgagagctc

SEQ ID NO: 7509 - DNA, 87 bp, Zea mays
tgtyatggatgagggtggttcagctgcaccctatgttagtcctytyagatgttttaaattcctcaagtagtagtggcwtgttgttta

SEQ ID NO: 7510 - DNA, 1124 bp, Zea mays
atgcaacttttatatcaatgtggtatttcaggacgagcatgggaacattgttatgctagatgggaagcgtttgatccatactgatgggactggcttcatatctgaaaatttggctaagaaatgccctagcagaataatcaaaggaaagaagtcaaaagtttgtacgcttggccctgtgcttgccattttctttacagaaacttattactaatattttaactttatggatgatatgtgggggttctacagatggttgtgatttttgattttttatgttctgatgtgttatttgtgggtggaactcagcataaagcctagtcgtgcgatggttgaggccccagccctcattggcgtagtttgccagcaaagtcagggaagagaggagatatgaaaagattcaacctattacttaattgttctgagtacatgcgtatacccagtggtgatgcttgtccaacaacagcctatccttgccttaggagtattgctgaccccacatgacaatttatcaagccaacacattcataccaagtatgacatagtcccaagcaatttatgtaggctagagttaaaacctaacacaggccactagtaaaaaggggaaaacaaataaaagaaagcaatatatgaggctcagtaatattgatattattagagggcctaaagtgtgttcatggtttaggcatgtgaatagctgcttttcatgcactcctgtccaagggtgattctttgggtatattcctttgtttcaagtttctccacttcacatatcaagtttgctgccccatgaataaagttttttttttcaagtttggccgacgcctacctctccttatattatttctatgccttatgattgcactattcgctggcacattgaggcctcctctggacatatccatacaaaccacaatatgccatggatttcttttgctctgaagttgttcagtggactgcttctttccattcctccgaaattgaaatgcttatgtaaataaaggagcatttatggaaatcactcctgcatatgtatgcctctgcattcagtatgcagtagtttatggtaaaggttcatacaactgtcagttaatatattgattgtttctatcccttttcaggtttat

SEQ ID NO: 7511 - DNA, 1462 bp, Zea mays
tgcaaacaccacatagaaaggattgttgaagattgaaaaaatatagaaaattgattttatgcaaatgactctccaaaataattatttagagattgaaatttagataaactcttggaaatgctctaagtaggcactagcattaagaaactcctatctaaagctatatcaaataggcccattggtagttgataatgtaagcccttcttactaccctcactaggggcgaaaacgagccaagccggctagctatagcttggtcatgtaacgaggcttagttcgctccactaacgagccgaaaaagtcggctcatgagccagctcgccgagctaacaagcttcaccataagtgtgaacttgtcttccaaattataatataaaatcttaaaaataatttaaataacatatttaaaattagtaaaaataaatatattactaatataatatataaaacatattaattttgtatagtaatctcaaacaacaaaaattaattgtctatttcctactaatattatttgttaattaaaattttatataacaaattgttgttagatcgagccacgaaccaactcacgagtcgagtcgagttggctttcacgagccacaaagcaagctcagttcgagcttgttctaaacgtcaagccaacttatcgagctcgatctttttttcaagccaacttgtcgagctcgatctttttttttcagcctaaccctcacattttcctcaaaacttggcccgtcatgtttgggcggttgggccaccwtcctattttcgtccattctcaaaaatacacgtcatgcttatgccaactttagtttggtatctttaccccattgttgtctgaggattgtttgggagaattttaaaactaagactctaaataaataatttaaaattagttctaaactttatctcacctcatattagagttttagagctcaaaagatagaatgctctaaatcatttagagctataaaatctagttggagagattctaaacagggactacaaaagagagtttcaattttaaattcttgaatatggagaacgggattgattgtaattttgcgttttctttattcaaaataaattttagtacattacagtcgtcataagggcatagcaattttttagcgacgagacacagcacattgttccttttcttttgttttttttaatcaagcatttgaatattatttgatcaattcgtgtagtggtcgaggcgtggccatgtggccccgttcgcgcggatacatgccaccccatagggcctacatgcgtagaactgcgatggtatagccgcgtagtcggatgagcgattcaagcgagaaatcaaaccgttcgtgattcgtgaaggcctcaactctcctttcctctcgtgggcgatcgactctctcctgcggcggcggcggcgatcaacgtcgacgactacggcccacgattctccttcgaagcgcgaatc

SEQ ID NO: 7512 - DNA, 815 bp, Zea mays
tgcatgcctgcagtttcatgctgttgcggctgcggtatgaacgaattgaataaggcagtttgtactctgtagtgtagtagttgcagccacgcttttatttcttttcatctaatgctcgttcaagactcgctgcaagcatttgttgctagctcgtcccatttctggaatagataaaaaaaacaaaatagataaatgggaacgagcttctgagttgtgcgtgagaaaaaaaggatcacgagaggatgaaaacttggaccaaaacttctgatttttaaacgtggaggagaaacgaatctgtacctgcgctctggtgtacccattgctggtcctcgtcagatcgttcccatcaccacgttcacggcaaggtgtaccatttgccagtaaacatcgcaaaaacaatacacttttgtagggtgggggcggcctgtttcattcatggccggcttgctgttgccccttgccgtggaggcgtggcgtggacgtggagtgagtggggatggatcaggccggtggcacgctgctcgagaaatagtcagccggccagggccaccaaccgcgcgcctcatggtccaatcatgcgcgtccaaatgtgcatcctttctggccgcacgatcgctaggattaacggccacaatgcatcctacgagaagcttccctttctcccatcaatcctccggacctccgtcctataaaccgccggggagcgtggcggccattcgacgcaggcacccagacccagcagctattgtggtcgtccctcagccgcgtcgcaccgcatcgcattctacgattcgaagctctctctgctcgcagcc

SEQ ID NO: 7513 - DNA, 348 bp, Zea mays
tacaatactacgtgcaggaatctacagtgcactgttgtgattggatattattgctttaggaacttatgcttttgctaccttctattttctatacttgtatgttgcccaattcatttgaagttcatgctttgtgcttttggggttaacctttcaataccctttgcccatgtccttggaaggcattagtgcatgacacccatatgagggtcaacaagctgacaagacatgattttttcttgagtcggttgcctgtgatttaactttgccatttggttaatagaatactttaacgtgctattgctagtaggtatctaaatctctctccctcctctcttgtcatatactcac

SEQ ID NO: 7514 - DNA, 1415 bp, Zea mays
tgcccttccatcatggtggagcctaagattcaaaaggaatgatgcctatcatagtacaggaatgataccagagttggataaaaaaaatttatcacaattttttttgttgtggtccgacatcgcctactaccgctgtcagtgtgtggctgaaaatttgctttctttcaactgaagtgacaggattcaatcctttgctaccaaacagataaaaattgcttcccttgattcattccagccggattaattacatatccggaacaagtgaaagggccggattcactgaatcctggcttgtaactgttcctagcctggattcattcttgagctgccgaacaggcccttatggttcctccttcctgtcacggtttcgggagatactcttctactgcacggcgatgttcgacatgttggacgcaaccttaccgagggagagcgaatctcgactggtgttcgagaaactcgttatgggatgctacgtgttcaatggcatctcctgtgagggcagcgaccttgtgctgcgccctaagaagtatagacagtggcaggcaagaaacgaacgaacatgcctcttctggatggctacaaagacgaggtcacgaagcattaccacaaagatttcttggtttgccgggatggccaatggcttctgcaaggatggattggtgtgcctggttagaacaacatatattgtatgctcattaattatcgtgatagtctcatgcacacctaaagtattttattactattgccccaatctgccaaaactcgagaacaatttatatgaaaggtatatagcaatttattcaagaattctattgtctcggcgccacttattctagtgtcactaaaggcaccatcaaaaatgacagtttcaaaaatagaggaatatatatagttggactgtggtggtgaaaaaagttgatgttagctgtgagttgtggaaaaagatacgagaagtgaattgttaaaaagttaaaaactatttggtagaaattaagcccctaaaagttttctatatatattcacgattccatctgaaaacagttaaaaayaggcctaaagatgctttcagttcagcgcaatcgaaaaagtcggattttagaaaaaacttctccctaaatcattcttttgatttaggttttgatttttaagggtaaaagtcagagccaaatcaccctaaaaaacattatagatgagtggatcaatcgaacgactgcatactttccgctagggtgggccgcgggccgggcagcacggttttcttggcccgacccttgatcaaatcaggtctagcgaaatccaaaagcccgttcgaccccaaacaccgactgaccgacacgactccccccttcgtcttccaatccgccgctgttcgagtagtcggcggcgcggcgccggcggccggggcggcggcg

SEQ ID NO: 7515 - DNA, 322 bp, Zea mays
atgatgcgtcctcccatgtgccctcgtttattttgtacttgtgcccgtatacttcgatctgttaaaatctattggttgtgtgccctgtgtctgttgtttgggtatctatactgttattttgagacatgttgacttgcatggtcatctggattgggttcgcatttctgagtcatttgtcttgacatgaaaatcttgctttttttcttgatcttaaaatctaggttgtctttgttgcggggttgattctaatattaaaggggacatttgggattttgcccatgacatcgttccctcgctaaaaatttaatttgtgggttcgtct

SEQ ID NO: 7516 - DNA, 870 bp, Zea mays
gccaccaataaataaaacatgtcatcattcattgactcatttatatacaggcctctctatcgctccgtttatgggccctgggccaccattcgagagtccattgatgggctggccggcctacgccgacgcacttatataaaagccccgaaccctagaggccagcagcacattcttccccgagtcgccgtcgtctgctccgggctgctgttctgcgcctccacaaggctttggcctctgttgtaaggtagcatttcttctcgtgttttcgttctccctcgctcgaactcttttattagctgcttgatgcgatagagactggatcaaggttgtactctgtcgccttgtccctgtagtctgtcctcggttagtctgtttgcgattaatgatagctactgcgcggtcttgcttgctatcttgtttcgactggatcaagtgtcagatcgaatttttttaggtgtatagctgctgtagtatctgctttttatgtctttgtagttcatgtgcagtaatagttgcaacctcatgttacgaccaaatatcttacctggtttataaagtgtcaaaattttgaatttgttttactagtcatctaaattctgcgtacaaacttagtttgctcgttttatgtttccagggttgcttatactatattgkttgctctgtagatctgctttatttccaccctactaatgtgtaccargccttttctaagctggtcacagtggttgcaacttcagatcgatatctaagctgatcactgtgtttgcgacttcagatcgagattctgatcctttagtattgtgtgatttttactggtgtttctaataatcgattcatccggtgtaacagttttaagcttcacctccagcc

SEQ ID NO: 7517 - DNA, 460 bp, Zea mays
tgcatgcctgcagacagcctattgtctcttatcactgccggaacagaagacgatgtgtgggcctttgatcggcaatggtcctcgagaatgttagggagatgtgtgggctcaggtatgtcgaagtgtcgaacgatctcttggcttctgtacagtttccctggcttgaaaactgctgtgttcctgaaccattttttaactttttttttacctgtgttacaggtggcaaagagcggccgaaggtggtctgtgcatcaagggcctcaacagcgacatgcacacctcacacaccaagaaaaccaaaaaacacatgccagaaaggaaaaaaagcaaacaaagaaaaaaacttgccacgtatataatcgataattgatgatgtattgaagaacagagttttgaaccatggagcagtttggaagttttacatgactggggaaaaaaaggacatgggattgtagctttt

SEQ ID NO: 7518 - DNA, 219 bp, Zea mays
gctttaggaaagacagaaaaaacattgaatgcaaatcgttagtcagaacaaacacagaactgaagaaaacgggattgaagtaaaatggtcattaagaattgcagcttgactcaatggcttaacaaaacaaaggcaatagatacccggagctcacatgttctgctaactacaccataggtccacaagaacaaaagatgcttcgctgagacaataccatgc

SEQ ID NO: 7519 - DNA, 249 bp, Zea mays
aaggtgttgctcctgaatcaagggaattgtatgacaatggcacctaggaggtggcaacctattgggttggtcaaacaatgaggcaaattcttgaataagactttgaatctcgtgtggtagactggtatgggattgttggtcagaaatctgttgtaactcaattgtgcaccaaagttcatccaatttgtctaagtgatacagctggcatactgagatctgctccaccattgaagtatcagacaactggcc

SEQ ID NO: 7520 - DNA, 280 bp, Zea mays
actccgacaatgatctcagaaaagacactcgcgagatgctggtccatctgtgaatggtgaaagcgctgcaaatggaactgaggaaaatggcaaggctcatgaagtagcagatagtgagagctattcagatactggcagcattgatggacgggaagaagaggaggatatattatctgaggataaatcaaatgatggctcagataacgaaggcgacgatgaagatgatggcattcctgttgtttctgatgaagatgaaaatgttgaggttagacagaaagtc

SEQ ID NO: 7521 - DNA, 64 bp, Zea mays
ggtaagaagacagagtttatcgatacttccttattaggcagaactatttcctcctacttgtggt

SEQ ID NO: 7522 - DNA, 74 bp, Zea mays
cgtacgtacagtaaaaaacaaagcagttcttcttcttcttcttgtacaggcaatctgagttgtctctggcagag

SEQ ID NO: 7523 - DNA, 452 bp, Zea mays
tgcagcctccgttctgtcgcccctccgccgcacgaactcctcgaagccgcggacctcgtcatcatcccggtctcctcgagacctgtgccgcgtgtgagactactactcctactccaattgcacggccatgtaaacacctctcaggagttgacacaaaaaccagtactgcggctaggattagtataatctgctttacgtgcaaacaatattactgcaaacattgactgccacaaaggaagtattcatccttactagttactgcgttttccttgataatgcctggattgtttctgtttgacccacatgattaaaaggtataatctttcttcttacaatggttactaaaagcgcatgaacaggaaaccaggatcggttacaagtcatccctgagctggccctgcagatcccgattccgcagggaggcgggagaggtgaaggccgcctcgccgcag

SEQ ID NO: 7524 - DNA, 1500 bp, Zea mays
cagtacatccaaccagatccaacaatttttttgttcaactgaaaacctctcctgctgctgctgtctgaataatgcttcacatttttaccgtcttcattggctggtaaatacagtaaattcttgtttgaatttatgcgggaagagagacccaaaaaaaaaaacaattcccaacgtgccgtgcaatatctgcggattgcagctgcatccactgcgcgccgcgcgtttttttttctctcctcctcgacaacgagaagtcgagaacacacacgcacatacggaacggaagctactagcccgcagccttcttcagtctcccgtcttcttctggtgcccaacacatcctcattctcagggtcgccctctcgattctccctcaagtccagtccagccggatcaggtccccttcccctcctccacaaggtgccgcctcccgcagatccgaattggaatctgggccttcgtctccgcaccaccaatccggtaaatatacgcgggcaataaaaatccctccctcccccccgaaccgtaatgatagatagctgcttgcctgctccggagtttcttccgctgttctctctcgcgcaaatttttatgctgggcaaagacggtgttcttcagcttcgacccccaaaaagggcgaagctttcgcgtccttccccacacacacaaattacctgggagccgtagcttctgtttggtgcggccacggggtggaagaaatggtatgcgggatgctcgccaattggcatgctggcgctttccgtccctgcagccgcaagaggccttctcttttagatctgtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaaggtaagctgccccctcccccccccccccacccgcttggaagaaatggaaataaataaataaataatgctttggctctcggttggagaggggcgaggaattagcttccccgcatccttcggtggtttctgatgtcttggttagaaaattttatgaggttgcttgataagaatcgcattttccttctatctgatctctcaaaatgttcgcttatctcttgtttttgcttgcctcagtctacttgcaagatctgtgttcagttgacttgagttcttctcagcttctttgatgtgaggagattggcgcacgaaatcacgtagcagtagctcttattccccactcgcgttttaacctgagctgcggcagttggcattcttcattcagtcgtaatggatgggatagctcgtaataagggcggtgcttcgcctggtacaggaaagggaagggaagggaagggaagtg

SEQ ID NO: 7525 - DNA, 1500 bp, Zea mays
ggatgtattgactatatatattaatgagtatccttttgaactgtaggacattgtgatatttcctgaagatttgtataagtttgtaatttatataaagaagtctgtaagatgcaattaacatgacatcattaaatcatatatagaaatctgtgtggtattgatggttgtaatgtagtagagaaatgagtgatggttgtaatgtagtagagaaatgggtagattaaattaaaaaagattatgtatggctaagatcatagatagattatgaaactttttctcataaaagtataacacgcatttgtttttccgttcccgactattccggacctgatcccgtttctgataataaaatgcggatacggaaacgggagagggggtttttccgtccgttttcgtctgttttcatccctatttgtatataacctattgtgttattatatgtttccgcttgcaacgcacgggcactcaactagtgattgataaatttcttagaggtcacatgacgctgccctgagacagttgtacctaatggcgtagactctggtgtccattaatacgattagacatatctactcctatgataggtacgtctgtcattgcaactggacatcctaagaatccgtaaccatgttaggttgtggccagtaggtcgtacatatatccgtgcaaaatattattttacacttcagattcacatggtttagtttgaagtaggaggtgagatagataaggtgctatagatagccttacatagtctctaatgatgcctctaggcaattggctgtagggatgaaagtaggatgggaaaatcccgaaccgaccattatcgtataaccgattttgttaattttattccgatcattatcgaacccgacttgaaaaacaaaaatgagacaaaacgagatatcaaatgcggtaaacggaaacgaaaacgatagagacatttttccgatcgttttaccgggatctcgttgtgatgatcccgtttttgtctcgtattttcaattcgggaagaaatccgcctcatgccagcattcagcccataagtagcccataaccggcaaccctagctttctctccatatgcccacggttggctccacgccactaggaggacttatcctgttcttgtcatccacgccgatgccacgaggcatcaagactcatccacgcgaccaaccgaccacgccggagctggacgcatccatgccgccacccgccatcgcctccagcctctaggcgatcaggcagccatccacgccgccgccacccaccatttaccaatttggttgtattgtctccttgatggcctgattaacatctctgtcttcaggagaatagacgttcattatctgtatctattatttggtctgttgtgatcaatcaaaattgatgactcacaaagaagttcagcatcgataaatctcatcgtcattgtcgtcattatcatttaataaccgatgaatttgctctcctggttgcttctgaataggtctgaagg

SEQ ID NO: 7526 - DNA, 1500 bp, Zea mays
cactcaactagtgattgataaatttcttagaggtcacatgacgctgccctgagacagttgtacctaatggcgtagactctggtgtccattaatacgattagacatatctactcctatgataggtacgtctgtcattgcaactggacatcctaagaatccgtaaccatgttaggttgtggccagtaggtcgtacatatatccgtgcaaaatattattttacacttcagattcacatggtttagtttgaagtaggaggtgagatagataaggtgctatagatagccttacatagtctctaatgatgcctctaggcaattggctgtagggatgaaagtaggatgggaaaatcccgaaccgaccattatcgtataaccgattttgttaattttattccgatcattatcgaacccgacttgaaaaacaaaaatgagacaaaacgagatatcaaatgcggtaaacggaaacgaaaacgatagagacatttttccgatcgttttaccgggatctcgttgtgatgatcccgtttttgtctcgtattttcaattcgggaagaaatccgcctcatgccagcattcagcccataagtagcccataaccggcaaccctagctttctctccatatgcccacggttggctccacgccactaggaggacttatcctgttcttgtcatccacgccgatgccacgaggcatcaagactcatccacgcgaccaaccgaccacgccggagctggacgcatccatgccgccacccgccatcgcctccagcctctaggcgatcaggcagccatccacgccgccgccacccaccatttaccaatttggttgtattgtctccttgatggcctgattaacatctctgtcttcaggagaatagacgttcattatctgtatctattatttggtctgttgtgatcaatcaaaattgatgactcacaaagaagttcagcatcgataaatctcatcgtcattgtcgtcattatcatttaataaccgatgaatttgctctcctggttgcttctgaataggtctgaaggatgagaaaggggctgcatcctcagatgcaatggatctcatatgtgacgcagagtggtaggctgatcaatatcatgatgaccaaggtgaaccataccggcaaagtgtaccacatgagggccaagcgacaaatggctcaaagcctcggccagatcgcaaagttcaaacgtcgatacgagcaggaagcagtggaaagcaaggacaagtagttggaacggagctatggcctctgtaacctaagtcggttctgttgactgcacagttttcagctaaggacatgattttattttagatcacatcatcttttcttttgttccacttcagaattgggtttgtaccccgtcgttagcaaactatggcacttgttccatcgtaaagccccaagaaaatagtctattgattgcttttttttctctgtcctttgagtttcatgattcatttttattttgtcattgctatgtttg

SEQ ID NO: 7527 - DNA, 61 bp, Zea mays
ctgatggaccgagttgcggccccacaggggccgcattccaagcagcattcaaaggtgcttt

SEQ ID NO: 7528 - DNA, 735 bp, Zea mays
ttttttgttgcgagaatgaaccgtgacgttagtgtgttttgctggcggttaggtgcaaaatactcgaaacctgaattgcccgctcgctatttcgggttgtaagtatatgatgaatctgattttagttgcatggtgtacccatcttatctgaaaataatgaaagatctgtttgtggttgactaattacgtgtgtgtttttttctaatgtcgaattgcgatgtaactggactaccaatctgtgatttaacactgacgttccgttccttttttttggttgaaatgctactaagaacagctgttcatatcacttgaaatgctacttagaacagctgttcatatcacttgaaatttgtggaagcatgcccgagccagtcgcatccgtccgatcatcgctcggaccgcccgatgcccgccacgaccatcgtcctcgcgtgtttggcccgcgtcacggcgtcaggtcgctcactcccgtcactccttatcccttcccatcgatcccatgccctgttgccgcgcccgcacctccttccccatccgcgcccgccgcggctcctccggcagctccgccacgcgcccaaccgcaacctgcccgcacggccaccgctgcctggtagtatctatcaaatcagccacctgtcctctttttcttcaaatcaagtccgtttccctttcctttctaccctctccctcgtctccggcgggcggtggcctcacctccctctccccgtcgccctg

SEQ ID NO: 7529 - DNA, 814 bp, Zea mays
agagggagaggacaatcctcaccgacgaagtggaacatgtgtggaggggcagctccgtcgacgagaccttgcagtgcggcaatgtcgacgcgaccttgcgcaagtccactgacatttaaaattatactaaaaactcaataaagagcctattataaaaataacaaactaaactctataatagatgccccttttaattgtttgttaaatttatattaattttatgtaatcgatttgaaattgcctataaatattgtattttctaataaagacggattgtcacggagataaatttcctgcaggacgagaatgaaagaaaaggctttcccttagacattcatggggcatgatgggtgattttttttctccccacacagaaaagggaatttccgttgccagcacttgagatgggtgctctactgctcttctcgtccgtgcctttgttcaaacactgtgccgggtcccctgtagtgcttcacatcattactcgactaccgtaccttgtcggggcacgcttctacgttgtcgtcgttgtggagggagcgaggtcatcgtagtaaatgccggcgcaaatcgcagagcacagtgaacgtgttcaatgcaaacatgcaggggggagccgagcggtaggaggggcatgcgtaggtagctacacaatttaatgcactcatcagaagggctctatcgctcgctatatgagccgcgcaacaccacagcagcggccagcgggtgcagtgtgcagcagtaggactgccgactcgccattgcatcgggggcccagctcgccctgggctctcgcaaccagtggcctctggcc

SEQ ID NO: 7530 - DNA, 1500 bp, Zea mays
tatatcttaaattttatggactcctttatctttcttggcaacctaagttttgtaatatgtagatttctctataatcaaattctcccaatccagacttgaaaaagcttatcagaaaaaaacttagagtgtatttggttgagcaggagaaaaatagagtggctttattttcatcattttagatgtttggttttcaacaaaagatgagcraaatgattcctgaagtctacatatgaaaatttaatataaataattgaaatgcttccactgcacaaaagcaattggacttgagggctctttcgaatgcgagcgctttcctccctctcctactctctacacttattacggatctccaaccaaacatagaacgaggtractctgctttattctacttttcaactaaacaaagattggaagatctttattctatttaacaaacatagagataatctattctaattgactcttcaaccaccgcaccgaagagagtagaggttcacacgaaagtccagccggacaccgcggctcccaccttgcctctcgccgcggccccgatccctcgcggtgaaacggagttattacggagttttctgacggcagtaacacacgctactacgttctgacgactcgccgacaccgggcccgagaaactagctgaacaaaaagcgtaagccttgtaattatttcggtacgcaaaaaacgcagcccttcacagttgagtattgttgggcacagccgcacaggtccagcgctgcaaggtaagggcatgtacaacctagacactgttgcacggtactccaagtataagacataactaaaacacaacataatacagtgagtatgtctaaaacatgtgtcttaccatatttattgtaccaatcagatcattcaataaattaaaatgaccaatcagctaatctcctgtctcgaacatagagctaagacactatgtcttcgtcaagatacatgtcttgagtttttttacaatcacccccctagacacactcgaagacacaactcaagacacccattgtacatgccctaagatgactgaaggcgcgatgtgttccaacggtccacctcgaccctcggctcaccgtccagacagagcaaccgcctaaccaagatgcggagctcagtgaccaaccggcccgacggctatgatcttcttcgcgccccgctttcccttatagaggaccatctgaaccgttggatcgaagtataaataacgacggacacgcaagaccgatccctctatttgttcgcacgtctctcgtgtcacctcccccgtttgttaccccgagaaggcaagccgaggcggagccggaacgggaaggcgccgaagcgttcgcggtcgcggcttcgcgatttcgggtttgttgttcgttctctctctctccgtccgaaccccccataatctctggcgctaaccctagcccaatgcagcaggaggatcgcctttgagagcttgcgctgggtggtggtgktggagcggcggcgaag

SEQ ID NO: 7531 - DNA, 1500 bp, Zea mays
atagtccgtgtagttcatttcacaccattccttatgattggactaaagtgaactttattcagaacgtgcttaactttattcagtccgtgtagttcatttcacaaagtcatacacaaacagctagccgctggctgcatggtgccaccggccacgacgctgactgcagtgtggcatggtgtggcctgaccatggagctcaagaacgctctcacgacttcttcttatgcgtctcctctaatcaaacccatcacgtactccgtccaccgtcgccgcgtcagggcttgttcggttctactccaatccatatggattgaggggattgagcgggtttcaatccctattaagtcaaaatctctctcaatccgtatcaatctcctccaatccatatagattgaaaataaccgaacaagccctcacagggcacgatgatctctgccgtcgccgctcgcgaacccaaactttgccacttggatgccatctgcataagtctcttggcattgatcatggttggttgccggctctcctttgctgagtggaattcagtgtctggtggtgttcagctagctagctagctagctaggtgtaatgcttagcttcctgaggggttgatgaggaatcgctgctaagatggtgcagtgcatttataggtgagaagaaacagcagagcaattccttagacaagcccacgacttagaacgacatgggagtgctgtgcaaggataaaacatggtgtggtactgattagcttttgctctggggtctgggctgggaccatctgtttggatccaccacccagtagcaatgtctgggtagctaggatatatcacaatgtgctgccatgctgcaatgcctcatgggccaccgaacaccacatgtacattgggttcaagatatctgacagttcctcgacagctttatcgtctcttcaattggcggtggatcgagtctactatctgattaagcctgtccagcgccggcggcccacacaagttgctcgacagctttatcgcctcttcaattcagtgtctgcagctggaccagtagcagcacgtcatgtgagcttttatttcgcagcattgcattgccatctctgatcgagtcgagagtcgagacactcagccagtgcttccgtgcccatgcacgttttgctgtcccttgcttgttgatcgccgatgcatctgaagacacaacaagcatggcagtccaggcactgaaagcgccccatgaccggcaccagcatgtgcccgacgacagacactcggccccatcaaaatctcatccaaaatcctgctcgctgacgcgtcttggaacatcgcactcttgcttgcccacccaaccatttcgctccagcggttgatcagtgagctatatatactcacggtcaggtggcctctggacatcatcgcttgcacttgcagcgtcacaagcaaaccgaagctagtcagtcacacacagctctccagcttccatccacaaagaagaaggaaacaagctaaccatg

SEQ ID NO: 7532 - DNA, 1500 bp, Zea mays
cgaatagtccgtgtagttcatttcacaccattccttatgattggactaaagtgaactttattcagaacgtgcttaactttattcagtccgtgtagttcatttcacaaagtcatacacaaacagctagccgctggctgcatggtgccaccggccacgacgctgactgcagtgtggcatggtgtggcctgaccatggagctcaagaacgctctcacgacttcttcttatgcgtctcctctaatcaaacccatcacgtactccgtccaccgtcgccgcgtcagggcttgttcggttctactccaatccatatggattgaggggattgagcgggtttcaatccctattaagtcaaaatctctctcaatccgtatcaatctcctccaatccatatagattgaaaataaccgaacaagccctcacagggcacgatgatctctgccgtcgccgctcgcgaacccaaactttgccacttggatgccatctgcataagtctcttggcattgatcatggttggttgccggctctcctttgctgagtggaattcagtgtctggtggtgttcagctagctagctagctagctaggtgtaatgcttagcttcctgaggggttgatgaggaatcgctgctaagatggtgcagtgcatttataggtgagaagaaacagcagagcaattccttagacaagcccacgacttagaacgacatgggagtgctgtgcaaggataaaacatggtgtggtactgattagcttttgctctggggtctgggctgggaccatctgtttggatccaccacccagtagcaatgtctgggtagctaggatatatcacaatgtgctgccatgctgcaatgcctcatgggccaccgaacaccacatgtacattgggttcaagatatctgacagttcctcgacagctttatcgtctcttcaattggcggtggatcgagtctactatctgattaagcctgtccagcgccggcggcccacacaagttgctcgacagctttatcgcctcttcaattcagtgtctgcagctggaccagtagcagcacgtcatgtgagcttttatttcgcagcattgcattgccatctctgatcgagtcgagagtcgagacactcagccagtgcttccgtgcccatgcacgttttgctgtcccttgcttgttgatcgccgatgcatctgaagacacaacaagcatggcagtccaggcactgaaagcgccccatgaccggcaccagcatgtgcccgacgacagacactcggccccatcaaaatctcatccaaaatcctgctcgctgacgcgtcttggaacatcgcactcttgcttgcccacccaaccatttcgctccagcggttgatcagtgagctatatatactcacggtcaggtggcctctggacatcatcgcttgcacttgcagcgtcacaagcaaaccgaagctagtcagtcacacacagctctccagcttccatccacaaagaagaaggaaacaagctaacc

SEQ ID NO: 7533 - DNA, 1500 bp, Zea mays
agaaacaccaatgtcttctatgcaattttttgggtgtgtcaaaaatatggattggatatatttattgcttatcaaatcttatttatcatgcctatggtcgtggaatcagctgagctttttcaaaattgaaattatcgaataaatattcaagctctaaaacgtctcaagaaccactgaacgatttgacaattttatgtattaagaagaaattactatatgaggttgatattaacaccaccattgatgactttatattaagaaatgttagaagaaagttttaagatattatacgaataattttataggtttttaatatgatattagtttatactgataaaatatgtgtgtgtattaagtaagtaaaattatatttatatagaagaggcctcgatctttgaatttgtcctaggtctctaaaatgtcatccgactttgtggggtacctaatattggcattgtggatgtcgtagcaaatacaccggtgtactaaaggtacctaaggattgctagggcatagagagtgagccatgacaccatagattatgcattatcaagtcatgacattacaagtctaatgcacaaggatttttattaaggtttggaccatagaatgcataatatcctacatgatcttcttgatgatgggttactgaatgaagaatgtatacaagattacatgaaaggtttgtgcttgtccttgcatgaacacaacgagagagagaggaaggagatgtcgcagttataggggtggaacctcgatgccaagatctatagcactggtctcggcattatgacctacgatgttaaggtattgccacatcagggccacatgtgtgtccacgctgctgacgacgtgatgcctcagtgcgataacctataacatcaagtcgcgtaaccttggcgatgtggaggtcacgataaaatccaaacacgataataactttattaaagatgtaaacataaaatttttgataaaaaagataaataaaataaatatcatacactatacgatgatggttttcagactaacctagataagacatggtgatgatgtctttgcaatatagtttttagactaactaaaagctactcctaagtaatagttgacatgaacttacgttttttccttttttttctagtagatgtgaggataaactaatataagcacactataccagtctagtttaaaacggtgggtctaagatatatagaccattcgaaattgtcttgctcacttgtcgcgactccggcccatttcattccatttcattccactctacattttcaccctgcaagtctcctgtttcagctctcttcccttcactccatcggctcgtctgtacagcatcccgtgtagcgtgtatccacctcgtcgccacctcaatcctcattccccaatcccgtccgcttctctccccgtcccttacctcgcccaggaggggagcctcccgcttacaaaccctagcctctactcctctgagcttccaccgctccgctcccc

SEQ ID NO: 7534 - DNA, 1500 bp, Zea mays
ctttatgcttcaacatgtgtgtctgacttagagatagagatttgagtttgatttgcaaaaacaaaccaagtggtggcaaagcatgatccatatatgccaaaattgaataaaactcaaatttatttcatttgaagtgattttgcacttgttctagttgctttatgttgtgttggcataaatcaccaaaaagggggagattgaaagggaaatgagcccttgggccatttctaagtattttggtgattgattgcaaacacaagtgcttaaatgtgaatctatgcccatggatgaacaaagtgcaaatcttgagtaaaggtatgtttctaagccttagtacattggttttgtgtactaatatacttgtctaagtgttagaaacagaaagaagaagagttggctgtgtacagccaaaaaggctgtttcggtctggggcaccggactgtccggtggtgcaccggacagtgtccggtgcgccaggctgcctcgggcgaagaggccgctctcgggaaattgccgacggcgtacggctaaaattcaccggactgtccggtgtgcaccggactgtccggtgagccaacggtcggctgggccaacggtcggccgcgcgatctgcgcgagacacgtggccgagccaacggtcggaagggggcaccggactgtccggtgtgcaccggacatgtccggtgcaccaacggctcccagatcttcaacgatcggcaacggtcggcttcgctggttatggaaataaatcgggcaccggacagtgtccggtgtgcaccggactgtccggtgcacccgacgacagaaggcaaggatggccttccagatttgctctcaacggctcctagctgcctttgggctataaaagggacccctaggcacatggagaagacacccaagcaaccttagagcattcttgatcatccacactcagtctttgcgcattcatttgtcattctaagtgattcgagctccgttctagtgagaactttgagatagtcttttgagctcgattcttggccgtgtgtgtgcgcattttgctgtggatttgtgtgtgttgcttctctcccttactccgtgcttctttgtgaacttcaagtgtaagggtgagagactccaagttgtggagattcctcgcgaacgcgataagaaaagaaaagcataacactgtggtattcaagttgatcattggatcacttgagaggagttgagtgcaactctcgtccgttgggacgccacaacgtggagtaggcaagttttgtacttggccgaaccacgggataaaccactgtgtcttctctgtgttgaactctttgtggttatcgtattgtgcaagatcttctctctagccacttggcattaactgtgctaacgcttaatcaaagttttgtggcttaagtttttaagttctacaggatcacctattcacccccccctctaggtgctctcaattggtatcagagccgttctcttcaagaaagggactaaccgcccgaagag

SEQ ID NO: 7535 - DNA, 1084 bp, Zea mays
gtttcagcaacataattggcacactacctagatttgaaatgtataaaggaactctcccatgcagaacggaaatagctgtggtggtttctacaacggtagctttatgcaggaggttagtacgctagagctgaagcacacttcatgaataaggtataaatttggtcattctattccattctatttccaaaattgtaaggtattgggttttttgcttgctttctaggttgaagccttacgaaccttgggcggacgggatgtggcctgcgcggaagccagatgcacctgaggttccagaagctccacgcgcgaccgatcggaggacgcggatggtacgtcgagggggaagctaagctcacggtataactttccagcctcagcacgggaatccgatgcagaggcgggagggaagctaggaacaagcacgctcgacagaggaagcggaaggtcatatcgcggatggcgtcgagggccagaacgcgacatcggggcttctttcgtgtttgagcggcaggagcgaggcccatgagatggagcaggggcggggccacgaacaatgtggacgccctcgttccactcttatgctattttatatctcagaatgtgaatacttatgttttctataataatcatgggccattttcactatcctgggaaattcggatctgtgttcgcctcaattcctggacccatctttgcagctctatatatgtttcagaccaaaatatttgtttcagactacgttaggttattatgtgtttccgttgcaacgcacrggcactcacctagtcaaatcttatggacattaattaaaaaaacggctggacatccacagacttcactaacaaccaattaaaatctaagcattatatagattatagaacggtaacactcccatgacctaaaactaaacctattgaacagactcgactgaaactaatcaattaattaagaacctataacgattaacagtcactgctaataaagcacccgcatgtttaacgaccgatggatgtcactgctaataaacctatagaaagtttttgatggactcctcgagctcattcacgacggccttccagccggc

SEQ ID NO: 7536 - DNA, 183 bp, Zea mays
cagcgtgtaagaatattcacaacagctgatccgtctagcaacaatcttgaggtaactacgtgatcagcattcattttataaattttgtcttgtatatattaggacatttacgtctttttaactcatgtggttctttataggttgttattctttatgatttcaaatggtactttcttctgaatg

SEQ ID NO: 7537 - DNA, 251 bp, Zea mays
ccacctagcacccaccgtcccccgtgcatctcctatatataaacctccagcagggcgccacaccagaaagcgacacgaccgcgcccgaggagaccacaccacaccgcctcctccgcccgccgattcgtcgagctcgccctcccgctcgcctagctcccctgccttttcccttcctccccacctcctgccccgcgaacgtgctcccgcatgccaccgcgctgacgcgcgcggcggacgacggggtcgggatc

SEQ ID NO: 7538 - DNA, 172 bp, Zea mays
agtagagctagagagtagtggcgagtggctcgtcacgtcatcagacacggccacgtgctagctgtatttcttcttttcttctttctctaggtgtaattcatggcagcttttctctattttgtattgagccgacggattggagtttggagcgtgtgctgctgcctgctggtgc

SEQ ID NO: 7539 - DNA, 130 bp, Zea mays
atcaccgagcagcggctgcggcggcagagcacgcaagcccgccaccagcacgaggaggtagaagaagaagcgaaccaccagaaagccccaagcgaagccgaagcgcaggcgacgatgggttcttgcggcc

SEQ ID NO: 7540 - DNA, 727 bp, Zea mays
cttgcctcaatctccatacgttccctccaatctcgtctagctcgatctgtaatatttcaccctaatattataataacacaattctgtcattattgatagctagaattaagtgtgatttaacttaattacgaccaaaatcgtgtggcgcgcgccatttactagtaaattgtaaaatagggggaaaagaagcgcatagacggaaagcaaatcagatgaatacaaccctgtgtatgtgtgggatatgcagttggccagccgacgtcgctgctattaccgcgtgtcgcgcaccactcagcttgacctcgtctactagaaggaaggcagaaggcagagccaagttctagtagatagaatttcaaaggaagtaaagtagtcagcagagcgcgtcttgcgcgccgaggcgaactgaattgactgaaatcggaagagcctgccaccagtccagacttgctccggcgatgtctccacctagcttctcctactcgcagtcgccgccggtcgcgtattattttccggcaatcatatgttcggtcatatatccttcgctcccctgccgtgcgtacgtcgtttcagcctctacaagtagttccaagccagcagtacctctactaccccccctgacgatctcaaccagcaactcaacaccgtcgctttcgttccattcctacgtatctgtggttgtggttgtcggcttgtcgctgcagctgcactcgccataccatatgac

SEQ ID NO: 7541 - DNA, 1285 bp, Zea mays
gtgggctattttatcttttctgttgggctcattctatctgtggtagagatgctgtcagcagttaagacaaaaaatgtaccaaggattggactgctttgagcaatacaacacagatcctccaaatggaagtagccaaagttgtttgtttatttgccattgctattgatagaacttacagtgcaaaacaaacgacaattgattggagttgtatgaattgattgtgacttttatggcatatttctgcattatcctgacttgttaaagttctaggttggatacttggaatttatgcagccttcgtgcaaaacaatgtatcagtatataggattatgtagttactgatctttggcaagggcttgaagttagatgtcttaatgactagagctaccttgattttttttcctgaaagacctgccttgatgattttttttgcagctttgcttctagatttgctgtattttagctttgtttctagattttctgtatccagaaaaaaatggtgtagtatcaaattatcaaaatttacacttatgttatgtgatgattgattgggacacctttaagaaatttatgagatcaaaataagcaagatattcaaggtcatttttaattagtcaataaatagttatgatgttacaagcctactcttcatatcttcaggtacattctcaaaccatccttgctccctgtcaggaataaaaagatggattgctatttattatttctttaatgttcctctagagaattggttgaaaatgacgtgtacattgggaaactttgtcatgcaccatatagcactttgcacggtccattagctcacgattcaaatacatgaatgggatccaattgcttgttggttagggaatcttgaggggttgtcggaattggtgttagcacttggcaaaataatggtgcagagttgggtttgcgttgcgtgtggtgctggtttacgctgcctagttcaaaataacaaacatgactagtccatttggtgcatgctgagcgagccatgctgaacctggttgatccctggaagctgctggggcgtcgtatgactgacgatcagrggttgctttaaagcacaggtagacttcaagttctgtttcccgcaagttgccattgcggtcctgaaatgaaaaaaccaggtgtgggaatgcggaactgtccatctacaaaatcagtggcagggatcctctcattataaagttatctatagagagcaaggacaagaaagaaaatagatatcttggctattcttttgtccagctgggcaatcgacaaggtg

SEQ ID NO: 7542 - DNA, 112 bp, Zea mays
acaattgacaagctcgctccttttttttttattgttttgttgcagaggatctgattatggttgtcggtttaatttcgttgtgagcatcattgtgttaatatgttttattgcg

SEQ ID NO: 7543 - DNA, 1349 bp, Zea mays
tggtccttttccctgacccatatttgcagagacaaatgggatgattccaccgggctcatgaaatgaactcacgatatacctcctcatctaggatgagttgatccttaaaccaagcacccctaatactgtctatgcctagatctgccatgattttttattcaagctacgaaacaaattacaaaccataatactattttcctaatagtttatccttttacatcactaaacttgatatttcattacagaatggagttcattccctccgtccagctgtatggtcagaatataggagatggttgatgatgtccaatagcttgtgtaagtctcattcgtcttctaagatattatttgtagttgtcagtaaccagtgtatctattaatatattgagattaaaataactaactcaatgaaatatcaggagagcttttcgttgtattgctttgtattatagttattcaattaaaggatacattttgtcatggttcttcaattgtaaggttactttttaccttgtagtctgagggagaagcacttccatttggttttgaaatgtccaggcgatctgaatactactaaaaattaattagcacatcagcttcttttttttrtatttggcaatggccaatgagtactgtagctgacctgttctctgraaattgttactatcttccttagcaacatgcttttgcattatgttttagaaatgcctccacaatgatcagttactgatcgtcggtacgatgtccactagcgtgaattcatcaagatgaggtttacaaatatattgtatttgctatacgtgagacttttggatcctctggtatcattgtggcttgcatgccagtactttgtataatagagattatgcgagtaatcttaccagtgatgtcgttgtcgatcttacgcttggtgcccctaataacaatcttattaggtccatcagcctttcctgttctgagcaagttgaagtaggcattatttgtctgtttgaccaacgacatcaatattgtgataaatttatgttttgtttatctactacagctcaagactgtgactaaatttcaacggattaaggtggatagcgtcagatttgaagatgagaagctttaggatacctcgtattgggctaacattaccattcccatggcaccgttaccattccatgtttctaatgcactgagggtctgaggccacgcttctgtacgtgcctaccgccaagacaccttgagctacacatgtggtttgttattatcttgaaagcgtaattgtgccaatactataaccttaatatgcttgcttgatctatattgtttctgccatcaagaatgagtcaattagataaggatat

SEQ ID NO: 7544 - DNA, 1300 bp, Zea mays
catgtggtacacatctctgtttaattaagttattttgttaccgttttggtcattacattacagctttaatcatttctttacaatttcggtcattttattactgttacaatttaatcgtccagtcaaaacacgagacacacagtagtccatttgagcatgtggattgatcaggtacgacaacgcccaattagagcatgggacacacggtggatggtttagaatgtatrggggctgatctgcacatcagtgattgtttgggtcggtcatgcctcaccctatgtgatgaatagtgttgtatgccgtctatattatagaacactcaaatctttctgctctcatccatttttgtcttggacagaaacaaaaattagctaattcgatgtggctttaattcacttgaattctacttttttacagtattttcttatatagattgcagcaggagcaggagtgcaggacgatcagttggctgaatatcatcgtcctgcgaactgccgcaccattttctaatccgcagcagttttaagctatgacctccatttttgtcctgcttccaacttccaacttccaacagcctcgcatactgctgtagtagtgctgccttctatacatggacggaaagagttaaatcaacctataactattacaagcttacagctccagcaaagcaccgcaggttatgatgaatcaaaaaagtgaaacccgttagttaaaatagttaacggataataactgccatacctaccgacgaaatccacaatatactagtattctatagatagcaacgcgtcggagtcggagtgaagctgtccatttcccaccaacccaaactcgtaccgtccaagacggggcaaagaatgcccggggaagccggcgagctggagcgtggcggcagcttggaaccggtcgtcctcctccctccccgtcgctcccgacctcttcctcctcctaatttaatcccacccggcctccccggttctccccgaccgcatccccccttaacctcccttcctcctcctcctcctgcggtcccaactcccatacttcggttcaggaggcaggcaggcaggaaggcaggttcgaggggggattggctccgctcctgctccattgcgcgcgatcgggctcgttcttgtgatctatctagccgtttcttgggtcagtgctggaaggtcaaactgttggtggaaacctcaccggggtgcttcaacgaacgcgaaggtgtcgctgtcatttagcgcgtcttgattggatttgacctgttggcctggtggcgtgttgtcgttgattgagctcgagg

SEQ ID NO: 7545 - DNA, 691 bp, Zea mays
ttttggatccaaatcttcaaagacggtaccttgaacttgctactttatgtatgacacactagtacacacagctctacaacaacggttctatagagctatttgcactggcgttttctagtgcccccagtgtaagagttagtgaaaatcggtattttcacttacggttgttttagaaccgctagttaaaatattattttcactgtcgattttcttaaagaaacttccactagtggttggccaatagaaataaaattttactgacagtttgtttaatgaaatcaccaacttagagctcttttttactagtgacatggtctagctagctagctctgcaaactagctagttagagccacactacagctgtacgtatatatcttccagcagcttattgattccttgttattttgcttttcccagaagctagcacttcgttcagtagtcatctcacactaaactaggtcgtacgtgctgggttgttccaaaaagctgatgaattccatgctcgatcttacttattacaaaaggctgcggactctataaaaggcagccagttctgtgctcccaaaccatcagtagtcctccggccatagtacgtccacacagcaggggcagagagttcgagagctagagagacagagagagggacaacgactaagacaagctagttcaccgataagtgatatcgaacga

SEQ ID NO: 7546 - DNA, 871 bp, Zea mays
tgggtgggttacgtggaagaggatttggtttccactcactactgactttgttggtgacagcaggcatgtctctctctctctctttttggctttggattggatgcatgagttaaaacacaaatataatatgaaattgtgtaaacatccagcaaaaaaggctactgttgttagattttttgctaggcattaatagaccggtcccattagatacgcctcacgagtctttggttgcagttttcttagaagaagctggtgtgtgttgcactacacttattagagggccacagccaccgagaggcgaaaaggaaaccgaaatgttattcaggtaccttgacggagactgtatggtcgagggtagggagctgggctagtctggtgctccggttgccaaatctacgacgaccgagacgttatcgggaacgtgaagcccaggacggacggggcgggcaggagcggccacatctcatctcatccttccaccgcggccggcagcacatcacgggcctgccgtgccgccaccgtggcgttttattgtctgttcgaaaccaccactgcctgcgccttcttctggagaaaggcaggcggaggcggacaggccacccccgcacctcattccacaattatttgcgcccgtcccatggtttatattcattattattattaaaatcacgctttctgtagttggatttcgttttctccttttgtttaattattttgtaattacagtaatctctcgtgactggtgtaacagtcagtcggctttaaaaggacacgagcgcttaaacccccaccccatatccgcatccgctgcctccgcctctcgagtctcgtccacccgtcatcctcctagctcctctactcgccagtcgcc

SEQ ID NO: 7547 - DNA, 103 bp, Zea mays
cgtgagggcattcccacccctaaccctgtcccttgtttcctctcttgcactcttcgttctaacgcttcactggatacgcaaaattagggtctgcaagcggcgg

SEQ ID NO: 7548 - DNA, 1500 bp, Zea mays
gctaatcgtctcattgcaggaatagcaaggaaatggagacaccggataaccaaaaactaacacgctgacaccccggtgggccccgccacgccacaaagaggacgcactctgaagcgcagatgtgcaatgccgacatggcaaacgtaatctctttgtatccagctggggggaaaaagtgccttccaaatctttctgcctgtagactcttctcttgctggtaaacgtttggctgacctgtcatattggtaggatggggagattgcgtggactccacatggagcagcgccgaggcattattgctcctcaaggcatggcaaacagcagtggtagcctggtagggcaggcagcaacctgcccaagaacacggctatttgttggagtggaggtcaaacagacgaatccgtcccgttttctcctcctggatcggcaagcgaagcaaacagacgaattgtgatgagagagaagatagagccaatttgcccaatgcagttcgacaacagtggagactgactgacacaagcacacgagacgtctcctttcctcttttttttttttttaaactttcgtgtgacagaagccgggaaaaggtccgtgcatggagagatggtgtttagtgcctaatcccttatccgatatcatcatcttgggcgctttacacggcagcgagtgttggcttccttttgatttgctttgctttgcttccaaaggaaaaccaacaagaacaaagaaacgcattccaatgtaaccgtaggtaggtagcaatctgtaaagtcgctgttagaaatcagcacatcattttcacgcgaggaccgtaccccgccgctcaaatatctggaacgagctttttggagctacccatacttatatccgccagtccactataattccagcatttagcactaaacaacaattgtatcataattcaataatttcattattccgactcatcagacaacaatattgtattagcacccatcaaatcaaatacccatcactacgaggaacctgtggataccgaatatccatcagatmcccatcggataacaggtacaaataccgaatatccatattacctgtggataccttattatatctataactgtagcctagccgtggataacaaaattccactatatctataccctacgaataattatccatggttacgaatgcgtcgtattattgctcactatgaggaacgtcagaaggagctcgataacgtcatcgtgatcttgatctatataaatgcccagccaggtccgcgcaaaatgcaccagctagctaaccaacccccctcccgtgccgttcaccaccacttccttcttcctccccctaaccgccactgcactgcttacccccatatagctaaccgcaactgccatttcaacaacttctcggtcagccttgtcacatttttttgacacatacatacatacatacatacatacattcaattttaatttgttgggtaaattaaattgggttcgatcgagtccgacg

SEQ ID NO: 7549 - DNA, 1031 bp, Zea mays
aacccatctggatagggacacgcggcacaaaattcactagtcggtccggttgagggtcctcgggtccgaaacgccgacacttaggctacctctagcagcttacctttctcgttcttatatgtaaacaacactctacaaaaagtgtaatttatagtgcaaaacaatgtttttgatatataggtgaagtgttgaagatatgatgatctcatcgactgcaaagaagtagattggatatgcttagaaacgagaaggtatagggaatattggctcgcatattaatctcgttactttttattatatgtggtgtaaaaaaactaaaatcaaaagattgttgcgtgacgtgagatgaactgcatcccctaactgagttttcgacgtttcgcagcggtcaccgcccgcgggggggccgctccggccgggacattattcctgccgcgaagaccaagcgcatggcattccgttgcacgcgtgagagcagccgtgtcgagctcagaggcactgcacgccagcgacacgttagccatgtgagtgaccaacgccctctcccgggggcgggcaggttgggaggacgagcaaacgacgtgaggcgtcgggcgtcgtgggtgcagcggtgcgaacggaccgcggactggactcggtccaaagtccaaacacgtatgtacacggtctgtccggaggccggagcttcacatcgctggccggccccccgcgaccgagatgtcgcggccgtgcttcacatcgctggcccgcccgctcgttcgtcggtctcggaactttgtccacctctgcgctgctggcctcctgctgctcctctccctcctgcagcgttgccgtccacaggaacaggacgggacgggttgagaaaatttcagcgaaaccatcggcggattacataagccgacagccaccggtcgttgcgtcttgctcatcagaacgctagctaggactaggagaagcttaacctctgcaaccaccgataagagttactactatttacataggagcggcagctgccaccgcgtgcgccggcg

SEQ ID NO: 7550 - DNA, 166 bp, Zea mays
atttgatggcgtgcygaattttggtactatagctgtgaatatcatgcatgtcttgctgtgctatgttaagtaagctggccatgtttgagcagcggttattatctgagaatggatactatccttggaagcagcacggaatgggttgcggttacgaccacataaaaca

SEQ ID NO: 7551 - DNA, 1500 bp, Zea mays
atttttctggaaacttcatgcgagggctggccagttgttgtgtttgcagtgtatacgatttctgcattccctttggacgaactggttcatgttcatttttctcgtgccaatcaatattaggaacagaaggaaagtatacaattttgatatttccgacttgtcaatactcagatcaaaggtccagtttcttcggcgaagccgaagggtaagaaatactgcagccgcacccaggctgcacctaggctgtctccagcaaaggtcgcggaggcgttcaattaattcttggtaccggtttgagattttttttatacaaattttgaaatttttatgcagtctttgaataaatattatggattattttatgagtttcggctaaaaccaaatttcaaaatatgcaactgagtttaaactaaaaatcaaacaacattcgaaaaactaataaaaagaaagttttctaaccgtgtcgaggtccatgcggtccaaaacacacgtctaataccctaaaccgtgtcgtcacttgcccaagccactctctcctttcccaagccatgtctgtccaagatccacacttgcccaagccactttctctccttcccaagccatgtctgcccaagatccactcttgttcgatgccggaggagacgtagccggcgtgcgttgtcggctagccggccggctccaccggttaaccactcgggtgcctactcattcgtttgagtggtacaccactttcctataccaattaatcactcgacatcaccgatttatcgaacacgctatccagttagtcgagcaccacacaatggcgttttgggatgactatggcgttttgggatgacgagccgctggttagaagtggttaattggtcctaaggagtggctagccgggcgagtaagccgattaatcggctgataatgctggttagccggcctacaggtaggagctagggttagggagattttcccccttttctcttcaaatctcttgaacattgcactggtatttgcaatatatggtaactatacttgtaacaacagttcaagttattactattttcaaggatgtcggattggtccgatccgatcgatccggtttgggcgcatggggacaacatatatcttggtttcaagtgcaagtattgcaagaaacagtggaagggtggtggtgctacacgtttcaagcaacaccttgcatcgcgtggggggaatgtgcaaggttgtcgcaacattccaccggacactgtcgattactttcggcgtgagctagacaaggtccatgataaaagaaaagcaagagtagcggaagaggcacgaaagttgcaagcggcgggaatgatcttcgacagaggatcaactgtgaactataaaacatgtatatgtatcttcgatgttgtttgtgaactatgaaacaatgtcctgtaatgtgtttgaactgctaaatgttgttattggacttgtgataatgtttgggtcatcttttgttcaaattatgggacctca

SEQ ID NO: 7552 - DNA, 523 bp, Zea mays
ctgcactatatatgcactatttgtattgaagagtttgaaatagagagtgagatcagaagtgagatggggagtttattggagatagtcttatagtaattaggattaggatgaagagagtagtaaataatgaaataagttattttttataaaagaaaaaaagagaagccgtgttggttcctcgtagtcgtaggtcgtagctctcccttcctgggtcaccgcgagtccaaacaaaaagaagctcacaatcaccgcgagcacggagaaccgaaggcccgaagcgaggcttgcctgtctcgctctcgcgcgaccggagcagagcagcagtacatagtggagccaggtcgcctcgcctcctccacttctatatcagttccgccctctgtcccagcagccctgtgcgccatcgcgcggcccacacgagcggcttgccggattcgcgccgacgcggcagacccagacaggtcagcttcggatcgaggaagaggaggcggtggaggcgaggagtcaactaaacttgccagcc

SEQ ID NO: 7553 - DNA, 1500 bp, Zea mays
aaggttacatttacatgacatgtgaaatttgaatgcataataacttgtagacataatttgtgtaaagaggttgaattgaacaagttactttcgtccaaggttaatttttatcctttgaactataaaccacacactagccaacactagcaaataatgttaatttaaatagttatgttgattatccattatgtatgggtggggcaggaattcagagattttctcgacgcgtgtgagaaggtattcttcttaatacgatgtccaagagctatcatgccatttgccagtgcaggtcgagtgcctttatcatcaaacattaaaacttaactatccatgaatcccggtccatttttcttacaaaactccgtgttctttttgcttgtcaaggctggtctgtaataggcagtcgttctcttttacgctgtcgtgagttggtgggtttctaaaatgttcactcgtgtgggctatcggactctgactctgaggctgaggtcaaatatgctgaagataagtagcctgtttctttctactcttttgcttcgtcagacacttgtattcctgtgtttttttatgagatggaaatggggcttacagcttacctcgtgtgcaaaaatgagacgataatccactaacaagaaaatagaagacagggatgaagtgatccacgaggatgcttttgttcacaacgagctgccggccatcgaccatgtacagtcaccatctgccatctccatgccccccggatgctcccatctctacggacctgtgggtaggatactaggatccacagccctacgcccctgttccccaacgcctgcggatcaatcaaccgggagtgaactccagcctccaggcgtagcacgtgaagcccgtgtgagctcggccatgggtcaccgccgctttttgcaccgacaaagaaatcgaagagtctttcgaaacgagttttgcactgtgctggtgcaggtcgtggagttgataaagaagtgcttagcttaatataggacgacacatcttgacgaatatcactctctggcttgtgtgtttcatgtgttgttaccagaccattgatgagatcctagaaaaattcagaaatatttttttccagttataaaaaattacagagatatttacggactattttatttcgctacgtactttggtacttttatttatatttttatgcaattttttcagttaattatgaaaccaacgtggattaattattgttttgaattgcatagaattcagaaaattttgtggtgattgaatattttaaccaacgttgcatattgttaccacaattttatacaagtttatgttttctaaatcatccaacgatggtttagaattttgtgaccagaagttttcatagatatgacatgattattatttgaccaactttgaatatttaattcatgcatgttcaatgattcagtattcaatatttatttcagatgtcctaaatattttctgttttaattttgcaaatgtgctcataccgcc

SEQ ID NO: 7554 - DNA, 949 bp, Zea mays
cgtcatccctacatttgcatcatgcttgctcattaagtagtagttggttgtagtaggagcataatgcgtcgataaagaaaggagggggatgttatggttttattttttgttgttcaataagctgtcatataaatgtttttataatgcagcaacggttttaaagggagaagagacaaattctacagggacaaaactcccttgacatgattaccagttctgcataaattataaaattaaatgtctataaacccataaaaacaaaactctctattgagagtgggtgttttttctaattcatgtttcgttttattctacacgatataatggtcttcaaaacaaaaacctccaccaagactagtgcaagaatagcgtatcattaaaaaaagtagaggccacttgaaagggatcagtattctattgattgaagtttcaaattttttgtggttggtgaactgccgaaagcaacaactccaccaagatttgtactcagcggtactcatgtctttttatgccctaccagtactggaataggttactgtaatcgcattccaccttttgtttatccattttgaatctgaactccagtttgaagcagtactgaaactggttctgcagagataccatctttctgcgcatttcagcacattgcaccgatttaactgctatatgccttggtccgaagaagaatacaattctaacgtagaacctggacatgccattttgattttgatcggttttttttccaaaataaatataaatgtttatacataacaaataagtatcattaagtccatcatcagatatattttgatagtatatactacctcccgttcttaaatattgtgatgtgaatgaacaagcaaacgaacaaacctgcccagattgaatttgatttctcctaatgtgttgtgaatgtgaaacttcgaatgaagaagcaaacggatgaaca

SEQ ID NO: 7555 - DNA, 1500 bp, Zea mays
cgccttcgtgtcctgtaagcccgactcatattatttcgcaccggaccgtattttaggctcctatttttagatcgtgctggtgctggttcaaaaggtctggcccatattctcaacactacatgttactataatttatgttaataatagttttacatgttgaaaactgtagcgtaaataaataccctgcaaaactcatttcattatgtgaaattactagtacacataagctatatagttgtggtcctcaacatatttagtgacattttttagaatgacggtagtaggggccagtagaaaatatttttttatggacgggtaactgagaacagctagtggaaatcaattttcactagtggccgggttaagaaaatgaaaatatgaaacataaaaatggtttagaaatagcaaaaaaattaattagagaagactggctcgcttgtctccgtcgcaagtcgcaacatttttctcataaaattcgcgtgctacgcggctgctaggaattaaacccacaagcctcgtgcaaagtcttctctactactccacctataacgtgctttgtgcttgaattacagttttgttgtccatatattatagccaactgcatgtaaattgactatttgaggtcgtaaattaaatcaaacaaaaaagttgtcaactacaaagttgagtaacttttgaagttctataacttttatttaggtactttttccctccgagatcatttgcaaaatttgcattttaaatttgacaaattcagatgtaatttttgagagccaagatgatttcaaataaaaacgttgtcaactacaaagttctataacttttcgagatctataacttttttattttgatagttttatcatctttagaaaagtaaggataaaaatgattttagtgccattttttaagaaaccgccaccgtaaatattattgaggtttgataactaaaaccgcgtgtaaaaattgtcttgtcgtaggcttagagctcatgtctctcctcactgatactaggatcaggttatttaatagctcccataaaaaagagactggtctactagtgaaagtttcgctagctagaacactctcatcacagtagtgacacgctacgtacagtcgtcagataccaaatcaagaatccaaaggtaaaagaagatcgaggatgggaaggcgctttaggtcgtagcttttctcctctacccaccggtctgatgtatttaatttggacatatatatagtatataatgtaaaagaagggatcggaggcgctttatttatttcctccggcctttttaattttagctaataattgcgagtgccggaggagaagcactcgccgtgtatatatacactagctagctaggcagccattgttgcgtgtgctcatatagctaggttatttgcagctagctagctacgcacacgtacgtccgatcgatccgttgttcgttgggaatccaatcaaatcattaattgcagactaaactaaactaaactagaacc

SEQ ID NO: 7556 - DNA, 73 bp, Zea mays
tgtttttgtatatagtactcgtacagtcgtacccattatctggaacactcacgcagcgtaaacggccacctcc

SEQ ID NO: 7557 - DNA, 349 bp, Zea mays
aggatgacagttagagtccctctacttacagtctaagcgagtttccttaatcacgtgtcgagtaattatttatttctttccaccggaacactggaatcaagctgatgtaaaatgtggcatgcaggttggagatgctggcggcagtacaaaggaggcgcctttgaaagccaaaattcacctcacgcttaaagtcccccaggacaatatacagaattcagttgtagtgttccatgttaagaaaagatgggatttttagtttctatttgtaagctcagatggtgttacgtcatgcgcacataagcaagcgtgtacagatggagagccaataagagatggatgcaaatttgtg

SEQ ID NO: 7558 - DNA, 805 bp, Zea mays
agaaggcactcaacaaaagctttctatgccgattgtttgcagatgacacttggcaaagacacgcctttgccgagtgccttcctcgaacactcggtatagttaatggtcttcagttaccatcaaccgctttaccgagtgacaagagaaggcactcggcaaaagccttctatgctgagtgtgtgcagatgacactttgtcgagtgaaattcagctctttgccaagtgctcggccytttgttgagtgtttttttatcagacatttggaaagaagtctttgccgaatgtcgcactccaaagaagtctttgccttaatctcgttttgtttttaatactgttctggatttaatttgcaccactttcgttgctaccctagaatctagaatctagctagacgactgagaatcacatctgagaagcttgttactggtccaagtaatcatgttgcattttcctgggcatttcagtaacgtcggcctaaagcaacaacgtagggacttagcggccaacagcttcgatgcgacaattaaaggaatatgcgatgaaggtgcctgatgcaatccggccggcagatggatgtatatataataatagtgaattactgatccgtatatatagtctgtggtaatgcaacaaaggcttgtcaattatcaacgtatgaacacatcacgatcgagtagagaaagtgcgtacgtacctgagcaaagcaagcagttaactatagtagtagctgagaggctcgtagtatttaagcgcaggaaggcctgggtacgtagatatagcatgggtggtagctgagactgagagc

SEQ ID NO: 7559 - DNA, 235 bp, Zea mays
ctggatcggcaggccggtgcggcgggcggcatcctccccaatgaagttatgcgtggagccggtgtccaggagcgcgaggagggtggtggcgcctagggtggcccgcacctgcatggaattgcagatgggcatgccagtgactgccctgagggagaagacaggggcgccgtcctgcgggtcgtcccctgcgagttcctcggcagcggccgtgagctcgacgccatggaggtagaag

SEQ ID NO: 7560 - DNA, 1500 bp, Zea mays
tactcataaaagagagcgtattcatatatgtgattaatctgtccaggaagcacattaagagtgtttcacaatatcacacaaaagttttggtgggcctttaatttgcttcagtctaatcaaaacgacagctggatgcattgtggtgttcacgtcgccagcgaaaccaagttagtctctaattttcgtgtgtgtatatgggttccagttggcccgagcttacacacaatccaaaagggatgatgtatgttttactcgaagaaagcaccaatgctgaaaacaacagctgaaccaaaagttagacctctgatacaaactgaagacaggtcactatccaggtttctattgatgctttctctttggccacatcccaggtacaatatatattccattaattcagcaccatagtcaaagatgaaatattacgaatgtatatgcatgctaaaatggcctgtttgcagggctgtggacctacccacttacatccttgggtacggtaaatgccatggcatctttgtatcagaggccatgtttagcacaactatacatccaagaaccatgtcgaatttaaggtttgcaggataaaatatgaggtgtgtacttattttagaaacgatgggtatgttttaatccaaactaataaataaaactgaactggaataatacgtacgtacaacatacgcacaacttggtccaagaatctgtacgaattagggacgagcagttccaaaaaaaaaatcttggagctttttagttgtgccacaaacagtcccctatgcctatgtatacatccacactaaattaaaggacgtcgagtcgtcagattgatcgatcgatcgccctttattggagtgatctcggtggagatgacacatatctgttcatcaatcacacacaggcactagtacccggcctaccacagcgaggtagcagctgcagtggtggatcgatgtgaggcgcgtgattggatggacgcgccaatccaaccatgcactatgcatgcgcgccccgagatgttatgagcaggcgtacacttgcatgagcgagcgggagatggccgatcactgtgcaggggttaggccggccgtgtgtgcgtcttgcttgtctcgaatagatttatggtgcggtgcagctagccagctctccgcccgatcgctgcgtggttggtctcgtgcgtacggacccatgtgtgcggggggcccagacattattgcaggaatagaaaccctacccctatcttctcttgcaacccaactctctctctctctctctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccgggccggccaccaagcaagc

SEQ ID NO: 7561 - DNA, 842 bp, Zea mays
attttattttaatctagtatcagggtgttttgttggttatcactttaattatatctgctagctagtcactcagtggaatccagagagccaataatatatgcttctctttgtaccagctttcttgtttatatattagatccaagtattatatttgtagctagaggcaacaatatgaatagtaaccgtggttatcctaaacttgtttgccgactaggaccgggagatggtttgtttgttttaagcttttactttttacaagacatgcctatctttattttccctttgcctttatctttgaactgctgctactcaagttgacaaggaaagcatgcatgcagtttggattagcagtccaggtttttttttaaaaaaaaatgccgctttaatttacttcgttcgtttttatatcttttttagctttataacttgctgggtcttgaaggaaggcatatgctgttgggcctgggtatgggccttctggatgcttcctctcccaaaacaacctgtcgctgtcagccgatcgatcgttgaccgatctctctttccactcctctcttaaaccctagccgctgcgcacaacaacctgctactcaatttgatcaaccgccatccattctcctcctccgttgcagctgcggcatccatccaggtaaaccatcgattcctcttctgctcctttgttgttgccgccggcgccggatcgatccatccgtcagtccaccggcggctgggggttctctcttgcagttgcgctgccgctcatccacggtcgcggatacattagatggatagctgagtgctgatgcaaacctccaaatttcttgcagtagtccgaccaatcc

SEQ ID NO: 7562 - DNA, 1500 bp, Zea mays
gatttagtggagtttataggtgtgcgagtgatttgattgggttggtcgtggttatttgtaaatgttaaactgatgaattttatagtggtatatagtgattgcctaaatgatagtttttagttaaaaggtttcaatttaaaattatttagggttaagttattggttacaagatttacatatattagtataaattgataccatcgtataggtaattagtataagggggtgtttggttactcggactaaactttactcctcgctatatcgaatgatttaatgttagttataagtattaaatataatctaattacaaaactaatttcacacatgaggactaaacgataagatgaatctattaggctatctccagcagcttacccatcccaatacccatattcaaactccaccctgtgaacaatgcagtctacaatgcaaaacagtgttttgggtgaccatatgagtgaactgctggacacggtcttaagactaattagtcaatgatttgctcatgtgatattataataaacatttgctaactatatactcccccttttcaatttataacttgtttaacttttttaccccaagtttggtcgactcgtcgtaaatattctttatctctagtgtgatatcgtctagcatataatatacttgaatcatgatcacttaatttttttaaaaaaaattgcaagaaaattgtataaaacaagtcggtcaacttataaaaaaagtcaaacaaattataaattagaacgaaagaagtattaattaagcttaataaatttattgtatcatttagtcttcaactatgtaattaattttactcgacaataaaacatctaactgacacatgctaaattttagtctccatgaccaaacaaaagttaacaaaagatgtcaacgacgacmataaataaatagaaaaagaagaaaaaagagataaaaaatgaatagcaggcggccacctgacgaagtgacgatggagtagaatagtactccgtgttgatagctgttagctgacatgcagtgcgggggcctagcatgttttgctgtaatgggaagcatatgcattcttggggagcagagcagatcacctcgcccggcgccccgggcccggscatggacacgacaaagtttgaccagcaaccagctagctgcaaaacctgctgtacgtatatcgtgcgcccaacaacgaactctcgcggagacgaagacgagctgtgcatgctgtgcaggcacatccctccatcctccctcgcctcgatctcaacgtgctgtccaacacgtcgtaccgcccggccgggcaatcccgctagttaacgtgtagctgcttctttataaacgacgtcaacaacccgttcatatccatctccatccgacgaccamcaagctaagggtcgtcatcggccggccggacgtacgtacggcggcgagcttgctacctctgttctattcatacatcgatacattacattacggtgcgagtatactatatatacc

SEQ ID NO: 7563 - DNA, 837 bp, Zea mays
tgtagatattcaatactggaactgagaattagaatcaagaattctgagctaatgaatttagagctggaattaaagctcaattagttgaaattgaactttaaagtgtatctcaagattcagaaccaagactctaggtattagatgaaattgtaattccagatacttttaaacaacaaatttgtattgaaactcatttctgatgctagatagatttggtagtggatctaatttaattctaacattttcaatatctacatccaaacgaacctttaggagtatttgagactgttttactctacggtggcgtttggttcgtcgaaatgtaacgcaactaatttatatggggtaatggatattgatacaaaacttttgtttggttggactatttctggtatatctaatctaattataactagtaagtaaccagatcctattaccgttcccttaacaagttctgaacaaacattactactccgcatcactggttggttgtcatttgccaaacggtctaaaccgttattttcagtttttcactagccgcttcgctaccgtgcacaggaaaacccaaacaaaccacagaacccgagcaccgccgccatgtccgccgccgcagccgactggcttccgtcagcgtccgtgacggcatccggccgcccggtgctttccgcgggcgaggtggagcggaatctcctcccgctcgtcgacctcgagcccgaggaaaatccgcgcccttgctcccctccgcgccctgcctcctcgcgctgacttcccaccgcctcatcttcctccacgagccttcccgctccgcgcgcggcctgccgctcgccaccgtcgtcc

SEQ ID NO: 7564 - DNA, 1500 bp, Zea mays
tcgttttaaaattgtataaaaaccaaacaacgttagaaaaccataaaacttatcgagatgtcatgacatcttatgtggaggctatgataaaaatgacaaggtttcataaaatttgtcacgtatgacccatacaaaaccgaagaatctctaaataagtttcatgatttcatgtgaaggttgtacacgacaaatttgatcgaaaacttgtcaaaattttataacatccaccaaatatgatatcataatatctaaataagtttcattattttctgacttcactgactttttatacaattttaaaacaactggttttcaagttcatggtcatgttttgtgaacatgatgttcgaaatttctggtctgttctggatatgttctcaatatatactcaataacatgaatatcaattttccattattcgaatagcttgcaattcaaatttgaatttttcgaagaaacttaattaaatgaaaaatactaaatatacaaaacatttcgagaaacgtgccaaaattgaacatgttgttccagatattataggaacacggtagaaaaaatttagggacaaaaaaatacactttgttgagtgtctagaaaaaatattcggtaaacgtccccttgctgagagtgtcagcctaggacacttgataaagttgaagctcgtgagctaccgtcgacttctaacggcgctttaccaagcgtcttgctttatcgagtgtccaacaatagataaaagtagtgtcttcgtatgcgggagtgtcacacactcaataaaccacctctttgccaagtgttgtattttgcgactgcgacactcatcaatgtcgagtgtccgacattttactctcgccaaatgttttagcacttgacaagaatacgtctccggtagtgtgatataccttcctgtggtatttgaccaaaatttatgaaaatatacaactattctgtttattatacaataaaactccttcatgaaaacaccgctatattttccattggccaatacaatacgtacagtggtacggttggatccagggtcttctaatttgaaatttgtttcttaaatatatatatatattaaaaaaaatagaggctgacgggcaagccataaacagtgcattgcacggcaaggagtctcaacgaactcattagttgcaaaagcacacatttagcgctacaaacgctgccgccagagaaaatacagctcgtcgccattcccatactccgtgcaaggataattaggggagggcgcgttgtgcgcgcacggcgcacgcatagcccgatggccgacaccacgagaggtgtccacttgagccgacaggagctaaagaccagccgtttcgctccatgaataatcgtcgctcagatgatagatcacacaactcgcaagcaatacggcagcagcgctattatatatatgggtatgtacaagcaagcacaagaagcatccatgcttaaggtgaagcaagcagcacacgagacgatatagagggagggatc

SEQ ID NO: 7565 - DNA, 147 bp, Zea mays
ggtggttctgtgagcccgtcgtgagaatttccgaacaagaagcgagtgatcccacgtcggtcgccagtggagacgacgatggtggacacgcgcacaggatccggcgctgcgacttcagtcatcaaagaaagctccctggtatggcca

SEQ ID NO: 7566 - DNA, 882 bp, Zea mays
tgtactcgtattggaagatttgctggacacctatatagatagcagtaattgttggagctatagctcactgtaactgctctgcttgtggaccagtattgcaagtggttgctatggcacattggcacatcagtttctggctggctcacagtaggaaacactgtacaaaatacaatctcacggttcagttttggttttgggattaccgtcaaaactaacacacggaaaaaagtactgtgctctcgtccatccctatcatggaaaatccagagcacacagtacaaaaaggaaaagagcagccttgtctcgaggtccgtctatcccaggaccataggtgacaaggggctaaacaaaccggctgtcactgggccccacactgacagcgaggcatccatgctgctgctactgccacagccatcagccatcacagaggagaccggactctggcaacggaggttcacgtgagcacccaaaaggccagagcgaagcagaccacccctctccttccctccctcggtccctccctagtccggtagtccctccctccccgctcgcttcctgcactgcaactccccccgtaaatctgcacagcgcagcgcggcatttaatgctctccaacctttggtctccccccgccgctccatcccataccgctctcgcacgacgagcccacagatgcggcaagatcgaatccatggcgagagctagcagaagccgcgggcttggtgcttgaaccctcgatccttcttggaggtcccccccgttccttctccttgcattgctcgcgttcctcgacgcgagcagaccagcagaagaagaaaaaaaaaggagggttctttctcgcgtttcttctgtctattctgcggttctttcttgggagcagta

SEQ ID NO: 7567 - DNA, 639 bp, Zea mays
tgcacatcgtttgttcttcacttgttcggccatagtagcacaaatcgggaggcccattcaaataaacgagtcaaacgtgcctagataaagtggcccacgacgtccattctcaatcaacaatggtcaatcctttgttttctccagctcagtgtaaatccctgacgtcaatcctttaatcgctaccggttaggggtatttaaatgcactagatctaatagttagtggctaaaattagttgagatatccaaacaacctagctatttttggtaaattagataatagttaggtagctatttgttagctgactaattccactaacaatttttaggcaactaactattaattatagtgcattcaaacatctcatatcaatgttttacgttagtaatttgttgaaggcaaataatgccaaatatggcgcgcggaagataacgaccacttccgacctcaggtcgcttcctcatccctcggtcccgcgtgtcgcgctcgcccagacccgaactccgcgtatcatcatcggtccaagcagaaggatcggaggcacacacgggacaggtaaattggatctcgctcgaggaaccaaaagcactctcgatcacaggaattcacgtcgatcgcttgagttagtttgcagccaag

SEQ ID NO: 7568 - DNA, 756 bp, Zea mays
tagctatatacacatgtctggtctgacgacaatcaaaagggatcgctagctcgggctagccttcctatcactgtcatgacatgtgctctgcctctgctggtkgataagccgtgcgccttctcgctaattctttcttgtgctagaggcgagtcaaacaaacgctgcacctcgtagcccttaatctgcgctaagggtcacatgaccctgttccctatcgctagttaccaacgacccattccccctgacagatacttacgacgcgtccgtacgcggcaggcctcggcagttcggcatcaccagcaccggcgccggcattcgccccctgccagccggttcgcagattcgcagggcggagtcggccgcagttgccgcatcccaaacgcccgggaacctttggggcccctctacgagcaaatgaagttgctgcccctggcttcgtaaagctctgacttttgatcacttgattggcagtcgtactcctcgctcataggccgacacggccgcaaagtcaactacccgctccgccatccttcaacccccgccacgcgcctatatatgttcgcggccatgtccgtactagtcctccaacccacaagccacaaccccgagctcagatccctcgcctcgtgtcgtgtctccggtcgacgacgaccaacagccagtgtgggccagacggacaccgccgagctatagcgcttggtgatagcaagggacgaccggcggccggaccggagcacgtacgtacgtaccgcagcg

SEQ ID NO: 7569 - DNA, 268 bp, Zea mays
ccacctcccctcccctcccccctacagatttcactttccaattcctatttatctcttcttttgttctttaatttggttcgtacgtacaagacttctcggatcactcgtcttctttgattgcatcatcgagacctgcattttcccttccaaattcgtcactcactctggttggccgccttctgtcttctgatccaatccggttgaaatcctccgtctccttccagcaagatctggcacataaggagaatcggcaagaaccattctgcaa

SEQ ID NO: 7570 - DNA, 932 bp, Zea mays
caaagtgtcaccactctatattgtgtggaattaggccacccaattctaaactccaatagacatacaaacaatataattagaattccatctcattttaataccatggatgatttggtaatgaaaccaattcgattaatggcctctaatatcgacattcaaacaaagcttaagttttgatgtgaagatcgataattcttctttatggaaaatatctgccaaatcggagtcaacaatgggtaagtattaattgaggttctaacataaattatactccctctgttttttaaaagattatgaaaaaaatgaaaaaatatttagaaaattgttggagaggtgtttttattttaactatctaaattatcgatttagaaagtttttttagaaaattactggaattgttcttatagaacctacaaatttagatcggcgcctgacaggcatttgaactagaacaagaattattcgcgtggaaagcgacaaagaaaaacccggcaggtggcctggcgcaccaggcccagacacataaacaagagcggaagcggaaatccaaaccaaccaaaccaaagtaccaaacgacgctgcgctcccgttcccccgtcacaaacacacacactgcggagaggaccgcaacgcgagcccaccccaggccgaacgccgagagcgatccctcccgtccgtgttgccctttgcgctccgccttcctcctcttccaccccgtcacttccgtgccatccgcggctcgcctccccaccccccattcccgccgccccatgcctccggctcgaccgtagccgcccgacgacgaccgccatggccgccgattccggcagcggtgcccgccgttcccccccttaatccttgattggtccgtcccgattcgatttctgtcgatcgttcgctgagggatcgctcaccttgagttgcccacaggg

SEQ ID NO: 7571 - DNA, 881 bp, Zea mays
aatgccactggtttttagatattagtatagattataagtagtatagtgaaataatgtagtagtaatagtagtatagagtagtatagtgtagcgtagtagtattagtagtgtagagtagtatagtgtagcgtagtagtattagtagggaagtatcaactcataatgagttgatttgtaagtactgttacttccctttaatgaagaatgacgttgccttctctgtgccgattgtcttgctgttgtgtttgtggcataacttagagtttttgaatcatttctccacccgccttatttatgacgttgactcctttgggatagtaattaaataactcgggcatcacatcgatgcttttagaggtagctgccgagtgacttgaggacgacgtcggagttttagagataactaccgagcgactgaacacgatgtcggagttttagaggtaactgccgagcaactgaggacgacgtcggagttttagaggtaacaccgagtgactgaggatgacgtcagagttttagaggtaacgccgagtgacttgaagacgacgtcggagttttagagataactgccgagcgactgaaggtaacatcggcgttttagagataacggccgagttagaacgggttgcgccggccatgttgagggtaatagccgagtgatgatgtggaagtgaccgccgggtgacaacgtggcgcgctggtgttttgaaagtaactgccgggtgctgactggacgcttttagaaacggtatctgactcgggaatatcccataagtactgcgcttttagccgcctctgctttccgtgccctagttcttgctttcctgcctccaaatcctctctgcaattcgccttccactctgttcgccggtagaattgag

SEQ ID NO: 7572 - DNA, 442 bp, Zea mays
agtgaaattaaacgggcgtgcaaatctagtatcttcaccgaccgtagggatgtgctagcttcatcttacgtagtactagaagatacacacagtactggtataatgatataatagaaacaatctccacgaggatgacgtggatccacgtgtcttgctagtgaagcgtgcgtggcgctgcatctataaaatccgtggaacggccagctcctcctcggcgcaccagaacaggcaacgcactactcgttcgtatctttaagcttgctgctgcagcgtaagaaaaagcagtctgcactcggtcggtcggtcgctctgttcagctagctgcatgctcggccaccatatctcctccagtacgttcgtcgttctccacgccgctatctggtctgcggtaagcagcagctagaggccgttgtgtaggctacacagaagatcatcgaggagg

SEQ ID NO: 7573 - DNA, 156 bp, Zea mays
gcagcgaacggggaagatcggcaggcggcggcggcggcggcggcggaagaggagatcgtactggagatgcccgtcaagccggcgccaccgccgccgctgacgtcgccgccggtgaaagtttctccggcgtgggagacggcggcgctgccgtcgagc

SEQ ID NO: 7574 - DNA, 1274 bp, Zea mays
agatgggatgatatactattgatattttgtattatttttagcgtcttaattaacttgaataaaaaataaaattaacaaattatatattttattgagagtataacactttataatcttatgcttataacttttgtataaaaaccattttggctcgagatcatacgaaagaatactctcttcatttcaaaatagttttttctaagccctgttttttcctatcaacctatccacatttgaataaatgatgataaataatttataggttaattaataaatgtatgttaaacgaattatattttagaacggaaakaatactatttttctaaggttaaactttatcgtgcttatccgattagcgtggcgctactgcagcgccaaatggatgtatttcataaagtattatctatgatggcaaattataaattgaattatagtgcaagagtaagcaaaagtaagagagtaaaatatcactttataatcataaataaactgaaataagctagtattagtagcttattttagtttaattgtgatctcaaagtgatattttactcttttagcattacattataattcaacttaggccttgttcggttagctctcaatccaggtggattgagtgtgattagatgagtttaaatcttaaacaagttaaagttcttctaaatttcttccaattacattcaatccatgtataatgggaataaccgaacaaaaccttatataatctatgagagaaacaaacatgtcccatctttaacaacgtgacttacaaaaatgacctataatttaaaaatgagtatattttatataatttagaacatcaacaaaaacattccactccaacagtaacgcatcaaatctagattatagggtatcatgtagtatatttaaggcatttaagagagtgacttataatttttaactaaattttatgaaatgatgcaatgttaaagtagtttttttttgtataaagatctatattttaatttgaggcaccaatttaagacattgttagagtgctattagacataccatatattggcgcgagactaaaaggagaaatagaaaaaaatgagattgattttaaaatgatgttttatttaaaataaaaaaattctaccttccctaccccgcccctgcccgtgtccggtggttgcggttgccccttgcccgcatcatcccacctcgcgaacgaggacggcttctagtccctcgcctaccccgcccccgaacctggcgtctgccctaccaaccgcagcagcgacactaga

SEQ ID NO: 7575 - DNA, 1500 bp, Zea mays
ggtggcatgtaatggcaatggcattgaaaggatagaaaatataaattaatagtcttgaaggggacacataagtttagttgttattgaaggaattggtataaattttgatgacgttgaggggattttctacaagataaattatagtcccactaatgaccacccaccctccaatattggaacaactagaatagtggataagggtaccctcgattaagtgtgtttggttggacagttaattagaatagaacggttccattccgrattttaagtttgtagccgttctattctccgtttagcaagcagaacagagtcactttattttttgtttggttaaagagtagaatagaacgaagccgctccgttctttatttgtttggatgaagagtcatatgagtgtagatgggagaagagagaggagatcactcgcgtccgagagagcgctcgcatccgaccattttaaaatgtgtttggttgaggagtggaaaggaatggagcgactcaattctcattttctggatgtttggtttctaactatagaagaacgaaacagttcataggatctacatatgaaaatttaccataaatagtcgaaacgctcctgctccaccaaaacgattggatgcgagcgctcacgttcaactcatatgactctccaaccaaacaaagaatggagcggctccactctattatactattcaaccaaacaaaaaatagagcggctatgttctgcttgccaaacacataatagaacggatcctttcccaaaaactgaaatagagccgatccattctagttgactctcaaactaaacacaccattagtggagcgggagcactctaattatttatggtaaatttttatatgaagactctaggagccgctccgttaatcttttgttaaaaacacaaatatccagggaaattagaatatagacactctattcttctctactaaaccaaacatgccctaagtgcgatcgacttaggcatacatattcacctatcagaaggcttctctcaagttttaactataactaatactattcaacattggattgaaccctatgagaagaattctcctggctacaaacttaccacaactacttcaattatactcgcgggttcatgcatctcgaatattaccatattcattatgtaacgaataaagtgtgtgcatgtagggatgcacgtcatatttttcaactcagtttccattcaagacttttaatacgattatacaaatcctcatactctagggcttctaggaagtatgtaccaagtgatccctcgagtattaaaagatatacaaaggttgaaattactctccttatgaacaatatttgtataactcttattaaaatattcttttagttcagtttacccttcgtcgattcgagttccgctcgccttcgtcttcgtctcgacccacggcccacggcccacggtccatcagcgctcgtcctcccttcctccctctagcgcctgctgcctctctcactcc

SEQ ID NO: 7576 - DNA, 1500 bp, Zea mays
tgctacccgggagcatagtactcctccgtccagcctctagccaggagggtacacgctactcccaccatctcccatgcccagtgctcgattgtgttttcacgtatggaatagccaggttctggcttatcgaagcatgtggctagttgcaaagtctccaccacaacaggcctacatcgaacggtccttaatcgacacagacgggcaaactttcctgctcaacgtctggtctacattacatattatttccctaaacttgatacctgagagagttaccctacttgaatgatgaaaccttcatggccacaatgggttcatcatctcaagtccttttatttcataaattcccatatcccgtgttacacatcatattttaaaaacaatcctaaattaataagaagggctaagcatcactaaattttcttaaaacgagtattagggttgtttaatcaagaaaggaaatacatcaactgtttgatcacacaactcttatcacctaatgcatcattcaaggtgataaaaaattttaaaactgaaggaggggacaaatgcaccggggcttgcctagaataacactaggttagtgtggttagatgatgtccgcttggtgagcctcaaaaatcctaacacttgatcaagtcgtccatatagggatgggtccatcaaagccaccttgtgatccatcctgatccatgctctcccattcgcataatcatctagcgtacctattggagatgcatagtgcatatgagcatgagcaagagaacacaaaatagataatctgtactaaagaggataaatacttaaaacaagtcatcacaattcctatgagcaaacactagataatttttaactccataacaatcacacacttggagttaatcatactgaacttttaggaaactgttggggaccttcggcgtccgaaggtcctcaaaaacaggatttaacagtatttctgtagtacaatgtgtgaacaggtaccctcggactaaagtcggcattgcagtagaccggaataatacgaagcttgatacagagccgaaggtgtcgagcaggaaagcttcggcgtaacagcaaagagtggaaccgacttaaagatgaaaaggctattcagacctcgatagactactatagagttattatcaaatgtagagggcatgaatgtaattttataagggctgtgtcccgtgtctataaataggtgaacagtatccccgtactgttcacgctgacttggcatttgctttgtgcgtcacgcttgtactgtcatttccttccgattgaaggtatgtccttcataaccttcgtccacaagttattatatcctaggggaaataatgcttcggaggacgaaggacgttaacgattaacattttctatgttgccttgttcttaactcttagcacttgagaacaagtccccaacattggcgcccacctccggtgaactcacttccatttcttgagcttttcaacatcttcgacaagcatcaccttcgtc

SEQ ID NO: 7577 - DNA, 1500 bp, Zea mays
gatttggaacccaatgaactcaaaagatatttagaacttttgagaaatgttttaagtacctcaaataaatagattttggttctcggaaaatagaaaaatattcagaaaaatatgaaaatttaccggaaacttctacaaggcatattaacatgtttcaaacactttttacacttagaaacactttgcaacagtatgaatgcaacaaacaaagaaccactagggctcactttactgtataacaaaataaatcttcattgttttagtaaaggaaaaagaaaaatgaagaaaggaaagagtaacacctgaattttgagtatagagataaaatatacctaaaattcaggatgttacacttattagccatcagttggtcgtgttcatccttacgtgtcgacccaaccattaataccgtgtgggtggtctttgcttttccgacagagttttagattctagagtgtgcctgtggagatatttcttcttttcgttaacagtcatagtagaaaaaaaaactcatgctggagtgaagcttgaaacggcgccaaatatccgtgaagggttggcacttctaaatttgctacaatataaattatacgagtatataattctagaacatcagatggagacagcaactgatatgttgtacgaaggaaacgggactgatcggtaagttgaactgattctggtaataagctgctctgttcagacttcagactgtggttcccctcttgggcatgtacgtacactgttacccttttgtgaacgtacggtactatgacgtgaaaaggatcgttttcgatgtgccaatgtaaaagcttctcccttgaagatatgatgatgtgtatccttttaaaattgatttggattgtagagatatgaccatttcggctagacaacaaaatcgaaatgaggagatacatagcaacgaaacgggtttgccgaaaggaggttcgccgtttggacggacgcccctggtttggcgtcgcccacagaccagaccacagcagtagcagcggcttgcccccagatacctcgcgctaccacagcacgtcacatcctttgtggaacagaaacgcttgcaacgcaagccattatggaatgcacgccgaactcatgcacccgcagcatcatcctagctaaccacatccccagaatactctgtttgattttttttaattccttttcctttttcacatgaatttagaggcacccacagattttatttcctttttttcatttccctgaagaatactggatctgtaaactttcactaacccagatagtacgaccgtcccttccgtgagaaaatacccaaccgtcgtaccaacatcctcctctgtcggcgatgaaagctaaaaccgccgcctctcacacactacacgaacacgactctcctataaaaagcacccgaggcgaggcgaggccagaccaggccactcaacagcatcactcaaagccaagcaacagcagcagcttccctagcaacaccttgcccctgagctc

SEQ ID NO: 7578 - DNA, 786 bp, Zea mays
gggtactgactatatcatttgcagtcaaaatttgaacatcctgattttattgatattatggttatatttggctggtctaccagtacacataagtcttctgatgtatttacagtgagataaaaatgacatttatctgtactcctgttagttaatgagataccactacacatttaacattcatgagatgaaaatgattagtttattactctcaataaatggcgcatgcgagtttggttagttttgcagatgttgaaatagcaacttttttttgtctattcaagcgtcatgttcattgtgtggataactgcatgaggttcctgttgttcaaggttaagtaattctgtggagtcaatgctctttgtcttatttatcatcaacaatrattgatagatttccatgtccatacttcaaagatccacatcatgtttatacacaactaaatgcatttgttgtgttggcctgctggtataacaatcacaataagcttttcctagtcacttcatactagcaaatgatgcaagaagcctcaacaaagtggtaataacactgcaaagttaagccttatcgtcacactttattctggtagcctctgagcagacattcattttgttagaggagttctagtcctctgttttcattttttatttttggggttgtatgatctttcatgctgaacaaataattgacttaactgcacataattcgtttgaattcagaatggtagaatcacatcctaaatataactatgttttgcaggagaatgatcctcctccttggctgcacaga

SEQ ID NO: 7579 - DNA, 261 bp, Zea mays
ctccgagatattcggaagaacctcgaggacatgatttcgtcccggcgctcggctttgaacaaggcgacctcgtcggcagacgcccagctggaccctgttccagataagcttctgggggagatgcaggggctgttggcaaaagtcgacaggatgcttaccaggcctcatgctaatgctccttagccctgccaatctggagggttgtggctgtaacctattcggtagttaggcaactttggtgtctgctctgtatagctgtga

SEQ ID NO: 7580 - DNA, 434 bp, Zea mays
ggtatgccgccaaggcgccaatccgtgacagattgcgttctgcactaagagcatcccaaacatttacttagtgggcctaagaagaattcaagaaagcctgacggttgcggtgggctcggttcctcggttttcgaaggcaggtgtctgaggaatgccctgacggcacctgtcaccccgtcttcagattccatggctttcgccacctctacagccttgtctttcacctgaaattacaaaccaaatcatttgtttgggggggggggggggtggggcttggaacatggaagttcctctcctgagtgagtactgcctcttgtttctgggtcatatattctgattctgttctgacgactccagaattttttggcagtggcagaaccaaaagattttgtatatctactagacaactgccctcatgactggctttttctgca

SEQ ID NO: 7581 - DNA, 1500 bp, Zea mays
ccagtttacacaaggagaatttacagtttagggctgcgattttatccttcctagtcgtgtgaactgcatttcctaccgacgccaattcatactgttaaatcaatacttttttatcaaaaaaaaaaaaaactagtccgtgatactatccataacaggctttcagccaacataggcccataaatcggtcctccaagcccatcagggcaagagcccgtgaatcacttgttatggcagctatcttaactactcaagtggtgcttgaatacaataaaactaatagttagttactaaaattagtcgagacatccaaacagtacaactaatactttagctattacctatttttagtaaattaactaatagttagatagctatttgttaacttgctaatttcactagcaatttttagtcaactaagattgtgtatattgcaaatggcgcgtataatgcaaatggcatggctcctttctccataacaccaatgattgtgtcgtcttccgtcggcaaatacaatcggctataaacgaagacccattgaggtttcaaaaagaggtgaaaagtgacaggccacctgttcctgtcaccacattacagccaacgagcaaaaaggccataattcggccttgtgcggccgataaaagtaaaaataaaaatatcgtcattggtgatcctcgcacaccaaatatgccacgcagaatggttactctgaaggcttcggacaaaagaaagaccggaggcaccggggggcaagcacgatcggacacccgatcacggtcacctgtcctgcgtacgccggaggatccgggtactaaggccgaacagtccgagacaggtgcgggcagtccggctatgatggccaaacggtccgtagatggtcagaagcagcaacctcagaccatcggaccacaacgttccaacacaagtgttaggaaacaaaacactactaagacgtctggacgactcagtagagtcggccctacttttggtcagttgcttgccaaatatatgaagaaggccgttccacacaaccgaccaataaaacaaacgaagtcaaaagggcgacctgtgcgaaagcaaaagccgactaaacggacccaaagggtagcacaaccaagatcgccttgtcatcctcctccagggatagcatggtgcgtcccgttctatccatcgccgatgtgttgtcctgctcatgtgtggggtggtacggcgatgaattcatattactggcccaatccgtttgcttatttgggctggggggcaccacaagtttttgccttttgacaggttgatcaggtagacatggccgaagaggatgcaatccgaaacggcctttgtgcattaaagttccatcaattatttatattatctgatcgcaagagccgatgacttgcatcgagctgagtccttacttcgggaacaaaatcttatgaaatcaattgtttctgaagttttcactgatgcttttggttcgccaagctccaccaaaaggcaggggggcat

SEQ ID NO: 7582 - DNA, 1500 bp, Zea mays
gcaaaaacttgtggtgccccccagcccaaataagcaaacggattgggccagtaatatgaattcatcgccgtaccaccccacacatgagcaggacaacacatcggcgatggatagaacgggacgcaccatgctatccctggaggaggatgacaaggcgatcttggttgtgctaccctttgggtccgtttagtcggcttttgctttcgcacaggtcgcccttttgacttcgtttgttttattggtcggttgtgtggaacggccttcttcatatatttggcaagcaactgaccaaaagtagggccgactctactgagtcgtccagacgtcttagtagtgttttgtttcctaacacttgtgttggaacgttgtggtccgatggtctgaggttgctgcttctgaccatctacggaccgtttggccatcatagccggactgcccgcacctgtctcggactgttcggccttagtacccggatcctccggcgtacgcaggacaggtgaccgtgatcgggtgtccgatcgtgcttgccccccggtgcctccggtctttcttttgtccgaagccttcagagtaaccattctgcgtggcatatttggtgtgcgaggatcaccaatgacgatatttttatttttacttttatcggccgcacaaggccgaattatggcctttttgctcgttggctgtaatgtggtgacaggaacaggtggcctgtcacttttcacctctttttgaaacctcaatgggtcttcgtttatagccgattgtatttgccgacggaagacgacacaatcattggtgttatggagaaaggagccatgccatttgcattatacgcgccatttgcaatatacacaatcttagttgactaaaaattgctagtgaaattagcaagttaacaaatagctatctaactattagttaatttactaaaaataggtaatagctaaagtattagttgtactgtttggatgtctcgactaattttagtaactaactattagttttattgtattcaagcaccacttgagtagttaagatagctgccataacaagtgattcacgggctcttgccctgatgggcttggaggaccgatttatgggcctatgttggctgaaagcctgttatggatagtatcacggactagttttttttttttttgataaaaaagtattgatttaacagtatgaattggcgtcggtaggaaatgcagttcacacgactaggaaggataaaatcgcagccctaaactgtaaattctccttgtgtaaactggaaaacgagaagtttctgaagtaaattagcttcaatrcccgactcttcgtgcgaactggaagaggcttttgtcgtttcrttttctgaattgtgacctgtcagattccagggcgattcagcgcatgctgcacgcaccagatattttaagggtcacacttgcttgtttcatgtactagcacaagaagtaaccgtaccacttcttcaagccaaatcgccagcaatccacc

SEQ ID NO: 7583 - DNA, 377 bp, Zea mays
tcttttgctctcggcgctcgtttctggaatggaaggtccgtccctctcggcagcgggtagcggtttaaatagccgcagcacgcagccacgcaccgccttggcgaatggcgagcccaccaccgccttgttaggttccacacctgatacagtacggtaactctatggacctccatgacaagtgggaccaaaaccgtggttccctagttctcattgcagggcggctagaaaccgtgggtcccgcattccgacgcaaggaggcagttaaaataaaatgccggtggcgtcgttcccattccacctggcataaataggatagggccgccgccgccgcccgcctcggcattctcttgtttgtccattgcacatgcacgcgctca

SEQ ID NO: 7584 - DNA, 810 bp, Zea mays
cagtaaagactgctgtgctgcaactgctgttgtgctgcaacagtcaaaaggttgctgctgctgctataaagactgcaactgttgttgtcctgcagccgtcaaaaggttgttgctgctgctgtcctgcagcagtcaagactgcaattgctgctgaccacatgacttattccatcaccgcgctacccacgacatctgtcataatgagcacgaacagagacgaccaggcaacaaggcacatgtagacaaatggccttgccaagggggattagagcacccgtcatgctgcagctcgaggatgaactgcttgttgaggaggggtgtagtgtcaaggcctaaggaggcccacggaggggttgcggtagcagcagccatgggccctccaagggggattagataaggatagttagagataagattagaaaattagttgagattattttggagattagttgagattatctasgaaggttatcagttagtagtttgttgagagcttttaggagagttttaaagagataaggatctctagctagatagaggcagccaactggcctatttatgtaatcaatggatgagaaataaagtaggcaagaattagaagggagaaaccctcctcttgctcggccgtgggcagaggccctcggccgacgtttctgtccatcgatacccctctctaattcatcaccgatctagcgaccataacatctggtatcggctagcttgggtttcgatctgatcccatggcttctgctgccaatttcgcggcgtcatcctggcaatcggcgtccccatctccatggacaacgccgc

SEQ ID NO: 7585 - DNA, 1500 bp, Zea mays
cacacatcagccaaaccaaaatccagatttttttcttatttatattacgcattagttgttcagttttccaatctccaatatttacctccttcgactctacgtcatttagaggagctttggatgacctgtcgatgccaaagcaacccaagatcttttctccccaatgaggtccctcctgaaacgagagatcttagttttatcaaagttctttgcgcacattacgaatggtttgtcgcctaaaaaccgacgttccagctacctagtacgaatggtccacactcctgcagcaaggaccccaagatcatacacgcggtccggcactagggcccttcagctgttaggcccaaagaacattaataggaatatagagaagaaacatagaacgttgtcggtcttagggcacgtacaacgctattaattagagggtctcttgagggttttaaggaggtaagcaaaaaatcaaacaaagagtttttacacgattcgctatatattttcagcttattcgtttggctttagttcgtaccgttttctactgtttttacagtattttgtttctataaatatatagaacctatgaagtacagtcctagtaagtcaactcgatggctttagttcaaagggtattactcacactatctctcaaatctagaaacttagattgcattttgtagttgtctctttctcgaaaaccaaaccgggatccgtacatgcacttaagcggttatacctgaggctatccgcaaccgttatccctaaatttttcccctattttttcatcttccgtagcggttctccctaaatacttcccttataccccactacaactataaaatatcattttctatatcaactatcaaatttttatctactaacaattactcgtggaccaacagcatagtgtttaggggatgaatagtgacacgctagatctgggggaaagagaagagggccggcacgtaggggcgctgtagggacaccgctgcggccgtagagtatcccttacagacgacatgcaaggggcgggggctgcccaggggcagcgttaccgttagtctgaggcaatatatggagcagcccaaattgagatccattgatatgataaataaataaataaataacatcacgagaagacggtacaaacggtggagtgaccgatcgagaatggcaaaaagaaaagaaaaaaaaaacacgtatctaaaacgtgcaagcaaaggccacttctacttctagagggtcatggcatggggcatggatggactggtgcgtgtgatcctgatcttgccgagtgcaatcgagatccgtgccagcccgtccatactgcggtggcgtggcggtgacgtgccggcgcggcgccgataagaggttgagagagagggaaaaaaagaacaatcaattctccagaccctccccggcaaccgcgtccggccgtccgcttccgtctccttggataaccacgacgcccgccggcaagcgaaagcgaagcgagccaacccagcc

SEQ ID NO: 7586 - DNA, 1319 bp, Zea mays
acattgttatatgctttcttaaaagcagagtaaaatctcgtttcaaaaaaaaaataatcttttgaaacttttttctccagcacctacaagttataggatggtgttgatgtaagcaaacctagtttgagttggagcataaacgttgggtaatgctgaaaacgactgcgggtaaactagctagttctggttacagaaacacagttcagttatagactgaagccgcagcggcatcgtctgcatctacacagttatagactgtgcggctgtagaagtactagtattagctacaatattcgatagttcatctcctgcagctacatccgaagctgtatcacagccgaactgaaaaccatagcatcgagcggctggctatccaattttgatagctcagtaattctggtagttcggttcagttctatggtaaaatcgaagccgtcaccatataccgaagttcataaaaaccgaaaccgaaacaccgaaagtagttcggttcggtttttcaaagttcgattcgatttcagtgaaaaaaaatatccacacctaatggttaggcttcttgaccctgaaacccacctaaccaaatcactccaacacctataattcaccaaaacgattgcatcgagaattaacatacaatcaaaactaacgatttagatcactagataaccctcactttcttgcacactcaaatccaaaagataatattatttggcactcctcgtcctcccactcccccaccacttcgtcgcctccagcctccccctcccccatgacagcgccagcgccaccccttcttcctcctactcatgccgctgttaccgttgacccttttccttccttccctttccctcgcgttaacactttctatatgctagtaaaaataagggaaatttggatccataccattaaaagataaccactttggatccatacgtactatctcacttacatgtgggtccacatgagtcaatgacatgtggggtccatggtatatatctaaagtttggatcttttaatgatatagatccaattgttcctaaaaataaagtctggcgctgaacagtgaacatgcactgcgctctcttccccattagtggatggtgggccggactggacagtagatttgtggcccaacaaaaatacatagcccacaaccctgacttggtgggccagaattgtcagagggcaccaccagccaaggagggagggagagggacggacgaaggcgagccgacccgacctcctgcggcgtgtaggtggagagagagagagagagtgaccctaccgggcgggagagagccaggaagaggagggcgacg

SEQ ID NO: 7587 - DNA, 1500 bp, Zea mays
tttagattaattttgtttcgtgggagcagcaacgctctttgcgtacaagatacggtctcgagtgagccaaaccaaaccaaaccgcctccagctccagcctcctgtcctgctcccttcctcccctgcctgcctgccgcgcaccactccactcgagtgactcgagtcgtcctcctcccaccacctcccgtccgttgcgttgctcctgcccgcgcctcctccatccaccacaccagtccgtcgttaaagctgcggcatcggcagcacacgccgacgggtacaaggagcactcattgcctccccatctcgtgtaggctctccccctcctccgcgctccgtccgtctctcatcaccgttccgccgccgccccacctctccctcctctcgccgccgcctccgaacccgccacggcgcggcggagatccaaccggacggatctggatcgacctactccgacaccggtaaggaagccaccgcttgctagtccgatgcattgtccattctactctctgcgcaatcctgccctgccctgcgctcaaccgaaaatctctgtttccgcaatggatatcatgcatgagatatatatggattcttcagctcagtccatccactttacttctttgttttcctttcgctactagttttcgtatttctctccggttaattacaaggcccgactgttaacacttctgggcctccttcttcagctttccgaagatagatagatagataacaaggttgtgctgtgcttgctgtctgttgggaagtggaggaagctcaataagttgatatccgcctcgagctcgagggaaccggtgggcaggtacctttaagatctgacccagttcttgtctccgctgttctaaattctcacaggttggttgcgcaacggtccaagaaatgagcctaaaccaaaagcaaaagaaaacaaccaaacctgtgcagcttttgttttgtttagcctgcgatgcgatgtgtccagtttgagctcgagtctcgagagcatgcatgtgttatcctttgtttttttttctcttttattctgccaccaacttgtcacattttgccggccgttacgtcgcgtagaatgggatcataatatatactccagtataaaacataaacaaacggctgcaaagctgcaggttttgtgttcctatcctagcacataggataggacatagccgctgcatgttgcgaaggatatgagcacgccaggtccagccattgatttcttgcttcctttttcggttgtagagtcagtgggcgcagcgcattgccttgccttgccttgcctcatgattctccgtttggtaaactcatatttatgaccatgaaggatgtggcctacattgctggatctgctgctacattggtggtgccactgatctggtaccttggtgatgaaaaaatctatgctggtagtagctaggtagggtatttgggagtacttttatcatgaatcgatccgattctctgtggcagggccccccgatcacgagc

SEQ ID NO: 7588 - DNA, 1334 bp, Zea mays
tgcagagtcgcagtcaatatagaaataatgcgaactggcacggtaggaccgccgcgcctctccctctcctctcctgctgcacctggtggcactggcacagtggcagcgcccgtccacggtccacccgcggcgagcgtctgacaccagccagcgttgccgctctccccttttcactgcacctgccgttttcacacggccggctaccagagaactgttacttgtgttgtaaaaagtagcgaagagctgtaaacacacatacttaattacttataagcaaccgtgaactagtgtagatcagctgcttcacatttcctcacaatcacacgcgacgcggcaggcgtacgccgtcgccgcgtctccgtccgtacccgccgctggtctcgtggaccgtgcggtgggcgggtgcgacgcgactgtgagagcagcgggggggcccggtcggctctcgtcgcgcggctgcagccagcactgcatgcaggcacagcagcagccgcggacacggcagattctgcagcgcgcaccctgcatgctgtcacggctgtgaatggcctgcgcagcgctggcagcctgtgccgccggagaactgtcccagacactgaccggtacatgtggagaatcacgtccaaggcactgaccggtcgcgctgccgcgcgtgccctcctgagtccttgcttcgctcacctcacacacgtcgtacgccccacccgcatgctgcacggcacgtcccgtctgctcctgccaggctcccatgatgacaccgagcgagcggtacggaatacagcctactacagtgtctgacgcctgacggacgggttagcgtaagcagccagattcgcgtcccggagctctcgcctttgttgacgaggtgaggggggactgggcacggctgctgctcggtcgtgctgcccgttacagtagttggaggaacgcagcagggccgttgggtcggagcaccggtgcccgtcgttcgtgtggtcgatccaatggcccaaatctcttccgcggcccaacaaacccacacacgcaggcgcctgcgaggcttgctcgtgcgacccacagcagcctgctgccgggcgccgcccactacaaataaaaccccttccccatggacgtcgcccaagagactcactgctactcgcgctcttgccaccgtctactctccaacccttctgccatccctcggcaccagctcgctgacgctaccggcacccctaccgtcaggccgcatagccgtgctccgatcaccttctttcgcgctacagtctcaagggtagctagccaagctaccaagctcgtcaggagcgagagaaagaggccgccggcggtgcgcgggg

SEQ ID NO: 7589 - DNA, 1371 bp, Zea mays
catgcccctggaagatatttaatagtcaatagtaaagcatctgacaacaatcaagaaacctcaccaaataacttagcaccttcttaagaaaaggtataactaacaacccttggcaagtacagtaaaatccagaagatggagaagcaaaatatgatacaggaatggtacatgaactgaccaagtctaggaagccttctcctgacatatgaaaagaaatactatattatttgttctcacatgcctaaagagaattgctattatttcaaatattattatatggcaatgtacatatcgctttgaaattttgttatctcccgttgcaacgcacgagccaaatacctagtatatttattaaaaccacacttcattccacactttcatgtacttgataaagaacataaagctagagataatgttagttagatgttttttgtagctttgaattagagtatgtgatgtaattttatttttgttatgaacattagataatgaaataaacttacgaactatatatagagctgaatatactctttttctttctaacaaaatgatttgtaaacgaggtagtcattgcatagctctagtaacttaatacaaatattaagtttgcttttggtcaaatttatttgtcttatcttttatttgttttaataaatttgttttgaatttcgggctctgatgtgaatttcgggccctgatgtgaattttgggccaaaaactgaatttcgggccaaaaattgaattttgggcttttataatttcgggccgcccgaaataagcccggcacgtttaagcaattacgggccgggccgtgggccgagggcgaggcccatgggccggcccggcacggcccgaaattcaaacaatacgggccttttcgggcttgggccggaccgggccgggcggcccgaatgtacacctataggcttgggcgccaaccaaccaaccaagtcgccgccctccttcactgcgagctgcagaggcctaccgttccttcttctacctgctctgctctgcttcggctttcggcttctcgcttcatcacccatcaatccaccgctcttctcccatctcttggctcttgcttgcgcactcgtccaaacggtaaaacagcaagcgctaactgatccaaaacatcaaaagcgccgcgcaggcagaagcagcagcaggtaaagaaccggaagccaaccaggagcgcattcccactcatcaaccagcagagctcagatataagctcaccagcactaccccttcccatcctctcccactccctcctccctccccctcgtccagtccacacccattgggcgagaagccgagaaggacagggagggagcggaagctagccaggccgtcccgtccagagccgct

SEQ ID NO: 7590 - DNA, 1500 bp, Zea mays
ccaaacacactctaaatactggctgaatatattgtaccaaattacccataataatctcaccatgacctgattcgaaaccggaccgacctgacgttgacccgtcgatggcgttttcgtttggtgtagctgtcacggccgttcgtctccgccgctacagcatctctagtcttccgtcgtctcccttctttccccttcgctcgcttctcttctttgccgtccagtcgtcgtcgtctcctcgtgggctcgcggccgtggcgcattaaggattcgaacccactcgtcaaagagaatccatccgcaaaatcgaaagcaacagcagctgattattaaagccccgctttttcaaaagccgcaagggctatacccctagttgtaaattggcggaaaggaaattcgcctcctcttctccaattgcagctgcagttgcgtgctcgagaggggtgaagaacctagaagccctgccagcgcgcggcgccggcgccttgtttactctgcgacggcacgctgattgcattggtactgttcttctcctggtaagtgctcatagcttgcaccttttgtttgctgtcctgtgactgtgagcaaccaattccaattttctcccctttcacccgtccgtctagttgtggatttgtgcgctgagtggtgccctgccaaatccatcaggttcttcagcctggaacatggatctagcaaacaagctggtgtacccaccccacaaaaaagaagtatttgctctccataattcgactttgagtctgacatggatattctgagtccagtttttgccatgctctaaccaattttttagatgtccttgtgctagataacagctatttgtattttttactttaaaggttgtggttttatcttctaaaatttgatgtaggcatgtagccatagtgtttctagttgtgaggctcacttctgtccctactccctagtccttaagatgccaatttcgtaaggtttaacgagattctccttccaacccaaaatacacgacgttttttacttttagacatcgtgtttgattgttcgccgtattcattttttatgaatattatttattttatcctgacttattttatgattagagatacttcaataatgacttatttattttcttatttgcacaaaaaactgaatactactacatggtcaaacatgatactaaaagtcaaaagcgtcatctattttggtagagggagtagatgctaggattagtggaatttacttcctgatataagtgttcagcttttggaatctgaactactgtgatgagagaagaattggaattggttcaagtttgaaatcttcactaactttagctgtgccttgttttatgtatccataaacgatataatactactgcgtacaagacatatctgtcaacacctgatttttctgtgatgtgcttgtagtttttcaagtttttggtatgtataaagtactgaggatatatatgttcctggtcaatttgtcatcagatcaccacac

SEQ ID NO: 7591 - DNA, 375 bp, Zea mays
gagacaccaattgtgtggtgtactgcggggaaagtttgttcccgggtgatttgagaagataaagctcactcggtccgagggaccgttgagagagggaaggggttgaaaaaaacccggcctttgtggcctcttcaacggggagtaggtttgtgagaaccgaacctcggtaaaacaaatccttgtgtctcacttcctcattcgcttgcgatttgtttttacgccctctctcggactcgattacatttctaacgctaacccggcttgtacttgtgattaactttgtaaatttcagtttcgccctattcaaccccctctaggcgactttcaattgttatcagaacacagtgcttcattagagcctaaccgctcgaagtg

SEQ ID NO: 7592 - DNA, 254 bp, Zea mays
tgcagcttcgatcgtcctcacctacctccgatatccacgtccacgacccgtgcaacgcctgcttctccacgccgcttcacttccctcccggcccgcacccctatatagccaaaccctagctgcccagcttctcatcaactaaccagctctcgcctgcctcctccatcatcttcgaattcttcatttcttgatttcttccactgaccgaccactgcttgctcaatcgatcttaacaaagttcctaacaagctaga

SEQ ID NO: 7593 - DNA, 1500 bp, Zea mays
tctcggtaggatggtagggtctcattatgatacaaggacttgtctagttgtacaatgttaggaagttctcacatgacatctacaatggttgtcacgcggtttacaaagagagatgaattacaacacaaacacaaatcgaatcaacaaagtagactaatatatactgtctagagatataattagattatgcagctgatggtgaagcacgtcaacttgcccatgtcaacaactataggatcgatgattgctcacaatatgcatgttgcgcagaaatggaggccgccacaagttacaacaaacacaaatatgtcaaatgtaaagttagctatgctgagacacctacttcagcatatgaacccgtatgataaaaaatgtaacacraagaatgagattagctgaccaagatgggtatcactaaaagcgagttatctaaggtgcacattgtgctccaataagaattaaaggtacaaatagttatactaaaaatgacaacataaagtaaatgtattaacaagtgagagtgctacataaaatatgcgtgatgtaatattttcaaatggtttgagctaaataccgtatatggcatggcatggtattgtaaatgggaacatgcataattctacatattatgatgggggtagcccatgaatatgtaaatggcaccatgaaaatggtgaacgatcgcaagttgaacttatttggtgtctcaccatttgttcaaggaatgttgtgtgcttggccaaactcacacacaaaaaaggcaaaggaagcatgtaacttggttcacaaatccatacgttatgacatagttatatgaagtagttagttccgagttaatataatatgtatcgtaacgttgcacgacaaagattctagaaaaccaactatatcactcaaagataaaaaatgtactatcggttaattttttctacattcacatatgggctcatcgactcccatagtgatttgtctatatttttccccaaattagttatatagtgattgtctagattatttaactagaaaaaccatgtcatggactcccaaagtgattgttgagattagtctcccaaaaaaatttctaccaactaattagtgaaaaaacaactatttaacatgtttttttctcgatcgcctgatatatttttccctaattaagtaaaccatgtcatatataattaccgtgtctccttgtaaacctttttttcaagtagagttgggaggaccctggatccctagtttrcccatatcctaccccacaacccgtcaggagctggggggaaatcgatctcccctcgaagctctcgcggcgccccgcgacgcgggcggtcctcgctagtgcctcctctcggctcgtcgccgacgaggtgagcggcaccccgtcctcccctttgccttcggcgactccgtggtcgtccattgccagcaccctccctgtgacgtccgcattattcacgtgcaccgtcgcgccgtcgcgcagggtgaggacctccccgtcgg

SEQ ID NO: 7594 - DNA, 1500 bp, Zea mays
aaatgttgtccgtctcctttccctctccctctcccccctatgcatgcccacggccaacagcgcagctgcaatgctgcatccgtgctttctgcatgcaccggggctgaccggttggacttgggcatctctctcgcgctgcatctgccagcatatggctctggcactggcatggggtgcctgcctggctccctgccaaaagcgtccgtcgaggcgtcgactcgtctgtagcgtgcgcgtccgctagcgacagcaaaaagcaaaagaatatatttcacctggagaagggcgctccgccgttggactttcgtcgtcccatgtccgaatggtgatgagcatggccatggctggcgcgccgctgaatagaacaggacgcagaaggatggatggatgactcatcagatttgcagaccggagatttgtttcgggtaggaaacgtacagattctcctgttaacggggacctcgtcttgtctcggcatgcaatagtagtataattgcatactcctataaaaaaacagaggagagacggggacgaaaaaggagcaacttgccagctgagcatttgtttgttccctttgactgactgggaggggagcagagcagttcacactgttaatgctgcatgcatgtcctttactatgctggcagcatggcaggatccaaggcggaggacgattgtgcggagcggcttgttgcgaccggtgccgctgccgcccatattttggacttgggatgcaggatactcaaaaccccggtgccggtgccggtgtgctgacagcacagcacagtgcgtcgtcaccgagccaaaagaggcagagatcgatcgttaccactgtactagtgtactggccctcgccctcctcgctctccctcactctcattcagattcaccaaccccacacggaaccatgaatgggcacacatggtcctttagatgcttgtggacgtgragtaccgtgaccgtctcgctgctgcgtgataaatgcagagcccgattgctcggattctcgctcgcatgtgtagtgtagtagtactgagcggacgttatcgggtttcaaaggactgtacttactcctgctagtaaaaatacagatatacagctggtgctcgtacagtactccgcaagtccgcatacatacacagccacttcatttttaaagcattttacctgtgagctcggattttttaaagtgcagaacatgttcccatcgcctcaaatccagcgccgcaccaaatccgggacaagaatttaccacctctccatccatctcgttgcctgcctgcctgcctcgggctgcgactccactggacgaccctacttcaccctggtcttccaccccaccccacgcacacgaagacagagagagccctccgggcgtcgattccgccatactgccaccattactgacgccccctcaccgcctccgggcccaacgagcaagccagggaaggggagccgaggcctcgcctacgcctaggcacgcccctccccctgcgcgac

SEQ ID NO: 7595 - DNA, 309 bp, Zea mays
gactaataaaaagaaacggaagggagtataatactaattttgtccgtgcataatgacttgtatatatacgtgttacgtggctggccgcctcgctcagccccatccgatcaaaacacagacgaaaaggcaacacaaaaacaccaaaggcggtccccggaatcggaatgggggtcccagctttgtccgtgcgtgcctcagccctcctcgacccttggttcctccacacacacgccacgcccagcacaaggatctccggcgccgactgcggcgacctcctcctccgatccatagcaccagtagcaggcagag

SEQ ID NO: 7596 - DNA, 408 bp, Zea mays
ctcaacaccggcctacgaaaacgctggcgtaatcacttttaaaaaacatctaatagccaccaaaaacaattgtaaagttaagctcgctcagtagacaacattgccaccccatagcatcccacccgtccatctgccatccaacgctcgacctcagcgccgacaccacccaccccgccacacaagcgccgacagccgcagaggatcccgcggccgcacctaatccactccgcctcgccgcgccatgcccatccggccgcaccacggggcccaccccgagcgcagggcagggcagggcagaggtcgcttaaaacccaagcaatctaactaaccacgagggattattcattttccgaccaaaaaacgaaaaaggcaaatccaaagacggagaagaagaagagtcgcgaagga

SEQ ID NO: 7597 - DNA, 238 bp, Zea mays
atctgctcattgacacgacacctccgcagccacagcgccgttttccaaggtgctcgtgctactgcgttgcgttgcgccgttctttccttagcaccagggagggagggagggaagggttaacaatattgttggttggtttgttgcttcgttgtagacaaacatcgtttcggttgcgttctctgatcgggtagcattcttttgtacgtttcttccatcatcgccttttgacctgaggtgc

SEQ ID NO: 7598 - DNA, 178 bp, Zea mays
ggggtcagtcggattcatataaggggagaggacataaatattcgggaaggaatgcactaaaacttcagagttgttgaaaagtagagaagcctcaagaaaatcaaacatcctagtggtagatcggaaggatcctaacaaagatgagccagacaaagtgaaaggaatccaagatgaagtt

SEQ ID NO: 7599 - DNA, 1500 bp, Zea mays
tctcactagccaatctaaattccatgttagagagtctgttgcaatgagatgttatatatagagtttaatctttatagagagacaaataaatagtcaaaatagagagttaaaaataaagagtctcttaaagttgctcttataaaactctaaatttagctaagattatatttttaaaggaatacaaatggattgaaaagtgagaggtgtaaatgaactcatgcatttcctctatttatttagaggatggataattttttccttgaattttttaaatttcaaccggttaaaacggtgcaaactaattagacacgacatgtgcgatatcgatatcgattagctcgacttcaacattgatgtaccaattggaccgaccgatcgacagacccatgcatggaccaacattagaactggatcggtcaatacggactgacggctcgtgcatgtgatctgttttgtctggaaccagcctaatatagcttttgtccgtggtgcaatcaattttggtaagcagtctatttggtaagcaatcaatttggtaggagaagcagacaaacatgtctgtaaaagtttagaatccgtgccaaacaaaccgtgcgagatgagctttcgcacaatttgtcgtagaacccaccttgtgatggcaatcgtttgcgctaggggaccagctagctaaaggacactgtactatgatgtggaatttggacatttggtgctatttaaatgcaaggcagtgctcttgccctttgttttaaaatatatatttggtgctatcttccctcctaacgtgaaattcgtgtacgccggagcatttccctatgactaccagcaattaagggcctctagaatgagtgacagatcaagcgcaagaataaaaaaacgtggaattttgataggaatacatgggcaaaaacagaggattgagaaacacagaaagactaaggagtgagccggccgtttggatagaacatatgaaataaacaataaaggttgatgaactattatagtcataccttccaatgcttagcatatgaacttcttcgaatctagtttggaaatttaaaccatcttcaggatttttggagattgaaggaaaaaaaataacttaatttttatctcaatcctcgaaaatttcagaatgaatttaagtttttcaaactagcccttagtttttctacgatcgaattcgaatccttcgttccaaaggcatgaacagtctcagtcctgttaaggaaaatgatatcctctatttttcctatgaaaatcctccctccaaggctcaaatccaaaggaggcataaaccgatgtataatatatcaaatcaaataaatcaagtagacaaaccatagtgtcacatctcaaaggatcatcagagcgcgcaatcactaaacggcgagtctatatatggaggcattctgtgcctaagaggctcacaatcggagtagatcaacaatagctctgcttgttttttttttcaaataaaaaaagcacgagctcagcgac

SEQ ID NO: 7600 - DNA, 612 bp, Zea mays
caaaatgcgctggttgtattgcactttgcaactactacttacacaatggcggtgaattaaacggcgtgacatgaaccattacgtacaccgtttgacggaaacccattcgatgtttttgttgactttgggcggagataatatttcagtcctctttttcttaacagagggcaatcccagttgtatttttttctaccaccactgaacacatgctgacaccagcaaagccgcattctgcgtctctcgtcactcacggacaacctcttttgattatgtccactaatgttgccgtgtcacacgctcgttggtcggcagcaacagtcagctacggatccgagaggagagagagcagataaagagcgccggtgcaggtgagagagatcaaagcaactgttggtgctactggctgctacacggctggttctcccggtctctgcactacaaacttctgatccaggattataaaaatcacttgctgtagttgccacgcaccttcttctcaactctcaagcggcaccttccttttctgtgtttcccctctctctctctctctctctctctctctctgtgctagctgctagcagagcagagtgtcagtcagtgagtgcgcagtgc

SEQ ID NO: 7601 - DNA, 1500 bp, Zea mays
tgcaaattaacgtgtatactccaacagctgcttgaaacaaatgctaaaaatctaaaaatgggacaaataaaaaaaaactcaagtatggtgctaaatgggccgttttacttgtcttgcatgtgccagacgtcctttccttttgccatgcaagtgcccgacgcacacgcctgtgcacacgcaaaagctccagatggattggtgagaacgcaatggccacaaaaatatacagaacatgagtcgctggatacaggacgcgtttttttaaagaaggttgaagaagctgttggagcaagtaaaatgtgatttcttttctaatatctattttaggaaggtttataagttcttttggagttgctctaacggacatcgtttcgttgctagataacaacgtgagcttagcagtactcgtggattttttttacctttgtcgactctcgcctctcatgtaagcactcatcaagcagcaaaaacatattctctttcttttccatcgaagaggcgctccttcaacaacatcctctatgtgcgttgatgcagtcacatttatgaattatgcaccacttgcctgcacaatttacatgaataaagaaatctactgtatcaaaaacgattaatgtattactgctagtatgattagtatatagctcatgctaacgctatgattctaggaagggggtcaacagtggcggtggcgatggcggtgcgaggggcgacgacgacaagtctgaggggaggggcagcgggaacacagggggagggggagggggtggggtcgcgtgggagggggatgaagacaaataatattgtccattagattttagtaagtgagatggttattcaacgatctgaattaatattgtgttaagtttaggtgcaatttatttgttggatttaatgaaggttttgagtgtgtacgggtgatttgtttgtgtggattttgcaaaagtttaaactaatgagttatatagtgatacggatatagatgaatggtgcaccttgtaaatagatcagatcatgaataaaactatcatacatttttgtgttgttttttttggctgaataaatggcacaccgtgtaaatggatcgcatctagtaaataattatatatttgtgtatagtttttggagggatattttatttggcgccacgttgacttgtttggccgaaacagaaagaaaggaagccaaggcaacggtaaaagacgcgccataaaacggcgcgcggcttctattttctgctgccgaaccaaaaaaaatagtgagacaataaaataatgccacgtgtgtggatcacgtaccggagtccggagcagcggcaaagccgcgtctggtctgattagggaatcttgttagagatggattaaaattaaattagtggatacatctcctatatcttaggagatctaacagtccatatgcctatataaataactaggaccctgcccaagtttcatcgctactcgtcttgtctgattcccccgagctagcctagccagcgag

SEQ ID NO: 7602 - DNA, 697 bp, Zea mays
gatataagacctactccaacttttcatacttcaagtgcaaccactccaagcattcaaagccaattccacaccgcatttgatcgatttgagtttgagtgacttagcggctagcgcatttgagtgttgtaaggtcttatgatcatgtgagctttgattgttctcatttctctctcgctcttattctcttgattataaattgaggcaagaggctccaaagctttatgtggagacccttgcgggacttggtgtccccgagatagtgaagcaaggctcaatcggtctccgtgaccgtttgagagaggaaagggtttaaagagatccggcctttgtggcctcctcaacagggacgtacatccttcggggtggaacctcgggaaacaaatcaccgtgtctatttatgttggccattactttgtgatttgcttcctccctcttctttctctctaagttctcttgcccgtgtttgttttgagttggctcccaaagttatctgcaatgattgagcaactctaggaaagaagaactctcttccgcactccgatttccttatcactctttctaaaccctaacctcggatcaaagtttatgttcaaagttataattttccggttttgcctattcaccccccccccctctaggcgactttcaattggtatcagaacccggcacttcaattagagcttagtcgctcgaagtg

SEQ ID NO: 7603 - DNA, 1500 bp, Zea mays
cgtcataaattttatgacgaatacaattttgtcattgcatttatgatgtttttttgaatttcgtcacaaaagttcttttaccacgcaccttctgtgacgatggccttttcgtcatggaattgtcacaagaacaaggacaatgacaaaaaatcttatttttgtgacataatatgaatgtcatagaaggtcatatttcttgtagtgaattgaggtggtcaagctatgcagttatgcaggatatgaaggattcaagccgcggggcgccraacgactatgcaggatctcgacactatgcaggattcaggtggctttgtgtcacagtgcttagcgacctgaaggagttgttgctggtcgcgatagaccacagcaacggtggcagtatcccttgcgcgcggagcagcaacctcaaccgcgcattgctgctcttccccctcacattcccatccccactctccctgtgagccatatcctttttaccaatttacatcgttgatttggttttatgaactcatattctcgcttttagatgcagcagcatgcacacacgcacaacaattttccatggcatgctttgatggaatatttcttgtattttatatcctcaatcccccatgcgttgatttttatttcctaccaaaagctatactcgcatatgattgattgtctggtatgttactatagttatctcagcgtaaaatctcaggatctctcttgaaatatctttctatgctacaagtgaaattcacttttggatttaaaraggcttatactacagttattgcaggctacatgaacgatggggtctgtcccagagaaacaactattgtgttatttgttttttattaccattttttatgttatgtactaattagacatattgaacatgttgtgttagagaatttcatggaaattagcttttatagatattagctgcatgtaaagaggaatactttagcctattgtggcactcgtggaggcttgtgaggtgctgcagaatgtgttaagatagcaattgattcttcagacttgttggaagctggtggactatcactttcatcagttctgatgaagcaattcaaatcctctattgggattccaatttgaggagacatgaagagagtactagtgcttttatctgcagctgatgattggtactcacctaccctccaactggtatacatccattgcctagatcatctattcataatctaacactccaaccgcatttcacatgtttcacatgtttctgtatacaccctgcatttcacatgtttctgtaaaaagtcacatgataaccttcttctagccctcatgctcttccttgtctggagtggtcgacacgcagggtcaaaagaaatggttgttcctcttgtcccaaacgcattgatcctctagcgtagttcttggggaattcacgtggatcgaggaagagattttatttgtgttggggtttggaaggtggtggtgttgctcctgctgttcttggtatgagcgttggag

SEQ ID NO: 7604 - DNA, 533 bp, Zea mays
ggatcgatggcttggcccgtgggctagcacggtcacaaatgaggttgtgctttagcaggccatactatgatgtgcttgccagcccagatgtatgtacatgaatatattcctaaataatgatgagcctctcaaatgttatagcactagtgttaagatacctacaacgaagcatggatataaacgtgcaaaatattgttttgtacactgtttatatagtgaagttttgaatagtaagtgagatatatatagtgtgataggaaggctggtgtttctcattgtaattcaagaagatttttccacgaacgggcctgccgatgcgagctgctggggtatttaggcccactaataagtccgtccgaccattgtggttggcttagaaatatttgtcggacaccaaggggccaagaaaaagaggaggtcgcttgcgtggccgcgcgacaaggcgtacggggagagggaggaggggtggccggtctcgccggcgtcgattcgccgccgtgtggcgatccctgcacggacgtcggtcggtcgcc

SEQ ID NO: 7605 - DNA, 907 bp, Zea mays
cgtattactggtcagaggttcgaagaccgacgtattttccgtaccgaactttcgtttccaaagtaccaatattatttccatttcggagttaccgtttctgataaaaaatatgaaaacggtaacgattttagtgtttaccgatcgtttttgaccgttatcatccatatgagagatagggtttccttgtcgtaccccacgcatgtggtagaagcagcttccatgtgccgcgtttattaggggcttgtagttggctgtactgaagaggatggagatccatttctaccaatgtggcctgaaaccacatgcatgtaaattacctaggagatagctccaattaactgtgtcgaaagctttctcgatgtccagctttaggagcaacgtcgggattttggacctgtgaaagctaacagtacagacaccaacttctggttatgatcagaatcgactggagtgtgctgaaaacctgaaactactgttaatctctcatgcagtatatgttgaagaatggcttggagctaacagtactgacaccaacttttggttatgatcagaagcgactggagtgcagtaatgaatctctaattgtttgcaatataagaaccagatacctcattcaaatggtttttccatgttacagattggtagccaagaacaaagaggttagctagtggtgatatgcgataaagttttcatatatgcaacaataaagctgaaaattgtagtctgcaaataatacagttttccttctccatatgtattgtgcttagagcaaccaatcttagtgattaaacatggccagtttaacccgattctcaaacacccaaattgtgctatttcacaaattacttgatcatcaaactatccttttgtctgtttaaacatatccatttaccctccattcgggtct

SEQ ID NO: 7606 - DNA, 82 bp, Zea mays
aagggagaccctgacgttcgaggtggtcaggttccgaggaacctaccacgccgtgctagggaggccatgctacgcgaagttc

SEQ ID NO: 7607 - DNA, 1028 bp, Zea mays
ttttcttccacgctaatgtttatgaagttattaactaggtacttttatctttttatcaagtttgttgtatttttatgctgaattgaatacatactattttaatcaatttttatagtatattatggtatattataattttaacaatatatttcgtcgtataatatattaacaacctttaaaagtaaacttaaatttttataaagtggcccgacacgtcgattttacgtagctccgccactgtaatagctaatactccatccgtcgcattatataaggtgtaattaactctgattcaaagaccaaaaaatatacttaattatgtctatatcactgcattgatgtacatacgccttatattgtggaacaagaactaaatgtggttaggctttatatcctaggacggagtgagtagaaatcaatggtttacaatagccaataatagatgtttttatttatttcctatatagatgtttttatttatttcctgtatgttttacaatagccttatattgtgcagaaaatttaggcacacgtgccacgaacgtctgaaatgtactccgcgcgtattaccctgcactacgacgtaggagtatgtacgttgaaccaagcacacatatatctctgacacagtacaatgatatactactacaacaacagtactgcccaattcatccatattttcacgttccatcttccgcgtgtgacaactcgatcggccacgcacgcagacgacgacggtcgacggagcagtacttcacagaatcctccgccactcgtcacaccaacaggcgcgcgctggtgcgcatgcatcatgcatgccatcgtccgtcccttggcgtgcctcggtagacggtagctagagtagtagcctgtgcttgctacccctggtcaacacatcgtagcctcctatatttaacgtatcctcacacatcacaagaacgacacacacaaaccagtagccactactccatccaccacaccacgagcgcgcgataaccctagctagcttcaggtagtagcgagagcca

SEQ ID NO: 7608 - DNA, 1052 bp, Zea mays
tggaaacgaccaccctgcgttcgtcgtcacaaaagattcctccctctctctctctcgctgtctttatgcttgctggagctcggggtcgggcggcgagacttaccagtacatctgtagttttgtactgtacgcgtgaagcacgcaatacacttggctggagaagctgcattatgaatgatatattaaataaataaataaataaataatgctgaattattcgaacagttggaggctactccagactgcgatttcgcaaattagaaacctttgtgtttatatatggcgatagagcgcgattgatagaagactcctatcatggcagcagaattatgaaaggcatgcagcgaagaggatgtcagtcactcgcgactattcggttgatgatatcgtagtgtactacatctaattgtagagaaactaatgacgcgccacaaaaatatggtgaagaaaactgaagagacgcgttttcttaaaaaaaaattgaagatacacttatgttaaagtttaacaaaaaaaattatgacgcgtaagggcatgtacagtgggagagacaccaaaacggttctccaagcacatgagacaactaagagactctattgtacaatggagtgtctctaaacgtagtctattaataaatacagaattaaatgtatttgtatagcatcagatcgatagaacagacgacaaattcgtacagtgggaagtgaggcgtctgttgttacttggtttacgagccagagacgtctcttcacggagagacggctctaagatttttttgcaaatamccccctaaaacaccttaagagcccccacattaaacaccactgtacatgccctaataccgatgattggaacggcgtgctcatgcatgccgcatcttcccaagaattggaggagtattgaccgccaccgccgttgtaccgggtggacgtttggagttccagctcctcgaatgcgctgcaaacgatgggttatatcttgaacccatccaattcgtcgcacatgcatgaaccctgtgcagttgtgcttcaatcctccaaccgagctgcaaa

SEQ ID NO: 7609 - DNA, 1052 bp, Zea mays
ttttgcagctcggttggaggattgaagcacaactgcacagggttcatgcatgtgcgacgaattggatgggttcaagatataacccatcgtttgcagcgcattcgaggagctggaactccaaacgtccacccggtacaacggcggtggcggtcaatactcctccaattcttgggaagatgcggcatgcatgagcacgccgttccaatcatcggtattagggcatgtacagtggtgtttaatgtgggggctcttaaggtgttttagggggktatttgcaaaaaaatcttagagccgtctctccgtgaagagacgtctctggctcgtaaaccaagtaacaacagacgcctcacttcccactgtacgaatttgtcgtctgttctatcgatctgatgctatacaaatacatttaattctgtatttattaatagactacgtttagagacactccattgtacaatagagtctcttagttgtctcatgtgcttggagaaccgttttggtgtctctcccactgtacatgcccttacgcgtcataattttttttgttaaactttaacataagtgtatcttcaatttttttttaagaaaacgcgtctcttcagttttcttcaccatatttttgtggcgcgtcattagtttctctacaattagatgtagtacactacgatatcatcaaccgaatagtcgcgagtgactgacatcctcttcgctgcatgcctttcataattctgctgccatgataggagtcttctatcaatcgcgctctatcgccatatataaacacaaaggtttctaatttgcgaaatcgcagtctggagtagcctccaactgttcgaataattcagcattatttatttatttatttatttaatatatcattcataatgcagcttctccagccaagtgtattgcgtgcttcacgcgtacagtacaaaactacagatgtactggtaagtctcgccgcccgaccccgagctccagcaagcataaagacagcgagagagagagagggaggaatcttttgtgacgacgaacgcagggtggtcgtttcc

SEQ ID NO: 7610 - DNA, 234 bp, Zea mays
tatttctttgttcagttccactgtagactatcaaagctatacagctttttatccagttttgcacttggcataccattgttggaccaaatcttaacatagacaacatgcttccactttacatttctgatttctacgttgtgaattgtgtgtcaaactgtcaactattctattcctttattttttacagccaccacacaaaatgtagatcaccagttggaaactgatccaggcagc

SEQ ID NO: 7611 - DNA, 1500 bp, Zea mays
ggaaactacttgacatgtctagctccgaaacctgtgaaaaaaaatggtccacatctggagtgtcgcaagcaagtagagctttgcccagacagattgagttttgcccagcactccagcatccatgccttaaaaggttatagttagaaagggggaggattgctaagcccttgccagttagccacatagagagaaggccttattattagatcatgccatttcttttcttacaaaattaacaaagtgcaaagcattactatggccacgaggaacagatagctacgaaatgaaactgtcgcaattatcatggaaaaaagccacacatttccttatccattttgtttggtagcgccacatagaaacaaaacttcatgtcacgatttgcatagttatctcaacacatgtggcgaatagaaaaggagaaagagaaaaataaacacaagattcttaaccataataagatataatttgtgtcgggcatttgcatagtcacatgcttatcccatggggaacgttaaaggtttgcttgcacggcaggaccattcctgattccctagatggtagttagatgacggcgataggagccgaggcccaactgcccagtgatgtattggccgtgttgtttatgtgatctgtcatggatgtcctactatgattcaaggatttaggacatgcgcagaactgccagcaatgaaaagtcgaagaaagagatattgacttcgagggggagaaatgtagtccactatgagaaaagagatacccaatgtctctggagaaaaagatctgaggtaaacacgtctaacttgcaaccatgatttgcaatagagaaatccgattgacatcccaccctttctcggtgcaggatgggacctgcagcagcaaaagcgcaaagcttcgatgtcaccgccatccacctaccctccatcgcccaaactgtctctgtctctgtaacgcgaattttattttacacaacagcaaagtgaaaaactggagtagggggttcgcttgcctcagcaaccgtcgcgtagcttgcgcgcctcggcgctggaacggggaatctggaggcgggcacgcatctcccaagcaatctcgcgtggcctcgcgtagcgtgcgaggagacacgcagagagggagggagagagaaagagagccttgaccccgccgtcctcgtcctgtcgtcctgatagctgatgcagtgatgctgatcagctgatgcgtgcggagctcgctcgtggagccgaggccctagcctgtagcctctcacggcggtagaacgagcacccatgggcctcactggatcacctaagcgtcttccaggcccatctgtgcctcacctgaggcctgtctcatttagtgacgaggcccaacccaccagcgtcagaatacaagagcgcgttatcctctctcttccggttccgggcaactcgaagaagccgcgtgcgttatcctttgagcagtttgggcgctgagcaagtccagtgagagagggagagcggcgagagg

SEQ ID NO: 7612 - DNA, 1500 bp, Zea mays
tacaggctagggcctcggctccacgagcgagctccgcacgcatcagctgatcagcatcactgcatcagctatcaggacgacaggacgaggacggcggggtcaaggctctctttctctctccctccctctctgcgtgtctcctcgcacgctacgcgaggccacgcgagattgcttgggagatgcgtgcccgcctccagattccccgttccagcgccgaggcgcgcaagctacgcgacggttgctgaggcaagcgaaccccctactccagtttttcactttgctgttgtgtaaaataaaattcgcgttacagagacagagacagtttgggcgatggagggtaggtggatggcggtgacatcgaagctttgcgcttttgctgctgcaggtcccatcctgcaccgagaaagggtgggatgtcaatcggatttctctattgcaaatcatggttgcaagttagacgtgtttacctcagatctttttctccagagacattgggtatctcttttctcatagtggactacatttctccccctcgaagtcaatatctctttcttcgacttttcattgctggcagttctgcgcatgtcctaaatccttgaatcatagtaggacatccatgacagatcacataaacaacacggccaatacatcactgggcagttgggcctcggctcctatcgccgtcatctaactaccatctagggaatcaggaatggtcctgccgtgcaagcaaacctttaacgttccccatgggataagcatgtgactatgcaaatgcccgacacaaattatatcttattatggttaagaatcttgtgtttatttttctctttctccttttctattcgccacatgtgttgagataactatgcaaatcgtgacatgaagttttgtttctatgtggcgctaccaaacaaaatggataaggaaatgtgtggcttttttccatgataattgcgacagtttcatttcgtagctatctgttcctcgtggccatagtaatgctttgcactttgttaattttgtaagaaaagaaatggcatgatctaataataaggccttctctctatgtggctaactggcaagggcttagcaatcctccccctttctaactataaccttttaaggcatggatgctggagtgctgggcaaaactcaatctgtctgggcaaagctctacttgcttgcgacactccagatgtggaccattttttttcacaggtttcggagctagacatgtcaagtagtttccttcggttgttgattaatttgcccactgtgatagagattttgcaccttgtggcctccacaagagttacttagtagagacgcacgttggaagggcttccmagacaagtgaagctcactagctcagcgttcagttgcttcccacgcttcaccaactgaacaaggtttatatatatgtcatatgatcctatctagtacttattcttagactaaaaacactatgagttagtgctaccaactgaaggatacgcc

SEQ ID NO: 7613 - DNA, 266 bp, Zea mays
taatccgagctcggtacccctgagaccagtcccaccgagtactgactactgagtactgactacactcccaagtcaactccaccgtcggctgtgctgcgctgctcttctgtgagtagtgcgcgcggcgtggtctccgttcgaaccgatgcgcatctgctgaatcggatcggatcgtgcgatcggccgccacgccacggcccgcgggtgaggcgtggtctccgggaggcagccaaccgatcccggcgccggcagcgcgcacgagagga

SEQ ID NO: 7614 - DNA, 330 bp, Zea mays
gagaggtgtgttttagtagtttgtggggactatagaaagttaaaaactattggtagtgttggtttgggactgctcttgtatatttcttgctcgtgttatccacgacgacacaacaacacggatgtgcgaaaaacctgcacgcttgcctatctccctcctcgatctcatgcgtccggcgtgacagacagtgctgggtcgcttgtcggccgccgtcttataaaaggacgcgcgtcgtcctagctgcctagcagttcctcagacgcaaagaagatcgagtctgcagcccacaccatagtgcgagcagattgcgtccaataggcgcaaagggag

SEQ ID NO: 7615 - DNA, 580 bp, Zea mays
ggtgtgatgtccggtgtgccactaaaattcatctccgaagactgcgctctcgggtttctgcgaaggggagagtccctgccgtggaccagcctggcccacctggcagagggtgcaccggacagtccggtgcacaccggacagtccggtgccccaaagccagaaacactcaatcttgtttttcagctgattttcaaatcggtttttgttctaacttgtgtgtgagttctagagtgacacctagcactgtatatgagtgtgattgtgcaccaacactacactagaactctcttggtcaaactactcatcgacaacccctctttatagtacggctaaaagagaataaaagacctaactaaatcgcgagtgtccacatctccttgacactcggactccgtagaccttcaccttttgttccgtctttttagccgtcgcttcgagttcttatttccgggattgttttcaccgttggagtacttctacctgtcatgcgacctaacttaccatttgtctctgcaaaacacacgttagtcacatataatattacgttgtcattaatcactaaaaccaaccaggggcctag

SEQ ID NO: 7616 - DNA, 1500 bp, Zea mays
gagcactctaatgcaccacccttttggtaactggaatgatacagtgaggtacgttatctaaatgccacactttaggtaatacaagttaaacaactaaaaatcttgaagtttatatctatttattttttattgatgcataatgtattctccaattaggcaacgatatagacacttagactctttgatgtaccgtgttgcgcacactgcatctcatcgattcttttctcatttgcgttgctacagtcgctatttcgcaagatcgtcgtggccctatcgggaacggagatgctcttagcgaagctggaggaccgaccaatccaactagcagcagcaggcggggagtggatgcgcctgctagaagagtgctagctccgcgcatacgctcgctcgacaaacgtgtgttgttaactattgtatatagtgttataattactgtcctttattcctgatgtttgttttgtagttgaaactcacattgttttttcatttccatcttgattttgtatgccgtgatcacgaaagaccaaatgttttcttgcggtttctaaaaatatagctctctattgttgtgattgtgtgccgtcgcatcgcacgggcaatgacctagtatgccaataatttgttcattactacttttttacatggtcactcctatttgccatcggcgcacaaccattgtcgaaagctgcaaattaattctatcgaaactaggtatgcttttctcagtatactacacaaagtaattctattcatattatgtactggtttccataaatatattaatgcctacatattgcttatatagatctgcaatatcaggttgcttactgtctatatacatagatcgttgttttaacatattgctaaaagactcgcgtactagtaacaaaataaaaaccatgacttgtttacgcaactaaagaagaggaatctagaatatgtacttttttttgcaaaataaaaaaataaattgctacgaggatatattattttgtgtataataagggaatttgttgggtgagtgagatggtaacgagataggggaatgttctagcggcggcgaggcggttgatattttggaggccggctggagagagacgcggttggcattcctcttcccttcacttctcttttctcgatagaagacgcgacagcagtggtgtcaaaggtaggccgcgaagaagagaagagaatggatgtcaaggaaggagctgcggcgtagccgtgcggcagcagcggggatcacaaatttgcaagctggtcgctgcggtcgtctcgcgggccgtgggccgtggggtagagaactagagataggctggatcagaaggcgtgcacggggccaggccgtaaataataccctacacctacaattgggccaggccacataagcgtgcccggggcaccgcccattgacacatcattgagcgcaacgcggtcgtgattgcgagtgaatccgtggtgtccaactcccaagcccctaccggcaaccctagcgaggcg

SEQ ID NO: 7617 - DNA, 699 bp, Zea mays
tattgcgatttacagggggatattattcattactgctggactttttttttcccagcgagaagatacagcaccagctcgacaccagggttaaccggagcggcctcgtcggctaccaatgtctgccaagtgatgcgtgggatgacaggcatcggcagatctgcatcaccggctcacagtcacggccgctggcgtagtaacttcgcttgccagttgccacagctgaatctgggcctttactaccatatttttttactgatttacacccatcatgaagccgttgtcttcctgatgggtccatgtccagcagttgctaataaacatgtttgatggtacagcccgcctcaacctgtaccttgctcgactaaaagctctcttctggcccatcatgtgatcacggactggcgtcgggcgtcctatacagcattgaagctgcacagtatcgcgctggtccctcgctctctgctcgtcacctctgccgctctgcgcggtattgatttcctcggacaccgtgctccccgaccccgagcgcccatccagcagccagctaggagtaccgccgagtgcactctgtctctgcagtatccttcccggccgatctgcatttcactcgttccacaccgtcgttggccggcccatagctctccccctcctggttagtgtagtgagcgcagcgacgagtgcaacggtgagagtaccgag

SEQ ID NO: 7618 - DNA, 238 bp, Zea mays
gctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccg

SEQ ID NO: 7619 - DNA, 1104 bp, Zea mays
cgtcgtggtgtgtagcgatggaggcggcggcgatggaacttccaagcggagggggtgaggttttagcgttccgcttttacccttgtgtgggaggcaaaccagctggacgactgccgtggcccaggggtaaaacaggggattgatattaggccggcgatgatagcaaggttggtttctccggatcgcctgccttgttcctgccgctgctggttcctggccgatgtggctcagtgcagtgggtgtgctggtacctggtagcccagtgtctcagatattggaagacacgatcatgtttggagactgatcaatcttagcgccatttggaataccttgacaccagcaaatgcaggattttacccaggatttctattgctagggaatcaaacgatcattttctttcaattccaaacaagttacaagtcgcagccttttacgaaggatgctcagatcagatgtgattgtttgaacaagcttctgtatgagcttgaacacacacttggcatgagtctgcgtcatatcgatctttggcatgaggaaatctaagctcaacaggattatgctctacaccaggattaaacgagaaccaatccataccttttcttttgcaacaacatcatcaaatgcaaagatctacagttacactgcttccttcaaacaacagtgcgactgcatcccattgattcagacgaacgaagcagtcaataatatcaatatattttcacatcacgctgttaaatggagctaagctaacggttggcatttcttaacgaacgaattcatgctggaaatcgcacagttcgcgaaggcagatggctccacacacaccacaaggaatattgagggaaatgatgaaaggaaggctgacagaatatgatcaagcaaaaacaacccgaacatttccacccacctagactagaagccaagagcccgacccaggacaggagtagctcaataacagtatgtcagaatataaacaaatacatgcccagtaaatgtgcaaaccagtccacaatggcctacgaagaacatcgactctagtagaaatgtgaaggggtacatttcctgttccagtattatgatatcatcaggtgggtactatattaa

SEQ ID NO: 7620 - DNA, 1269 bp, Zea mays
tgcccccattataagttgtgagcgagctgggagaagttccgattgctcaggaaagtagccttcacttcaggttgtgacgtaagtttaggtttcagagtaatcgaatagaccagtgaaatgttccttatgtgggtcatttaatatagtacccacctgatgatatcataatactggaacaggaaatgtaccccttcacatttctactagagtcgatgttcttcgtaggccattgtggactggtttgcacatttactgggcatgtatttgtttatattctgacatactgttattgagctactcctgtcctgggtcgggctcttggcttctagtctaggtgggtggaaatgttcgggttgtttttgcttgatcatattctgtcagccttcctttcatcatttccctcaatattccttgtggtgtgtgtggagccatctgccttcgcgaactgtgcgatttccagcatgaattcgttcgttaagaaatgccaaccgttagcttagctccatttaacagcgtgatgtgaaaatatattgatattattgactgcttcgttcgtctgaatcaatgggatgcagtcgcactgttgtttgaaggaagcagtgtaactgtagatctttgcatttgatgatgttgttgcaaaagaaaaggtatggattggttctcgtttaatcctggtgtagagcataatcctgttgagcttagatttcctcatgccaaagatcgatatgacgcagactcatgccaagtgtgtgttcaagctcatacagaagcttgttcaaacaatcacatctgatctgagcatccttcgtaaaaggctgcgacttgtaacttgtttggaattgaaagaaaatgatcgtttgattccctagcaatagaaatcctgggtaaaatcctgcatttgctggtgtcaaggtattccaaatggcgctaagattgatcagtctccaaacatgatcgtgtcttccaatatctgagacactgggctaccaggtaccagcacacccactgcactgagccacatcggccaggaaccagcagcggcaggaacaaggcaggcgatccggagaaaccaaccttgctatcatcgccggcctaatatcaatcccctgttttacccctgggccacggcagtcgtccagctggtttgcctcccacacaagggtaaaagcggaacgctaaaacctcaccccctccgcttggaagttccatcgccgccgcctccatcgctacacaccacgacgcagcgcccgattccgccggccagcaacg

SEQ ID NO: 7621 - DNA, 751 bp, Zea mays
ggtggttcccccgctcccgttgggactcagcacccgtaccgctcacctcagcgtggacaccagtcttatggcaatcccgcctgcaagaccaagataaacctagaaccatagatcgttagagttggatcttgtaattaatacgaaataaatatatacatggaagcttcagtcttagcgttagtctcggtcttagttagttttagttagacagggtagtttgctatatcctgtgcatttatgtttgtcatgatgaactatgtttgatttggatctttgtaatgattgtcaccagagtgtgggtatcccctgcattttggtttacatactatgtcaataaagttagttatatagttgggaaacccattattctcctttcctctttatctgagaagctgtgtggtctgtgttggagatcagtgaagatgctcatctgttcagtgctgttggagaattctatactcttttcttatgctgcaagctttgccagatcagttctgatgtgtggttgcgttctgcagatgtcagagaacaggcgtagaggaggaaggcgtgctcagcaggagcgagccgctccgcaggatgaggtgccccagcagcagcacctgccgcccccgcccccgatgtcgattgagcagatgtttctgatgcagactcaggcagttcaagctatcggtcagactctggccgccattcagcagcagcagcagcagcagcagcaacagcagcaagcaccaccccagccttagatcag

SEQ ID NO: 7622 - DNA, 1500 bp, Zea mays
ccgacaggatggtttaacttccgagagtttagctaacttcctaaatgttagagctaacttcctagggtttaggctctagaaagtttactattttggtatagtgaggctatatgctacatgagaggagcatgtacaacctagctagagccccttgctcggttttctaagtagaagagacatgctaaaaaagtgcatcataaaacccttaatcactatgacattaatgtagttaagaaacaatatatatagaaagtcgtgaagaaatatgctcatattttggttttcttcacttagggctcgtttggtagacatggatcacgaggagagatccataggggaggaatccccttgctattcaaaattggatttctcgtatatgaatcctctagtgatctctatccaacaaattaacccttaaccttcttaagggatctctcaattaataagaatgcatatatgccctgagggttgagatttttgtttcgggacaaccgacatggaatttctcagagttagcgaaggctgcatatattatataacaagtcagcccttttaaaaaattcctcgtctacttcacttgctgacagaacgcgatcgcactcgggaatcaaccaaaagaaaacgatcgcgcccccaataatatgaagcaggctccatcgaatggagcacatagggtttaggataaacaaatgtgcagaactggcagtagcagcaacgcatgcggctgcagctctcgatgcacttttggcagctcatagccctggttgcaagggctgtgaagtcataataaaccttcagctagacgctgctgcaggtgtccatgagtctcttcttcttcgtcaccatctttaaccacagactcgctcgtcaactaaaaataacgcaaatatggatcattcgttcctgtcaatcatttcaggccagtttacgtgacggagctgatgcatcgcgtgacgcgatgaagatataatggcgtccgtcgtcactcctctccgtctcgtcgtcgtcttcaccagttcacgctcccttccctcccacagaaatgcaggacacctcaggtgtcacacctgctcggccggccccatgacatgagtgagtgaatgaatgaatggaactctccatcgacctcgctcctgccctgcccttgcgaggtggcaacagcaacagggaatacataaatacgggcacatgtcccacggccccatccccacatgagctgagcatcaccgagtcaccgacccgtctccttcctccaccctcctcactccacacacgcctctctctctctctctctctctctctctctctctctctctctctctctctctctctctctctctgcagctcggattaattgctaccatccggacatcgggagccttccgtttgagctcgcggggctcacgtacactcattcacccaccgctcacctctggtcggtccatccattcaacacccacggccggcgcgcggcctccgagtccgagccgagtccggcga

SEQ ID NO: 7623 - DNA, 67 bp, Zea mays
cgtcgtacggaccgtcggtggctagcatcctgaatcctgattcatctgtggtctccagggattcggc

SEQ ID NO: 7624 - DNA, 478 bp, Zea mays
attagtatatacatagttttttgtcttataagttaaataaacgaaccagctcgaaccctaaaccctaaaccctaaaccctaaaccaaatgaaccaaatcttctctggttagtttattaactagccgagttgtatcccgcccccggtccacactggtatgaacccgggtacgccttccattttgctccctcgtcgtgcttggtcgaccgtagacttgcagtccccgtcgtcctcgctatactgtagttgcgctgacttgaccacccattggccacagcagctgaaccaagttcaggcagtttcgtgcccttttcttctccaccagctcaaagctgaacgcggcatccttcctttcctcccctcttctgcccccatttcgttcctttcacaccggggaccggcgagcagagccgcgcacagcagaacgcggaagcaagaggaggcgatcgactactcgaccagccctctccgtgtctccg

SEQ ID NO: 7625 - DNA, 535 bp, Zea mays
tgacagttctgataaatttgcgtgtggtgcgcggaatgattcttgccgggtgccagatgttggagggcgatgatggtggtggaagggcacgcatgatggatgccataagacgttcggcgcaagtatgcccaggatgtcaggcacgtcgttgccaaagtggactcgtgtgtcggttcctgctgcaactacgtgcccgcacggtgctcgcagcttttgcccttccccaccgcgcgctcctcatctatcattccacacgtcctgcgccacgtacacattaaacaggtcaagcccattaatataatgatcaccaaaaaagtaattagtataaaatactcatcacgtcaggtgatgaagcgtatgcattgcatgcatcgagtatatatttctgtctggtcggaagcaagggcctcgctcgagccactatatatataccaataatctccttcatatctcttcatcagagataggagagacgaacaagaaaagacgacatcatatataccgtacgttatagagtaggaaaatagaaatacga

SEQ ID NO: 7626 - DNA, 262 bp, Zea mays
tgtcgcccgacctgaccccacgcgaccactctgcccggaaggcgttcgtccatttgcccgagtccgagagcggctggctgctactttgccaggagccttcctgggagatgccatccagtcgcgagcaaagaactcgcggccactctacgagctttccgttcgacggctctcttcacagctcaagatctctgctttcgtttcgccccgttcccagaacaagtcaactccccccttcttggttcacggcacctcgtcgtcgtcc

SEQ ID NO: 7627 - DNA, 296 bp, Zea mays
ggctatgtttattgttgttaaatttggctcattgtgcagtataaatttggcaacgaagatagcagatgacaccagtagtatgaatttggcaacaaagatagcttagatagtatgaatttggcaacggagattcctaaatgacaccaggaccaatcccttgctttataggagtcatacagatataaaaagaaatagcaaacaaactaagaaaggaaagaacttaccctgccaaattcataccaagatttaggatgtacttacttcaacaaccgagacatcgaccaagataacatggt

SEQ ID NO: 7628 - DNA, 372 bp, Zea mays
gctaggagcacaattgcttacgtattaaacagtagactaatatatatatacagatcgcttccgcaaacattgttgctgaaagaagcatacatctcccacctgaccaaactgcacggacaaatgggaaataatggtgcgcagatgccagagttcctccttccaggaggctcatgctggcatggcagtccaaaagcctccaaaacccaaggcaaccgaacgccaaccacgagttcagcccacggagcaatggtgcatgggcaatttacccccatagtcaatggtggaaacaacaagattagtcaagtcattcagacagtgagtttacggcgctcagcttcctgctgtcactgctaaccggtaacttctactcgg

SEQ ID NO: 7629 - DNA, 340 bp, Zea mays
cgccgtcgtccccggcgccgcggccggatgagcatgagctcctgcgcagcctggcgatcccggagaatatctcctcgagcctggcgcgcgctcggtcgcggcggcggtgagccggggtcgggaggtacgggaagaaaaggctcactaggtgcaggccgccgataagctcgcggaggagcgaggacacctcgtcgtgcatgtgatcgcgaacctccttccccagaaggcaccggctcgcaatcagcaggagaacgtcctcgacctgttgcttcaggtcgaccgtgccggactgcccccacctggcgaagtactcctccacctcgcgaaccatgagacgggc

SEQ ID NO: 7630 - DNA, 1153 bp, Zea mays
ttgccgccgccctagaaattgggtacccgtagggactctcgggcacgaacgccgtcatggaaccacggtccagccaatccagccaatcggggcctcacatggcttctggtaatgttaagtggatttagtgtgtaacttgactcttatctctcggttagtcctaattcctaaaagcatatcggtatttttttggttcatgattactatgatttgaaatcaacacacccaaaatgcttcattagcaatttactgaaggatgacagagcacgtaggtttagccgtcagttcaactttctagggtactgtatcgaatattgaagatcagtgaaccacaaatgtccaagtacgaagaatttcagtaagatgttacttcagtgttgatggattcttctagtgaaatgattacaaaaatgatatggagttacttgatagttgatactgagatttgctctgaatgcatggcattttgtgatgattttactatggtcagggtacagtattttttgaactttagctagtccttgaaattgatatagtaattgttctcattagtgctgcaaaggtcataaacccttcgatctgcccatagacaatgcaactgtcgaaggatttagcaaattcagataaaaaagaactactgaaccaagatatccgcaccttagtgttattattattgtgtgttctattgttttagccatccacttgtgtcttactatcattattttatttaaaattttatatacattttatttttaaaacaaaattaaatcgatatgcttttaatcacaggagaaggggacggtggcgagtcgcaagcggccgactgccaccatcgaggagtagtgtgggcaggctgccggcgagggcaagtgtgcgcgactaccgcgaggacgagtgcgagcgggctgctggcgaggagtgtgtgtcgagctggcggcgacagattcttggatcacatccattggtcagtggtaatctctagccttaactttttcatcttctgttgatcagaactatctaaactgggaaaaaagtaattaatttagcttttatctttgatacttgtaatgatccccccttttccaccattttttcacctatattatgaagctgggaagggtacaatccatcttattatttattaaggtacaac

SEQ ID NO: 7631 - DNA, 1500 bp, Zea mays
gctaggttgaaccaagggataacatttggaggtgacctagaggccaatagtctaaactctaaccagaacaaaataaataaatagagaccagtgtcatctggctcagctgacaccagagcctgtaatcttcttcacttgactcagatgtcgtttaagttctcatcctggcgtaggtgtgaatgtcttcgtctgatgaacgtttgtattagccttgcaccatttttcgactgggaagtacggtggggtttcagctccctgggttttagctctgccaaaaaaaaaaacgctgcatcgaatccgatgatttgcttgcatggtcggagtagaaaggctcccgttccaacatgcagaaagggtccgaaccatggtccatggacccggtcccaacgatggatgatatgatccgggccaggcgttgacgccgatgtcaagcgaacgtgaacccaaatgaacgaacgggtgggtgggtattcacggaacggaagtatatgcgcgcgtcggtttgttcggttcctgattttcgagtcccacctcgctcacgcttcagaagtttctgccccggtgccggtagcttttcattcgcacacctctgatctttcactagtcactactcgtcaattgcaccggcgagcctccgatccgagcctagagggtgtttcgcgaagcaagggacactttgactttccatttcttcgtgtcttggagctgatgcgatagcgacgactacgaggcacgcaccgccggtgggtggtgagaagtcaaggtttccctggtactagtaacaatggagacccacccattggttaaccgatgcaagaacagttcaaaccatttgtaaacagcaattggatgggagggagaacgaatcacgcggtgacgtgtgggaacacgtccctcgttgtatttgtgcgggctcgatgcctcctcgagcgcgcgcgcgcgcggtaggggagaccggatctccctcctcctctcgctttcagcacccgtgcgcgtcgtgtcctagcaacctaccgtaccacttcactcgcgcaggctggcgtcgacggcggtttggaagcagcaatctcgccataacagcctcttgtccagagcagaagacgtcctagtcagacgcacagcttggcctagtcctactgcttccctccctagcggtttcaagagacgacgattctcctccgtgttcttccatccttctgctgctccggcgtcacgtctcaggagggtttcttggaacggatctgagctgtgcagggcagggcagggcagagcagagcagcgaattcccgtttatttcttgagatacagttggtgaacaggtggagaagaaatcgagagaattcttaagagttcggcgggtctaggtacgcggtatgcctctcgatcggttcttctcgacggcgtcgtgacgacgcgacgcggttctatcgctgtcgctcacgaatccctgcgttcttcttgcaggtaagccgcacgccggctggccccggccgcaccgac

SEQ ID NO: 7632 - DNA, 424 bp, Zea mays
ccgaaataaacagtgccttaaccgttaaactaacgctatgtttttttttcaataaccatgttacaagtggcttggtgaaattctggttggacaacgcggtggtcaaaggaggagtggggtcggattgccgggaagcacgtggctattataagctcagcaacccgaaccgcgtaacaaaacaaaagcatttcggcaaacggcaggctgcacctgcaacacaagaaaagaaaaggcgcgccttttctcctctcgttccaccgacggcgacgcaggcctcacccgcaccaaccttcgttctccttccccttctcctccacgcgcgtcaatttgccatcccaggaaggcagaaccccacacctctgatctgctctgcccatcatccagcgcatccccggccctgacttaacttgctgctcacctcgcc

SEQ ID NO: 7633 - DNA, 945 bp, Zea mays
ctgcaccgatccgccatagccccgctagcctgactccaacgataccctagttataacatctacttttgcatcatggtcgtagatcacataagagatacaatgtagatacacagatctttgcatatatataaatgtatctgtttcgaattgtccaattttttgaatagcatgtggtttatagatagggttagtttccatgctctactatgattgtattgataacagataaagaggacaaagtgttctggcggtaaataaggccagttttactgagttctgtcctttatgatgcattagctatttgatgatttatcaggttaatttaaaagatataaaaaattttatttggataaaacctattatcataaaagctaatgtgacacttttattattcgatttttaaggtggtgttcttagttttgttggtgtcctcatttttataattagttatgttttttcttattatagatcagaagagtaaaactgagcaaaaaaaatatgactaagagtaaaaacgaggaacgtgataaaactaaaggttttgtgttacgaaagtcaccgataaaaaaaaaagactcgaggcacctctcgataagtgattggagatcccttcatccggcccttctccattcacctacaactttcctcctacagcacgacggttcgcatcgcagcccactgggccacgggccacgacacttgcaaaatgaaaacccggcccacatagtccgaaattgaaaaccacagccgcgacgccgacgcgcaccgaacaacagctccgagaacgtatcgcccacaatcctccacgtctaccgcaatctgtcactatagcctgcgcattcgcatccgggcatccggcatcccaccccacccacctccttcctcttcccgcccgctaaaacccacgccaccgccgcgcgccgccggcagcgcaagggacgcacg

SEQ ID NO: 7634 - DNA, 723 bp, Zea mays
agtgaatccaacaggagagcgtcatctgcaccgcaccaccacaccagtggcagtggggctctgctcctcttccgccggggaccctggcacaggcgcgcgtgcaaaaagtgcgggaaatgccctccgcacggtggaaaacccgcgtcgcacgcccgccacgacgcggacgcgcccggcgccccccacagccgtcctgttcctgcacaggacgcgtgagagagaggaggggactgaacggcaggaggaacgcgcggcaagcagaacgtgtgcagggcgcgcgtgatcgccccggccaccaccacgcgtccccccggctccgcagaccgcacggccgcgcagccgtggtgccacgctatgggacagcaaggcgggccgtcccgcggcacgcccccaccaactggttcccgtcgacgccacggcagcgtttgcactgagccactgaactgaactgacacggcatgaattgcgcagagaaaatggaatcaaatactatcacactgctatggctggctgggccccgtcgttttcgcgggaagacgccttgcggaaacaaaggcgccagaagcagtaattgaggcaacaacaacacgatgggcagggcagagctttgaccggagtctactaccacagtgcagttgcctctgcttatatatataaaacacgccagagtttactccaatccaagcagaagagaagagaggcagacaggctcactagtgggag

SEQ ID NO: 7635 - DNA, 94 bp, Zea mays
ggttctttctttctttctttgttgtttaattttatcctgaaagctagctgaacaattaagtgccccatgccaccaggcggagcaggaggcgatc

SEQ ID NO: 7636 - DNA, 212 bp, Zea mays
aatgatgaagtgttttcattcataactttcatctaaagattatgtatccaaaaggagataatgcttcgtaggacgaaggtccctaatctttaacaattgtgttgccttgttcttgattcacaacatttgagaacaagtgaccaacattggcgcccacctccggtgaactcaaacgaccaccttcgacaacagctcgtttaatcacattcgtc

SEQ ID NO: 7637 - DNA, 795 bp, Zea mays
taccatgaaagtttagtgcacgtgatgcacatattaaattatcaccactcatcatgtctctagttgcttggtatattttgctaaggatactctttgacgtggtgatgtatagtggtgaaagatgttatttgtaaattataataatcaattaaagacgttagaactaagataaataatgatgatttaatatgtgaacgcaataaatttaatgtgyatcggatgcgaccttttaatagaaaggctttccgacattcacgcacctcttcgggaagggccaatgacaacatgggtcttcccaacattcacgcacctcttcggaaaggtccaatgacaacatgggtccacgtgtcagaaaccaccggtgggcagtggttatgatccgcatttcgaatcgaaagtcgaaaagccctccattttcctcgtcttcagtactcaccctacgaacccaacgtcccccccgttcgatcgcaacactccccagccgtgtagggtttcggctcgatactccgagccctccctcccaatggctaatgtcaagcggtcgactccagtgactgtgcccgctcccgctcccgcgcctgcgcccttggacccgggggctacagccgccatggccaagaagtcggcgtccaccggggcagcgattacggccacgaaaagccccgcggcggcgtcaccgctgattgtgatcgaaatcccgtcgtcacctgatgcctccacgggtggccgccgctcgacgacgaaagcgcggaagagcccgcgctgtggccgctcgtccttgacgacgagatcgag

SEQ ID NO: 7638 - DNA, 602 bp, Zea mays
ggtagagcagttataaattatgcggttaatataggagattaagtattacttgcagctttaattgcttggttatttatctatatatttaaattttcatgagatggcgttattgcttgatcttttcatatcaagcaaggcttgacatttgtgattttatattaatattttcaatcaaattaacactcaaacttgctcttcagtttactacttgcaaataaagcaacatccatttttgttatttttatgagaaaataaaatacaagttaggactatctctgaataaataaaagactcctggtcatagatacatgttgttttaggataatatctggtgaaaacttgaaaattacaaacatcaatatcaaatttatctggtttagaaacatgttaatatatgtctagatttttgtttgaaaatacttgcaaaatctcgtgatttcaagaatttttagaatatgttctagaagaaattggtggtgaaagaaaatatcaaaaccgtgcaaagacaaatgtgacaactatttttcacgggagggagaattccttgctttttatcactctaatcatgcagtacatttactttttcttcttttttcctgctg

SEQ ID NO: 7639 - DNA, 502 bp, Zea mays
cagagagacttggccgtgcaatgaagcttactgtcaccgaagacaaaggcaacggtcatggccttcatgccaccatgcgtgacagcgtgagccgggctaaggtacacaatgcaccgtgaacgaaacctgccggtccggtgcgtttagtaacggaaaccggcacacgcagggtgcccggaccggccgcggccgcggccgtgcagagcaggtcacgcacacacccgcatttgcattccattccacgattccatccctgatccctccgctcctctctactcctctagcggtccagcccctctcccctttctctctcctctataaacccaaccacgggaagggaaccaagagagagaagagaagcatcccttcgccatagcagccagcggagtaccaaaccccacacgagcaaaagcagagcacacagcacaaacctctttcccctcccctgccccgcctcctcctcctccattccccatcccccatcccccatccaccgccgtcg

SEQ ID NO: 7640 - DNA, 62 bp, Zea mays
gcaccaagcgaccaaacgcgcgccaccttgattgaactcgaagcaagcaaggaaaggcccta

SEQ ID NO: 7641 - DNA, 68 bp, Zea mays
tttaccgagctggaagagcacgtgcgtaacgcgaaaaacccggctaagcagacttcggatacgccttc

SEQ ID NO: 7642 - DNA, 1500 bp, Zea mays
gaattcgacctgcagaggtcgatggcgacggcacacgcatcatgaaaggaatgacgaaacacgaaaggaatgacgtactccgcccacgcatacggtcgcgtccatcgtcatagctcactctgaccttcgtactccgctccgacaaaaacgtgcctccgttccgaggcaaagtcagaatcacatggctcctcctagtcttccacgaggataccgactgtctggccgtatactttgaaagttcgacacgcccaaaaaacaaaaagctttctcgtctcgttaatttctaggaaaaaatactatagtttatcttcgattgccgctatatgatttttttgtttgcttcttgaatttcgaaccagatacctttatttgcctctaaactctcaaaactgtagtaaaacattcaattattttttttttaaaaaaacattctagtggatgtataatcacgttttaaaattgacacatgcaaaacatgtaagatgcaatcagcatgaatgcaagatacgttgatgtatatgaatgaattcgtgcaatgcaatggaaattccagcaaaacaatcgtcaatcttcgaacaggttcttaccatggatccaggttttggaacgagaggcccatgtaccgacggcccacagctgcacgcgcggtctagaaccagcgtccaacggtccaacccaaccagagcagagcagggcggaccagtaaacgccaatcccagccggtcggccctcggccgtgacgcgcatccacgcaccctaaaaatcctcggtgaatacccgaaactgccctcgagttggtgcgccataaccccctgggtcccctgcgaaccaacctcccaaaaagggtagcggattgggctttcccctccgcctccctcccctcacaaaaaggcggcagcacagcgccacccctcctgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggaggtatctttcgcttcgtctcctcgacgcgccggcgctggtgccgtagggtgcttatcgggtcgggcgaatgggtttggtggtcttgcttaggatagattcgtttggtccgggctgatgtcagcggagcggggaggcctaggttcactgcatctgtccccgggctcgttgtgttaagtcgtgatgtcggattggtccatcataaataacaaatcttgggccatctttgtctgctattttctagtggggagggtaggtggtattcttcattcatagtgccgagctcttcttatttagaaccaacggtgtcaagcttttggaattggtggctgagaatataccccttgttgtggccgtcagtgcaccgcagctgaaagcctgagcctscaatgtgtgtcctgcaggttgagccaaagctattttctaagaaaa

SEQ ID NO: 7643 - DNA, 1313 bp, Zea mays
ggcggtagacagacaaaaccttcactaggagtaaattatgactaggctctggcccaagccttccgacgacatgcctccatatataaaatttggatcacaaaaacaacactaactatatctagttatgtatatgtatatgttactcttatttttggtatggtatgtgcagaaatcgaggttttggattttgaaaagaatgttgtgcggcaaacttgctgtgaactcatcttattttccacataacagattaacaggtagttaaccagttatagaaagagatatgagacagtttatctgttggtaaaataaaatactatatattcctatatgttgcagatctgttaaaacatgaagatgagttgatatattgcctttttttttgttagaaacatgcataaaaaggtgatttcttctctatctccttctgctatcgtgtgtatataatcttttaattctacaataaataaggtagatccgtatatttattgacgttaacatgttctactcatcttaattcgataataagtaaactatattaacaatacacttatagcggatttttttaatagaccatcatatcaacaaattctgactaggccgctgtccctcgccgccccccgcttcgcgccctcttcctggtagctcctgcctcctgcaccacgtaccgagggatcacgcgtttcctgaacctcagctcctgcccttttgttgccgccctttcccctcttcaatgttcttgtcatttcttcttctagataagctgcatatcctatcgtggtcgtggtcgagctgttgtccccttgcttgtgaaccttcggccctctttggaggtggtcttcctacccctcaatttgccttgagcaatttggtttctagcgtctgtgggtgctctcctttgactgcttcttcctccacctgctgcgccggcaagacgacgaggtccaaaatctcggtggccgtgctgtcactctcgccgcttcgttattcttgatgcgcaggcacagctgctgtcccaaggcgtccgatttccgcattgcgtgctccgggatacacctcttctcgcgttgacttcgacgcgcactcgaggcgatcggggcacttgtttccatctttgatctccgctttccatagcttcccgcgcgatctatccgatctcctgcccaaagggagccccgttcccggatgctggaggaaggggcacacatatacccgcgacgtgatctgagccggcacggagctccaggagtcgagggctgtgttcttggatccgataaaggttccggccactcgtgttcgccccgccgcacgccgcg

SEQ ID NO: 7644 - DNA, 1500 bp, Zea mays
ccccattctgcatgggcatgagagtttgcagaactgcagtcgaattagtggcgaggaatgcatcgccataggtgttagttggcctgtcagcaggctgttccgatcccaccgttgtttttagttttttttttgttttgtttctctctccatcaagtgtataatctgtctgcgagttgcgtatatcatgcaatgctgagtgagttttgtcggcagatagcacaaagttttggaaaggtatctctatacagctgggcttattaatctggaggattattaattattattattatatctaatcacatatgaagatatggaatctcgtgtaggtagctagtgacaacaagttattgcttaatctcttggttatacgtactttggtgagttggtgtcagttgccctgtccatgcatgcatgttcatgcgtatggagacagtcagcagcgtggggcaagcaatgcaagaataccaaacttgcgtcacggtccatgcatatcgtatcgatcgtcgccctagctagctccttttcttccccattcagtcatcacctccatccccgtcgtcgtggcccgctttaacctttcgcgcttttgctctttttgtaagctgtactgtactgagatctccagacgacattccaaactgtacgtccgggccggcctccgcccgacaccgcaaaaagcgagctgcttggactcgtcaatggcgtcccgcgtccgtccacgtcgtcgatcgcaggatcctctacggaacaataacctctcttagtctcggactcggtgctgaccatgcagaaggtgaccgcaaccgatcagcctctcctttcgcgcccgcgcgccatgagccatgggaccatcgagaagggagctctcggcgagtaaactagtggctctgggctccggccggaagggatgagatagcaagaagagagagagagagacctcggcgagaccaccggtcgctcttctccatgaagacctagtagggttggctttgagaaagccgagaggaggtcactgtggcatgcatgcaccgcacagggtcgtaccgtagctactagaggccttgtaggttgtagccgagcttactatatatttaggcagcagttagactagcagctagtagatcgcaacatcaacaacagcagcaggaacgaatctgtagcttgttgttgagcaccatctttaggcttttcccttcatcacatcctgcccccctggcccctgctgctgctcgatcttttcgccttttgtcgtcgtcgctagggcgtggcgtggttgttgcttgccgatataagaaggctagctgctcctgctcacacgtcttatattcccttcttcttcttcttcttgtcctcctccttcgtcttctccatcttcccgtccttcgatccatcaaaagctggccggccgagacgacgtgcatagctataaataatagcccatagcatcctcaacaaccagacaagaagaaccacgccgccggttgtttgttaatttcttcc

SEQ ID NO: 7645 - DNA, 91 bp, Zea mays
gctgaatgcccgtgcgttgcaacgggaatatataataccagtatattacgataacttatatacaaaatgtgtgttatattgttatgagaaa

SEQ ID NO: 7646 - DNA, 83 bp, Zea mays
gctgaatgcccgtgcgttgcaacgggaatatataataccagtatattacgataacttatatacaaaatgtgtgttatattgtt

SEQ ID NO: 7647 - DNA, 286 bp, Zea mays
gcaagtaagcaatagtaaataaaaaaataagaaacggctcttaacgtagaacatgtttctatacgaattttcatatatgttgtcttttaactatgtttatatttagcttctaggttgtattatacaccttttcagcggccttttatacttgagttggaggactacaagataaagtgtggatatctcaaagggctcggctgcagttttgcctgtggtcaatggtcgtcgcttcattggtcaaaccttgagagccccggttcagcaatcgcagttccacaaggcggcg

SEQ ID NO: 7648 - DNA, 1461 bp, Zea mays
gggctcatgtagagtctgcaacggatgcatgcattaggagtgttttcgtataagaaagatgaagtttcaattcataaaccatgcagtgacctgagtaacactcgaggtcctgagttcgtatttttattttttgtagaaggcagactttaaacggggctaattttgagggcgctaattttccaattacaaatatctgattcgatatagagatcggtaaaaaaagatggaattctaaaaacatataccacatgcagatctagaataataacatacaaacctatatatctattcttattttttgaagcgtgtagcacttgagtgtccggacagaaaaaaaaaacattttagcctggttcggtttgattctaatccatgtggattggatggtgttgagtcgttttaaatctatcttacaatccacatgtgagtcatgtctgagtcacttattaagtatgcgatagtagtctgccattggcgtgttgtgtgtttcacatgtacaaccagttacgtgcccccacaggccttacacgcagtccagcaaaaattatcatgcccacgcgagttgaacctgaccagttcagccaccaacagagttcttactgttaagtccgagccaacgcttataagctgctctatgtctcctttactagccagtatggtactaaggtttttgcaagacaatacaacaacacagcagtgcaggcgttttgggctgattttttggtgcggcccatagtcgcgcgacagcaggaagcagtcttcttcttcggccgttcgctagcagccgagcaggcccaagtggtgcgtcctgttcacccacgacgacccacgacgcctgcgtcggcccttgccgaaactggcgtgcagagcagtgctccacgacgccgccaccacctgcccccagcagcggcacgctccgacaacggcgaccatggcggtgcrggcgcggcggctggggagtctgttccctgctagatccagtagatggctgactcatcgaggccctccgtgaacatcatctgcgccggtcgtctgctcggctgcagtggattaggtgagcgggattccggtagaggattgttgagtttgggattctaggttcctcgctctccctagccatcacagctgtgcaccacgcctttgtctccatcgtcgtagtcgccgtgtggtacgccgcaccaaccgtagctcgcatgctccttctatcccccccacagtgtacctacgatgttctcccataataacctgggactgtgcaggaggcttggtgtggaggcgctcagcagcgggtggaagttcccgtcaaggagtctgtcccgtcaaggagaccgtcgtgccctggacggagtcagagcaagagtcgatcaacattttcctcacgatgattgagcgacacaggcacaattcaccatgatcccatcccccactcaaacctgcaaaatcctgtagccgaacatctcg

SEQ ID NO: 7649 - DNA, 1500 bp, Zea mays
gagacgaacgaccaagcccccgccgagcaagtctacgaggtggggtgaacaacaaagtccccatcaagaaagtctgtgaggcgggggcgaacgatcaagtccctgctaagcaaatctgcaaggaaggagcctggaccgacatcgttgacccacgatggccatgatgaggcacaacatcaccaaaccatgtccacgtcatgtgtacgacaacaaggggagtcatggcatcgaagtctcaacccacgtaccaggaaggacatgacggcaaaccctgcgtgtgctcgaacatgctgaagggtgacgcaagggagttgacgaaagatgaagtcgtactggacacgaacctcaaccttaccgggagtacgttctgtgggacccatccggtgcgatggcatgggcatagagtaaactatagggtcctgaagggtagatggatgggatagagcgccatgcaaggaatatgaaggcacacgacctgtcagaaggagctataacgtgcgcatgcacaccccaagattggccccagaggggcctactacgcaatacaactgagggcgatagttaaagaactctctctcgctttcactctttttccctctttcacttgtaaggactatcccttgaagtataaaagggagtccctctcccctcgtacgcacacaagcacaccagctgtaacacgttctactgcaatactacgatcagcactacactggactagggctctggcctaaaccagtataattccagtgtctcagttccactctcgggtcctcatgatccaccattcggagtgagtctgcgcttgcatctgcaccgaacacaaatctattatcccccggtttccgaaaccacgacaataaaccattctactttttagccaaattattttaaatttgatagattttatataatacaaaaataatatttataatatcaaatatttataagaaccaaacaaattattttattaattgtatttgaataggtttttaatgcttttagtcaaacctacgatgttgactatttgataattgttctttgtaatattaaaacttaaacttaggctaaatttatcagcttttatattcttatattttattataatatagtctatagtgtaatataagtttttatgcgtttatatataaccactccattctaaatataattaatttgaccttttttgccacgttgacccactcgttctattcaattttttaaaataaaattttaaaaacatatttaaagtatattatatacttaaacaatattacaataaaaatcaacaataattataattttttgaataagatgagtaggttaaacttaaattaaaaaaagttaaagcaattataaattagaacggtgcgtttatacgcacagcacagcagccgaaccagcgagctctgaaaaaaacaacatgatgccacaaagccaaacaaaagcatagctgagaggagcttcggtgtgatctccgtccaccctcgcgcatcggcc

SEQ ID NO: 7650 - DNA, 334 bp, Zea mays
ctggcgtgcgcacttctggtctgcgcgacggcggggggcctcggcgggcaccccgcggcgcgcaacaacatgctcggggtgctgacgtgggtggatcacggacgccgtggacgctcggcgtcgcgtccctggcgcccctgttcctctttccagcgttcggcatatcctcgacgtcatctccttcgtcctcgggagcttcatcctcgcgctcgccatcgagcagtacaggtacagcatccaccgccgccttgccctcaacgtacgtgcgccgcgctcgcgcgtccgaacaaacctgctgctcctcggcgtctgcggcacgaccgtgttcatcagc

SEQ ID NO: 7651 - DNA, 1500 bp, Zea mays
gttattatataagcctatctcaaattcatagggtgagatatggaaattgattctatagatttacatgttagtttccgacgtacaacttatagcacatttttctacttgcttcgctataccataaatatagtatataactatctctctcaaatgatttaggataatatacaaatatactatatatataaatatataaacttaattagttttgtctaaattacaattattaaaatggaattcaattccaacgaaacaaacagggccttagagttttagagaaaggttattgtatatgttttatattaaaattatagttttagttcgtttcggcacaatctatcatttttattttttgtgtaaataaaccattagaaaaaaaaacaaactcaataaaacatgattttgttggacagtttatggtttcaaaaataaaaacattagaaaaaaatcaccaacttaacataatccgattttgttggatattttataattatttctatagtcagagaagttgattagtaagtgttgccgaaatcatcttaagattcggacacctgaaatataggagtgataaacaaaacacaatctactggaatactttagatcaaattaccgctttcctttagcgtctttaataatcaatcaaataaacatgtgaaatacacggcagtcagcaaatgaaaattctatctgcgggagctgcatttcccacattcagagaattgacgtcaacagcgataagtgttgagagacaaggctagttaagtgttgagagactagttaagttacgtaacacagagaaagtacaaacgtgtcatagagaaaacaccactgatatgatacttctaagaactagtgtcatatcaaacgcctttaacgtagtacagagagacaaggctagctagacgagtccaatcgaagcgcacatggaatcgctcaagatgactggcgtctcgtgttcttcacctcgagtgtgcaatgcagctgccatcgtcacgggtcgtgatttgtgacgaaccagctcacgtctctctctgactctctctctctctagagcatttcgaaaccggaggaatgcagccgtgcagcgcactctgtagaaggctgactctgcaaatcatgcgccatctggtggacgctggagccatggcggcggcccggcgggaaaaaagaaaagcacaccgcggacacctacctcttgggcaggcggagcgctcttctcctcccctctccaaggtgacggctgacggcagagcgtgacacgcgcccccctacgtggccacgagtcagcgacgaccaggccacgtcgcgaggccgccatgccgccctcccttcagcgtcgcgtttcgtccccgcaccctccatgcatacatataaatagacgcccacgctcctcgtgcttccgatcatcagacaacagacaaacattcaaactacacgtcgatcatcgcatcgcaccacacggcctgcctgaataatccgtccgtccaccgaccgcca

SEQ ID NO: 7652 - DNA, 1500 bp, Zea mays
tatgtcgtctgggtgtggcgataacatggtccccgcttccgtaacgtgtgatcgcgacagaacgttcaccggttcaaggacgccgtgtcgcatgcgccgagaaagaaaaaaaaatctcctggaggggaagcgtagtggatgtggatccttcatatgcgctgcgcgcgatcacgagcaaaaactgtccaaccctgtccagtccacaatcttcagccactccagcacgtactagtatctttaccacattgtgattggarccccggacgcggcatcggatcccatcacgaaggcagccgcggcggccaaaagttggcgaaaggcaggtcagggccagggccaggccatgatggtttggttcacgtcgcgggagaaaagcatcgatcgagccgccgttgtcccgggaccggattgccttcatgccgatatgggcgtggaccatcacgtttccggcgtcgagcgacaggcacctgaccaaacaacagattggcccatgcccacacaggcacacacacagcaaggcggcgaaacgggacgcctcaagcacgtgaccccggccctcgcgcgcgcagtacctgctgatccatcgcacggacggaccagtctcggctcctgctggacagtggacattttgacgtggaccagccctgcagctgcagatgagccggccgccgcaccccctgcatggcagtggcagtggcactggcaccggtcaccgttgcctgtaataaaaaagctgcggtgggaggcgaaggcgtccattctcggcgtgcgtgaactcgccgctcgccgctcgccgggaaacttactgctggcggaagacctcagacctcactcacgttcgcgttcctcggacgagggctcggcagcgaaccgagtgcccgtgtcgtgtcgtccttcgttcctagcccggtttcggctgcctcgctctcaagcaggcactggcaggcagcccgccaccacatgcgcgcaccgccaccgctggtcccacggcgcggcacgccgcgtccgctgtcgtttcttttcgtcgccgatgcggaataaacaaatcgcgtagccagcccagcccaaccacagaggcacaggcactgccggggcagggcagggcaggccgtcaggcacatcggcacagcagcgcgagccggcctagtcggaggagaaaaccccacacgcgcacacactggctgggtagacgccgctcgcgctccgccgctagaggctgcctgttttgctgccgcctcattgcttcgctcctcctccctcgccgccgcctcctcgtggcgagcgagtcgaatccattccctcccacccccacgggcgccggccgataccgacccagagctcggacgcgccgaggcgaggccaccgccggaagcattctcgcctgctcgccgcggggacggtagctacctaggggggggggggggggggtaaggaggagcgaggccgtcgccccgtccggtcttcgtgtgctgtgttcagcagctagcagtgcgtgccgag

SEQ ID NO: 7653 - DNA, 436 bp, Zea mays
catacaatgtttttacttccatcgcaacgcacgagcactcaccttatatatatatataaaagccacgccctatcgaaggaatcaagaccacatgccacagctgcacagcaagcagcccgcagcagtgcaggcgtgcagcaccctcatcggccgtgacagctagctgcgagcccgcagcagtgcaggcagcaggcgtgcagcaccctcgtcggtcgtgacagctagccgcgagcccacacgaatacacgaaagcgcggcgcggccgattttctgttccgccccctgggaaacgctggattttagcgtgcaccacgccaccacccgaccccagccaacaagacccccctgcctcgcctcgattccacccacacccacatcctcacctccctccgcctccgagtgccaccaaaccctagatctcgcaccggcggcagcc

SEQ ID NO: 7654 - DNA, 1263 bp, Zea mays
ccaaaaaaatgaacgagcgcctcaacgcatcgaaaacaaaaactcttgagccttgctgcacggaaaacaaaaacgaggaacctgggggcgcgtggacggaattgggagagatgcaatacgcgaggcatgtgtttgtttcggaacgacccaattttttttgccgagttggattcattttttgtttggttttagtgatatattgaacctagtttcttgtttgattacagggttaaagtaagttagagctacactatctcttgtttgttttgtgatgaaggatgaattgaatatagtcacattcctggtcatattactcaagatgatatcttcaatttaataagatgacatcattcaaaataaataaaactgacactattttaacatttgagaaatctataagcataagatataaataaattaaagttattattgactaagtcgtaaatttttagtgatgaggtatcactgttacattttagtcataattaaagaacatccaaacaacatcaagatgtatttcagtgaatttataacatttgccatcactatcaggcttgtctagacggtgacgaacgttgacctttacatgttcgacgatagcactagcgaggctcacgggttgtgcctactagagaacacgccgccatcggagggtaagccagcaggggactaacgacggaaggcaggcggggattaacgtcggatggtaggccggcggggtccctcgtcctagaaggccagctggggtccctcgtcctagtaggccgacagtgcggcacactcctgtgctagtctygagtggataaggcattagtgacgagagggtggagaggaagtgggtcgaaatgtagccgttttattctctttcactctacaaccaagcacaactttatttaaaaaaataaatatggttttaatgatatccatttgtattcgatccgattaagggcttgttcagtttactcggaacgatgacctgaaacgatttgtagtcgaattgcttgtataatttacataagctttgatcaattcctggatagaataccggacaatcgaatagggtgtatacccgcccttcgttcttttgctcttctcgcgaaaacccaatctaccctacccactgcctgaaacccaacaaacgatcaatttcccttccgtacctccctctccctccctccctacgacctctcatctcccatcccgcggcggtttccttcccgtctcccgaaccccgatgccggttgccgagcgagcgagagggcc

SEQ ID NO: 7655 - DNA, 565 bp, Zea mays
acacccattgcctgttttttttttgaatcaaacacccattgcctgttgttaccatgtacaggttgtaaattggttcccttggtagtttagttcgtacaaagagaggtactagtgaggtctagttgcttcagaaaaccaacagtaacatgagctaccatgtgtgtcgcaaaaagaaagaagctgtcatcatgtgcctcgaaactggaggattttcagtggctaacatgttgcatatagaattgacagttgatttatttttgggttccttttcaatcctgtcatttgggccgagaggaggataagtgtcgtcgtagcccatgtcaattttgaggtcaaaagcattgggccgtccactatccaagcaccgaatcacgctacattctcacaaatggctgcgggtcgcacccggcgctcggcatccctccccgccgcaaagtcgcgccgccgtcgcctcgcacgcacgaacgccatcacttcgtcgcttacccatcagacagacaaacaaggccgaaactccacgacgtcccccgctcggcagcagcaacagccgagaccctagcgcagc

SEQ ID NO: 7656 - DNA, 691 bp, Zea mays
gacctgtgcaggttggtgcaaatcaggttttcagacaacgattatgtgactgctcgatgagttgatctgcaatgtgacgtctacaaacttcaatgactccgcaaactcagcttcgaccggcctagagcgatccccagcatgattaatactaagtttatcgctcttgtttcttttagatacgttcaagatggatgtaatctactacgtggatgttttttatttgttatgtgtagcttatccattgtttatgtagtaattgttttaggaattaattaatcttaaaagtgcataattatctaatatatttaactatgagtgctcaactagagatcatgcagagttgctctaagtcttagctctagtgacaaacacattaaatcaggtcaacttcttgctggctttcccatctcttctcccctttggccaatgtccatgaattaatccttccatcctttttctatgcttaggtcttcgttagccagcctataatcaaacttgtttacacctcccaacaagctatggcgtcgccgagttcgagatgagatcgatcctgctgcgtggaatttgaccctggtagtgagatcgcccagtgacccatagtctctgcatatagcctgcacttgaccactggtccactgcccccccacacgccacgccattcctcatttcacaccaccggcagccgggaacc

SEQ ID NO: 7657 - DNA, 137 bp, Zea mays
catttctaacgctaactctggcttgtagtgtgtgcttaagtttataattttcagattttgcctattcacccccctctaggcgactttcaattggtatcaaagcccagtgcttcatttgagtctaacaactcgaagtg

SEQ ID NO: 7658 - DNA, 649 bp, Zea mays
tgctcctttatattttgcaaaacaacataaaatggtggaggtagtattgaaaggtgttttttgcaaaatatacaaagcaaccagagacattagatctataataaatggtgatgaattaacatgtgcacaatgtacatcaacttccatgtgcaccaaatatattccatttcaaggaccatcagtgataaaataaatacttttagaatataggggtttatctgaaaaacgaaatcttgcagaaaagacctccagtycttcactctttcgttccgtggcatattccataggaataatttataaaattaaaattatatgtacattttcaggtcccctctccctctccgctccccattgccgcattgctctccctcggctcggtccctctccggctctccctcacggcctcgcccactgcgccttcgaggagctccgaatcccgatcgcctcggtccccgcgagctcacatggtgggggcgcgcaccagaggctagggttcccagttcccatcattctcctggtttgtcccggttcgctcctggttttttcccgcgatttttgccgattctcttctgattttcctgccgttttgaggcgcagctgattaaaaccgtggggttttggagagcctgaggctgtggcggcggcagga

SEQ ID NO: 7659 - DNA, 546 bp, Zea mays
ggttatggtggtagggaccctaactgcggagcgcgcgtccctcccctcggtcgtccatgtcacacgcatcaccggggagttctcccagctatcaacctcgcctccgctttctcggcgcaatagcccccaccgtgcagtcgctcgtgcgtggccctcggtgtggactgtggaaggcgagcgtgtaggagggcagtaatctacagcagtgtgcagagctcttatctcagcacgacccacccctcctgacgggatagaatcagtgggacaagaggtccgaatttccctttccccctccttccctgtgaaccaagcagcgggtgagctttccatccctctgtctagcccctcatatcccgttatacaaacatcacctaattttggttgcaaatcctttctgttgctgtttctgatttattttatttgatcaacagtaggcacaatatcctttgcttgtctgcagtattaaagtacacaagtgcataagcgactagatttggagtggtaaagactagaaccaaagagctggtggattagaggtgtagggag

SEQ ID NO: 7660 - DNA, 234 bp, Zea mays
ggttggtcaattatggttctgtggctgccattcaagtattaaatttggccttggcaacttccaatgaagtttgttagctactaaacattttgtgagcgaaagggcctctagcctagcggttaaaggacttccgagtagcacctccaagtcctgggttcgattcccctcgggagcgaattttcaggcttggttaaaaaaatcccctcgctgtgccccatccgctctcgagttacg

SEQ ID NO: 7661 - DNA, 287 bp, Zea mays
gtggtgtatgtgatttgcccatagtttctgcagcctcattgttttccatttgggatcaataaaacttcatgctcatggatagggctgatacatcaggttttgtcagtggtggtatacattacatgaacatccatgtgtattttcattttgtgtatactatgtgcttcctcagtggtgaagttgtaaagctggagttctgatctctgttggttggattaagtatctggtctctggataacatataaatttcttcctatcataatcctaccttatttataataagcagg

SEQ ID NO: 7662 - DNA, 125 bp, Zea mays
tcaccaccagcaggaggaagtgagctgccgaggaccacgccgacgatttctgtgagtgaaaggcggttactaggccgacatcttttgcgggatcgttgctctctgcagctgaagcaaatcggcaa

SEQ ID NO: 7663 - DNA, 1500 bp, Zea mays
gaggcggcggcgcgggcgcgcctggcggaggcgctggcggagctggagcgcgcgcgggcgcgcgccgccgagctgcagcggcgcatcgagcagacatacggcaagcgccggcgcctcctcgaggagacccgcggccggatccacgagatccacgcgcgcctccaccaggaccaggaccgggatcaggagcaggagcaggagccctccgccagcggcacttcctctccgtcctcgtcgtcgtaggtgcgtgcggctctctatcgacaaactctgcctatcctgccgctttgctcagcacacgcttggaataggaatctggatgagcacttgctggcagtgatttgactgcggcccgtctccgatcgagcagcagtaccttgccgattcattttcttgtttagttcccctgtgtgtctgctcctgatcctgatcgaacagtaatggctattaacaaaatccgattattttatgcagggaacaagcgagttggcgctggatcatcgatggtttctactgctacgccgcgcgcttctttcccgtttcctcttgtcttatcgttagcttgcaagcttgactttggccatgtaccgtagctgtagtatacacgactctctctgacttacagaacgtcagaaaattgctcagtgactgaattggattgggagttagttctagaaacactctaatcagactaataaaattcgttcactgctgtgttggctcgtgactgaattcgtcacgagataattctcactctctttacaatcgcttttcttcacggtgagtaatcgctctcacgaagaaagaatagtaaggcgatgtgacccaaccattggggctaaaaaaaagcactctcacgacctggctcgagtcggagaggttaacgagaccgagccgagcctacttttatagctcgtttaaacacgagcttaagtcggagaggttaacgagactaagccgagcctatttttataactcgttcaaacacgagtcgagacgagtctgagaaaatccgagtcagctcatgagccgaatagatcatgcagtgctatggcacgacactattacattactatgttattgatttattttcttattttacggacataatagtatagatatagtttaaaatatgtttctaaatttttgatacatattttttaaattttatttataataaaaatatacaatttatcttgcaaagagatttaagggcagtttggttcgtggctaactatgccacactttgcctaaggttagtcgttcgaattgaataactaaccttaggcagaaaagttaggcaaagtgtggcaagtgaggctgcgatccaagcccttagtctatagaaactgacgcgcttcgtgcgattccgctcttgttcgcggaaatcggcatcctcccggctaccccgggccgggaatcgaaaaggctgccgtgttctccacttctccgccttaccctgctctcctggacctccgacgcaccccaaacaccgcagag

SEQ ID NO: 7664 - DNA, 1500 bp, Zea mays
gggccaagatatcaccatccaccatgcctaggatatcacaatccactcccttagaagattgacgtcctcgactcctcgtcggtcaaccctaatctaggaacctcctctcctagccacgtctgtgttgatagtgtcgtcatatgccatgcgatgtgaccactctgggcccacatgcgccatacaccatattgaaagggaaatgtgcctttgggccatttctaagtattttggtgattgagtgcaaacacaagtgcttaaatgtgaaaatatgcccaaggatgaacaaagtgcaaatcacaagttaaggtatgtttctaagccttagtacattggtttgtgtactaatattcttgtctaagtgttagatacaggaagaagaaaagaagtggagagtggctgtgtgcagccaaaggctgcttcgggctggggcactggactgtccggtgtgcaccggacagtgtccggtgcgccagaccagcgcggagcaaaccaaccgctctcgggtttttctccggcgacttcggctaaaattcaccggactgtccggtgtgcaccggactgtccggtgagccaacggtcggccgagccaacggtcggccgcacgatcgccgcgcgacacgtggccgagccaacggtcggaaggaagcaccggacggtccggtgtgcaccggactgtccggtgtgcaccggactgtccggtgcgccagatctgcagtggtcggcaacggtcggttgcgtctgttaaggaaagaaatcgggcaccggacagtgtccggtgtgcaccggactgtccggtgcgcccgacgacagaaggcaaggatagccttccagatgtgttctcaacggctcctagctgccttggggctataaaagggacccctaggcgcatggaggagaaaaccaagcattccttgagcactcttgatcactcacacatcaatctcgcgcacttgttcgacattctagtgatttgagctccgttctagtgtgctagtcttttgagctcaagtctgggtcttgtgtgtgcgtattcgctgtgatctttgtgtcgtgtgtgagttgctaatccctcccttgctctgtgattctctgtgaacatcttttgtaagggcgagaggctccaagttgtggagattcctcgcaaacgggattgagaaaagaaaagcaagaacaccgtggtattcaagttgatcattggatcacttgagaggagttgagtgcaactctcgtccgttgggacgccacaacgtggagtaggcaagttttgtacttggccgaaccacgggataaccactgtgtcatctctgtgattgctttcttgtggttattgtgttttgactcctctctagccacttggcataaactgtgctaacccttaatcaagttttgtggctataagtttaagtttttacaggatcacctattcaccccccccctctaggtgctctcaattggtatcagagccgttctcttcaagaaagggactaaccgcccgaagag

SEQ ID NO: 7665 - DNA, 673 bp, Zea mays
catgaaagagtacataatttgtttgtggattattaattatatttataaatatattatagtatattatattttatctttatctaactacaaaaataattatagattgttaacttttttttgcattactggtaagattttgtcgattttataattttgtctaacatgttttattatcaatctaaaattgcaaattatatgttaacgaactaaatttgtaataaaatatatgtaataaaggtcgtctaaaagtaagctaaaattcacgcacctaaattttatttagtaaagtgttttttcttgacatatgacactagtgttttcaaagcttgtctcttaatttaggattaaattaataggcctctctaaattgctttttataagataaataaatcctattccgtctgctcatcttcaaagaacatttcaatgaaacaaatatttgggaaaaccaatggaaaaagaataaaaataaaaattgaaaaagagaagtggaggaaaagtagggttccattccacggcctgtcgagtgtcgacccacaaaccacgcaaccgatatattccccagcacccccagtctccagccgtccaaccgagacaccgcgtgcgaaccaagcagaccacaacaagaagaagcgaagtcgtcgccggagcaggaggaagagcgagcagcaag

SEQ ID NO: 7666 - DNA, 1500 bp, Zea mays
atgacttaacatgtgtgtttgacttagagatagaaatttgagttttgatttgcaaaaacaaaccaagtggtggcaaaggatgatccatatatgccaaaattgaatcaaaataaatttgagttttatttgaagtgatattgcacttgttctagttgctttatgttgtgttggcataaatcaccaaaaagggggagattgaaagggaaatgtgcccttgggccatttctaagtattttggtgattgagtgccaacacaagtgcttaaatgtgaatctatacccatggatggacaaagtgcaaatcaagagtaaaggtatgtttctaagccttagtacattgttttgaagactaatgtattgtgtctaagtgcttgaaacaggagaaatcgagtcagagaaaagttggctgtgtacagccaaaaggctgttcggtctggagcaccggactgtccggtggtgcaccggacagtgtccggtgcgccagactgactcgggcgaactggccgctctcgggaatttaccggcgacgtacgactataattcaccggactgtccggtgtgcaccggactgtccggtgagccaacggtcggccgggccaacggtcggccgcgcgatctgcgcgggccacgtggccgagccaacggctagaaggaggcaccggactatccagtgtgcaccggacatgtccggtgcgccaacggctccaagtctgccaacggtcgacttcgccatttaaggaaagaaatcggccaccggacagtgtccggtgtgcaccggactgtccggtgcaccagtcgacagaaggcaagatcagccttccagatttgctctcaacggctcctagctgccttggggctataaaagggacccctaggcgcatggaggagcacaccaagcattcctacaacattcctaagcaccaagacatcgattccgcgcatttggttcattgtgatagcatctagagctcttgttgagttgtgaactcattgagtggtgttgcgagctcttgttgcgacttgtgtgcgtgttgttgctctaattttgagccttgtgtgcgtggctagttcctcccttactccgtatttctttgtgaatctcaagtgtaagggcgagaggctccaagttgtggagattcctcgcaaacgggaaaagatcaaagtaaagaagaacaccgtggtattcaagttgatcattggatcacttgagaggagttgagtgcaactctcgtccgttgggacgccacaacgtggagtaggcaagttttgtacttggccgaaccacgggataaccaccgtgtcatctctgtgattgatttcttgtggttattgtgttttgactcctctctagccacttggcaattattgtgctaacgattaaccgagtttttgtggcttaagttttcaagtttcacaggatcacctattcacccccccctctaggtgctctcaattggtatcggagccgttctcttcaagaagggactaatcgcccgaagaa

SEQ ID NO: 7667 - DNA, 1500 bp, Zea mays
caattcctcttggaatatctctctctatgcctcaacaagtgaatttgacttagagataggaaattgaatttgatttgcaaaaacaaaccaagtggtggcaaagaatgatccaaatatgccaaatttgaatcaaaaacaaatcttgttctcatttgcattgaagatgcacttctatgtgttgtactttgttgtgttggcataaatcaccaaaaagggggagattgaaagggaaatgtgcccttgggccatttctaagtattttggtgattaagtgcccaacacaaatggtttaagtgttcaattgtgccaaagactcaagcagtgaaaatcaagatacaaggtatgattctagacttagtacattagtttttgtgtactaacatatttgtctaagtgctagaatcagagaaaagacaaaagggaaaagacttggctggagcagccaagactctgcgcagtctgggtgcaccggactgtccggtggtgcaccggacagtgtccggtgcgccaggctggagtctggtcaactggctgctctcgggtctcgacggcggcgtacggctataaatcaccggactgtccggtggtgcaccggactgtccggtgagccaacagtcggcagggccaacggttggctgcgtaatccgcgcacgacgcgtggcagagccaatggtcagaagggggcaccggaatgtccggtgcgccaacggctccgaatctccaatggtcggcttcgccaaagaaggaaagaaatccacaccggacaatgtccggtggtgcaccggactgtccggtgcgccaggcaacagaaggcaagaattgccttcctggaatgctctcaacggctcctagctgccttggggctataaaagggacccctaggcgcatggaggagtacatcaagcattcctaagcaccaagactccaattccgcgcattcgattctttgtgatagcaactagagctccatttgagtagagatctctttgggttgtgttgtgagctcgagttgcgacttgtgtgcgtatttgtgctctgattttgtgtcttgtgtgcgttgctcatctcagccttacttctgtgcttttttgtgaacatcaaattgtaagggcgagaggctccaagttgtggagattcctcgcaaaagggatatagtgaaacaagcaaaacaccatggtattcaagtgggtctttggaccgcttgagaggggttgattacaaccctcgtccgttgggacaccacaacatggagtaggcaagtgttggacttggccgaaccacgggataaaccactgtgcctatctgtgttgatcctcttgtggttatcgtgtcttgcaagaactcttctctagccacttggctttattgcactaactcctaatcaagttttgtggcattaagtttcaagttttacaagatcacctattcaccccccccctaggtgctctcaattggtatcggagccattctcttcacgtaagggactaatcgcccgaagag

SEQ ID NO: 7668 - DNA, 193 bp, Zea mays
gtttatgtggtcatttaatagttaatatataattatcagttagtaagtctctattacttatttattacttactaagtatttaggcatcagtagattagtagatggggatagtaattagttaggcattagttgatagtgttagtcacgtaccatctttaatggcaattgagttataaattcgtgtttccaatag

SEQ ID NO: 7669 - DNA, 1240 bp, Zea mays
tggtactcatagtttcaaaaccctaaagattttataaacccatgattcacaaactatctaacaaactgtagtcattatatcaaccatatatcctaggaatcataactaataacaatatgcacaccaatcaaaactaattaatcgaaaccatgcaacgcaatatacgtaacaaacgaatcagtgagacatcataccttggtcttcaagatatacggatcaaatcaaagttttccaactcgaatacgaagattggagcacctctcggcggtatggataaagatgaaaacgagccgggcgtagctctcggccaggaaagagccgatttataggacttcctagctcggcgccaagatctgtggcgccgagctaggtgccacgtgagcgccgcgtcgacgacgccacgccagttctagccgccgggagccaccagcgccaagttagagctcggcgtcatagtctatgacgccgagtatcggatccaaaacgagaattaagtcttttaggggtctaagtttaattttgttgtcaaaaaatggcttataaacaaaaaattcggccgttccccgaggatgccctgctgcctcgagtgcctctgcaagcgctggaaggagaaggggatggaagctttgcgctcgactgcaccctatttgagatttgactttggaccggaacccatcaatttggcgctcctcccgacgcagaggtctcctccctcgctcactagcagagcccaatgccatttacatcttctcagtctttcttgctcgtgtctcctctgtctcgcttggtcaacgtactaccacattaacatttcgcgtcggtatgtgcatggcctcgatcgggcgtagaagacggcctcgtaaactggggtggccggatcgtgttcagctggcaaagttactcggtgcgtgcaaataaaatgttgcaagcaaaagtcaaagatgaacaatgcggccggccgggtgatactcctaggctcctagctagcggctagcgcatgcgcacacgtatggtatttttcccaagaaataaaccacgcacgtacgaacgtccaccgcccatcgcattgcctatatatatacgttcttcgtcttctctttgttggccatgcatggttagcaataaagcagtgaccaagagaacgaaggaaccggagaaagaaagctacaccagagggaggacggagatcagctactagcgtaccatagtctctcgtttcgggtagtcaagccacaacggt

SEQ ID NO: 7670 - DNA, 1500 bp, Zea mays
cgcaattatcaaaaccacacatggagctttcaaagaagtctagagtgctcccatacagtggtcaatacatgcatcgtccttggatgctagataagcgataagctagatatcattgttatctagtgctcttctatttttaggttcatacaaacttcacctaaaaaccgaggggcttatgttgacaacaaaaaaatataccaacatagatattttgcttcaccaacaagttcatatcataaaaaatatagtagaaaatgtttggcatgacaaaaatcaaagcacaaccatgacggtttggaagtggccaggtcgatttttcttgcctacttcgagtctgatttttttcggaattgattttggatctattttcaatctgagaaacttatagactatgttcatgacatgtttcctactagaataaaatcagtccctctatataaacgtgaggatcatattctattgagaaaatctaacttccaatcataaaaaaaaaaatcatccactaccattttcgctaactttctctctacctgttcatcacgtctgtcgatgaaatctgacggtgttctagacgacattgtttcaaggatttcaatgtgtcccctccctatgaaggacatgcttttaaatcagcctaacgactgtgtgttttatcgcttcactacattctttctaggatcaaggttgtatacgaacgtgctaacatttattgatctgcgatccaaatcaacatcaacactgtgtgctacttgtactgcagtactactgttcgtggctacccaacattaaccggttggcccgtttgctacgcgcgtgtagaggcaaagatttgcatgcttgggacttgggaccaaagagattaaaaaaaaaggctggacggcttctgctcgaatgctcgatgatcctccgttgaaattgactgacccttttcacgattcactccacaacctatcagcaaaggctcaactgctcaaagcatgtggcgtgttggagatcagacaagcatatgccctcgtagtactacctcctctcgtctcgtccatccgaattaatagattgctgatcggtcgttccagctgaaaatactccctttaattagctttcttgcagtcgctctattctacacacaagtacaatctgattagccatcaccaagccttgttctgattggttttgacgacattcctgccaccataattctgcaggactccttgcaaacagtttaggctttgtttggataatttagtattgatcccaaatccacgtgtgttgagatggattgtgggtgtaaattagtttaagttacaccctaatctacctcaatacatgtagattgagctcaatactagagtatccaaactagacctaagatctttccgctccgcctttagaaatcgagccacggtacccactttccagtcatgtgtttttggaaagcactcgcttgatttcgaagttaaactcttaacacttttaaatcaggtttggtcctcagtctct

SEQ ID NO: 7671 - DNA, 1500 bp, Zea mays
  unsure (1)..(1500): unsure at all n locations
agcgaggaattacaatgaacctcgagggctcaatccctaaaatactgaaattaaatttctaaaaagaaatttaaagataatgatctccaaaatttttggagtggaccaagtatcataaccattattttgagatgaacargtataggtaatcactatgtagttggtacatagtgtagatctcttagtgataggcgaaattaatcgctgcattaggcacggtctctaggcaggattatccagaagaacaaaacgcagtcaatgcctatgactctacaccatatgttcaaagttaaaataatagatgatatatgataaatattgtatacggtaaatctatgtgaaattaatgatttgaggattcaccataatatattactatgcaaagagcacaagtatttatacaaggacaagtgtataaatacacatatatcaatatggtctacacatagcatagtatatcagaaaagtacgtgttaaagtatactcaatggtaatgagattaaaagagacaaatgacagaaccgttgtttgcattccacagatcattacacttatatancaagtgaaggggtgtatcccaagaggtgtgtcccttggggaaaactgtcgcaccctttggattgatcacatatgtaatattttgtaacaattataacaacgcctttcagttttcactgcctggtgcctcctagggcattcctatcttcgccgccaggatttgctgccgttcttgcgtgtatatctgtcatccaatctgaccgtcgatttgtgatctgtgacgagtgacggacacagaccacaacacatcatcgtcgttctggtagcacctggcatgtcctgaaacgtgagttccaacgtctcgccagcggctgtcttcttgctgtaaatcaaggaatataaagcgtctgatgccctggccgaactgaaagggatcgatgcatgcctcggactcggaggaaaaggctgtaactgtccagcacatcggagccgcatgcatgctcagctctacagccgccatccgaagttccaacttccaagcttccagacgaagacgaacagagaatctctggggaccgatagattagctgcacttcaagctgaaagccccggccgcggggttagcgctagcttcctgccttgagcatcacgttcgtcatagatctcacgtaagctcaacaaaatccaatagaaaaatccaagcgccgagctgttcatgaagccaacggaagcaaggaacaaagcttggccagctaagctatcttatcccgtactcgaattcaatagtaaagagaatgagtatttccatcggcgatgctcgtgtgcgtgtatatatacggggtgcacaccctgcagatgacgcctcaagccagcagaaatcgtacgtagagaggcgtagagctagcaagctgtagctagctaggagctagcgatcgagctcaattcgttctcagtcgagctcgtcggccatcgacgatcagtagtccgttaggacaacaatcc

SEQ ID NO: 7672 - DNA, 321 bp, Zea mays
ctttattgtcatgatagcatgttagatttgttgctacatttattaattatcgatacctttgttgctaatttagtatttctccacatttatactgttgttggcacaattacttacgtataggacacacttaggacacatttaaagttgtgttgctgcaaacacgtttattgcttaaatttcttctttttgttttgtagcttatgcctagaatgattaaagttgtgttgctgcaaacacgtttattgcttaaatttcttctttttgtttcatgtagttgccctactaccctggtcattaatcagtttcaccgctgggtcagcc

SEQ ID NO: 7673 - DNA, 393 bp, Zea mays
cgacaactttatcgaccattcgacccttcaatctccggtctgcagctggatcactagcacgtcatgtgagtgagccctatttggctatttcgcattgagacactcggtctatctctctctcctcatttttctgtgggcatgccttgttttcaatatgaaaggagacaagaaatcctcatggtcagaatctcatccaaatcgttcccgcagacgcgtcttgcaacaccgcacccgccgcgctcgtggccctgtcccttgcggccttgccggactgagctatatatactcagaatcaggtggcctcctaacctcatcacttgcagcttcacaaacaagctaagcaagcatttatccagaaagaagagaaggaaccaagccaacaaccaaccaacc

SEQ ID NO: 7674 - DNA, 1059 bp, Zea mays
catattcgatagggctggagcgattctaggtgaaagtaataataaattcaccgcttatattttttttgttatatgtattcaacatagtatatgcttttattttctatgtgtggtttaaaaaaaggttattgtttatgtagtgattggttcataattttagaagtgtgtaattttgaaacaaaaaacatgttaaatatgtgacgtatagccaatagcataataatcttgaaggttggatttggacgctcaaagtgacaagctaataacatacttcgtttgtaccaatttgatttttaccaaatttgactgtattattttttgaaaaaaagtttaaagacatatttgaaaatatattatattctacaatataaagttaaatgaactagtataaaatataaattggaacgaatgaaatatgctatttctttaccatggatatgctttgaactagtggacgttgatattttggtacatgaaaaatagcaacgaggctcgaggcaggagaatgacggaagcgacgacggtgagaggcacagaagcaaacttgtgatcgtacacgatatgcggacaacgccgcacccttctatctaggccagactagaagggtagaagaagcaacaacggtcaagggcctagctatttgttaactctggcccctcacctgctccccttctgtccagcccacgggagggcgactagggttaggggcgaccggaggtccccgcgcctgcccaaatcyacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagag

SEQ ID NO: 7675 - DNA, 347 bp, Zea mays
tcaacagcttcgacagctgtccctccgccaggctccagcgctcctccgacggccacgacatcacacccagctaggtgccaaaatctctccggctgccacaacggcatgtacttagggcgctagctctcatccgctagacatgtagcactctgctacaccccccccattgtacacctggatcctctccttacgcctataaaaggaaggaccagggccctcttagagagggttggccgcgcggggacgaggacgagacaggcgctcgcgtgaggcctctcgctccctctcccgtgtggacgcttgtaaccccctactgcaagcgcacccgacctgggcgcgggacgaac

SEQ ID NO: 7676 - DNA, 1500 bp, Zea mays
ggttcaacctacatcctctactcaatgtaatatctttatccctgttattttgttttgaatgcacaaacaaaaatctaatatgatgcaatgatttatttatgtcttagtaaggatttactcagttttaaacatggtcagtcacatgtgatgataaataatggtcaccaaacattgagatcaactctattttcatgatttacatatttgggtattacacgcctctatagagtttctctttactagtgaccgcataagttatttgggtattacacgcctatatagagtttctctttactagtgaccgcatgagctgtactttctccaattttttattagttgtcgtttagtatagcgacatggtctctaaaatataactttgactaatattttttttgttaaaatataaataaacttttaataaatttgtacttttataaatgtacttgttaagacaaattcgtgtatataaatattaggttttaaaaactaaaaaactatataataaaatagttatttgtagtcaaaattttataagtttgatttaaatcttacccaaaacgataactaatagtacaccggagggagtatcaaacagcaggactttaatttgtcgggagttgcaccccctgttgtgtaaatgcaacagggctgtcggcacgagacagattctttatcctttgcactacagtagtacaaactttgcgcggatctagaggtaattatatattgttattattatgtgcgtcgatctagaggaagttattattattattatgtttacacagctggctaatcacgtccttggtagtgaaacgtatcttaatcaactcaccatccaatgccgtttcggagtgaatcatccacgacttagcccagtactgtcgacacaacgaatccaatggcaatcttgctcggaccaacttgattttcgtataattttggacacatccggataaaatgttgcacaaatctactcaaacgttgcaaaacatagtggcagccaggtctatatatgatgagttgtgaagaggtacaactccttcaaaaatcaagttgattatgcggataccgcaaacactgcaaattcggttgttccctacccttctagagtaatctctccacacacacacactcacacgctgctgccggctgccctcctcccgccccactcgtcccctccgaaccaagtccgatccatccatccccaaatttctcctctcagcgcgtggggcagtggcggcggcagcgtgggcgcgcggaccgctacgggcacgggagcagcggtggctgcgcaggcagctgtcagcatgcggcatggtgactacgggagcccaggcggcgccggtgcggctgcagccggcggcgggcgaccgtgaggcggctgcgggagcggtgaagtccggtggcgcctgctttgttttgtgttcctatttttgatttgcgaaaggatccaagagagaaaggagggggagaaggcgagaatccaagacaagagcgagc

SEQ ID NO: 7677 - DNA, 877 bp, Zea mays
ggttcatagacttatctttagcttaattttagcatgaaggaatagcagattagcagtaataggctgattaagcgtgtaatattctgcattaattagaaggctatcaaatcttaaaatgtagctcacagctgcctagagaaagagagagagagagagagagagaatcagaaaaggctaagtcagtccagtcaccaaacccactgtgtttgtcttgtgtgtgcgagtttctggttatttatttgagggctatttgcctatcaaaacacctaaaactatgaatgtgtcattcgagaaaaacaatggagttgtacatggtatatgtaggggtgataatgggctctaaattttacactataagatttaagtatcggatcagattaggatcaaactctatttctattcatttttaaactaaaaattatttagaaccttaccattttgtgaagaagcatttagatcatgatccattaccacgcctcgactcgctctcctcataacatgggaagtcctgactccttagcagaaacacgtagcgtgtatccgtaattgtaactaactcatgtaaacaaatacttgtaagggttgatttgatgataaggggtcacgggaggattggagaagattaaggggaaaattaatcccctccgatctccccgtgatctctggtcactaaatcagctctaagtgacttggcagcacaaagctaatagtagtcggtccatcacaaaactacctggctcttcgcatgcaatggactgactcgttcagtctctctcggccaagaagactcaacaaacctcccgctccctcttgcgacactcaatagtatcgtcagatcgagacatccccgtcgatcgaccggacgcacccggccgcc

SEQ ID NO: 7678 - DNA, 318 bp, Zea mays
ctccccttccgcctcttttagtgctgcgctgccgatgcggtgcccagcgagccaggcacggaggaggcgcgtgctctgctccactccacctccccccccccccccccctgcgccactgacgccgctcgttcgcgcaggtacgtgcagatcactggaggccttccatttctgtctccgcagctccgcccgcgagcgccggcgccgttctgcttctgaccgtgttgctgctgtcagttttggtcttctggccagcagggcagggggggaacccgcgggagcgaggcgcgcgagcgagcgagcggagggaggaggaggatg

SEQ ID NO: 7679 - DNA, 315 bp, Zea mays
ctccccttccgcctcttttagtgctgcgctgccgatgcggtgcccagcgagccaggcacggaggaggcgcgtgctctgctccactccacctccccccccccccccccctgcgccactgacgccgctcgttcgcgcaggtacgtgcagatcactggaggccttccatttctgtctccgcagctccgcccgcgagcgccggcgccgttctgcttctgaccgtgttgctgctgtcagttttggtcttctggccagcagggcagggggggaacccgcgggagcgaggcgcgcgagcgagcgagcggagggaggaggagg

SEQ ID NO: 7680 - DNA, 318 bp, Zea mays; identical to SEQ ID NO: 7678

SEQ ID NO: 7681 - DNA, 557 bp, Zea mays
catttttttatttttatttttacttccttttatttttactctataaatgatatagttaacggaagtttgatggttactcgaagtttgctttctgggtagaaaaaaccatttttttcttcgatcaactcagccctctgaataaagcaataggaaggtggaaaaaagagcagctgtttcctcgattccaatggcttaacccaaagacccctaattcggcgacaggacaaacacgagaaaccggccccacccctgccctcatctcctctccaccactttccctctgcgcctcggcccccacgaaatctggaaagcctggacgccattgctcacctttttccgtccagcgcaaagacaccgcgcgccagagagggtgagggattgccgtgaccgattcgaaaggtatctcctcgcagcgccgcgccgcgccgtccctacggcgggacgcgccttgttttcagggggtccggccatttcatccaggtcgtgtgaccactctgatctggattcctcttgcagccgcttcgggcgcgggtgggatcggcccgtggccggcggag

SEQ ID NO: 7682 - DNA, 157 bp, Zea mays
tctctctctctctctctctctctcactctccctatgtatgtctgtctctctctctcccgcatgacccactacctgcttatgctgcttgcttgtgcggtggacgctcaggtgcgggcggtgcggagcggaaaggtgaaagaaggggatgaagtaggag

SEQ ID NO: 7683 - DNA, 169 bp, Zea mays
cctcctacctcctcttcactccccccctcccttcctccctcttgcatcactatcaccaccaacaacaaggctaacgcacaccaatccaacaaggagaacaaaaaacaattaatcgtgttttgagcttttgatatcatctcgttccagttaagtgcgtgaagaggcaata

SEQ ID NO: 7684 - DNA, 1500 bp, Zea mays
acagtaggagaggacaaaactggcaagcatgagccacacaagaaacacatacagcagtgtatatcatcactccatgttgagaatgtcgattctaacaggctaagcatgttccctacgacttgtttttaaggatgaacaataggttccagtcagatagattccatatcgtgatggtgtacccaagatggatgtggaaataaaaaacacataagattgaatatggacgcattttagagcaacatgcaaataaacaaagagttcaccaaaacacttacagcggactggttgtggagaattctcttcagaagctggttaatgccccttgcggcagccatcaagcactctgcaaattggacttggtttacgttctaatccaattggcaacagtagactaatctagtgaattcacgtgaaacaaaaacacactaatacagaacaaactcatgagtttctgttgctaatttcatcagtataacagcgacacccgcaacggaaatagtaatttagggatcataaacaacgaggaatggttctgcagaacaaactagcaatctagcaagtcccaacaagcaacacaaacagaaatcgactgaagttgcgatggacggatctccaacccagtgaaatgcagacggacgacgacgacgcctgcggtgaagcacgccaggtgaggctccggatgcccacgcgacgccccaatcgataggattcccacagatctagccgcccgattcccacggtcccaagaagctaatgcccgacccaggagtcatccgcagctaccggagactagagcagatcaccagatcggagacctcagacgcctgggagggggacaaaccagcgtaaaccaatgggagtaggggttcgtagaagttacctacgcgacgcgacgcggggcttcggcgaacggcggcgcggggagggaggcggaagagatggacgaggagaagaggctgcggggctgtgagatgggctttgtggcgatgccgatgccgcgatgcacctcggacccggcggggtgccggtctttggggcgtgacaactgacacgtggggtcacctcgcgccgtgccttccggacgggccacgtgggcccttagtgagcgattgcatcaagctcttgtaggcccaaaatgatcggctgtcttagaggcccaaatgaataggttgttttatttgtttcccttcagaattgctcctcgtatgtaatctaaaaacatggattaataattaattaaaaaaacaaaatcggagatttgatcccagccgtcgatcgtgcgacctgtcacccacttgtcatggcgctttttaatccaaaaacgagaggcgcaccgtgcaccggtgcaagggagcggcagatagtttttttgtgcgcctccaattcccattctcctctactccatcgtcgtgcctgccggtgccaggctgccgggtgccacagtgccctgccacccagcatcgctcaatcactcgttcgatccatgcatgactcacccga

SEQ ID NO: 7685 - DNA, 1161 bp, Zea mays
tctcgtacggttcaagcagaaatacacaaattttcaacggatattagaaaaaaagggttcaaaactccatcagccacggtattggatcgatttgccttgaagatatgaaataagaaaaatccagaatttcttctttgtgataataatgccaaaaaatctcaagttggctcatctgtctttctttcccttatgttgatcattagaggcctcttgacttttctcttccctattttttattgattttattttttgactagtcaaaaaataaaatcaaaatttctagtggttttctgatagaaattatcttgttgcgatcctatgaatcagttcaattaaaaccttagattcatactagagccacgatgattcagtctcaagataaacaaaaggcaagggttcttcgaataagaaccgcttgatgatcatttattgaaagagaaaagagttctcttttgggcaaacaaaattggaaggaagaaaatttctttttttattaagaactacttcmttttttttttaagtctggttgcgaggtctaaatagtgagtatgaatcatagttccttttttttttgatccactctatgtatttcgtgtyccagatactagaataaataatatctgacgaattagaatcatcttgatagagataacaggccccttctatgtattatcaataggatcaattctaacaagtcacacactcatattccagagataccaaaacaaaaaaatccacggtcgaactaccagaatgtctagaaatgtggagcttaaagtagaaaggctttttttggatggaaaaactatgaagtcatagttttagttagtagaaacctaattcgttaaaattccgtccagtaaaacagaagaattataaatttctaaaattatagataggaatatcgcgaataaagccattgcgacccccataaaaggagtagtcccccaacccggagcaactttcccatattccgaattcaagggtttcaataaactacctgcgccagtccgttttggcttaggtctagaactatcttcaacggtttgtgtagccataaattctatttaatcattggtgttgactttgtatactattccgttgtagttgtaaatacacgatcttttcatagatccattgtaatcttgaaattctataaaa

SEQ ID NO: 7686 - DNA, 1500 bp, Zea mays
gtgcgtgcgtgccgatatcccttcggtgcctgcacttctcgcactcgactcgcttctacccagcccatgcatgtactttttctaccaacggtacagcaagctgagtatttacgcaaaggtattcctctttaaggaaagcttccaggtagaagaagaacatccagttatacttatagctcggaacgataaaagtttaccagttcgcgagacgcaaaagcacacgcccaaacgttacttgcatccatttttcccccctcagcccccacggccaccagcccaccacacacacacacacacttgtcctgctctcttttcgttccgtttcgttccgtttcgttcctcctgcctccaattggaaacccaccacaaagaagcaaaagcaccaatagccgagaccgagacctcgagccagccgagcagcttccacctctgacccaaacccaaccccattcagcagaacatccagttatagcttaattaatccttttctttataccgactccctcgtggcctcgtcgcctcagctccaccaccaccacctccacccgcgcctccaaaatccaaatccgatcgatctccgcggcctccagatcccccggcgggcggagacggcgagctccaggcggccaagaagcccccccctcgcagcgctcctctcctctgcctctccgaatcccttaccaggtccgtgcgggccgttcttgctggctggctgctccctgcattgggcacggttgctggagcttttccgtgcgctgttttgggtgtaaaagcttcgatttttacgtggtgtaacatccaatttccggtgctggcgctgggattttgcttcggttggggtgggggcttggggctggttgccgcgggtggcgctggcccgtggccggatgtggaccggccgggtaatgcgaatgggaaggggtcgtttggtttggtcagagcttgacttttcgccagccgccgccgtggactcggcctctgtcttttctctctctctctctctgcaaatcggctgctttgggcattgtagatcacctacctcgacacattttctggacggtcgaacaacttaccaagctttggacgaagtggtgctctttcaatgttcgtagctttcgtcagaattttccaggacagatcgtgactgaatggcatactagtcagtgcttcgcaatgtgtactagaacaaccactactacggtggactactcggttgtacaattgtagggacaaatcttggtgacttgacttgaatgtgtcactataaaagcatatggaagcattcttgggtgtttttgaatcatttcaatggatccatgtattaacgctctgcttcccttggattgcaactgcagggggaaaaaacattgcctgaaagttcttcaggccctggtgtagcagctgaattacccagtttaatggcgaagaacgagctttagatggtctaaagatggagatgagatagaagcaccacaaagtgtacagtggggtagcaaggat

SEQ ID NO: 7687 - DNA, 1439 bp, Zea mays
tatattagccacgaccaaaacagccccgtcttttattgatcatcgctatatatatatctgaacctccttggatagatttatttatcctcgaccctcctccttttctttataacttgtgatattagatacgtacaagggagaacaatttctatgtacaagaatcatacactgacgaaatattttctttaagacaaggttacatcttgcaacagaatgaacgggaggctcctcaaagccaactaacaaggaaaccggaatgacgctcttgcaagctaagcccagctcaaaaaagagcttagacttgctgtaatccttgtctgggccatatctctggcccgttcatttggtgcacatggccctcgatttaaactggatcctgggtcctggcccacctaaattaataatcatccctcttattaggctattctcagtggtgattttaattgagtttcatctttattaaatgtttcaccacatcagcaaaggatttaatagggggagagagacaaagagagttttatttctacgaaactcaggatgcacaattttatcgacaaaaatttatgtgacgttcttgaaaatagtgtaacgaaactctgcgtagtgaataatcttatcaattcaagagtttctttgaatcttattttaaacttttgtttgtttgaaatcacatcttctttaataccccaataaaacctttaataccccaataaaaccttgttcgattatttccgtatcatttgaatcatgaggaatcaatgcaaaccttgttcatttggtgcacgtcggcacgcacacgggtaaacgtccctttctttctctcctatcgtctggtactcacttgcaatgtgctttctttgctatcttgctcgtgtggtagatgggatttcctcctctaagtgaccatcgcacaggagaccaagttttggacggacaagaagaggttcgagacagatgccatattctgatcctccctcaatatccgcaaggatctcgatgccccaatcctctccaggtcctttgctttctctttgcatttcttacaggaaaaataatcctgcttatacatcaattcgttccaactagacatgtgcatgggttggttaaagcggatatggatgggttctgtgagttagtttgttggggctaattaattggttctcggtgcaagttcggtgggttagatgagtcaacaacgtgtttgcttcatggggtggattgagttgtattagatgggtcacatgggttgagtttacttcatcatctggccaccattgataaacatacatgccactaagatttctacatgaacatttatgtaagtaattttaattttactccttttcatggctgaaatgatttctgcctggacactacatgctatgccaggattgttgtttgcatagtcacactttgattttattgtttgtttatacaac

SEQ ID NO: 7688 - DNA, 1500 bp, Zea mays
acggcatgcacgggcacggcacgcgcacaccgcctcccgatcgtcctcttctctactactaaaggattagtaagggaaggaccgaaggagtactcttctggtccgcatcatccacatgccgccgccgccgccgctacgctacgctagctgccgctctgcaagggccccccgcgcggggcccccgcggccctggctctgccggctcgatcgcctaatcattcgccccgggcgcggccggacccctacacctcctctaccacaccgtagcatcagcccatctcgctcccgctttcccatcgctctcgcgcgtccctgtccgcgggaatccacctcagtccagccacaccgcaatgctgctgcgtctgcctctgcgtgctcaacacctccgctgcataaaagcaaccctcccttctctccctcacttccccgtcgcgctgtctacctctctctctctctcatcacagcacagctccagctctaggctgtagagggtggaagaagcgaggtcgagtcacagaggcctgcagcaaccgtctgcgctgagcatcgaggccgcgctctgcagtctgctgtctgctctccctcgataagccgggttccaagctagctctgcagaggtacttggtcttttctgattcttgcttctctttctccctcgaattctttctcttctataatacatactgcgcagctgttcttcttctccgtcttttttttcttacgaaatctgatatgatactttcaccgtcatccgtccattctcaccgtgcaatctcaactttacacttcttgacagaaaggtcctctgctaaaaattcaacgaagcatctgctctcctctcctctccgctgttcttgctatatatcgatcgcgattccattactacgatacataataataacaaaaagaaagaacctttccgcgtgtttggttgctgctcctgagcaggcaggtgcttctcccctcgcgagtatgtgggtgtccacaccacacgcctatcctccttttttttccgcttcttctctgttttcttccctcttaatatatccatcaaatcactgtgttagcgtgttatgttcttgcacccccactgttcacatgccctgctttccccccgatccgtgtaccctgttgtggggcctgcggatttatcgtattcccgcgtcctatctctttttcttgttggaacagagctgccagtcatagcagatagtagatagagaacaagcatagattaagtgacacaccgcttgctccatctggggtcaaacagaggcttttgtgtggtgcaagcaagatcctggacaggagacgtcattgtttactgttttttttctcctccattgacagttgcataaaggctggcagcaatttttaagatcatgctttgagttcccatgcacgttccccctgcttcttgcagtgtgagctctgactgaacacgaagtgattggcggcttctcatcgatcgatggttgtgttgtgctggccatctgagcg

SEQ ID NO: 7689 - DNA, 1500 bp, Zea mays
gtattgttcttgtctctaattttttaacatacacattttgtctttatacttgtacggtttcgtgtgatttgaatctctaaacttattttttgtgttatcaaaggtccaaactatttagacatgtgatgacaccaaaataagtttattgggactagaaatattgggactagaaatgtacatgttgagagtttaggggctaagacaatacaacttcataagtttaagggcattagatgtgtattttaagagcttagagatcggaatatacaatgctatatgtttaaaggccgctaatgtattttacttgatgaaatattaaaagaatagattatagtgcactagggcaagcgagcaactgcatctactggcacaaagcgatatccgagcacgcgtaacccaagttcatgaaatggtagaaacatgtaaagttataaccttctcttctctcactactatgaaacaccaattttttagtttttattgttgtcccttttgctatacttatttctaggtccgaacattaacttcaacgcccacgtccattagcttgtatggttatgaaaaataagaaaaaaacgtgtataccacgttcatacatagttaatcgataaaacatatatttttgtattttattaaaaaaataatactactataaacggtgccggtagttgaggtgaagtgacagagtaaagagcgccagagtccccgttccttgtccagcactagcgcatcgatgaaaggttctctcctctgcccagaacccagataccaaaatgggaccgagagaggctaaacagaagtgacagcagcagctatccagctcacccgagaacagtttgtttactgtgaagaactgaagacacatcacattccggctgccgtcccttcccttgcatctggctctccttgcagtcgcagcctcgtacaccgcttgtgcgagcttttactcctaccccaatctccctttgctacttttggggacctccagacctctcaaatcgagagaaccaaaaacgatagagaaagagagcctgtcagcccaagaaaaggttcctcccctccttccccacctcgccctcagccctcatcatcctctaacatccgattgtgccctgtgctctgcggttctcggatccaagatttcgccggccggccgccggcggtggctccggcctccgggagcgggagaaagactggatttttcgggccatggagatgtggcctgatccgttcaggcccgggcggtggggtggcttcctgagcaggtctgattcgtatcggttcaaatgatctcggcggcttgattggtcggttccgcttccgccgggggatcggagctagggcggtggtttcttggccggccggtggattcatcggctcgggtctggtgggatcttggtggttgctggttcagcacacgagccgcaggtctgcgtagatcccctcttcgcttccgtggcggatttgtactgctagggttttggttgggtctggtggaag

SEQ ID NO: 7690 - DNA, 79 bp, Zea mays
agccccacgtttcgtaggtccctatcccatcattggcagggtaggacccgcagcataacgtctggaattataggaatcc

SEQ ID NO: 7691 - DNA, 1500 bp, Zea mays
atgtgcttcgctgcacgcgatcgcaaccatcgagcgtgcagtgcagatcgaaatcccatgggtggtgaattagtgatccaatcagcatccaagccagatcagttacgcaacgtaacaaaaataagtatatatagcagaggttattgaacttaattaacctatttacttaataataaattctagaataaatttcaaaggttcattcatattattgaatttgttttacgtggcaagttcagaattaaacaaatcacatcctaaagatcgcaaccgagtcgttttagttttctaaccttttatgcttttatcctgagtttaggcttgagtttatgctatccgcactcgtataactctaaatttctactctaaccggagtatcttatccttgtcagcaatattctctactctatactgtaattcttcacaatcatatttactactctcttcgtttttttagttgtcgctggatagttcaattttgtactatccagcgacaaactaaaaacgaaacgaacggaatatatatttcaaccctatgccaactaccacatgttatattatttattttcagcatcaccactacatatacagccacatcccatgccacccaatcaggtctgagacaaaaaggacagctttagagtaaaaagggacgaactctacaggtagcgttcatcgtgccttccgtatgctttgcgtggctggtagggtcatccgctgcagcagttttttactggatgtgtagctgtatgttcgtagcgttttgtttagcgcacgccactgcggacagcctaaaagctactgcaatgaactagaacagctacgacaagcaaagatcacattacatgtccatatccatatccatagatagaggtccataggtagcaattaagtaaacattacagaccctctagatagtttgaaatttgaatatgttgctttttgcctctaaacattcaagtttcattattcaaatttgaggtccataattaaataggttggtttttgcttctggtcaatgttttgaaatttgaatggccatgtacgtttccttttatatgctatatgtttgtttgcacttatcaaacatcgaaaatggacatctagatattcgggtcacaaagccttaacaataatccacctgcatgatatgttttgattgtgcgatgttaagaaaagattgttggatagatgagcgatgccaatggccgggacctgctgcaccaaacagagccagcggcccgccttcctcctcgcgcctccgaaacagaacagcaacgacgtccagccaggggaggggccatggggccgcagtatatatacytgcgccttgtaccaccgcccaccgtcgcaccgtgcgcgcgtccctcgctcctgcgccgcccgtccgatccggtcactggccggggagggctcagaaacctttcatccaatacatacatctatctgagccctttcccgcggtgaggcccgaccggagtccacacacacacggtgtcg

SEQ ID NO: 7692 - DNA, 572 bp, Zea mays
aactctatatgaacatatattttctaaaaattagtaaaaaaaattattttgaaggcatcaatttgttgcgtcttgcactttttcgagacacatgatatataatattgaccattgaactaataaataaaattaataaaagataaattgaaagcatgcgcaatgcgtgcccctcgccaaaaagaagttgaatgatgttgatgcggcaagttaaaaagaaaagaaagaggcggaaaacacagagatcacgtgttctgggatatatttccatttccatcccattatttctatttggaatagaatagaaaaagggagagggggaaggaaccgcctccgctaatctctcgatctatgtatgcatgcgtggtgcggaaggagtcaggagcgagaggagaggactcgggcaaagcagcaaccgccgccccctgcgaaccgctcgttcgccggcccttgatttataaaaggagccgaggcctgttcctcacttgagaagaagacaagtgagaacaatcatatatatattgttgcttaaagagaagagaagagaagagaagatcgacaagagattggcggta

SEQ ID NO: 7693 - DNA, 1500 bp, Zea mays
atggtccacagtgcggtgagtggctgccgcgaacagtgtagtacgtgtacggagcggtgaccagtgatcctccaggcgcacgccgattcggcccggccgcctgctgtgtcgtgtcgtgtctctgttgtgcctgcaggctgcagctacagctcgttgcggcggggtgcatgggatgggacggcgcgatgcatgcatatgtattgcagcgacgagacctgaccctgggccctggggtccgtgtccgtccggtccggtcgtcgtgcacgcacacacaggcatgcagcacagcacatgcatgccgccctgccggtttctggagcgccgccgtgccaccactggcactgcacgggccaacaccgacggcggcgcctgcctgcatgcttggtcgttgcttcttaacgtcagcggcaaaccagcagacatgttccagtccagccagcagttggtctggtctatccagatccaggagccaacaaaaggccaaaaatataatatccatgtatccatcctggacggtggcccaccaaacaggacaaggtcacaccgcgtactctgcgtgcctccacagcatctcacagagctccctacaacctccttataaatcagtttttaaggggcatctacaaaattagtggagtggattttaatcttttctgcaacagacccctcaaaacggtatttttttctgagagtccaacaaaaccttacaaataaaggagttttaagggctatgaaaaagttgggagcgttttagagaaaccgtggagacatgtttttgtgtttccccaaaaaacttgatttaggagatacttttgggaagctcttggagatgctcttagagtatctctaatagttatgtaaatttagcaccttaaattgtagatttagtaagtagttaaaacacttttaggagtaaaaatgtctgtgctccaacatttctctattattgcttgttaatttttaaatttgtccatcaacataaaaagtagtatgttttctatttttaattgaactagcacatcaacaacctttcataacctcttgaaagcttgaagttgtccatggaagaatagaagctcgtggcgacagcatgaatcgaagttgtccatggaagaatagaagctcgtggcgacaacatgaagacaacacaaggcactggagatagatttgtggtcaagagggtggtgggacgacgcaaaacggtgaccgaaatatggtttccgcgatggttttagaaccaacattgatttagagagtaccaacgaggttgataaatgtagggataaaattgagttttgtagggagtttgtaaatttaagaacctgctttacatagatgttagagaagagtttttcttgaaaaattattaaattcatatttagggagttatttacataaatattggaaatgctctatacccattcgtttgtgaacgttggacgtggtaatgttatattggcttaagaaaaaccacgagcagttgtacagattaatgtggat

SEQ ID NO: 7694 - DNA, 190 bp, Zea mays
gcccatgacgtggcggagctcgcctaccctggcctacaagacccgcacgcacacgtttgcgtcaacgaacgaacacgacgccgcgagatttttccgacctaaccttccttgcgaactccgccaccgcgtccctgcgttatagggccgtcgacgacgacgggttgcgcgtccccgcctcattcgcgcgacc

SEQ ID NO: 7695 - DNA, 908 bp, Zea mays
gtataatgggtgcgcggtcgcgtgggaggattcaaatttcaaacccacgctctagtagaaccagaggtcgttgttatgtagtgaatataaactattttttgaaaacacgcaaaaaaatataatcctttatgttaggcaggaccacgatatcatcaaataggttgtgtctaagattagtccaccagacataatctatttagccatttatattttcatggtatttaaaaaaccaaaaaattcttattaaccataaaatcagaaaagtcctagttgggacacgatcacacgacagtcgagcaggggtgggaatttggttttaaccgatagttcggttcggtatatttggtattccaaaatttcggtgttgaggtttctgaaaccgatcggtgcgtggcgaaaccaaaaaccgagcagttcggtatcggtgattttattcggtattcagtgaccacagaacttgaatcaagtttcaatgaacacaaaacaaaaacaatagccgcggacactaggcgttttcattagtcggcacaaatcagaagctaacaaaatcaagaactacacctattaagaagctagcacctgcactcaccgtttaagtagctagcaaaagaggagattgaaacccacgtggtgcagcgagacgagaggcatcctgtgagtgatgcacgagagccgatagacacccacagccacacacgatgacacgacacgatccacctggccgttgcgttacacgccgcgccgcacacatcagtgtcatactgtcatcacccgtgcctgtgtctcaccagcccactttccccagtactctactcacccacccactcacggactcatctactgagcagcgcggtgggcatccgagcgagagggcgagcgcggaaggatcggaattccgaaggttgggc

SEQ ID NO: 7696 - DNA, 1500 bp, Zea mays
cacgcctcagaggccgtaacacacttaaataggaataacctgtggcggaactgcccgaattattcctacttaagtgtctaagtcccgctttaaaggctagaccacacttaaatgggaataacccgtcaatccctcggatctagttcgacgcggccactgacaggatcaagtaccacaatctcactcgatggtgagtcacagagcaaatacaataaagcataaaaccatgcatgaaagagtattaagttattacatcatcattggagtttttcaaaagtagccatcagtgttcgaagtgcagcggaataaaactaacggtaattaaacggagagacggggaagcctgtcccatcactcctcatgctcctcctcggccgaggcagggtcccactcgacagtccaacccggtggcaagatggacagccaagtcactctagcaaccatttcctccagagaacctgtaaaaaattatgccacaagcaaggctgagtatactaatactcagctagacttaaccggtgtgaggagtctactcctctacctctagacatgcagctgtttggctgtggggtttggttgccaaaagcactagctgagtttctaaatcaagtttttaactttgtcaaaattaagtgtgactctcttaaggctaaagatgtactatctattcatacatagtagcaaacatttttagcaatcaacatcttgtatcatctcatcacaattcctcttgttactcaatgtagcagcatggatcaagcagtctcattagctgtgttgtagcgaaggcagaaacgccacccttcgctcgaagtctccgctgcttagtcgctgctctgacagagacaaaacaggcagggacgcccttcgcttgatcggcaccagacgaagaccggcgacgaaggcatcccacagtgcggcctcgtccagctcagaggcccacgtgcgatccggcccattgtaacgggccctgcgtagccgccgcgtgttacgggcctaatttgtaaaggcatccctgtaattacagtctgtaaccctgctttatgggaatattctggggataacctaggtagctgagggcacatgcgtccttaacacaaggcgctgggcgttcaggtacctataaatacccccggcacagtgcccgtgagaggcctggttaacagagctatttgccatcccacgcgtaaccctactgtctacactattcacccctgttggccttcttgcgactgatagcaagtgccaacagccaccagtgcacttcactatcaatggtacgacatacaaattcggatactacttagcggatggcatatatccaaattgacctacctttgttaaagcaattcatcacgcatttgaggaaaaaaggttcacttcacaaccaagcaggagagttgtcgaaaggatatagagcgagcatttggagttttgcaggcgaggtgggcagttcttcgtggcccagcttatggttgggatcgtaatcacctcgcagag

SEQ ID NO: 7697 - DNA, 907 bp, Zea mays
gccgaaagatcgggcacctcagctacatcactaccgaaggggagccttttttatggacacttcctataaaagagggaggagctcttcaaaaacaaccatagaagccgggagcaataaaaaggagcttctatcgactcctctcgcatgtttttttcttttcatcgacgctacatcgtaggaggagctatatttccaaccaaacatatttttttactagagtttttttttgcctaaaaacgaggagagagttgttttcttagaggagctagcattaattgataccaataatgagtgcattaattctattaattagtgcatatctgctgcactaagaaacatgagagggtaaatgagataaaaatcttactttagtcctttttagtcacctaagaacttaagtttaatcacccaacattattcactaaatttacttatttaggaactaaaagtaaataaactttagtcactaaactttagtcaccccaaaccaaacaaacctgtttttgttaggaattctaataacagcctattttaaatccttatgtgtggattttcttgcgccgtcttcagctccccggtcatattttggctgtaaacaatgttaaagtcagcgataagcagttaacttattctggaacgacgacgtgcaagatgggttcgaccgttcaatccatggctgtacctgttgttgagaagtgatgaaaggcgcgcaccgttgtcaaatgcgtcgggtggctgagggagctgaggtcaccgccagtctcttgtcacaccaaacacccagtggttcaggctggccaaagttatgagttatctgccctgtcctcccaaactaatctagtcccaggaaactaatttcaacacacaactggacgacggtgcgttgcgttggtggccgccggcgacg

SEQ ID NO: 7698 - DNA, 1500 bp, Zea mays
gaactagccgcagattcctcaggtgcgatcggtcaaatcatccggcgaggtgagaaggctcatccacgacgctttgcagccggctcgcatccacaaccaggacaaggatcaactctgtttacggctcgactcataaactttagcttaatttttttcatcattgcaatcagatgtgcctgagcatgaaggcctgaagggataagagcactcgcttgagtggtagctgaaacggttatagcgtgtttggtttgagaaatgaggtagtctattatcttatcactccttactttattgtttgatttgtgaaatggaatgatcaataatgatcattccatttctcattcctcataggataatatttagtaacaatattagaaatgagttaatttcaccaagtttatgaattagactcacgatacatcatcttatctaaaatagattgattcttcaaaccaaataccagtccaattccatctcagtgaaccatcggcatacaagtaaacaaataggatgcacgacaacccaattccatcacstgataatcaaaatggttttgtcattataaataccaaaataacagggaaagttaaacatgaaacttgcatcctcatcagaaagctcgaatgtttgagtccttacacaaaatagaaggcaaagagtacattcgggcattttcattatctagcactccatcaaattgtagttgcctcatagcttatgcagcatccttaccaactccaaataagaggcctccatatcctccttgtataacatgatcatccatcatagaagaattcatgtgtatgttaaagctcggcactatggcgttaatataggattgatgggactgtcgtagttgawggttggctatacatattattwggcaatgctatcagcttgaattatactgacattaaggtcctatgcacaggatttacaataaattatacattacacttaaatgtaagtaaataaaatataaaaaagatataactgatgcaaggcaattgccttaccatcgtttgttttgaaacaacacttttgtatttgttggcacttccggtcggtgcttcgtgatactctttctaatcacatgaactggaatctcatgaatggcggcgcatggtcgaaagaaatacgacgacggctgtttcgtttctgtggtagagaaatacggaggcgtaaaacagagccgactcttgcggtcttgccttggttacggatatgggccggctgccatggattcgcacgggaggagtctacggccagtttcgcgctacctgcctcaagccctcaacagccttccgatttcatctcaactcccagcagcagcgcgctttcatccgacagaggtcgccatatccatatataatgcaggcgccatctacctcggcagcctcggcagccttccctcttcatctcaagttctgaaccaccaccagrcaccagcagcgcgcgcgccttcatccggtagatcctttcgagccgcctcgcggatcc

SEQ ID NO: 7699 - DNA, 734 bp, Zea mays
tgccaagagcttgcttcgctggaatggtattccgaactggtattatatgcttgtggagtttgctattttggtactatgttggtgatggtttgtctttgagattaatgtcgctcatggtttgtgcttcaacggtcggtagagctatccatcagttcacaggcagaacacaatctagtcatgtttaacacaaatgggtgagctgtcgcttctgtaagaaatgtaaacaatatagaatttgggtaaaaatctcgcacatttttttatacataaatggattataagactgtttataatctagcgttcggtgaaattcttatgcgtttccagtcgtcttaatttttttagaggtgccataggggtgaagtgtgtgtattcatatatttgtatcatgataaaaacatataaaaattgaaattcttaaaagctgtaaaaagaattaaaaaaccaccacacaaaatacaaaaaatataaacgagaaaacaaaggaaagaaagaaaaagaaaagagagggagaggaagcgagcggctgggcgccccaagccccacatggtgcagcgaggtccacgctaacaacttctcgaccttggcctcccacggctctgccgcattgccgcgcgccgccggccggcactcgccgtcctgacgcgagaaggaagatgctctaggaagttgggggcctggctagggacagcctgtgtcccgccgtgggatcggtgggagagggggaggcaggc

SEQ ID NO: 7700 - DNA, 1500 bp, Zea mays
accgaacggcagaagctactgccctcgctacatcacgttcccgtcgtacaaaccgtccggtgagtttctgttttctattactgccgttgtgtgaatggaatcagtgcaggatgcacagccgcaccgcacaggggaagagaattgagtccagatttgtcatggctttgccgctgcactactctgatcggacactgtgattgcgattgcagtggtggccaatactacggaggggatcaacaaccaatccaatggcgaggttccgagctacatgcgtacgtctgactctgagtagcgtccaggactccaggttctgtgggcctctgccgagccgagtttgtatcaaatatcaatagagcgagacgccacggcgtgcttgcaaaattaccggcccggtatggtcctgtataattctttcattcacagtatcgaatgactggccaccgcgcaccgggatttggaaatgaaatgtgaatgttaatgtatattatattcacttgactgtaccagattcgtgcacaggatagtttgacaacttcgtttttttccaaattattctcatttccttacggccctgtttggatcattggaatttaatttgattctaataataataatttagacacatcaattaagctaatacagttttatgtaaaatatatttatatactattattaataaaatatcagagatatttatgtactacatttttactatagagtagttagtctaaaagcgtattataaattgtagagtataaatatattctacttatacataaaattattttttcctctactccatgaatttgagatagactatctctaaactttgaaaattggtggaatatcaaatttcaaactaaatagattactttattaaataaattccaatttctactaaataaatggatctaaacgctctgtaaaggaaaataaactgacttttcttgaaaaataaaaataccttcgtaaaatagcgttcccaagctagggctcgtgtctcatactttttctccgcgaggagttgagagtctgcttgcgttgttcctggttgcgtgtcacttttcagttctggtcttatcgctgcacgcatctcgtttgcggttagttggcttggctagttgcttcgtcgcatcgcaaccggctacggccgatgctgatggccaaggatattccgtatcaaacccatgtgcgagtgcgaggccaaggatattccgcgctatcttcttcagttcttccattccgttgagataatcacgatacgcaacaaaaaaaagttttttagcagctaataaggggcaaaaaggaaaacaaaattagaggtggtccccgatacggcagcgcggggccccacttgcagcgagacggccgtttcctagcccctccgagccaccaccgttggcgttgatacagcccccccacctggcctcatcgccccgaagagttgtggtacagttgtactgagctgagctgccggaggcagaataggagaggcaggcg

SEQ ID NO: 7701 - DNA, 632 bp, Zea mays
cgatgatatggttggagtgtatgtggtgtggattgtgtggagctagcccgccaaccggctcatcagtcatcacacaaagcatcggaacacttttttttaatcctggtgtgagtcttgaaatagtgcagagacttagagactttaatctgatattacttatctagatagataacagacaacatataagtagagtgtgtatgaacctttcacatagaaaaaacaaagagctacggagattgttgtgaacacaccacccatgcatgcgaaccccttcacatcttttgtttgcgtgatctgcttactccctccgtttcgttttagttgtcgctggataatataaaatttaactatctagcgacaactaaaaagaaacagagagagtactaatagatcgattttgttttacaaaatttgccctgtcgcccggcgtgccctgtaccggacccgtaccctctctcgccggcccctgcatgctcagctataaagctcggcggcagcttgcttgggcaggccccatccaatccatcgcgcgcactctcacctgccttccttctgccagctgctgactcatctatcagctcgctcgcacgctgcagaacgaacgaagctgaaggcggcggcggcggctagcc

SEQ ID NO: 7702 - DNA, 273 bp, Zea mays
ctagtagacagcggcccggtcgggcacatactcctcttcctatatacatcggatttggatgggcggcatatatgtacgtgtgtgtaatatattattactacatcttgtactatatgcgacgattgcttgactgatgaatcacgctttttaggttagaccaatttagaagggaattagagtggattaaattcgctcccggtaaaaaatgactcgaagaaaatttagggactgtttggtttgtggttaaatgtgctacactttgtttaatgttta

SEQ ID NO: 7703 - DNA, 1500 bp, Zea mays
caaccccatcctatagccctaatttctcttcctttgaatgctcttgctgtttctccctccaattgctaagatcgataaacctgcgtggagttcctatcttcaatttttgtggcagtgctagttaattttgttaattgcgatgtagcgtgccgctagatcgaccttaccctttgtttggctgggaattcgccaccgaatgcctcctatttgctgtgggctgacttggggaattcggggatggttggtttccgggactaattttcattttatttcctaagttgccaaatacggaaactattagcaaattagggattaaatggaataaaatgatgggactaaaacttattccctagaaatcccgccacggatgcctcctattttagtcactgttgtgggtcatccatttaacattttttatgttcctcaacatgcacgatttcagtttttagcttgatctagatgatgattttgagttcggaagtcagataatttcatgagctttacgtgtaatttgtaaacatttgctctctcgaatgtgtaggattcactaaatttctccatgtcctgaaggcttaagatgcagaaaagtaatgtggagtgtccttttgctccacaaaatgaaatgcattccttcagttgaatattttactgtttcgtcgttcccatagagtacttgcagacagcagagggttttttctggacaacaacagcagaggttgctactagttgttgtcgaaagttctaatatttgcaattttgcaacccacaagtgttgactctttgctattataccacctcggtctatgatttgtgagtccgtctgtctatgatttgtgggaccaatggcaaagtggtgaagcccaatgatgatgatggcaaaattgcaaatcccttaaagttcggtgctgtacagaaaagacatctggtatgtaaaccaaaaggatgctatagaactttccacaagggattgacatttaccaggtttttttttcttaggcacagcccctgagtgttattcctttcttgtgctgtaaatatctagaactgtgatttttgttacagtgcatgttcataagccataagtcttgcacaggttgagaatcgagcacagatggctgtttactccttagagcctctttgaaacttaaggaatttcatgggaactgtgtaggaattttgaaaggaagacacaggattcaagaaaaaaaatcccatccgtttttcctaagagggcattaatgtttttttaaaatacttcagcatgattttgacacatgcatcgttgatgatttgtgtggtcttgttgtcatcactgggaacaactttgcctatttaccataaatgcatgctggtgtactgatgcagagaatgtttgatttgtaaaactgtcgaatttttgttttggaattttgttccatcaaattattgagcttatgataaatcagatggacttttgaggcattgatttaatggtcctgtaagtggtctagtaagtctgta

SEQ ID NO: 7704 - DNA, 853 bp, Zea mays
ggtgcggccaagggccgtggtcacccgggtcgcgcgttcggccctcgaagatgttcaaatccaagaggattgcctggcacgcaggcaatggaggactactcttgaagtcactggcaccaactcttagtttcttgatgtcccaagcaactaggggtgtaaacggatacttattcggatatcagttttttggtcttttttctttgattgtgaattaatagaatatagaatctgctatgcaaatttatattcttgtttttatattgagcttgtaaagattcatgaaaggtaaacctcaaatctatcatatatcttcttaaataataaatataagtttcggatacaaatcgaatacggatacggatatttttttaccttttttgttgtatagagcaaataatgtatgaaataatttatacaaaatgttattcttgtttataataatatgcttcataacataagaagagattagcatcaaatttcatacatatctattttataatattaaatttgtcctaataattcggatatccgtttacacccctacaagcaaccccttccaattttgccaccgagtgttggccatctgaatgcaagctgactgacagatatgaagctccaccatttgctcagtctgtctaccctttacttgctgatctttatcatatatttgctgatattccatcgattggtagggctatggtttctgctcagaagttgcttacacaagttcacaagggggagccaatcagcagtgatatgttgtctgatgtgtatgtatttagaattgcaatagaagccctcaggatgggcttaaacagtgcagccaggtcccaaattgataccggagataaac

SEQ ID NO: 7705 - DNA, 507 bp, Zea mays
ggttcgtcggcgaccactaaggccttgttcgtttccgtcggattgcacccggaatcgttccaggtaatcaaagtttatataaattagagaagcaatccggtcaggaatcgttccgacccaccaatccggcagaaacgaacaaggcctaagtcagtactccctcctccgccctattccatctatttgaaaacggtgcgatgaaacccacgtgtggatactccaaggagatgttcgggagagcgcgcctcgcacgtcacgaggcaaaccacgcccccgcgcgcgcgcgcccgatgcgcggcgtcaccccgcgccgtccaggactcactcaccagcctttatttagccataccacacatataggtatgtgttgtacttgaggagtttgggggggagcttctgctctctgtgcacccttattaggctggcgcggacagagtgcattgcctgcacctgcacagagcagaactactggtccagttgcttgcgtgctaatcatcacatcagatc

SEQ ID NO: 7706 - DNA, 980 bp, Zea mays
tcttcttggaagctagggtctttgtgcgcttgctcactgatccagaacaagaacttcgtcgaggtggcagtcctggcagacgtccttcgtgtgcctgcgagtctgcgacaccggatcttgggcctccatggtgagttggtgacgagcccacgacgggcgggtgaccagtgaggcgtgggcgcgcgacaagctgagcacctgagcgacggggcgcgagttgctgagcagagagcacctgagcgggcgaggcaatctagcagagccgcaggtggctggctaggcgtcggagttggggtggaggtggacggatggtgcggctgcggactgcgaagtgcggtggtggcgtggacccatggtggactacgagctgcgatgccggcgtagcggcacgtgacgaactgacgacgtatgtcgatatgcggctctgtgctctagcctttaggatttcgagttagatttgtgaagttaggacttgaaagactttgcgtgcacacatcatggattgtggttgtgacggtggcctgttgtgcaggagttggactggaccgcttttctagagtggaacatgcacatcgctggatcagttgatcaggtcatctacacatctcgttaggttcgtgagtatctcacgagccagcccgagtttaacttattaagaaccaatctaaattattggctcaactcttaactcattttaaataagtcgagctaaaatcgagttgagtactgataaatcgagttgagtccgttatcgagccgcgattcgtccaggcctacaactacaaccttacggtctctgtttcgcggacgtttttactgaggaaggtccatccttctccctcctaggctccgtcggtctctctctctctttccttatccccggcccgtggcccgtgctaacggtgattagggttccgaatcgtgtttaagcgctgcgaaatcacggctggggcttcgtcctcgagtcgtcgtcctgctgg

SEQ ID NO: 7707 - DNA, 173 bp, Zea mays
cggggacgggaagggcgcccgccgcctcacacagcaggctagtagccagtaccccaagaaaacccctagtcactcagatcccaatcaaaagaggagcatcgcagagctgtagtacgtagcacgcaggacggcaggaggcagcggtcatccgcggtggccggtgagcggtggcc

SEQ ID NO: 7708 - DNA, 258 bp, Zea mays
gatatttaagtgaatgttctcaggtatttaccgataatgaatgaacgattttcaacaattaccgggaacttattgagttcaataattatcggttgtgtgaagtaatcttatcttatatacatcctatatacatgtggaatacatctgctacaccggaggctgtgggtcgttcgaaggcacttccttcgtaggcagaactgtggccctacacagaggacacgtggagtgagagtgcagccacatgtcgatgcagcagac

SEQ ID NO: 7709 - DNA, 966 bp, Zea mays
ggtaccatacgsccatctcttattgcgggtaccacactagcacttttcaaattgtcgatgcacctctttayagttcttttaggttatgtgccaatttctygaggcttataaggacatttctactctatatctagaatctactccttccatttgtctgaggtactgaatttagtgctaccaatcccggycagtggtaggtttagtatacaaggctatctctgttgttgttrtagttattacactatagatttgattgtgcctatggttaacatctctctgagcatggtttccagtctgataatcaagtgtgcgctctaatttgtattttcttagcttgtttagtttgcatattatatgcactcakatggtgtatactaatgtttctatggaattcattgaaaattcatctacttaccctttcctaccctcaagtacatcaagagtgcaaagctactattaaccttttgtttctatggaaaggactaactttcaactgagtacgctaactggttgctctgatcaaatctgaaagtcrtgttccttcatytgtatcactacagtttgttgttaattgtttctgaacctgtagtgtggcaacagacatttagawtgtgctagaagaaacccagctraaatttgaggaggaaaggtatttggtattcgaaccacactcaatttttcygaattaacatactaagagtctcggagcatctgaagccagttatagcttatagggagctaaacaaaagtatacatcttcaatgagcacacactaatccatgttcctatctgtgcatgcagacaaaatttgctaaaagtactacctaacaattccaaagaggtactcataagaatttgtactccaaggttttgttttcttctaaaatgacacagatttgtactttagctgtgtgagaatttgtaattctgaagttgagtgttcggagagtttgtgagggctgtgga

SEQ ID NO: 7710 - DNA, 117 bp, Zea mays
acttgttctcaaatgctatgagttaagaacaaggcaacacaaaacattaatggttaaagtccttcatccttcgaagcattatctcccttaggatataatgatcttcagacgaaggtt

SEQ ID NO: 7711 - DNA, 477 bp, Zea mays
gatggagactagttgtgtttgagttagatgatgttcgctgcgagttagaaaagttatatgaggattttgaggtgcatcatagagagacaaaagatgctcaaaacagatctaatgcttcctcatctttgagtattgaaagatcatgtagtttgccatctgcttcatgtgaatttcagtcattcttgtcttcaactcaatctaacccatcaaagagcgagttgctaatctatttagaggagactaatgtgagtctgagtaacaaggagtttgattcgttgaattggtggaaggttaattcacatagatttccagtggtgtccagaatggcaaaaaagttcctaactataccggcaatatctgtgtattcggagtctacttttagcacagggggtagaactctagatgattaccgtagttctctaagcccttctatggtggaggcattgatatgctcctctagctggattcgaggtgcac

SEQ ID NO: 7712 - DNA, 1500 bp, Zea mays
ttgtcctgcaacctcttcttcctagctggtttgaaatctgaataactccgttttggtcaacttcatgatgccttaaccatgtataccaagtggctcacaccatgttgcagcgtatgagattttttgcggtctcacaccagaattaatttctgtttagggctcctttggttcataggattttcaaaggaaaaatgtaggaaccatgaatcctttggaattagcactgtagagccgtttggttcgtaggaaacaacctgacgaaaatctttggaaattttcctatcctccaacttctataggaaaaccataggaaagaaacaatccaccctgacctcttttttttctgcagctcgcataggatcgaggcaaacagctggttatttagtccgtgctgagcaagcaacaacaataaaaaatagcactttgtaaatcaatacatacgtaagctatgatgagttacattaactacatagtatactctaagcattcctatgtttgtcctgtgtcatccaaacgtctctttagggatttttcctttggttttgaatcctctgtttttcatatcaattcctttcctattcctatgtttttcctattcctatgattttggattcctgtgttccaaaggagcccttagcggaaactacatgtacagcgaccgcttcaagtgagctgatggcgttacagttgcaactagcaagtagcaactgccaggacagatgcatcagtacaggatgagagaatcacactcaagtcttcccaaggcataaatgcttgcacccagatttcctacgaacatcagcgttgccagtttgccactgatgactgttctcttcttccatcccgagggatactgctatacatgccagacagacccggagcaacgatctgtcagacgaaaaggagatgtggagagcggaaagagacggcgtccatcttcttttttttgttcttgtaatctccaaccaaggactcaaacacgtcaagcaagtaaacggagggcctaaccataaaatggctttgcctttattccaaagtccaatacaagtcttccttggggaattagctcattgaagagagagagagagagagagagagaggggagacccattaccaatgccaagaacaagaaaccagagaggacagccgcgaatacaatccgaatcccctccaaaaacccaccataccgtctcccccatctgcaagaacaagatcaggagagcatcctagggggaagaaacaggagggggaaaaagaagcccagaaagaccaactgaccaaacaaaaaggtggcatctttgtgtcaccgaggcaccgccgatcacagaccaaagcccgctcctctggtccatcccaagcgtacagcagccgagatttcttcgatctgcgcttgcgtttttttttcttgtaaagattttagttttccccccttcaactgttgctagccttgagtcgctgagaagtttcgagaagggtggtgtgagtgtcggatagctcaag

SEQ ID NO: 7713 - DNA, 1500 bp, Zea mays
ccgtggtgatctgggcgctgtttcgttgcttgtttgtgtggtgtcccagacttgcggggacgcggcctgcgccttgggccaaactcgagttccggaattttcctggtggaattgggaacggccggcctagggatctcgcgaggccgcaccagaattgatcctttccgtgcaaattttgccgctccagtccatgtttaggtgtttgggggtgatctctgacctaataaagcgttagctcggcctgtttattcttcatacagtttatcatttgcgtgtagatttgggcatatgtgcctcaggaagcaatgaaggtccatttcgtgaattcgttgctgtgtaaattgctaatcccacgttaagtgtactcatgattcgttgcctgaggtccaggcgaaagacctggcgcttagttcttagtgcaaatgttgagtggataaggtgattttaattaagaaaaggtgtatcctttggcaacaagattggcttcagactcgttgattttggaccaaactgtggctaagggaatcctttgccaaggcccatccatgtgctagcgctagcgatctgtactgaacaagggaggaccaagagcaaaagtatacggctaaagaagctagctttgttctttgcttgcgctggtaacttagcatttctcaaaagggtggaatcattggctcaagtgcggaatcatttgattcctttgattataaagtcatatgttgttgttttcccttctaatctgacagatctgagatgaggcatgaggtgctccatgtgagagttttccctagacctcttacctggctcttgcttgtgactttatttaattgggaatgtagatcacatctaacatgctccattgatatgattatttaatgcctttggttgatccacctgcttctttctttttctgccttcccgaccagttttgtttaatgcctttggttcccataaagtctatatatgacctctctttccttgcttctattctccattcttgaatgaagttccataagcttctccaagaagagggaaaggtcctgtaggggcaaagcgtcattttgctggtaacagggtacttgctgtcttatcctttcccttgccaggtagagtcaatttattttgtttacattgtgagaagaacactatctggtggaaatggtctcatttcaatacttattttctaaaactggagcctaagcgaatctcctttggtaatgccttgtaatgtgcagctacatttacataagaaaatgttttcagtcgacaatttgtgaatgcagtagatatatatacatatgtatttagtcctcatgtgatggcgtcatggtgtcacaggtattttctgtgcatacttaagggttgattttttctgttgcttggcatatcttgaatgatttatgttacggaacctgtggcccgatcttacatgatatttcataaaatttactgttccccacagaatgtaaccatgctaatttatgtcagatttctgagaaa

SEQ ID NO: 7714 - DNA, 643 bp, Zea mays
ggtggtaattgggtggggaagggaagagaatgaaaacgaaatgatataatatgtgktagttggtatagagttgagatatagagtaaatatgactgcggagaattgtggtatagagtaaagaattttgctggcaaggacagaatattctttttagggtagaaatttagagttgaatgagtgtggatagcctaaagccgccgttgcatgacccactgcccatatgcctctccatcacgcgcactcgtgtagctgacctatggggtcccatcgttagctacacgagtgcgcgtgatggagaggataaagggcagtgtagtcgaggggagagggcgtaccctttgaggcgggatgaggaacgacaatcgacgtgtttttcctcggaggggacacaatcatttaatgcgacgagacatcctgcctgtcagccgaccgttcgcagcacgcgtgcgcgtgggattcgaaacggccgtcatccaaccgttttcgaatcacaccttggtggctccgtccgtcctataaagctgtccgagagggagggcttcggaccgttacctttacagtcttagttctttgccttctaacgccgtttccaccttctgcccaaagagcccttcgtctttttctcgcccattcgttcgtttcg

SEQ ID NO: 7715 - DNA, 1435 bp, Zea mays
tcgagttagcttcgagtaaacttgatgccgcataagatttgttcgtcagtgtgtaggagctatatacgtagagaggccaaaagacgcactttgggggtgttctggttgcactcaattaaagacttatttagaagcacatcagttttttagtttttttttaaaaaaaatcactttctatccctagtttttagaaactggtttatgaaaagagttaggtgaaggtgtttggaacttattttctagttttttatacataattacttacatacccttactctattttaaaagcggttgcaatagttttaaatttcatgaaaccaataaagacatgacgtaattaaacaaacaaaagctagttttagctagaggtcagtagattcttgttttttaataaattaaaaaaccagtttctataaactacaatctaaactggtatgtttgaaaccaatctactttctataaactagtttttttttttaaaaaaatggatgcttttaaacaggacctaaagtttaacccatatcaagaagaatatttaaataataattatatgtatttaaatgtagtttaattataaaactattttacagaatacagactaaaaaaagagatgagtttatttaaccttcacaaaatagggggtgacagactgacaggggcatcttaaaagccgactgaaactgcacgacaagtttcccaaaaaggacgtccaggactgatcgcttctggatgttgtttgaactttgacctctttccatgcacttacatagttgctggacgtccagtgaattttcttcatacttatatactagcaataaaacttccaaaaccaacctctatgcacgttagtgactcgcattccccttgaaagaacaccaagccgtcggagtggaaatggaaaagctttgccgtagagcagaacgaagtcgtgagcgaagggacatggacggacatgtcgctctcagctctctagacgtttgacgggaacgggctaaggtcgcaagcaaggacgtacgcaacggcacctaccgaatcgccgagaccgggcaaaggttgggcttgggcccgagtccactccattcattcagaaatcagaaccacgctgctgcccaaacggccaaagccttgccaatgcgctgcgacgacgctgccatcaccatcgcaggacgcgtccacatcgccatcgcccgccttccccgccgttggctgccgtgacgacgcagcaccagcaccgcccacgcgcctgcaccacctgcctcccaagtcccaactcccagcccagccgccccccgtcctttataacctccgcccgccgctcgcagctcgctcgcacactcggtccgcccgttcccaccctccagggtcgccaccgcttgcagttgcagctagcagagccgactgagcttgacacgcagtcagcgagtccgacgacgcc

SEQ ID NO: 7716 - DNA, 509 bp, Zea mays
  unsure (1)..(509): unsure at all n locations
ctgcagcactagacagcaagccagcaaggtattcccctccttctgcttgcttgcatagaggcacaaaaaaaaacgcataacaaatcgagcagcaatatacgatgcgcgggacacggcacgaacggggcaccggattcgatgcttagaatcgcgcagcttgatacgcggcagagcaagatctggatcgcgcctggctgtggcagcagcaggttgactctactacggacgagctaagaagagagtcgaccgcggttgccgttgatcgagcaaaggtgcgagggataggagggcgctncttttccttccctggctgcttggctgggttagttgattgactcccagtaaaacgggcagcactgcacggcacgacagaacccactcggcactcccgcctctctctactatacccagctactcgcacgcagatccacccacccacccatcgttccttccgttccgtccgtccacttgccgttgccgaccacaacccgctcccggaggacggcggg

SEQ ID NO: 7717 - DNA, 1399 bp, Zea mays
tgcttttgaccaggacaacgtcgttgactgtgactcgatggtacgcgcaagagcacgtcgaatcacacgaaggtttatataggttcaggccgctagaatgcgtaacaccctattttttgtcgaggctatgtattggagtttcactggtgtatacagattataggcgaactgtgggtggtggaggatgagttctyctgctggtctaatggtgcgtggttgctatgaaaatgttaatgagctacgggatagtgttgggatgtgatgagataagatgctttcgtaggggtacccctcggccttatatagatgactagagagttattcttttacaggttgtcactatctaactctacccgaattcctttacgggttgtcaatatctaactctactggaatcctcttttaacgcaagatgcattcatgcttattcgaagttcggtcactttttcagtcgagttaacgccgagtgtttagctcttcagatgtgtgcaacctcttcgcgcgagacatcaacgttccggtctgcgcataacccagacatccggtctctatttccttgggtcaagctcgtccgatctaggcctggttgtgattcgagggtttgtcttgctagacatgccattgggagctcatgaagcgtttatgtgttcataagaacacagagaatatttatctcctacacaaccaaayacccccttaatatcactcaattcacatagagaaaggcgggatgaactgagcctacaacggctgtatgggcttatttacaccgcatattgaagcccaactcacgatgtttatttccacagagcagacccacaacagtacaacgggcactcatcaggcagcatatgtccgagtccgatacagtcaaccaatcgaacttgcctccgtgttgacccagcacactaggcggtacaccgctctcccacaccgtacgtccctcatccaacgttccacactcgctccataagcggttccgcatcgccgcacccagtccacatagggcaaccaaccttccccaccgactttacctgtaccaccatacaccggtctcacgcgcccacgctgtcttagccatccagcgcaggatagcacccgcggcgcacgctacgtctataaatagacccccaccccctctccatcgagytctttccccagaggcaccctcaatcccctttcccctcctccctccagactctcggaggcgggcgcgcggatctgtcggccggggccgatccagtcgattccaccggacaaggccgccaaaaacacactcgctcgacgcagcgagcggggccggcccttcgtgccgcggggcgcccggtggcgagggccgcagcgcgcagcgatctgaaaccctaggtggtggtgggcgccgccgccgtgtgtagacgcg

SEQ ID NO: 7718 - DNA, 1267 bp, Zea mays
gagtggaaaattttagacatgaatacgagaatacaattagacaaaaataagtaacacaataaaagttaaagtatggatctcaacttgtcgacaatatcattaagtcccccaaagagaaacgtcgtcaagcatgggaatgagaaccacttcacctgatacatccaagtacaaatgtgtagtatgtttaggattcaaagacatgaggtggaaaaagtcaaatacatctcataaaaacctcattgctagactgtttaataagtatttggactataattattttgtgaccttgttttattgtagacggccaacttattatatttttccttgcaaggaaagaatgacacgatgatcatggcactaaggtagcacatgctaggtttggaagaaggggaggcagagaagcataaaaagaaagctatccaccttaccttgtcttagaatatgtgtgaaattctagcctaagacttaatatgattaatagaatattcatgcaaataagatctacatttttttagaaacctatatcgaaagaatttctaggttaaacgtgcttatcttagatatcttagaatctaataatacttatttagtataataataataataatttatagaagtttgaaataatttataatttagggcctcgttgactaagaaaatattgtattattttatctaaataagaaaataccacagtaatttattgaagaaggaagccaacgactcagattctcagacattcaagaaggatcggcttttataaacaaataaaagtgatgcaggatagtcggccatcctgaagcatctaaaactctgtcgaaacacctgtagatacttgacagcgataaaacaaagactcggcaccaaacaggtgagcacgaaacgtgcactgatcgtcccggacgaggaacccaacatgccatcaccacactagagtacactactacaaaatctctccgaaacaagccagcaaccaagtacagcagacatccgtcctatcccactcctagtcccaccgccaccttccctcccaccgccaccattcgggccgccctctctcccagtcggccagtcccagcaaatcccacttcaccaggcctcagctccagctcgcctatcccggtatcccccctcaccagcgccgccggaagatcgcgctgcgcccgtcgtctcacgaggaggcatcgaccggcgcggtggcatttaggaggaggaaggggaggctgtaccttgttgacagggtcttagttaggcggggaggggcgag

SEQ ID NO: 7719 - DNA, 579 bp, Zea mays
cccatttggacatctctagtcctataccgacgattttttttttcactgagagccctttgccgtgtgcaaacggtcctaatggtcacgccactttcaaacctcctcgagagcagctgccgccagaaggagaggaggaggaagcatctacgtcgaggcgaccgagcttagaagagcgcagtattgtgtcattgtgtgtcaactccagcagctaaaaatagacggggctaaattacagggacctccatcaacatcgccgagccctggaaacacaacacgcgaagccaacaatggctatttataacatctcacctttctctctcctcccctccttagttcccttagcgcgtgccggccgcctccgctcatcgtcgtgcaccatgccaactccgagaagacgatcttgcaaggaaagcgcatgcaagaacgtcgtcacatatatagaggagtagcagccagcaagaggtggaatcgacggcttgatcccgagaccgaccgagaccagctgcaaaagctcctagctagcgcattggccgccggagtgggctgcagtgcagtacaggtggatcgcatgcgaggagg

SEQ ID NO: 7720 - DNA, 364 bp, Zea mays
ggtacacacgacaggacaatgtgtttaataatttcatagagttgtatgcatttcatgtttactgcatgcagaatatcaaaagattgtatcatcaacatttcctttaaaattttcaggacttgttttcagctgggagcgacacaagttccagcacggtggagtgggcaatggcggagttgctggaaaacccagcttccatggataaagctcgcgacgagcttgctacagtgattggtccaggaaagaacattgaagaaactgatattgggcagctgccctatctccaagctaccgcggagaaactttcaggctacatccctccgtcccgctgctaccgcggcgtgctccagtcgacacaaaagta

SEQ ID NO: 7721 - DNA, 1088 bp, Zea mays
tgtcttaggctttgggttggcacttcgcagcgatgagagcctggggccctggagtaaataaataaggcgttcctaatcctgtgcagtggaggcacaacggcgtggcgcgcaagttttctcgttcgttggaacttggaaagtggaagtctgagttgaccgttgactggtgtcgttagcacgttttttttggttgatggagttgtctgtcctgccttttcttcctttctttcctggctccaagccaacaaaaatacacaggccgtaaaggatcctcaagccagccgcttttctttcgtaactagaaaatagtaatcttttagtcagctatttggcaatcaaacaggtgcatatatatggcaggggtttgaacaagtctattctatgccttatgaaatcgtagttttgaggcaaaacttgaagctagattgtactgttcatcactccatcgtctcagtacacacgagaccagaatccaggaatatgcagtgcagacttgcgtgttactttatttagtagtttaggacttctgatgttggtttctaggggattatgtaatagggttgtttcctctattctaagaattttaatctgcatgacccaacaatcaccctagaaattagtgattcggccttcggggcagttgaggttctcgatatttggcctactcgccaattaatttatttttcttgtggtccttgcaggggtttgtgctagagaatgctaaaggtctatcactaaatggggacctcaatatgcatccagtgattgcagggtctttgcccctacacacccaatctttgtggtaagatggtgaaatggatttgcccactttaagattgagcatactgtggtgtatgctgtatttttttctgtttgtgtctacctcctaatttttatcctatatatttttatttttttgcatgataactgggaattgtatgttgtgtcacgaccatccaatagtttatgaactatactcataaagtcttggtggtgttcctaatgcaaatggggactcagtgacaacacgagtagctgctgatcacgacacccatcaagattttcagccaacaagtaaaagttcagat

SEQ ID NO: 7722 - DNA, 1263 bp, Zea mays
ggtatgttttcctctttgttttgtttcaaggcatgtttgttgcacatcagagtatcagacactgaactctaccattttgataaattcatacggcaaaataattggattattataataggcttatgtaccatgccacacaggcattgtataaccattgaaattgttatcaacaatattcatgttttttaggtccttgagttgattccccttttacaatgtttaggatatttgtgttggtatattggttgaaatttcaaacgagattgtgactggaatagcatgactacaggatataatgacagctcatttcctctagtgcagtattctaataaacatctagtcttccaatacttctgttctgttgttagaacttatttgcatataaaacattaggaaggaggagtgttgctcatgcttgtgtactagctcttagagaagatttccctgagccatctatatatttcttaatgtacactaaggaggaatgacaatctggtggcctagaccagaagaaaggatttaaactgttgctttctcattttcttgtaactggttggttgagtggtctttagttttcaaatgaactgtatatttagaaaaggtgtaactcatrcttcagttacttttctatatctttgaagattcatattttataacataattatgtgatttatgctgcataccagttgctatgccatacttcagggtggtaatgagctctaaactttacactataaaatttaaggatcggatcagattacaatcacgctctatttctatttaattttgaactaaaattaattaagggttcagacaaattatgaagaaacatttggatcgcgatccattaccacccctagccacactattcttaaatcaattggtggcttagcttacaagagtatgagagtttccttcaaggctttgttcggcttgcttttttacatccagtttgtcaacgttggtttcaaaaggcttcatgtcttagctttcaagtatatagttaaggaaaccacttaaacaaaaggttggtggcaacagttctttgctcagtaaagataaggaaagagactggcttctcatgtttcatgactttgttacttattcttagacatgcagttgtttcttgaagactaaaaatacccatgttataacatggaggaatagttgttctatagatgtctttgaagaaagcttgcttggattgcgatatgtgcaaaaggacctagggttcaccagctgtctttcctattaaaacaaata

SEQ ID NO: 7723 - DNA, 241 bp, Zea mays
ttttttcctcctccgcgcttcagtcttcccagcgccacgattccggttcttgcagagtagcgcagagtgccggaggaatctgttggattctcctgctactggttcggttctttgggagttgttggcggtgtgccttgagcgatttggtgcgccgcggattgttgtggggtgagggtgatagcagagacaagggccgtgtggagagccgaggaggagggaagggaaagggggcgcaccgcgc

SEQ ID NO: 7724 - DNA, 294 bp, Zea mays
tgacgatctaatacctaattcattacctaattcatgggtggaagggctttccagtcattgtggttatcgggttgggtcgggccgtatcttcgtctgcatacacacacacacgcgctggtttagactcagcacacagcattcattcagctagcgagcgagagagaggggaacaaaaaggaggggcgaggaggacagggagccgagcgcaagagctgaggcttcgccgcgaaaccccagacctcgcgccgccccttcccctccgcggcgtcgtcctcgcacgctctccgatccaag

SEQ ID NO: 7725 - DNA, 1500 bp, Zea mays
agaatttacctgttaaagctaccattacgtttgtgcgctttacgggcgctttaagttgtctctagcggtttactcatcttatttacaatcttatctcgtattttaaattttacttgtgtaacctagtttttttcatggttatatacctgacccgctagagatagatcgactagtgtgagttgttgtaccgtacacttagtactcctaagcctagtagtatcacatgccaaatggcagggaaccaaagcagcagacactacctagatagtccatctctgatctatgcccgagtaattgaggccttgtgttgttttgcacaaattccgggttagcttccgcgttacactatccacgtcagattatgtaaaatatgagatctgcacacggtttgcataacgatgtttaaaataaaaaaaataagatagagaataaggcacaatagtttctagagaaaacactagttttatttttcaaggagcagagcaaccttatgtttggacccagagctaaaccaaacttttctcacctttgttttaacttcgggatcgaaacacacactaaatattttataaaaataactacttataataacttctacttctaccttcgttcttaatattttataataactacatccttattttttactcagctaatttatttttaactaaaacatgatgaataaaaaaagaatggagggaatattagaaaaaatcgagcccatacgaaaactataaaataatcaattgattataaattgtttcgatttttccatataaaataacggagaagttctgccgaataaatcctgatataacttccactagttaccttgcccaggaaagaaatcgaaccgtacgcttttgcacgtcgatagcgagcaccatttaagctgcaaaaaaaaggcaacactgcccgtgtggaaacgattaaaggcggcatatgtaaagtagcaaatatctaggagtgacaactgttaggcaaaatacagctggtgttctcaaaatatctaaacacacgtcgacgttattgagccgcagatccacaagctccctcgacgtacacaatgctttctatagtggtcatgtttgcaacatgcatacagatttctctggagttatatctgctttccgacagtgcttgagcccccattcgacgctgatccgttcagccaaacgccaccggtggcacctgaacggccgaacagctgatagagcctagcagaatgtgcagagagagcgcgtagtcgaaaatggttggatggagtggagacacctgggctcaacaaaagaaacctggactcgaaggttcaaactataaaacacactcccgagtccctctatagcccaaaccaattccaaaactgcaggcctctccaaaattcgaacaccctcgcctggaaccttctacgagccagctccgagcggttgccgtcccataatctgagagacggtgccgtgggtttgcggcgcctgggtcgccagtaaagtgcgggccgag

SEQ ID NO: 7726 - DNA, 592 bp, Zea mays
gtcatttaggacaacgacgtgggtcccaaaatataactctgaccaatgtctttttctttaaaatacaaataaatttttaatatatttatactttataaagtacttgttaatacaaatcggtgcatataaacattgtgttttaaaactacataataaaataattatttgtagccaaaattttataagtttgactaaaatattatctaaaaagacaactaataagacagagagagtagtagtagtttgaaagtgcacaatacacgccattattcggacgagtaaccactcaatcaaacaacactccaatcaacgcaaggacgcatcgtatcgggtagttttaccgaaccatctctctcttcgcctagcgtgtatgtagccaagctacgctagcgtctgaagcggtggaaggaaagacgaacgaagctacagctgccgaggtccccgttcccgcccaccgaggcgtcgcgcatgcggccacccgcacccaggcactggcccgggggagcgaggcgtggaggcggagcaatggcgggcggtctggaccgatccgtgcaactgtaggcgcggcgcggggggtgttggctggtgcgtg

SEQ ID NO: 7727 - DNA, 152 bp, Zea mays
cctgcctgtccctgtccccgactctctctctctccctctctccctgctagctacacccgctgctgtgctgacctcctccgatcctctgcccggcaacaggaatacagcaggggaggagagggggggcaaccggcggcggtcggtcgcggagg

SEQ ID NO: 7728 - DNA, 792 bp, Zea mays
  unsure (1)..(792): unsure at all n locations
cagtacgctttcacgttccatcaaaaggtgcacaaatcntatatagtgcgccgcgctgttttctagttttgaaccaatatttgggatcgaagtttttatatctgacgataaccccttgttccaaattttcctgcctgcaccccaaaaaagctgcacgggtatgtaactacgtgcaagtgctacaaaagagaggctccaaagccagagccctatatatgtcccctgtgaacagggtcctcgaatcaagggcagcggagatgcgtacaggaaaagcagcgcgaaagggaggaaataaatcaatgattgtttgactaacacggccataagccaaggttaaatttcgctactagctgctacggcgactataaagctaaacaagacaaaaaaaatgagggccactctccgactaaaaaacaacacatggcagaggcagaccacaatttgaacttccctccaaaagtccagactcccaagtctgaatgttccaaaaattagttatcttcaggaaaagagaatgttcagtagctccaaatactcttcttgttctttttaggccaatcacatcatcgggtagaccatttcacgcgcttgtggtaaatcccagcacttatctatcgagtcctaattaatcccactcctagttttatatccccaatgacagagtagtataaagatcctaaaccccagaaaccccgatccccagagatccgtctctgctcctggctgcttgatcacattggcaggcagtctgcagcccacttggcgctttggccgtgtgtgtacattggtgcc

SEQ ID NO: 7729 - DNA, 955 bp, Zea mays
ctccataagcccccctgctcaacccaacttagaagccttttatggtgctcgttcttgtaagtatgtccccactcatattttatcttgggtccgcctctatccattttctagccgagtgacctaataactatccctcgcccttcctctctctgttcgcttggttgtcgccatggcaacatctctttcatggcttgcctgctgccgccgtagatctggcctccaagctaccgtatgagcctgccagcaaccacgctgccaccttcgaacctcccacagctcttgtagctacccatccattgtcgttgccccctccacgctgacagagccctgctcacgcatacagtacatgttaattcgactgaccatgaccaaatccccatcgcaaacgattcgttttgttttttctcgcaaagcaccggcggggggacgtgagaggctccatgcgcctcgtggagactacagagggtgcattattccatgcgaggccggccgtgggggtcagaggtcaagctagctagctcgtcgcggacactgaacaccaatccgtccgaaatgccatgtcgaaggctccaagctgtagtgggaagcggtgaaacgatttgttctagtcacagtaattaatgctttacaataaataaataaataaataaagagtcagagcacgaacgatcatgcttgccaccgcaccacaccaccggaaatccacccactgttttgccgtccacgccttaaaaaagccgcggcgcatccgggtgcggtgcggctcacagtgcccccaccaaaccacccctgtgcgattcgccgccatcattgtgagcaagctcgagcgcgtctgccgccaccgcttccgttgcttagctctgttctcccgccaagaaggcgaaggggagacggttgcctgagttgagccagccagccagccagtggcggggcgtctgctctcggttgctttgct

SEQ ID NO: 7730 - DNA, 1500 bp, Zea mays
gacatacatataaactatattcatatgttaattaatgaatataagtttagtctaaaacgaattctattttgggatagaagaagtattaaagtaataagaacaaatattatattttatctaagttaaaagatcaaaaaagatataagttgaaaagagcatgagtcctttttcatagcttagttcgctcagtcactcgtcctctttcagctagcgaggtagtaatatgtgtgagcattgtgttgtgtgtggcttcctgtcgtattgggatcggtgatttcttatagcccatctatgggataacgacccactggtagcgcgagatgcgaaggagaggacacgctcgtgttgggtttggtggtttctcatagcccatgtgtgcagtaatgatccactcatagatgagaaacgcgggagaaaacagatctacacgctccatgagacacacgaaactcgtgctttaaatgagtagagattacgagtattaaatatagtataattataaaactaattacatagatgaaggctaaatagcgagaaaaattattaaacctaattaatctataattaacaaatatttatcttatcgtttagtccttagagaaaggcaacatgtaactcagctgcgttctccatgtttgacaagagctgtgtgaatcataatttgagaggtactgcatgttttcagtataaacttttaatttcttcgtgtcaatacttctgggcctatccttccatcatcaatctaacatgggtgtgtgcattctgatttttggcaatgtttgtgagcattcatttgggtaaattgggcgttacttttctacttatcattcagattccattcttaatatcttgatccagtgatcttctcatttgacttgatataactgcaggattgaattttctgacccagttgcagtcaggcatgcattgtcattattgtctgaaattgctacgaaagatccgtactctgttgcaatggcatattggcatttgcgccacagatggtcgatctagctccagtatatctggcaagacatagtatcttatgagcaaggagccctgctgctctcatgagcaaaatcaatccagatcacaccctctacatccaacggtgctgtgtcaggggggtttttataaaatgtacagagttgcaaataacattttataaaaaaaactgacacagcaccgttggatgtggagggtgtgatctggattgattttgctcatgagagcagcagggctccttgctcataagatacggtgtccccatatatacccccgcaacccccacgcccacccactgcaccccggcccacgcaacgccgccggccacacgcacactgccacacggagctagctagctgatcgatcctcctctcggccgcccgcccgttaattaggtagccgacagtatctatccagctaggtagccagccagcgaggagccgccgttgcttcctagctgcacctccgcccggccggccgaagaagacgccgacg

SEQ ID NO: 7731 - DNA, 1500 bp, Zea mays
ccaatgcaaacgcctttcatcacgtcataaagtttaaattattccgtgcggattagtgcagctgctgctaactacagcaacaaactgtgccgttatgaacgagaggagccggtaaaacacagccataaatacaaagagactcagaggagcgtcagttctgtagttgtaaacaatagaacgtacagccgtcaactcatgaagaagcgagatagctagaacccatgctaagcttaagcttttgcaccaccttaggattcatgcgtgcgtttctttggcaaaacgttgttgttgtagcccactcccatcctatgttcaaccaacgtcggccaagttttaaagctctaaataaaatcagtaccgtaccagacctcatctcttccgccgccattatattagacgtcctcccttaaaaattaattgggatggggcgctgcacacatggtcgtactcgtacattgtgcgctggctttaaacgtgctgtgccgttgtgctggacaagaccgtctcgcagccaactcaatatggaagaaaacaaaattagaataacaatgatgatcgatgatgcatctggtttatgtctaggttgacagttccgttttctatttgaaaatccattcgaaattaagtagacggtcgattgaaacatttgttgcgagtttctcaactctttcttcttcttcttcttatcctagcggtatactttaccaatttgaaacttgtggttattactcgcctcagcatgacattggataacctgcttgctgttactcaaataagcatgaaacgttcgtagtgtatgaatgttgccttttacttgattcgaagattttttttgtgatcagtattgtccagatccggctaaacttgtattcaatgcacatttatttgtgtttgtaaacgtatgtgtattagtttgacattattcatatctgattccgttttttgaaaaaaagaaaacccggtgtaaataacattcgtacatatattcgatcgattttaggggcggtagaacgaacagccgaacagggatgcaggatgagagcaaatactggtagaaagtgacccgttcgcagacaaatttcgctcacatctttcgttacgatttgcgagcgagggcggagagaatgaagctagagacgccaaggccgccaactcaagagcgagagcgacgatgactggacgccacacgccacacaccagcaccagcacaccaccctcgcgctgccgttgctccccactttccccagcggtacagcccagccctactagggtgacccagccagagatctctgccgcggggcccgccccatcccgaacgccgaccgacgggcaatggccgcctcactagtaccactataaaatcccgcctcccgtttcccaaccggcttctagctacagctccttccccctctcttccggccgttaccaaagcagacctctgctcagctcagcgcaccctcctccatccatccaaacgcaggaggcttgtcggcggctgca

SEQ ID NO: 7732 - DNA, 1500 bp, Zea mays
ttgataagaaaattagaaaagctcaatccaccatcctcttgggcattgtgatcctttcactcaccgagtgagcatgagatcgaaccactatcccttagaaagaaaacaaacaacttttaccactacaccgtttgactatgtgtgctataaataaagtgatattatatatgatatgtagaaaccataacaaggtatgagcacctaacaagttctactctcgtacaattttcaacacgtgaaaattatgcatccccattcacatccgtgttctattcgttttgatcctaatgtgataaagaaataaattagaatatgaaacaaacattatcgctccaatccgatctattctcatctatcctcgtaaactcctcccatagaatcgattggggaaaaaataaaaagcaataacaacaacgataataaacaaataacaacaaagccctcgttgagtcgttttcctatccttctcgttagagatgtaaacggtacaaatattatcatagcattcaaactttcgaataagctaattatcycgttgaatagtttttyagatatccggagcatatctggattttggattcagatctggatagtatatgggatgactgatatccggatagttcggatatcagatacgaatatggaatgactgatatccagatatcttcccggatatccggatattttttcggatatctttttcgataccgatgtgcattttgatgatttttaaagaaaaataataataatacacaaatagcctcaaattttaatgaggtaaaatatgtccatttatatttaaaaaatgtttagaccataaaattcataatatgacctcattttcctattttactcccacttgttgcatgaagttatacgtgaaataactttaagtgtccaagtttcaacataatcaatatttcactttatcatttttatacggagacttgaggctatcttattatagaatgtttataagtcttgataacttatttataattgtcgatcgaaattagaatattttatgaatttaattgtatttcatgattgtctacatgaagaaattaataatacactaatagccttagaaattaacgaaactttacgtagtcacaacatatgtccacatataatcctaaaaatgtttggactaaaaaagtggctaaataattacaacaaccataatatgttggaatggtgtcttacacgctattcgaaaaaaatatgttaccgacgttatatgtgtctgactattccgtattcgacacacgattatctatatttgtattcaaaagcatttgtatttatattcgtatccaagctaatcgtattcaaatttaaatccaaataaataaaaacaattatagttcgatcggattacactaacttatcgctccctatttccattgctatttgctacgaaccagagtaccagagagcggaagagatttccatcccttcacatttctcattccctccctcgttatcccgcattcgtct

SEQ ID NO: 7733 - DNA, 358 bp, Zea mays
tagactccttttataagctaaagagagaggtaggttagcgatagctttctaaaaagagtcatcgggctatgataaaaccgaatgttctataggttaaaataatgttttattggagtttggagatgctatcgtccttagtcgttgacatttctattgccgtttctatgaaagcagccgcggtatattgaattcggaattagcccaatccgtgctgctgccgtctgtctttccctatcctcttcccaagaaagcctcgccgcaatagtttggcatccatgggattcttccattgcatctccaccgtcaactccacgcatccctcaacgagcactgaagcccggcgagccccggatcgccg

SEQ ID NO: 7734 - DNA, 493 bp, Zea mays
ctgaaaatgttaggtgaaatatacatcttattgatatagacattttagagggagagcgtgcaaacaccaaacattttaagagttcagcatgacagtgagacggtgatttgggtagcctgttaataaccttgcacgacgatatggatgatgacacacacaccaacccgtcgatcagtctgcccctttccatttcaacggggacagacagactctagctagattaatgcttaagcacatacctacacacgtgtaaactactgacggccctttcataattaggcgcagagattctatacgtgtgtaaaagcagacatatcaaattgcctgcatcgccctttgtataattgtcttccaaaacacacggtttcgcgttgcagtataaagatcatccagcaaacaactcgagaagcataccagagcacacacagaaacagaacgaagtcctcgatcgctcatcgtctcctctgctccggtttcgttggagatccaggca

SEQ ID NO: 7735 - DNA, 1026 bp, Zea mays
ggtaacagactttctgggcgttcaccagttggagtacaccaactcactaggatatgtgaacatgaaaatcaagtacctaccactaccacaaggattgttacaatcaaaatcagaagactgttaatgaccaaacaaaaagattttaaaatggtcaatattacggagcatccaataagatttccattgaattctccagcagcaccatctccttctgatcccattccaccccctcccgcaccaccatctccttctgaacccattccacccccttctgcaccaccaagccaagagaacaagagcaaaagttctgcaacactatatgcatcgattggagcagttattgttttttttatggtggcctcatcagcactatgtttcttttactactgccgcaagaagactagcactgttgtacctttgtctgcaaacagttcaagcaggcaattgcagaccactaccatggaaggttgcttgatgtgctaatattttgctatgcatatttgttcaatggttttttttcccaaaaacctagcacgagctctgcctctcaattaaggaaggaaagaggtttatgtacaggttcgcctgaaggcctgaaatgccccaaagtgctcacacagaaaacaggaaacacacaatcccctccctttggggattagactaaatagccaaattgggttactaaagaccctagttcgcacaatcacacatttgttcaatgctcacattgctgtagtgctttgcattcctgtagtttgcatatgctttaggtgtacgctgcaatactgattgcttcaatgcacaaatagaacctgtgttcctcttctaacccctgtttatgcagggataactttattcagacgatctgagctcgaaacagcctgtgaaggtttcagcaacataattggcacactacctggatttacactgtttaaaggaactctcccatgtggagcggaaatagctgtggcgtctacatcggtggcttatgcaggaggttggtccgctatagatgaagcacattac

SEQ ID NO: 7736 - DNA, 111 bp, Zea mays
tgtaggtgaaatgacttcctctttgcattaaaacattatgaagcattttcccctttttgtatataggttactggtttcccaacactgtttttttgctatttttgcatgcag

SEQ ID NO: 7737 - DNA, 573 bp, Zea mays
caacttttaaaatcgaattgctgttatccgcagacatcaggaaaagcttccaaatttccttcttttttttggcacccccctacgctcggaactcatatatcaaatcaaccacttctcgcgataaagctgcaccgccgaattcaacattttcccacgccaaccgctccacgcccccgagtccacatgtaactgacaggtgggcctctctaataggcaggtcccggatgtcagaagcaggagctggacgctttccctgtacgcgctggtcccccttttgtcgcacctaccgcgtcgaggaaataagccgaatatattatgcgcggaactcggaaggtgtaaccgtgtaacccggttgccgtggttgtaatcgtacgtgtaaagcgtacgcctacgtatttttactgcgatcaagggcgagccggctggacgccaacttgtttcgtatccctcggtcgtcgccaatatatatagccgccctcctcccggccgatcccttcgtcctcaatctcaatcccacaccaccaccaccacctcctccggtccccaacccctgtcgcaccgcagccgccggcc

SEQ ID NO: 7738 - DNA, 1500 bp, Zea mays
ccgattgctaaccctcgctgcttggtgtccaccgcgtggggcggggggtttggccatttgcgtgcaccggtttactgcccgcgaccggctccctcgccgccctgtctaggtgcgatgaacagacgagcgaacttctgctctacaactggtgctgggttgggtggggcgaacgattccgtgatcgggggcgtgccacggcgccgcctgctgcgtgttcttgtccgatgcccggagtgggttgcggagaggtagattgctgatggggatctgccattgccgtgaatgactctgtgttgatccatttgcaagttgtgcttcggttgggaagggatgcgtgccccctgtgcgtggaatctttggtgtgcaaggaagctagggagttgatttttgcgtgccttatcctgtactgacatggtcaaagataggattcagtgggttgttggagactttggcttacccaagcatgcacactttttgtttgtactaaatttacaaccaaactgcaacttatgcatccctatgtcgaatgtgcttgcagtgataaatttaccacctgtaggtattgcgactagaatagctgctgaacttttttggctgcttcgtaggctggctgatattgattggcatatcaataagtttgctctgcgcactccttttagtattttctattactaggtgaaatcggatcatcttgccactttttggttcaggtagtagaggtaatcacagctaacccattggttgtttctccaactacaacggttggctacattgtagcaaggttcttttaattcagagatgcctggcacaagatagtgttgccatggcttcgctttgatgtgcgcaagctaatttttgtcctgcctttgattacactgtgggatacgctgccaagcaatcagataattctagttggatacgaaggttaacgaccagaaatctatgactccctttgctgagtatcaaatgggtgttttatcctctgtcaagtgagtgcagtccgaggccagggtgagatctgtagcggggctggggctggggctggggccaattatttatttctgtatataattttcaacatggtacccttatctctgagattatactaatagctatagctattttttctctcaacttccttggtactagtggtttcattttttttgttggttggcaggtggcccttgtcatttgtggtacatattatatccagtaggattgattgtcactttgtagtttgttctcaacgcagtgtgttccttgcattagttgtgattaacttttatattatgaaaactctcttgggtttgcaccacatactgtaccaggttgagacgaatagaattgcgaccttgcttgatagttcatgactcatttttttaattcattctctgcagaatcctctatctgtttcggtaactgtttgcaacagtttgtgtggagattgcataccatcaccttccctgaagtgaaaaatatatgggctgatcttggcatttc

SEQ ID NO: 7739 - DNA, 159 bp, Zea mays
cgaatatctgtttgataaaagttggatgtgtcccataaaattttaggatatttgatttgatatcggatatttgttatattatatttgtatccggatatttttccttgcaccacacccgcaaaacccttggtccaccccatttcctctcattcggcggct

SEQ ID NO: 7740 - DNA, 1227 bp, Zea mays
gtacccctgaaggtgagtagccctgatgaagaagctagttgaaaggcgcgccaagctaactaaggtagggtaggctaggctaggcggaactgaaaccgcaattcggtcgaattccaaaccgaggtgtaaagctaggcattccaataagctgaggcagcgaggagcacacctcgatcgacaagtcagaaccgaatccgcccgcccgcccgctcgcacgcagtccattggataaagctgcaggttttgtgttcctcaggaaacgaaaagaagcccggtcgacggagcaagcgggactattattggcttcaggggccggggatgcatgggaggtctcggggaagaagaagaagagaagagagagagagacaaggcaacgactgatgactgagctcgcgggggcagggagaattcggccatatccgaaaggcatccatccgtcccacgcacacgcacacgcatcgcccatccatccactcagcatcatcttctcccgccgccggccgggcgccgacgtcggtttctttccgggattcctccatggccaggccaggccagcgaataataataataatcccattctcctcccccggcccagccagctgagatgagatgagaatccactcctcgtcccgcccgcccgcccttaaatccccgccccgcccgcgtccatctcctgccaccgtggagctccagaaaccaaaccccttycctctccctcgctctcgctctccatccamcttctctcttgttcgctagctagctcatctcgccctgccggacgtggttcctgccttggtaaatctctcattcttggcctgggggcttgctatgcatgcatgcttcatgcttgggtttaggttttagcagcagcatcgactcgagatcagccaacatgcacaaaacagggcctccccgttcctttctcctcctcctccgaccctcgcgcattgcgtagtacgtgctgcatgcatgcgcgtcatgtctcagtctcaggggccaggtgcatggtcacgcactgacctgacatgcctcgcagatgcagtagaaagaaagaaagaaagaaagaaagaaagaaagaaagaaagaaagaaagaatatagagcggccgccccgacaacgaacagctgcttcatcttgcatgcatgcatctgagctgtgtctcttagagtgaaagggatgatgatctgagtctgagctgctggttctacccgatttgcatgcaggcat

SEQ ID NO: 7741 - DNA, 1500 bp, Zea mays
agatgagcacccgatctgatcctagggcacgtgctgtgtgtggatgatagaatcattaggcatgcgaacagtcctagatagaattgagggctgcgattgggcgtcatccaagtgaaaggatcccagccgtccaatctcctactcccggagcgtgcagcagccagtgaaaaaaaaaatcatacgtgagaaaatggtgagaaaagaggtggagagaggaataagcgagaggaaacaaacaaacaaacaaaaacggtggtggggtttctgtttctttaagatttataggaagatagtgttaggcagcccttattggtgggcaggagtatattattgctcgaggtaggaggagagccaggggttgttagaacaagtccagtctagagagggagcgaaccaaaagggagaaataacaaaaaaagaatagagacacacacacacagctctgttcttcttattccaatcctctctcatcttgctggttcatccttgggatcggctctgtcgtcccctagctagttcgttcggtgctgtggtttctgccgctgtatccaagaactcttgctcttgctgagtctgggacttcagttcctcgcagaggtatagtataagccttgttgtctttgtcaagcaatagcttaaactatcctttgcgtcttaatctgaacaacatatgccggagatgggatggattcttggtttctacgtactccctccctgcttgttgagctttcggtttctagttagctccgtrtgtttggtggtgggtgcaccagcagctgaaataggttgcttctcgttttgccttagtcaaggctctttgaaatccgaccgaattttctcgggagctagttcttcctggctgggatttctggccgggtgccgaattttaggattcgtttcctttcacagcccaccaatttggacttctggttttgctccagttaggtgatgccttcacccaaaacaacttgaaggcttgctatgtcccaggtagctatatatctcaaaagttttggtggcagtcttcgaggaagtggagtcatctcaagtttttatcgatcgtcccargtagagataccttaaatttttattggatccactctttggggggttctttttttgtgctgattttcttcaggtttcgctcgcccagtatcagacatattcttcacctcttttgcagtctcttgtctgaatttgctgttattatttgcatgggaggttttgcttctgattcaattgccaatgtttcaagcaactattcttttgtttttcttctctctccaattacacgcagcacagccgaattcctaatactttggaatctctgcaattttttcatcttcttttgcagccaggctttacatatcttgggtgccgcacacagtatctatgcacctttgacaacaccaatctgattctgatgacaacaacagccactatctcccgtcatccttgcatcgatctgtcagctggcgtcgcctcgtgcttctgaagacg

SEQ ID NO: 7742 - DNA, 1032 bp, Zea mays
tggctaattttgggcggctagggtagaaagtaagagtgtgcggcgagtgggcggtcgacactcttacattaagagtgtgaattttcgtggaaccccgacactcttaaattaagagtgtcggtaatgttaaaacccacacttttagagtgtgtttggttgcgggacaaccaggacagggacgttccctgacgtcctctcttgaccctccaattctgagggagaattagggacaacactaggatagtcttgtcctaacccttgaccataaaccaaacaaacttatttaaagtatcgtctcatactgttccatcctgtcattgcaaccaaacgcattagagagccgatatagggtctctgtgttgtacttgtacacgggacggagggagtagcggtttttgggtattcgtgatatgagtattaagtactaagggctaatttggaaacttaaatttctcaagggaaaataaaaatcctttaggaaattggggttctcaaactagccctaaaagaataacggatttttgttgtcaggcgatgagaagacttttccttctgagtggccggctaaacccacaccagctgcagcaccattttggtcctccccttcgtcaagacgatgacaatttgacatccgctgctagcgcaagcaatgacgacgtacggcacagatgatacctgcaccagggtgtgccggccgccacacgaagggaacgcgcgcctagctagctctgcgaaatactgttccgcccgcctagcaataccaagctctgcgagaaaaagcggggcaagttcgctagctctgtctgtcgatcctctcctagctaataaacaaactcacggggacgcggaagccgcctccgtctcctagtcctaacccaccaccaacgcaataatctacagcagcggaggaaagcactacagctcttggtcgagcagtgtataaatattagcaatcactcatgctcaccgtgtgcacgccacaaatcatccaaattaagctaacaacgaacgacaactccacgcagagcaaca

SEQ ID NO: 7743 - DNA, 375 bp, Zea mays
tagctagccaggtctttgtcccttcgccaggccttcatcggggactagcacactgcacacgcacccactaggtatgcggatccttactcttccattcctgtttgtgcgaaaccgagaacccaaacactaacttgaggtcttgagctgctaattgtattcggatctgatcaaattacaaatctatgcatgtacattagcttcgttttttttttgcaaaagttattggtttgtacacccacgtcccttggccgcccctgatccaggccactagcatcttttgttcctttttttttagaatttttcgctaatatgtgctgcctcctgatgaatcctgatggtgatgataagctgttgttgctggtgataataatccag

SEQ ID NO: 7744 - DNA, 177 bp, Zea mays
ctgcaggggttccggttccttctctatcagccgttggaccgttccgctaacgtatcgtaattgagagggctccttcgtaaaatccctcacccgaacaatggatcgtaaattccccggcaggggaatcgcctgcatccgcccttcccaaaccctagcatctcgaatccgccggtcgcc

SEQ ID NO: 7745 - DNA, 699 bp, Zea mays
ccaatcaaacagactttatacttcataaggtgatacatcatgagcttatgccataaattttggtggaatcaactcattcttcatgtatatactaattattacattacgagaaatgaggtggtaacgaatcaacttattctatttcacaaacaaaataaaaaataaaagatgagaaaaaaaagataatcttgttactcaaaccaaacacccgttatattcactttactcatgattatcttttatttcaaactttataaacgctgtaaaatagtgttttgctgtgctgttgggtagcttaccaaaccagctacatctacgcgcgccggacacggctacgctcgaatctccaagcacatcatgcgcccccccgaaaaaaaattccccacgtactagaccaccacccgttggctttctcccctcgcaccggggaacgcggctgccgatccgctcccgatcccctgccctcctccttccagccgactgagattccaccaaatcggcgcccgtgcagtccccgattcgattggcaagcacgattggccgctcctgatcagctacgggacagggctggatttgatttgatcggatccccaattgggtgtccgggtccgcgcgttcgggcgggcgggcgtgcgggcggggggattgctttagggtttcagcgggtgcggtcgctgtgtaggcgggtagggttttgcc

SEQ ID NO: 7746 - DNA, 400 bp, Zea mays
gatgatatgacaatagtgctaagaaaatcacttcgtgatagccttagctgtctttggaaaatcgttccaagagattagagcccttatccgctagcacctctcttcctgtcttttcgtacatgagaagttttcgcaaaaaattcccaattttcctgtaccgaatgcatgcaggtcgacagttttagaggatgcatgcatgcatttccaggtggggtccatcgacaccggggtggcgcgctgggagagacgcagagagctgtatcaagatatctttagatgcttaggccgtttgttgcctataaataccaacgccatatggagcggccggcacacagcaactcgcagaaacgagtagccatctatcgctcacacagttacacaaaacccgtcggccgtcgcc

SEQ ID NO: 7747 - DNA, 132 bp, Zea mays
ggtgttccagttccacttccaccaccgcggccgccgcgccctataaatggccgccatcggcagctgcactccggtaccaatccccgattccttacacgctaagccacgccacgcaacgcaacgcaactagcc

SEQ ID NO: 7748 - DNA, 1185 bp, Zea mays
agattgcaaaataaatactggagctgatttaagtaacttgtagatgctcttgtacattaaaaatccatacagaaaactgtacatgcccggataactggaaatagttttataatttggactgtttttactgttgaaactagaaagagtttcaggattaaacagatgttaaaaattttttttcgagagtacagaattaaaataggacgtttcaaattgcattaaagtgagctgtgactccttgtatatcccgaaaacctcgggaacaggcgatcatctttttactgctctacgatcccctacgggctatggccctatttctaccgccacgcccgttcttctccccgcgtgttcgagtccatcttcttgtgccatccaacccctcgtccgtagatcgatcgctgctacgcgcctgcatgctgacggttcggcgccgctgatgcgatgaagctctcgtagcccgacgttagcgagaagacgggatcgcacaagtactggtacgcacgcttaaccctcggccggatcgttccggcccaagtttatctatgaagccgcgatttggagggtaattcgtggttcaagcgagtttgtttcagggagttactgtggcaagcactggtggttgctttgcgtagggtgtgtgctggtcacgagttggtgcgcgctcgttaagcgttcgattatatgcccggaaggagcatgcccgctctcttttccgttgtgtctacctccctctagcggctgaagccatgattttgatggaaatctgtgtgtaacaaaatagttgtggtgggtcagtgcgctgggcttcggatgcgtgcagaatgtatgaggcattcttcgtcttagtcaatgcctgcatgcagcttgcggagagcacgagtttgatgatgttcgtgcgaggacttcgtcccatctgcattctgctctttggccgttctgttcactagttgtgccgatagaagggcgtcatattagagttgcttcttactgaatctttactttcgtctttcatgctggtggccatcctttcttttttgttcagtgttagtcggctctggtattttctcactcatttgattttatgaatataaccttccttactcttgcatttccttggaatagaggtctcggccaggtgtcgatttggttcaaccgagggagcacctgtgcattgctataacaaca

SEQ ID NO: 7749 - DNA, 1356 bp, Zea mays
aaaatgatattttatgtttagagtgcgatatagaggattgatatagattgaaccacagtagaggatagagatatagaggaagagagattgctgacgtagtatgtgactggaatatagaggaagaaatatagaatgaaccgttgtccacagttttagctttgtgcctttgtcgcgtcttaggagcagaagaaatcgaacatgccaaattgcaattactagatatttccacggggccgtgcggctagcgcttgaccgtaagctggccacataattttggtttttggaggtccaaggctcaaaaaaaagagggcaggactatgcgacggagaggaagcgatagagatatacgctcggggccgtcgtcccccgttttcacttgcacagttgcactgtttcaccctcacgcagttcagttggagcgttcgttgtcaagtagtatcaccaacccggccggcgtcgcctgctcgcattgatgatcgcgatcgacaaatagtaacccacagcccggcacggccggcccaccaccaccgtccaggtccacccagcaaactcgtcggcggccttcgattgggtcaatgcagtgcccgccccgtcgcggcgcgcccgccttggattggatccagtcgtccagttcagcaaccagcgcacccatgaagcttggcgagccgagccacgtacgcgcacacgcggtccggtccggcaccagaccagggcgcgtacggtacggccctactgccctacactacacgtcgccaagcggtggtgccgaaagcgaactccccgcggacatccatatcctcccccaatccctatccatctccccgctgcgctcctcgattcgacccccgcttccctccaactcgcctccgcgctcggcagtcggcacccacccctcttcctcctctctgccggcaacaggacgcaggcgcataaaaaatagcaccgccaccaccacgctccacacgctgcagtttctggaaggccaccccctctgtccgctttaaggcgccgtccgcaccggtcgcctccctcccccactagcgctgccgcggccctcgcccatatacagcgcggccgcgcccaatcgttcgttccgttccgctccgccacagcggctccgcaccaaatacaggcgtgtccaccgcgctcgccccctgctggtctgcgctgctctcgtcttgctcgccctcttattccctctcctccccgctccgaactcccaaagcctccacccgaggaggaggcctgccaggttcgttgccggccgtgtttgttcgcccggccggccggcccgaccgaggggaagctgcagcctgctcgctcgctcgagctattgcgtaggccgttgacgatgtc

SEQ ID NO: 7750 - DNA, 1500 bp, Zea mays
gtctgcttcttccgctgttgcaccactaccagcgaggaggattagggtgctcgcctccgaataagatgctcacaaggtgataaaagttgcatcgagtccagccaactctgaacctcctcatcgccaaaagggactgggagcccgtctcctagctcactcgtcttcagctccgacgtgacctccgctccgctcctcccattccatgggtgatgtggcatcaatggtagatctacctagcgcgcgcttcgtctgggcacagttgttctcgtcagatctattattggtagagaccgctctaattgccgttttttcgcagggggcgtccactgaccaggccacaagcttctcaaataagcaagccaagctgctcaagacgcagaagttcgcgtccgagcttgaccatctcgccagttcgttctttcactcataccctttgtttctcaattcgactgtaatgagtgcacaatacttttagggatatatagatgttttccgcaagggctttctctgatccaacgagtttgttcttggtaggtggatacgtcaaggtcaaaggtcaagttggacgtgatgaagccctgaattgccaagtgggccactgagctacttgggtttgacgtatgtttctgatccatgcagaggtagttatatttttattgtttgatgtgatactctaaaggcaagagcaagtatgtgtatttcagtaagcatgttaagcattagaggataaacttgttgtatttggtatttcaggaatgatcttattggcgtacttgctaaacttggagaaaattgttaagccatttaccataaatgaatttgcatgtgttacctatgaaatctcaataatgattttggttagggcatcagatctacaccatcttcttgctcccaagtcctaagccaaaacattgactataatttaattcgagcatggggctccttttcaactaatttttttagtcttttggctaagatcaagtgtaatatttcttttatcatttcaatatcgggtatatgaacaatatgttcatattaaattcatttattatgagtatttttatgtgaatggtctattaagactctatgtcgcttagccacccaatcaatatcttaaaatatagttaggtaccggatattaaactagtttagtttatattccacttttatcaattcaaaagcgaatataaatccagctacgttttttttaaagaggactcaagtgaacacgtgtaccctcttgcgcccagacacctaacgaggcagtctgggcgcttctgtgctccggcgccatccccgacaggaggaacgcgacacacccgtccgcatctgcgctggaaaaaaagtgcgcaccggcaacaaagtccagccagcgagcacagtcatccgtcgggaggctatatataaagcgttgatccgatccacgaaggcaagagagagacaaagtagaagctaaggcgcgagtgataggagggttttggttcagagaggagcggggca

SEQ ID NO: 7751 - DNA, 1500 bp, Zea mays
gcatcggacagttcggtgccacccactagacagtccggtgtgcaccggatagtccgatgactgtacgaccaaagtggtcgctctcgggcttggccaagcgccgttggctgaattcatcggccgtcgctcacagagcaccagattgtccggtgtgatgggcagccaacgactattaccgcatcaacagagtggtcaatcaattatcttctaatcgttgtattgtgcactgttcgatgcgccactggacagtctggtgcacccgcagacagggaagactgggagcttccaaataaagcttcaacagctcttatactacttggggctataaaagggaccctaggcacattgagaagtacaccaagcatactttgagcacactacaactctgagactccatgaccatgccttcaaaatgttatggagagatttgagctctttcttgagtcgttactctgtcgttttgttgttgcgctctcttctttgcatttatgcgtgttgttgctgcgttgtgctcttgtgtgtgtattctattccatcacttactctcgttttgattgtaataacttgtgtaaggcatgagagactccaaattttgatattgctcacttgtgatattgctctaagtctaaataaaatcttgatggaggcataaagtgaaatgaacctctctcttctctctactttcaaacttggagttagttctctctaactcacattttagaccaagtttgtgtggtttgagttaagttttataggatcacctattcacgctctctgggtgctatcaattttgcaaagtttaaactagtgaattatatagtggtatagattcatttttgtttagtgttgtgattgatacgatatctaagcttatgtgtgcatgtaatggtttcatagatgtcgtccgtgctagatgcttactatgtttgatgtcgacgttggccttacgaagacttttaaaaagcgttggcgtaacacagacaatatcgagacaccgatcctaactataactttagcggcgatgactacctcagagaagacaaacgaatggtgatataaactagtcaatagaaaccatacgtgcgaggagagagaaatgataggaacgcgggtgatttataacaagattaattttgtcccaggggatataaattttattcaggactagtttgggaaccccatctttccaagggttttccatttttccaaggaaaattagttcatttycccttggtaaaatagaaatcccttgggaaaatgaagtttccaaactagccctcagaggaaaagcaataactatatgtatttcgcgcgtgacgtaggacgacacgtaacaagtcgaaacttaggtttgaaaggagagcccatacaaagacgacttgttgttcggcccgacttaattagttaggcccataagcgtgcccgttctttttcgcgtttcacggcggcgcggacagagagccatcggcggcgcaccgaccgccggcgaagggtacagag

SEQ ID NO: 7752 - DNA, 888 bp, Zea mays
ggctaggcagcacgggagagaccgagagggagaggaacagggacggctcgtagctgatctcgatgagaagttctcgcgaccggagtcggacatgcgccgccacgcccgtgtcctgccatacccggccgggaagtatggagggcgcttggaagcctagctctccggttttaatagaagagataactttggtctaattttttttagcgaccaatagtgagatgacaacctgtcttcataacgattcactataagctattaaatttatagtatttttagcgaccaaggaactgtgtctagacaaacatatttaatcatcaactaatagtctccaactttgagcacccaacaattagtgcttaataaagattgctaaaactaaaccgtggatcaacaagcttcgatatatgttttgctttgcctttacctacaagcaagggacgacaaggggtagtgacgtgtagcttcgtctccaaacaccgtgatttgctgaattccttttccattggtgcacgtaatagtcatagtcctcgtcaaatatcatcagcagattctcatacgctgctaagtcaaaaggacgattcagtaaaaaaaaaaggcaaataattaatcagtgttttccttgtacgaaccaactcttgtgcacccctcactacctgctgacccctgctgttaacttctctaccccttttttgtctttttctcagaaagtcttgggcacattcactgattcacattagtacattacacactccaaaacatctttatatacacttgcgataactcgccaggcaccacttcgtcctctgttggaacacatttgattcctgtccaagatttttcttgagcaagcaaaggaattgaagctacaaatacttattttggatccta

SEQ ID NO: 7753 - DNA, 1500 bp, Zea mays
gagtctaaaattgctattggtttctctagatgtcgaacgtaaaacttttttttgtcttacaaaaatgaaccaaaatagacacaaattcgggatgaggatcgcaaatgcaagcgatatttacggtcacggctaatcgtgactgtaactgcgagctacttttgtttttattattggcaccacctgagttgctgcggacagctcatttaaagttggagtccatggaaaaggccaagaaaaaaaaacacccatctatatggtttttatttggaacagctccaggagctaaaaaaaaacaacaacgcatggatgcgacgcgcacgtcggaacggctggttgtgctgtgctgtgctgtgcgcggtgacgcacacgagtgccgtttcgcgtgagctcagcgccctgtcactgtgctgtgcttcatcgtctacgtgctgcgtgcgtatggccgactggccgtgagcgagagaccccgaccgagggcgtggccggacaaggcggcttcgtcgccttgccggccggggctggaagcaagcagcagcaccagcctgtgacggccgctacgtgccagcatagtttcctcgctgtcgctgctggcatggatggctgccaagccaaatcactcactcaaccaacaccatagtttcagtttcagtttcagtgctcgacgrggcgtactaagcggagcagtgacttgactgacagtcgcaaacaggggtggaggcgtggagccataattacgacgtaaaagggtccaaacaattcaaaaagacacaaaacaatccatcaatactataagataaaaaataccataggatatatacatgcgtatactgatttatatatatcatatatatattaattagtaaaccgagtaaactcgttaacgaatcaatctaggatgtcagttcagccagtgaaaaaacatcaaacaagtcgatccgatttgaaccaagttggtcacgaatcgagcgagcctcgagttgtatctttgaattgtagttgcacgagttagaacaactgattttaagctgaaaaatctaaaactccaataggaacaaaatccacagcagtgataagcacaagcgagcggcgtgttactcaacaaacctctctgtcgtcgtcagaatagtagcagtaggcagtagcatcacttgttggggtgcatttgagtatttgactcttgccagcgaggaaagccaaaacaaccgctgaattcaaaatccaccacccaccgaaaatttcccaaaaaacattgatgtagggaacggaagggcccggtttttggtgtccaacaccctatttaattcaccacactgtgctttttactccaaccgcgcccccacaccccgctcctctcgctcctcgctcccttttcaccttccccttcgcaggctccccctcccgtgccgtgctctctcaacaagggagaaggggaaaccaccaccaccaccacacttgataagaagggggccgcacgcgcctgcccgctcccgccgctacgcc

SEQ ID NO: 7754 - DNA, 436 bp, Zea mays
aaagagagatagcttcctattattagctcctaaattagtgggctgattcgttcctattattagctcctagattggggggctgttccttcctttttattagttaccaaagtagtgggtctttcctattatcagctcctaaattagtgggctgagggctatatatatatcattgtaaaccacagggaggaggcaagcaataaactatctcgtacactactcctattccctcaagcctgcggttgaggtgttgatcctcaccggagaagacggacggcggctacgagctacgtagccgtggtccggccagttaggggtttgacgcccttgacatgcagggtgtttgattcatatgtttttgtcgtgttgattattccagacttatgcagcagagcgtggtgagcaactgaaatggtgggagaaaaatgctggaccaaat

SEQ ID NO: 7755 - DNA, 1231 bp, Zea mays
ggtttagtttaacatgagactttgggcagggtccttgagagggaaccgttggacgcctggggcgtcggacttcaccggcgagcagagggggagcgggtcagggacccgagtctcttgcaacctgtagccgagacgccagttttgcttccaactcgggtcacgactcacgaattccgtcccattcccatccgcgcggacgtctcctcacgcaacctgtagccgagaccctctcacacgcttgcgatctccacctccgcggttgccggccgacctcttccccgccgcctccgccgcgcctcggggcaccggacccgtctccaacccctagatctcgcgccccctccgccccgccggccggtggtcacgccccgcctctcccgccgccggacgagctcgccgtggggcggagaggtcgccgccggcgacaggagccacgcgatgtccagggaatcctgccctttctcctcgcctcagtccttggggatccatccgtgctaatttccaccgttggtgagcaattccctagactaatttacagggggccgttcatttcgctttggtactgtactatggtttgttccgtactcgagtatgaatcattctgcaataacccacacacagcacattctcaattgatcgtgcttgccactccagttactttaatggcccagttcagcgcgacacgagttctcaaatgggtcctgtgatccatgggattctgtgtgacctgctcagagtactgctagcttgcacaagttcatttatgagcttctctgcatgctaatatccattagtaaattcagtgtgggaaaaaatgatcctctttgtggctatcttttttctttccattagaagtgaaattataatatcaggaatggaaatccgtaacagctaaaatgattgaattcttttttttattttgctctgtatttgcaggcttgcagccttttgtatcgagcatgtgctaaattgggcacgcagaaatatcatcaagtatgctgatattaccgttccgaaacatcccaacttgccagcattggtcggggtaaatttgtcaagttatcaattgaagtgtgcttggttattgatttccattaaattgcagcatagcttgctcttcatctgaaagttttcgagggtagatgtttatcgtgcaccatggtcgttggtaatgacatagttgacatggttgggtgctaaaaggacgagaagggtttgaataaacggtccg

SEQ ID NO: 7756 - DNA, 498 bp, Zea mays
cagctcgccagcagctctctgccctcctccctcaagccctagccgagtttttccatggtgccctggatgccagcccctttactcgctgcccctgcattcctgctcgccctgcccccagccatggacgccgtcgggccacccgttcctatctcccctcaccctcatcctctggctgctgccccttcctattcctggtggttgagtcttcttccatggacgccaatagcagcagcccactccttcttttgttctccatggatgaaagcccaagcatctgcccctcccctaggttttttacaatcgcagcagcacgtcgaacctttgcaaccccggtgagaccagctgcttgcgctatgtttattccccaccaattcctatatttgattatttactgtatatgtttgtgtgtttgtggtggaggtaaatcctaggaaatttagatgagaagaaagctatagcgaggcgcttgccaagtgcttggtgaatcgcctcaaccgg

SEQ ID NO: 7757 - DNA, 374 bp, Zea mays
ttagtcatatgatctagcgttgtcattaatcatataaactcacctagagacctaaatacaggagcccgcaagcgttgtccttggcaccttgcatggactagagggttactacctcgcaacaagctgtagtccagacaaaaggatttaaaaattgcccaatcgacgctgcagccactgtcaatctcttcaaatgtgttgttccctccaccacttcacgtcccaggtcatcaccctctcggctttactgttcgcccatttgcttccttctcacaacgtttcagattcccaagaaggcaagaactccctctcttctcaacaccagcggcagctttggagctaaaggggcaggcagcctttgaccctcctcctctgcc

SEQ ID NO: 7758 - DNA, 1363 bp, Zea mays
tcccctattccgcgttcgcctcgattagttacaggttgttaatgaatggtgggcatggctccgcgctttattaaaaaaaaattattatggtgacaagcacctatgtatgtatgtatatatacgagggggcgactgcaaactttgcgtcgtatgcctaagccgtcactgtcaactaaaattcatatatatatatccaggtgatagaaaacgacgtcacgaaaattaggcgacaagagtagctgttgccggttgcatgcatgcattcacgtactaggtacgtacacatcccaagccacggtagagatgttttttcccggacgtacgatccgctgtataatttctcaacacctctctgtagcagctgacccaaataagaatgtgtcaatgagtgcagtgcagaccgcgggcgcgaggccggagagcagcggtccggttgcacgggcaagtgcgcaacgcggcacgcgggggtgccagcgcaggcgggcgcgtggccgtggcgcccgccacgtcgcgccgtgggggccacgtgttgcggcgcgggcccgggccccggacgatgtggcgccttggcggggacacgggcgacgggcgcgtgcgaggtgtccccccgcgccgtgcgtggcgcgtgcatgcattcctgcatggccgcggctcccacgtacgcacgcaggcgcaagcccagcagcgctagcagactcgtttcccgcccttccttggcctcgttgggtgcgttgcattgcatgccaattgccaaggcagaagagctctctctctctctctagacgagagcgcgcgcgtcacctgtagctgtgggtcagtcttatttaagagtgggcagggccgttgcctcagctcagcctcgtactcaccatcaccaagtacactacaaccccagcgatccctgtattcctgatctctctctctctctctctatccctctgtttctttgggctttgcagcaatatctgaggcctttgctttcttctacatcgcgttaagttctcattcaggatctaacgtacgtgcttcgtgcgttgcctccaaggaaaaaaccctctccatcgtcgtgggtaagcaccaagtagaactgtgcaagggttcaggcatatcatatgcaaaacatctgaaaactcgctcggttttgccagctatatatatatagtcgaattctcgtagcagaatgcacacgtcgtcgtgcgtgcatatatatgtaatatgttttcttgtccatgcatatgcatgcatcccagcgcatccatcgcttgctcgtcgtcgcgcgctaaacaacggcaacgtgtgcgcgcggtgtgtacgtacgttctaacagcatgttggttctaccgacagcattggcaaccggccg

SEQ ID NO: 7759 - DNA, 608 bp, Zea mays
ggtactggctcgatctatctttaaaacatctaacatgtcttagatggtttcagcttcttaactggtagtagcagaggatagctaaggctgatttgtggcattgtgtgaataagctggaattgtagctggagcttgggcgtggaattattattaaggggttttctgtttgtatttggactatttagatgaattttatgcctcctgttatcctgtacaggggggaaaatctaacttgcttcttagcttatcacggattcaaagcagtctctctgcatttgcagaggggaagtttgcctcggtttatcccagaccccacttgtgtaggagcctcgggcaatagatctgcccttcttagcatgataaattgagaaccaatccttaagttaactatttttttttgttaaaggtggcactgaatttcatgggctattcgtcttcttgttttttgtttgtgatttttttgggtccaatctatctgtagcagtactrcctacctttttttttttttttgcaaattatcatttggtcgtgtaacttgccaggtcatacataattcagagaagggagaaccagctgctttattactttctcccaggacatcatcagcc

SEQ ID NO: 7760 - DNA, 825 bp, Zea mays
cgttcgtcgggtgagcacgagatacgtaatagttagtagagatgtgtacgatctgctctagaggtaaccagcaggattccacgacctctgttcgtacaggagtccggaagagcccagaacgttctatcgtgcgcctgcgaacgtgggcccaacacgtcagacggaagaatgaacaacatctctggcaactcctagaacgttcacggcacacagcgggggaccaagtgtggaccggggagacacccccggccctcgtgcccggtgagatatataagccgccttccctggcgaaaccactcgtggagacaacgacgacaagtgaccactacgacgcgagaagtcgaggggcagcttcgtgctaggaccgagcttcagagaggtctccaacggcaacggccccgccccgcgcctccgcccgccgcaggtacgatccgatccctcctccgccttcattctccgcccgagagctctacgctcgtctgtgcggtccccggtcgccctaaaaaaccaggcggtcttccgtagtcgaattcttcagcgttggaacatcgcgttttatatatgtttctcgagatttagccgagggccgggcttttggggtcttctcaggttttatattaggttgtgtcgccctgtgattaaaaaacggatttcttgtgtagatttttcactgggctagcaggccaaggttgacgtttatatattccatgaattattgtgatgccgcctgcagtgcctaacagctagctctcgctgctgtttgcagggactgattgctattagagatctatttggtagtggtcagcagctgagggtgaaccgaag

SEQ ID NO: 7761 - DNA, 204 bp, Zea mays
ggtaactggtaaccattcataatatttcgtttttacatttttgatatcaatatccattaatatgtttccccgttttgtttgtaaatcagccggacttctgatagaatgaactgaaagacttctctaacaaaagtggagctgaggggagcaagagtgctaaaagtagtccaatgtttttagatgttctcgaatgttatctgaaat

SEQ ID NO: 7762 - DNA, 896 bp, Zea mays
tcgatgattaaaggtctctgttggaaccaccacaatttctaagaaactggtttccgtcatcagttgctagaaactggtttataaaaaaaataggtgtgcgtgtttagaggctagtttcttaggaaaccaacttctagctttgttatacacaaagacaattcaatccttactctatttcaaaagtaattgattctattattctctttgtttttctttgttgccaattttaaatatagattgaattaatatttttaatctaaaatttttaaataataattaaatattcaaatgggataaagacatcgagggaatcacatgcatagacctaagagcggttacaatcactaatttctaccaagttaaaaactaattttagttatggaagaggcagtccgatttttaagaaccgaagcataatctgatatgtttggaagcacttgactttttataaatcagattgctaaaaaactggatgattccaaacgtgtctaaataattcgtatactaacatcgttgaatctctgaaataaaactactaacttattcaggaccgtccctgtaatacgggagtctgcactctgcaagtctcactgcaggttggatggatgtggatgaaagctaaacacaattttctccattcagccccttaagatctccgaaatagcgaaaccgagtcgctccgtcgaggcctttaaatgccggcacagatgttggccgaagcaggacgccacgaggcgaacaaccaactgcttccttccccgccggccgccgccgcctacaactaacacttcacgtgcccccatccttttccgcctcaagtcaagtgttcacggtccatcctctcgagagtctaggcccttctcccgaagccgcagacgcagaaaacggctctgcat

SEQ ID NO: 7763 - DNA, 564 bp, Zea mays
gacgtttcaagccagggttttttcaggtctgctttttggcttttggtcggatttttttgaattgggttggggtttgagtcaaaaaaaaccacggcctataccagcctgtaaattattgcgggtcaaaatatccgttgcattaatcggatcgagtcgggtcggatgggctatgatgagatctaagaggatacatcaatactacggactatctctaatagtcaccgtatgcagatatgtattttgaacagtatcaatgggagcgtgtaaacgagagagcgttttttaggagagcacgcatgcaaatagatttgtgaagaagtgagaaattgtagatttgggatatacggatggtgatggcatattaataatgtttgttggagatgctctatcagcttataaatagacagggtgtctgtttatacaggagtgctagtcttcacggcggggttgttgtcgcttgtggccagccgccagcaccagcacaaggcgatcgagagtggtgaccaccagtaaactgcaaagtgcaaaccaaacaccacccacgagaaagcggaggagggagca

SEQ ID NO: 7764 - DNA, 1234 bp, Zea mays
gctgggccgtgccgccacgcactccaggcccatcaggccatcaccaccgtgaaacctacgcgtgaattctactcacctcacttgggtaggttaggatgaaaactgtcggaaacgatatttattcggtaatcagttttttagtcgtttttctttgattgcgaataaataggatatagaatctacaatacaaatttttattcttgtttttaacatccaacttgtaaagattcataaaaggtaaacatcaaattcatcctatatattctcaaaataatagatataaacttcggtatggattcggaaacaaattcggtaattttttcaacgtttcgtgttgtagggagcaaataatacataaaacaatttgtgtaatattttatttatatttgtactaatgtgcttgataacataagaaaatatcaacattaaattttatgcatatctattttaaaatattaaatttgttctaacagttccgattaccgctttcatccctacctttgataatgcacaagcgggcggtaaccgacgaattttgattggatttcgctacaacagcctcggttcccgctatcgtctcgatagcatgttgcgtctagctggatccgcagatctcgctcgtttctcgtcgagacctgtatttaccggatctcaacgctctggcggcaacaaatagcgtcgcggacgcccgcctgcaagcgagcccgcctgcaagcgagctgagtagagaagaggagcacggaaagtgactgaatgagaagagaatgacgggaaatatctattcgttaagagctagtttggaaaactcgttttctcacaggattttcattttctagttcattttccctttgaaaatagaatcccttgagaaaatatatttcccaaactagccctaaaagatgaatatttcgactttaaatatatttttggagtctagggacaatctatataattttcagaaatttttattttttaaaattttagaattcatatccgaaaaattcgaaacgggattcgaatccgtctaacgtcgagaacggcatatttcagcggaaaccgccgaataccgagcggtaaattaatccctgctgacgactgctgagtcacaaagagtgagagcctccaactcgcaactccgccgcagcagagcacgcacgcagagaagctcatcagtgcccatcccctgctccagtgaggagagagatagagagtcgccgccgccgccgctgccgcc

SEQ ID NO: 7765 - DNA, 537 bp, Zea mays
aatgaagacgatggacgatgatgacgaccgaaagaggaaaggactacttagtccttaataacttgtattacgatcatgtgtaaatgttgaggacataaatatacttttactcgggctgcgtcccatgcctataaatagatgaacagtaacaccgtactgtttatgctagattgtgctttactctcttgcatcctggccttcgagcaagccgaaggtatcaatgtaatattaacattgttgatattcatatatgttttatggagtacaagaataaatgaattattaagatacagttatcatattcatccctttgtattcctattcacatattaaatgatgaagatatgtccttcttgaccttcgtctgatgagtattatagccatgtggaaataatgcttcggaagacgaaggtctgttatatttaacaattgtgttgccttgttcttgactcacagtatttgagaacaagtgaccaacattggcacccacatctggtgaacctgtacgaccaccttcggcaatcatccaccttcgtc

SEQ ID NO: 7766 - DNA, 1168 bp, Zea mays
  unsure (1)..(1168): unsure at all n locations
tccccgtgttggagagaacttccccgggtgattggacgggtcaagagagagcttttccgaagctgggtgtccacgtagaattcgtccacnggaaaaaaggtcgagtcaccaagaattggctttcctagactagtctctaaggccttgtttggnagaagggtaatgtagagaattgagggggctaaaattccttattattcaaaattctcgaggagattttagcctccctcccttacccttgatgccaaacaaggcntgaggtttatttggttcgtggattttcaaacaagctccctactagccattaactatggtccgggatattgaaaatcggacgcatggagggacgcctgtgctaggtaaatttgctcaggcaaacaataagcaaaatctttgtgtggattttctttaacatgaatgttcaattagcagtatttcactccttcccatttaaatatatacataaaaaccccataaaaacttgtgagattttttccatgctgagaattcgcagcagctgcatcattgcgaaatagccaggagcatcccttgagcagttgagctggtggttctacttctaggagcataggttggctcagctgcctcgaaaaccgaaaaggagtaaaaaaaatacaactccattctcgcttgtaagttcgaaacacatttttctaaaaactataggcactgagtgtgttcacatatttctaatgcatttttgcccgtaacaacattgtgcctactactacagtgtacagtactaccctccagaaaaggtttattcagcatcgttatttaggatattctgctctcaaacaatattttgacacacctccgcgtattgcacgggattgcccacggtgcctcggaatttccatccgcatatgtaagcatccactctgacacacctgccgggtttgttgtttctgcgccatgcggaaactgcacactccatctgcgtcagcgtcagctctctataaagttcctggccatgacgttacaagcaggcgtcgtctcttgccattgtctccttcgtcgcgccaaatgggcgcctgcttatataaggccgtcgcgagctgagcactggtggattcctccctcccctcgtgccaaccccagcctcagctcaagcttgcaagttgcgacttgcgagtgcgaggcggcggca

SEQ ID NO: 7767 - DNA, 1500 bp, Zea mays
gagtgattttagttttgttcttggcatctgtgccttcattcattcttcataagccagccatttagagcatctccaacaatgtctcaaactagtgtcttaaattgaaatatatgactctaaacaggaaaaactaccccaaaagtgtctcattttgtaaaattttgtcaaaaatatatagaacactctctcaagtgcctcaattatactacaccctagtgggctgccttataatctagaattaagattttactagttggagcagaatattttgttggtgtcctaaatcatataaaatatactaatttttaaattgtagggcatttttatagaatatgctgttggagatgctcttagagacggatgagagacagagtttaggacataattggcttaaatgagcctggctcccaaaaaaatgaaacctgttttttcgagtctagctccgagagagatgttgcatccagccgtgtaaggtccgctagatacacgttacaagcaaccaaataaacaaacattgtatctcaccaggttggcccgtagacaggctatcaatcagtcccttaagatatctctaccattttatctcttatctcaaatctcaattataaacaatacactatacgatacgaaataatgcaaaccaatgttttaccgtgccagcatgattctcttttaccctatgcgtcgagactctccatcatgcaacgcacatgtgaccgcatcggtcaggtggacctaacgacttccacatgcagattcggaggaaggggagagagggacggtcggtcggtcggagttgaccatattcccagtgccgtgggagtggcggggcccggagcagagtggtggcccagaggaggccgcacgctcgcgtcgtcgtcgtcgcgcggagccgaggcagagcggccgccgcatgcgtcgcacggagccgagccagagcggccaccaccactgttcacgaaagcaggttttgtttgtttgctcgttccggggagaacccgtacacgctacctcttggccgcggccgcgaccgcgaccgtggcgtggcaggctgcatcactggcacacgggaagtgcacgctgctggttgcacgagcggggggcgacgagtgggtgtccgccgtccaggacggcgcgcacgcacgatcgaggcggtcacgatctcgccgtgcggcgcaaggagccaaggaccgcaagtccggagccgtgccgcccggcccgtgcgcggcagtcaatgcccccaagaattgactgcgccgcgcgtgctcgctatccgctatttccattccacccatggcagccacgcttcgccttcgcttctcttctcttctcttctcttcgatgcgagcgatatgagagagagaaacagagctccccgaggtgtgtataaatgccaggtcggcgcgttaattctttctagttctactccccgctccccattcacgcactctcactctacctccctccctccctcgccggcgccgcgcgtgctcccgcggg

SEQ ID NO: 7768 - DNA, 622 bp, Zea mays
ccgaaggaataaagaaaggataaaaaagaacgaaaggggagttaggcttgcacctgtgttagttttggagagcaatgggccaagcggccatgggaggtaatggtggagcttctccttttattttattttcagttttctttctatttttcaatttcaaatccacgctttgcagtcaagtgtaacaaaaaatacccataattatgcaaaaataagtatttatatgtataaaattttataagcatggaatttacatagttatataacctaatagaagtaatttatatagaataacttactatcctatttattatagtttaagtatatagccaatattttatatttactatttattaaattttttagaagataatctcaatttataactttgttatgatacgtttaaaattttaaatttttagaaattagttatggtaatttcaaacttattcttttgctccacgcatcgaggacctaattctaaattcgtaaaatcatcacgcgccgtcttcagtcctctgcctcctcgtcggaaagccctaatcccactcaatcctctcgctgccgatccgacctcaattccgaatccctcccccatctcccggcgtccccaacgccctccgcc

SEQ ID NO: 7769 - DNA, 50 bp, Zea mays
aagtgcactgcagtagcggctagctagcaacaaagcccagagcacgtagt

SEQ ID NO: 7770 - DNA, 1204 bp, Zea mays
tgggcaggggtggaggagggctcggccgcaccagggggcaggggccgcgggggagggagagaggggagagagaagaggggttaggttgcgaaaaaggagaaaaacgaagaaccgtcatgaacggtaacggagaaagcttaccgaaggggaagaagttcgccggattcaagaagaaaactgtggattgacgatgaactggaggtccgatcaatgaatcgaaagcatcaagacgaagccatcgacgagatggacgcagcggtactctcggatttcgccaacgacgcacggattgaaagcaattgctcgtcagagttgttgccggagttggaatcgtcctgaacttcggcgagctattccggaattgtgatctaatcaagggaaacggtttcgagatttggaaagggctcggcgagagggttccagccataaatatattgctagggtgtgaagatattttatttttttgtaataaatcaattttttaaaattaaaataaattcccgaaaaggctgaaatcgtgtttaatgtccaaaaaatatctcgaaggctccaaaaaaattagaaaaaatcttagacatgatttagtaacaccttgaattttgggttataacaatttctttgctctttactcaaaattcagctttacacgagaaccaaatcgaatgtacttcggaggctaagagaaacgaagcttagggccctaaaaggtgaatttatgtaagacaatgttcacctatttatagtaaagttttacagctttatatgaaattacaaatatgctcacaaagtttacatatatgatacataaatgttaagatgtatcattgtctttcttcttcctatcttactgcgtaagatttggacgtcttccccttcgtcgttttatgtacgcagccctttctatgctgaagttgtgttgtaacttcgcggcttgcaccttcgtcgtacggctttacgcattcaaccgaagcatctttgcgtgctacttcaggcgaaggctattttcgtccatcctttttaaaatattcgtatatttttgttagatttaatattgccattttatattttagatttttaattatatacataaacagacccaaaaactataaacatagatagcataatagcaaagagaaaatttgggttgtaaatcgccactcctcttcccacacagtcattgagttcgtctgcggtaaggcatccc

SEQ ID NO: 7771 - DNA, 872 bp, Zea mays
agcgtgtgaaaccgaaataagaggacaaacagcaagtaaaatgtatccgtgaacgccaggaacccatgagttttcactgatgcaaggaggtattcaaccaagcaaatcgacgagctgatccttgaaacaaatgcacgaagaagaggcgctggggggaagaatcctgacctcgccttgcgctgatcctgcgaataaaatttagtttaaaaataaataaaaatatagctcgatcttaacttgatttaatcattaaattttatagtataaaatgcagagcggatgccaataggcgttaatctcaacagatattcccagatttgtctggcccgctgcgttgtgggctctcgccgtgtcagggaccaaggtgaagggcgtgcgtcgcctggcctggcgttgagccgagccagttgagtggagccgagccttggcgcccagcccgcatggagtcccgccgtggtagagaagtggtaatgccgtaactgtactccaaggattcccactcccagctccggcctcctccggcacaatgtcccacggccccgccccaccccaccgcgcacacgtgttgcccacctcccgcctacttataccccgcttccattcgtcctcccgatggatcggccggtctccttgctccaccacggtcagtcctcgccgcacctgcagtcagcacagcggcctcctcttctctgaccctcgccacccaccgaggcaccaacccaccactcgctcaactacctctcgtcctctctctctttccccctcacgcgcaacacgtctccatctccagcgcgagctattagttacgaggtaactaggccaagatccaaatcgcgcttgcgcgcagacagcagctcacttacgggggtgtc

SEQ ID NO: 7772 - DNA, 1149 bp, Zea mays
atgaggggactggatgcttattttgatcataattgtgatacactaaatgtcatattgtataccctgaaggcatcaacttgatgatcaatatgtgaacctttatgaaagtttctatcatatagatccagtcaatcgaacaccaccaatcaaagtggcttatttatgttgatatgagcacttactttgtgtatcctagaagtgagttgaggtgaagttatgagataatccttgcgacaatatgcaatccatttgctaaatctttgcatgcatatacttccagaagaaggtgttttgccatactgagatatttttgcaaggatcaggggagcacatttctaaagttagcctttatagaagatttgatggaatctagatctagaagatcgaaatctatcctgatgacaattgttgtactctttttcccttggtgagttttcctaaagtttctctcatgagtttttttaacgagtcaacaaagtgcaaatacaatatgtgtcaccatacgctccttttccgtatgttttccactaggtttttgagagttttaacaagtcatgtgttggtcgtggtattcgcccaagggggagtgttaagaaatcctaattagggttatatgggcaaataccaaattaactctgatgtgtctcacgtctctatataaggaacatgtacctctctcataagatagagaaaaaaagagatcagggatccaaccctatatcgtatctcttgtgtgctttatatgtcatgctctgggaaggaaaacatgatctacagcttctcctcgtctaaactactgataggagaagaatagagtgaatttggtgattcgtgataacgatagttgtgaccaatattgccatctctagacctgcagccagccgcctcaagctgccctctgcagctctgctgatctctgctcggtttcgatagccgcaggccgcgccattaacccgcagaggcggactcatggtaccacacgccatcggcccatcagtagttaaccaccaaccacgtagtaggccttacgggcctaatgtcgttggctggtcctttgccacgccatgaaaccaaagagcggcgtcgttgcgatccaagacggcaggcgagctccaggttcagttgttcggaggaagcccagcgccggcg

SEQ ID NO: 7773 - DNA, 1500 bp, Zea mays
cagagaaaggtgagtttgtggaccgcaactctgattttttctgtcagcaaaattttccactgatgacttggtgtgccaagctagtgtggcatatatgcatctagttggttaaggcatcgggctgtcgcctagctacaaatctacaaatattcattatgagttttaatccatggatcgagttcaatgtaaatttctttttcagggattgcttcatgcatgcttgaaataatagctagacttggccatggcacttttcctaaacctagctggaaatgttcaacattatttttccattgcattgctgtgcctgcatatgcatgttaataaggtcacatgtagctgttctcatggatagatagatatgcagctattgataattctcaagtgtcatgtgtagtagtgtgggtgcgccactttccttccttgcagtgactaaaattaatcttttagcccacagtttgtgtcgtatgaatggattgagattcttcacttgaaccatacaactagtaaagcagggactgactttcttacctaatccgaagcttctccaagttttgtcgtcccaaattaaatacaggtttcactttgtctgtcgttaacatataacttagtgattaagccttcactcgatctacctatgcaaattaaattatctctctatatatggttttattagcttttacgcccagcttctcttcctaaaacaactaaccgtcctgtttgtagcaacaaccatggttttaagattatacgacatccggcccaagagagaaactagaccagtcaattaaagaaaaaaaaattacaaatctttgaaaatatctgatagtaaaccattcgtgtccaaaaatttatttgatttgcaaacaagcagaagggtccagtttgaggaatcttgtagctagctgagcaatattttttgtcctccctacaacgaaattgcacgtagctatcctgagctccaaacaaatcaaaagatcttgtaaaattggtaaaataaataaagtccaagcagaaacaaagacatgctgttacaagatttaccacacgtacactccagtagaagaaaaatggagagtgtagaatccatcactgctgcaaattaaaccaggcagagagacaaaccagtcacactccgatcctaccgagtcaaagggaacgacgtctgccttgacttggcacaacatggtgttgatatgctcaaccataaaatggagaaaattctgacgaccatcatctgaaatagctagattcctagctcaaaagatgggttccaaagtcaaatattgatgagtcgttaaagtttgaaagaaagaaaaaaactagattaattaggttaaatcattgcttacttctcctaatctgtgcagaaaataaacaagatgagaaagttcaactagcttagcttatagggccaaaattcatctgacttgacttggacaaaagtttctcctttaatttggctatatatctataattattcacgtctgatgaccactc

SEQ ID NO: 7774 - DNA, 1500 bp, Zea mays
tagcccactcaaatcttcattttttctatgcttaatattaaataaacttatatataaaaggttataaaactctccgactgtccctgtctatagtgcatttaaacaccctttagtactctgtcagatctaattagaattgatcagctacattatttagcaattgatgtctctgaaaagccatataaggtggcggcgttctcctcttgtctgcaagcacgtgacacaaaatcgcatgcatgtcaccaattcagtgttgagtcgttctttctatcacacagtcatgattcatgcgtgtacgagaatagagagcgcatgtagtgttacctagagacgatatgcttcactggatcttcttgttgtaggacgatatgcttacacactatgacatcatgaacatcgacgtgaagctagcataggccacccgataagattaatctggaccgatctatccagaaatatcagattgggggtctgtttggtttgctatcaatccatgtagattacgtgggattaagtgagtttcaattccaaacaaattaaaatctttcatattttttttcaatcctgtttaatttatatgagacctaaataatcgaacatgaccttatatggaccgagccacatcgacggacgagctgacccacgagccatcaggttgggctatgttttcgttaggatatgtatggactcgagtcggttttttctatggtccgacccgaatctgacggacccacaaatctgacccgagaaactctaaagtctaatcgcaaacagtgtgtaatgtaacgtgcgtgcttgtttgattgtatcatgcgcttatatgcaacagaacaaactcgcaaggaatctaaggatattgtaaggtcgttaggttagtrtatttaggacacggcagccatggcattaattgttgctttgcttatgcaagctggttaatgtttatgttatctttttggcatcgcggcaaagggagtattgtaatcttggcatgatatatatttggctacttcggccaatcaagcatacatacatctactgaacatggacaatacctttaggtttttttagatactacactgtttttttttcgtcgagagtcccttttcgctgagagagtatatcagtttggctgatgggtctaggtctggtcatatattttatgggtctacattatattttacaaaaaaacacggcccaagcccaaacctgccacagctcggcccaatcaacacaccaaccgatgtgagtcttggccggctggttggtgggacccggcggacagcgtcgccaggctgtgttcccccaccctccaggctgcctgactcggggtctcgggcaggttccgccgcatcgtgtcgtttcttccctttcccgtttcccccgttcagttcagcttcggttggctcgccgtactcgggttgttcctcgcctcgcttcgcttccttcctccgcagtcctcgtctcgaattcgctcgcggtgggagaaatcggggcgcgagg

SEQ ID NO: 7775 - DNA, 435 bp, Zea mays
cgtatgtcttattgagatcgtgaccattcaattgagatcatgcggctgtagaaaaatgctctaacgtggatgcgctaggaagccgcgtttccttgccgctttcataataaggaaattatagaaactccaaaatgacccgatctcgaggtgaatcctttggagctactaggcccagagacagcagcgtgctagtctgccgccgtcacggcccaatttaacccagcccccaggaacttaaccctagtcccgacccgtcccaccctatcagttgcgggcgcgcgtccctgtttcgctcgtgccgttgcgctgcgccaagcctccccacctctctcgtctcttctccacccgccgccctcgtgggagtgaaaccctagctagggttctgcccgccgccgccttcgatcaagacgcctgcagccttagcgcgagcccgcc

SEQ ID NO: 7776 - DNA, 1166 bp, Zea mays
ttttcatatcttttgatttttaacaacctttttgaattttgtttgcactctaaagagttattcatgttttctatatttggatagtgagaagctcgaaatagaagatgactatatttagatagccatttaaataagttattggatggtgctttttttaaaaaaacactatatatatatatatatatatatatatatatatatattataaagaatatagtgagcctcttagagttgctcttagcttcaacagctatctcatcccattctttagaggattttgcacgataaattacactgtttatagagaaaagtttaaaatatgtaatacgatagtatagttattgaagacaacctaatataatagtcaaaactaaccaacatttagaaataaagaaactaccgtaaacacatactcccttcgtttcaaaataataatcgttttagttttaaatttttatttttatatttatataaataacaacgaatctatatacatatataaaacacatacattaattattctgtgaatctattgattcacgccttttcattgcctgaacaaacatgtcgaagttgcggtgcgacgagcccccacgggtgacgctcccacgcgcagcccttttcatgtcctccaccctctccctcatgccggcgtcacccatcaactcctccaccctactggcgatgtgctccttggtgacgacgcccgactcatcggcctcggccgggagcccgaccttccagacgtcgcagatgtacgcctggttgacgaactggtcggtgaagtagggccaggcgaggaagggcaccccgttgcggacgccctccatggtcgagttccagccgcagtgcgagacgaagcacgcgaccgcagggtgcgccaacacccgctgctgcggcgaccacgccaccaccatgccgcggccagtcgcgctgacgcggtcgaggaagccgtcggggtagccgtggatgccgccgccgccgaggacgatgtcagggcgcacgacccacaggaacggccgaccagagagctccagccccagtgccagctcccggaactggcgcgcgtcgaacatggtgtggctgccgaaggccacgtacacgacggacctcgccgcctgcgcgttgagccaggccatgcacgcgccgtcctcgggccgccagaa

SEQ ID NO: 7777 - DNA, 417 bp, Zea mays
ggttcctaccttggtaaatctctcattcttggcctgggggcttgctatgcacatgcttcatgcttgggtttaggttttagcagcagcatcgactcgagatcagccaacacaaaacagggcctccccgttcctttctcctcctcctccgaccctcgcgcattgcgtagtacgtgctgcatgcatgcgcgtcatgtctcaggaggggccaggtgcatggcatggtcacgcactgacctgacatgcctcgcagatgcagtagaaagaaagaaagaaagaagcaatatagagcggccgccccgacaacgaacagctgcttcatcttgcatgcatgcatgcatctgagctgtgtctcttagagtgaaagggatgatgatctgagtctgagctgctggttctacccgatttgcatgcaggcat

SEQ ID NO: 7778 - DNA, 1500 bp, Zea mays
tatcttgtaagtagttttattggctcaattccaagcaacctttacacttacattatgcaaactagttcaattatgcacttctatatttgctttggtttgtgttggcatcaatcaccaaaaagggggagattgaaagggaattaggcttacacctagttcctatataattttggtggttgaattgcccaacacaaatctttggactaactagtttgcccaagtgtatagattatacaggtgtaaaaggttcacactcagccaataaaaagaccaagttttggattcaataaaggagcaaaggggcaaccgaaggcacccctggtctggcgcaccggactgtccggtgtgccaccggacagtgaacagtacctgtccggtgcaccaggggtctcagactccaactcttcaccttcgggaattccaggggcgactcggctaaaattcaccggactgtccggtgtacaccggacagtgtccgatgcgccaaaggaggtcggcctcaggaactcgccagcttcgggaaaagccaacggctcgtccgctataattcaccggactgtccggtgtgcaccggactgtccggtgcaactccgggacaacggtcgtctccgcgccaacggctctctgccgcgcattgaatgcgtcgtctgcgcgcgcagaagtcagaatcgcccatgctggctcaccggacatcaaacagtacatgtccggtgtgcaccggacacccaggcgggcccacatgtcaggagctccaacggctagaatccaacggcagtaatgacgtggcagggggcaccggactgtccggtgtgcaccggactgtccggtgcgccatcgaacagaagcctccagccaacggtcaagtttggtggttgaggctataaataccccaaccaccccacattcattgccatccaagttttccacttctcaaccacttacaagagctaggcattcaattctagacacattcaaagagatcaaatcctctccaattccacacaaaaccctagtgactagagagagtgatttgccgtgttcatttgagctcttgcgcttggattgcttcttttctttctcacttgttcttgagatcacaactccattgtaatcaaggcaagaggcaccaattgtgtggtggcccttgcggggaagttttgttcccggctttgattagagaagagaagctcactcggtccgagggaccgtttgagagagggaagggttgaaagagacccggcctttgtggcctcctcaacggggagtaggtttgcaagaaccgaacctcggtaaaacaaatctccgtgtctctcttgcttattcgcttgggatttgttttgcgccctctctctcggactcatttatatttctaacgctaacccggcttgtagttgtgtttatatttgtaaatttcagtttcgccctattcaccccccctctaggcgactatcaattggtatcagagcccggtgcttcattagagcctaaccgctcgaagtg

SEQ ID NO: 7779 - DNA, 86 bp, Zea mays
gttgagttgccgaaggccgaaacagaacatggattgcatctcccgtgtccctcggtgggtgcaatgtgtgccccaagttgctggtg

SEQ ID NO: 7780 - DNA, 1500 bp, Zea mays
cacaggtaggataattggatccattcaagtacgtacgtattgctagctacctagatctgtcgtcttctcgagccatgcatgcgcggttgaatttgtagagagctctaccagatatatagttgcacttttcatcgaaataaaagtggagttatagcatacgatcttaaaggagaatcataaaacccccagtttttatcggagtcgatctccacggcaaaaaaaaataattcctttaaaaaccaaaaaaagaatggacgaagggattggccacccccacaaaaaaaaatgattgccaaggtggcggaagatacgcatggttactcttggaacttgggagcatctacgccatacgcatgatctgttcgaaatcagaaacgcagcggtaaccaatttgatggcccgttttctttcttccattccttcttcgtttctctcccacttgaatctactgtaaatttaaagaccatctggactatggtctgttcacttggctttaatctatacgggtatctactgtgttttatcgttcagcagcagtgtaacgcaaaagtattgagcgagaaatttatgttctaattagccagcaacaagccacagccccccacagctagaccaaaaccagacagggaaaatgtcaagttacttatatacaaggccttgataagtagaaacggataaaccacaccattttgtattgcggacagtgtgtgccacaagggaatcacttccagatgagtacaacttaacaatacatttctctccataaagtttcgttttcaacggttttttttttttgaaatgcccgaatggagtgcgcatatgtcaccgaggggccctcagaaaggcgaaggtatttgtcctccccatgctagtgggtggcagtggtgggtgtgggtgtgcggtgagcagagagaggctctggggctctgggccggtgagcccgagcgctccccctcggcgccctacaaataccccgccgctgccgctcctcttcttatcgtgtgacctcccccgatctggagctgaagtgcttgacgccttccgcttccacttccacggcagcacgagccttcttctccttctcgcttagcggctatagcgccagccaaaggagaagtctgcgggcgagtgcgatagatagacacagagaaaccgatagatcatcaaaaaacgagcgaaaaaatcggtccaaaccccaggccggacgcgcgttagagtctccaaagcttatccttccatccactccccgcagccagcttctcttctcgttcccggttatattaataacgcggcggcgtgctctgcttcctccggtttgctctgccctgcttcctaaacacaaacgcgctctgcaccaagaactatatacaacgtagaaactagccgcgccgtcactcccttttgtggcaacctgcagcacgcacttgctgagacaggggtagccttgctataggctagctagtgtcacttgccgaggacaagcaagcaggccggggagac

SEQ ID NO: 7781 - DNA, 217 bp, Zea mays
cacctcgcgcagcgtgatgctaacgccaccacgtacatgcaccaccagtggggcagctggggacgccgggagcaaccggcagcgccctataaatctgccggcccggccgttgcattgtctgcgtcagggcctctcgatcgctcatcagtcgccagaggagtagttgatcgaggtgagtgaggttgaaaagcaggcggcgaacaaaggcaccatcgtc

SEQ ID NO: 7782 - DNA, 1217 bp, Zea mays
tggatgaacaaagtgcaaatctagagcaaaggtatgtttctaagtcttagtacattggttttgtgtactaatatacttgtctaagtattagaaacagaaagaagaagaaaagagaagagttggctgtgtacagccaagaggctgtttcggtctggggcaccggactgtccggtggtgcaccggacagtgtccggtgcgccaggctggctcgagcgaagtggccgctctcgggaattcgccgacgacgtacggctaaaattcaccggactgtccggtgtgcaccggactgtccggtgagccaacggtcggccgggccaacggtcggccgcgcgatctgcgcgggacacgtggccgagccaacggtcggaagggggcaccggactgtccggtgtgcaccggacatgtccggtgcgccaacggctcccagatctgcaacggtcggctgcgccattttaggaaggagatcgggcaccggacagtgtccggtgtgcaccggactgtccggtgcgcccgatgacagaaggcaagatcagccttccagaattgctctcaacggctcctagctgccttggggctataaaagggacccctaggcgcatggaggagaacaccaagcaaccttagagcattcttgatcatccacactcagtctttgcgcattcgtttgtcattctcagtgattcgagctccgttctagtgagaactttgagatagtcttttgagctcgattcttggccgtgtgtgtgcgcattttgctgtggatttgtgtgtgttgcttccctcccttactccgtatttctttgtgaacatctcaagtgtaagggcgagagactccaagttgtggagattcctcgcaaacgggatattgaaaggaaaagcaaaacactgtggtattcaagttggtctttggatcacttgagaggggttgattgcaaccctcgtccgttgggacgccacaacgtggagtaggcaagcgttggtcttggccgaaccacgggataaaccactgtgtcatctctgtgtttgatctctttgtggtattgtgtttttgtgcaagactcctctctagccacttggcgattattgtgctaacacttaacaagtttttgtggctataagtttaagttccacaggatcacctattcaccccccctctaggtgctctcaattggtatcagagccgttctcttcaagaaagggactaaccgcccgaagag

SEQ ID NO: 7783 - DNA, 1500 bp, Zea mays
caacatgtgtgtttgacatagaaatagagatttgagtttgatttgcaaaaacaaaccaagtggtggcaaaggatgatccatatatgccaaaattgaatcaaaaccaatttgagtttttatttgaagtgattttgcacttgttctagttgctttatgttgtgttggcataaatcaccaaaaagggggagattgaaagggaaatgtgcccttgggccatttctaagtattttggtgattgagtgtcaacacaagtgcttaaatgtgaatcaatacccatggatgaacaaagtgcaaatctagagcaaaggtatgtttctaagtcttagtacattggttttgtgtactaatatacttgtctaagtattagaaacaggaagaagaagaagagaagaaagttggctgtgtacagccaacaggctgtttcggtctggggcaccggactgtccggtggtgcaccggacagtgtccggtgcgccaggctatctcggccgaagaggccgctctcgggaatttgctgacggcgtacggctaaaattcaccggactgtccggtgtgcaccggactgtccggtgagccaacggtcggccgggccaacggtcggccgcgcgatctgcgcgggacacgtggccgagccaacggtcggaagggggcaccggactgtccggtgtgcaccggacatgtccggtgcgccaacggctcccgcatctgcaacggtcgactgcgctgtttaaggaaggaaatcgggcaccggacagtgtccggtgtgcaccggactgtccggtgcacccgacgacagaaggcaagatcagccttccagatttgctctcaacggctcctagctgccttggggctataaaagggacccctaggcgcatggaggagtacaccaagcattcctacaacattcctaagcaccaagacatcgattccacgcatttggttcattgtgatagcatctagagctcttgtggagttgtgaactcattgagttgtgttgcgagctcttgttgcgacttgtgtgcgtgctgttgctctgatcttttgaagtcttgtgtgcgttgctagtttctcccttactccgtatttctttgtgaatcttaagtgtaagggcgagaggctccaagttgtggagattcctcgcaaacgggatattgaaaggcaaagcaaaacaccgtggtattcaagttggtctttggaccgcttgagaggggttgattgcaaccctcgtccgttgggacgccacaacgtggagtaggcaagcgttggtcttggccgaaccacgggataaaccactgtgtcatctctgtgtttgatctcttgtggtattgtgttttgttgagactcctctctagccacttggcaattattgtgctaacacttaacaagtttttgtggctataagtttaagttttacaggatcacctattcaccccccctctaggtgctctcaattggtatcggagccgttctcttcaagaaagggactaaccgcccgaagag

SEQ ID NO: 7784 - DNA, 151 bp, Zea mays
aaggatgtataaatatacctgggattgctgcctcgtatgataagatagcagcaggagcttagttgtattttgcctcattcataggttgggtctttcctttgcccgattgacatcagaaagaaaaaaagttattcgatgtcagttatgagcc

SEQ ID NO: 7785 - DNA, 1500 bp, Zea mays
tgtacctgcaatccttagaacatgtttggcatagctatgctctattttatatagctttgctttatgttatagtagctctactctaaaactcgagtcgggtcggagcggtctgctctagattttagattgattttttcgtaactagcagcagcgacagataaataactccagcacctatgtctcagttacttttagagatttttagagcacctaaatagatgttctaaaaattttattctatagttctgaaaactttataaagtttacaaccctagaattttagaatattcgacagactcaaagtaattccactttaggctatccgcactcatactactctaaatttctactctaaaaggaatattctatctccgtcagcagttatgtttactctataccacaatcctctgcagtcatgtttactctatatctcaactctttaccaactatcacatattatattatttttttatttctctttcattccacccaactacccaagcagtgcatagggtttatgccgtactactctgcatatgccgttccagtactactactgggraatagcgtagctcaaaaggtaggccactgcagcaggtagagtaaaccctatctctgtagcgtagcgtgccgagttcttcagtgcggacagccttagcgttttgttatggagtcatgtcaaacgcaccttaattactgtatagcagagtattgtacgcacaatactccagtgcagtgcattgtgcatagcagtggagctagtgcgtgtctcatcagtgctccggtactccgcaccgtctggcacgcggcacatgccctggggacacgcgcgccacggcctcacgtccacccataaatggtttgtccgctttcccaataccccacatcaatgccaccgacacgcaatactgttcactctctctggagtctggacctttctcgccaaaccggcgaatccgcccccggaacgccgtgcggagtggagccgccggcacccggcagcagtacaaaacaaaacgcttttaccacagactgcggggtggcgacggcgttggaaagcggagtggaggccagctgctcgctgaaacgccgcggatgaaacagatgtccgtccgtcggtttgcgtgctaggctactgtgccgcttgacagaagcgggcactcacctctctctctctccccgcacacgttgctgtcggcagcctcaccaatctcggcgccagactgggaccgcgaagggactggtggtcgccggttcctcccgctactccggctgcttttcctcctctctccgtcgccttccccttccgggctgcccatatttcattcggtgccaacaagtgccaagtgctcgtgtccggatgcgccagcgccgcctggtcaacagatttttgccctgcgctgtcactccaccacgctgcttgtactgaaagctttttcccagaataaaggctggggaggaggaagcggcggcggcggcgctctcagaagagagggtgag

SEQ ID NO: 7786 - DNA, 1500 bp, Zea mays
acccacacaatacctaaactaatttttgatattgataagagtgcttattataaagcaattcttgcaatttttttaagaattgatttttgcatttttaggtgtcaaaataaagaaaacccatcctagtggatccgtgtggtaaggaaaaatgggtaatctattccttaacaaaaaaaattttggagattatgtaatgcttactctcaaactttttgtttatacagtagtgatattctttgtttccctctttatctttggattcttatctaatgacccaggacgtaatcctgggcgtgaggagtaaaaatcaaaaattttttggaattttttcttataaatttaaattggatttatttcgtacatttatttatgagaaaatccgggggtcagaattccttacaattcgaaagtcccaaatgatccgagggggcggaaagagagggattcgaaccctcggtacaaaaaaattgtacaacggattagcaatccgccgctttagtccactcagccatctctccccgttccaaatcgaaaggttttcatgatatggcagaggcaagaaataacgattgtcaaaaatccttcctttttctttcatttcaaaagtgcataaaaattatattgccaattccattttaattatattcttttttcttaatgttaataaaaaaaagaagaaaattctggttttttctttccaaaattcgatataggctgaaagacaatcagatcttttttctcttcagcgggcagttccatatagaatttgttagaataaaacaagcgggttaaaaaaaaaaactctttttttttatttatccacaaagcaaaaaaggttcttatcaaacccacaataaaatgggaaagaaagataaagtaagtagacctgaccccttgaataatgcctctatctgctattctgatatataaattcgatgtggatgaaattggtgtataagcgcatttttgtatttccttagacttagatcgcgcaaggcaagaatttttcgctatttacgatttcatattcttgttactagacgttctataggaataagaagaaatcgcaactcttttccgttacacataataaataaagggtttcaaaagtcaatttttcttttcaatatctttcttttttttttcagaattccatttttgttcttccacccatgcaatagagagcgaatgagaaaagaggggttttcccttaaaaaatgggctttgaaatagaaatcatggaataatgctgaattcaaatgtttatttctttatttcttttctatagtataagaaaaatgaattaaatgaaatttgtggatttagcacgacctgggttgtgaccccatagataaaaatgcaaaatttctatcttcgagacgactgaaaaagggcattgaacgagaaagaaatcgtccacagataatcaaactatcgtatgccctggaagtaatatgaggtgctcgaaaatggttgaagtaattgaataggaggatcact

SEQ ID NO: 7787 - DNA, 1500 bp, Zea mays
ttggattacaaggactaattattagccactaaagtttagttcatttgtctccaaacaggccgactaatagagggactaagctttagctttcccttggactagcaattagtccattagtccacaaatatgagctaatcaagaccaaacacataaacaatctattagtccatagtatctaaactcctcgtgactaatagctaatgggataaacattagccggactaaactttagtctaactaaactttagctctaactctaacgaatccaaacagggccgaaaacggattaacatgggtctaagcctgatctaaacctagtttaaaatatttgtatccagacgtaatgttaaaatctactcctaataaattatgggatgataaaaaaacggatttttgggagtcattttttttgttggctcttggagattatatctaaaaataatggttgaagatccaattttgataaagtttcgtgcggcggcaattggggggcagcaacaaggagtgctgactgctggagtgctgctgcgtagaaactagaaccaacataagcaacattggtaggtgtgtccatcatggtaagcatgtactccactccaactaccagtattgatacttgcggctgaatagcatgcatcgccaatcgtcatgtgttccacgcggccatgccatgacatggtgccaatatgccgctgtcgccaaattcaattatataatataataatggccggccggcaccacgtcgcatccaattcaaatcatgcccggctgcacagccaactacggcgaaaattggttttaaagactaaaactattttcgtttttatattttctttaaaagtaaaataaaaaaacgataactccgaaaactaaaacgatatcgtgacaatagtcatgccactgactccggaaacaaatttacatgtgcaggcggcaggcctgatgatgcatacaggctgcaccgctgcagccacggccaggggatgacgagtgctagcttggcaattggcatatgcaacctacctaagcaatgtgctgccatatacgatataccttgtcgaattcatcccaaaactagtactgtacgtactacaagacacgcgattggccagtttgaggcaacaagggggaatccgtacgcctttttcatttcatataagtaagagcatcttgtggtctataaatatgttctataatttaaaaataagtatattttataaaacttagggtaccaacaaatcattccgatgcaacggtaaagtctcaaatctagtttataagtcatagtatatttgagacaattgagagagtgatctataacttttttaaccaaattttataaaagtagtttttcctacttataacatcatatttcaatttaaacggcattgttggagatgttctaacatctcagctaaagcctaacatcatcagcttcagtgagtgagtgcgtaaaagtagcaaaagataccggccgtgcgcaagaccgaactaatcgcc

SEQ ID NO: 7788 - DNA, 1220 bp, Zea mays
cttcagttatacacacatgtaattcatttccagctcacaattaaccaatgtgattttcattggtttgtgttggcattatcgacatagtgtttgggccttgccggatctgctatgactaatgccggcccatttagccatcaaaatctcttcgagccgcagctcaccgttggttcggtgttctgatctccaagactccaagacgtttcttataggtccgactttccttttgtagtgcaaggttgcctgttctcgcggtccaaggcaacccagcttgcaaactcttctacgtaagaatgacccaaaagaactatgacacttccccctgcttgctatactgctcaaacatttaatgccaaccttgagcatatagctggtgtcaaatggtttgttttgacatagttgatttcaaggtttggacaagtttcaacagttatcacacatgctgaatatctaaactggtctgaaactctgaattagttgcatagcaattagttaggtcacgatgttggatgctgattttttttgttctgaactcctctggtcgaatctccacggtacaacaagttgtgtggcactggagttctcaccacaacttatgaaattaaggaacacgttgtgtggcactggaattctcaccacaacttatggaattaaggaaggggatggttaagcctcctgctgctcccattgttggatgtttgaaatggttgtatgtatgatattttctaggtggacttgaaggataagactgctaaatataacacacattttaatataatacacatttatacataaattattgtgatattatatgtttctgttgcaatgcacataaattatcgtagtattatatgttctcgtgttctcgtggtattatatgtttctattgaaatgtataaaacattttctcataacagtataacataaattccagcataatacatatttatacataagttatcgtgatattatatgtccccgttgcaacgcacggacactcacctagtttacggatcgatcgtccttttcacccctaatctgggccgctaccaaacaagcacagttggctggagagcggagacactggtcgagccagcgagcgtgtgcgcttgctctgacagtttgccttcttcccaacccaacagaagcgaagcatctcttctccccccttcccaatcgggctgcgacatatccccttctccgtcctcccgcctgccgcc

SEQ ID NO: 7789 - DNA, 515 bp, Zea mays
actattagctggactgtttgaatgtctttggctaatttagcagctaattatataccagctacaatgcatttaaataccccctaagtcaaatgcttaaactggttagatgatgtggataattcatttatattatattctaaaaataaacacgatgttatccattttaaaagtcaaactactactgaaaattcctaatcatcggtcaccctccattaccaatggggtcggccgattgggctcagttgacaaccaccgacccaccgtatgtgcccgctcttctttcaatcatgcccgcacgtttgcctcaataatgcggcatatttgctgccacgttaggaacttctaagtcatcctgtatatacgagtatattaatataccacccgaaatgatcgagctacagtcttgcaaacgaactgggctcaccaccaagcaccaattatacctctctatatatacagtccattggccatttgaccytcatctcctatagcgtatcacaaatagaatacaacca

SEQ ID NO: 7790 - DNA, 358 bp, Zea mays
atgatttaacagattaagaaactcacttgcacgcttgcgtataaggtctgattgtatattaattgttgccgttagtatataatttgaggtccaaactacacgactaacggaatcggaggggattgagatggcatgggccgtagccgaaattggaagaagccctccgcagtaaactacgcatctggctgaccccacccgctcgcctcccacccacgcgttccagctcaccgcccacgaccacctcgccggcggccgcagcggcgccacggtgctcggctagggttccgcttcacccccctacccccctaacgaaagcgagagtgtggcatccgcgcccgcccggaggggcaagtcggag

SEQ ID NO: 7791 - DNA, 1098 bp, Zea mays
ctgcctgtgcctgtttcgtgtgtctgaggatctcctgatctcctcctcccccctcccctgctccctccccatcgtcatccacctcctccacccatcccctcctcgctcgctctctcgcggcttccctctcctcctctgacctgcgcatctgaagcatagatagcaagcaaggaccctgctcagtgctcacctcgccggaggtgctgctgctacggcggcggcggcgtactactactactacgacgaggtaaccaccaccaccaccacccgccccctcctcctctcttctctcgtcgggaatcgtcctggtgctgagctgaccggagctcgattcacccgttcgttcctcttgctcaacaccgtgttcgggcaggggatgctgcgtccgatccgcccgcgcctgaattcctccacccctgccctgccctgcagtcactgacaggttcgctgcgatttcgcctcgacccggctccacggtccgtgctccgtcgcccccggcgggcggacccgattcccgggtctccgccgccctcttcgcctcgctcccgaggtcgtctccacgtgctctcgggaactctgcgcgcagctccggatctcaaccgtttcgttcccctcaaccaccttttcgtttacccggattcctttttttttatctcgttcgtcgtcatggatcgatgatcaaggtgtccgccttcccttcgagtacaggcagcaaggggggaaggaaatcgcggcagttaattccgagatctgtgccgatttttagggcccaagctggaaagattcggcaagtactacgtctgatcttgtagcatagtacccccctcatgtccgaatagtgaaacttgtctccgcccttggcgcttttaaaaagtactactcatttttttttaattcgcgcactctgtgaaccaaatcctcctccttccttatcccaggcagcctccccatctcctgcgagttgcgtgctcaccgattcccgctcctctccattgcagactctgcgcgcgcacaagcccacaggagtgcagaattgaccgcgcgcacgacgacgacgaccaccaacagcaacaggagagaggaggagatcgataaggg

SEQ ID NO: 7792 - DNA, 861 bp, Zea mays
ctgagtcatgtacaataaaccagaaaacagcagtacacgtacatgcacatgagacttatacggcggtatatactagcacatgaaaataactcctctttgtcgttgctaccattctctagagactggtctgcacactcgacttctcatggcatggcatggcattgcagaagggagagaaaaaaaaacgcccccacggcccccgtcgtctagctagctccctactacctaggcacactacagctgcggctgccactgtcccttcctcattgttgaacagaactccccaaaacacccccgcccttcgcacgctgtctcggtatctcctctgcgccttctctctctccatctcctcaccaaccaaggcactctcgcctcccgtcttctccccctcttcttctctctctagttgccaaatcggagcggcagcaacgacagatccaatacatataggttccattgcatcacacatcagtcactccaaaaccatcaaatcacacgcccatcagatcacacaggcaaagaggagagagagagagaggagggtgggtgaggaggaagatgatgagagatatatcctactaaactatccatccatccatcaatcaggtagcccggcagcaatcgcgtgccgcctttccactcacgtacaccaccaccaccaccacctctcagtctcagcacagcagtcggctcggttcgttcgttgccgcgtcaaatcggggcaagaagccagcagctagccagcccccctgtcgcagtgttgcttcgcgtgccctgctgttgcttgcaccgcgcacgtacgtacctggagcaagctgcggtcgattgatcgaccggtggttcgctgtcgccgcggtcggc

SEQ ID NO: 7793 - DNA, 1500 bp, Zea mays
actaagggcttgttcgttttggtgataatccacatggattgggtgggattgagccggtttaaatctataacaagtcaaaattcactctaatcccacccaatacactccaatacacatgtaatatcaataaccgaacaaggcctaaagagagacatgttacgttttctacacgacaataggttttttgtacactacaactacaaggtaacacaaagcgatatagccattccacattccccacctggggcgccaaacgrgagacggcgggcaaggggaaaaaatccccctcctaatcacgagccgtccgtgctcgatccgacggccacaaacagagcggacccatcgatatcagactaggggaggcagaggagcaaccggctgcctgcctgtcagtcctgtctggtgtgtgcaccgcgcgtccgcgcgtccgcctggctgccttcgtctcgcccagaacgcgtaggcgcagcaacaaactaggaagcaacacccagctgcctcggcgcaacccgtcctcttctactccagaggcacctcggcatccgccgaccggtttccgagaggtttgctggagtgcaccagcggtggggcagcaaatctgtaactgtacgcaccacttctttcccgtccccattcttctgggatttgggagctctcttctccggtttggatttcggagtccgtctcgtcttggggttggactgagtgcgctcgtcctgtgaatctggatcctgggcaccagtcgcgttggtgtagctggagcctggagccggaaaggtgtggccctgatttatctctttgtcgatctcgttttggcggatgggtcgtgcttgaagctgagcggtagatttctccctctaccgcctcgtcgactctctctttgggttctcacgggtgcttgagaccagatatttaggtcgatgaacacaagggcgacgtttggcctactctcatgcgcgcaatcttggtgcctcttgccagtttttgggactccggggggttagatttttttgttcttgtgtccctgatttctttgtagcggcctagcgggtgagttcttgaagagaaagattagattttttttggctccgagacgtagtaattttctgtttgctaattctactgcatgctccgttccgccttctagatcgaccgaggagtaggattctgccctctgtaagcgtccttgtgcaaagtttacgctttcacttaatatgaagttctatttttattttgatctcatccttgttcggggtaaagaccgtaagataagagggcactacatgtttggatggggaggaagagcctctctctcctcctctccttctttttctggccttctgggcgatatagttttctaatgatttttggggcaaggttttgatctgatttgagtgcccaagttcactaaatccactggaacttcgatccaaagttgctctgttgacttcattcactaccctagtgcctaactacctgtgtccacttccaggattcagg

SEQ ID NO: 7794 - DNA, 1318 bp, Zea mays
tcattgttcacttcaatcctccctgaatgggacgtatcacgtgcgtttagccacatcttgcgttaaacaagtgatgattttgatgtttagtatttctctaggcgatagctgaagtcgattaacccatataagtaattaggctggcctaggcgttcacctagtaaagtgaagaatgcagtttcagaaaaaaaaggtgatgtatgatccaaaagaaaaacagactaccgtgtattgcgatagtagatattagcctggccctcctgttatggtgtcgagcaagttgtgttttgcagacaataatttccatatatctttcacatttaacttcatcaaatataattttttttcaactgtttcattgctatggaaactatggtgaaactgtggcattggacacctggtcccagagacaaaaagtacttaactatgcagtggatatcacatcattgccactgatccatgcgttacccaatatcatagcatatcctacatttacttgcagttaacaatttcactttcttgacagttagcagtttggcaattccaccaaactggcctgcacatacattttctatgtttaaagagatgttaacgatcctttgaattcttttataaataaactttataattgtgcaaataggctttcttggccaacttgcaactacatctgccatcaggtttgagcttggaagccacgcttttttgattggattaggtatagagatatatgtcctattcctatatgatggcacaaaaggtagcaaaactagatgtgctgcatggtgcaaccatgatacttttctccatattttagtgcttgtctcacttctgtttatttaatttttctcagagatagtttgatgtgaacttttttgtgtaatagtatattgatgaaattaaggctgatgcgctaaactcgttgtatcattgttattttttctgtcatgatttgaataaaatggtgaactccatgagccactaaatattgcctattagacctcaggcaatggagttttttcatccgtttcccgttgtactaacacagtgtactctgttgattggtatgattgtctgcagaattaccaagcctagcatttttctatataaataaaaaagaacaagttacacattcatgcagtaagtattaaattaaatatcaaagaagcaactattatccaggaaaactggcagttatgtctccatagaagaaattgccctacgtagtccggacattcaaatcaaactcaatcctgtacatttcaatgaaattcatcattatgttatgtaacaggattgcttttcattttcttcagcagaa

SEQ ID NO: 7795 - DNA, 1140 bp, Zea mays
ccatgacccttacaaagttacaatagacataccttgtgtgttttatatagttcaattcggagagtcatatgtggctttctttttttcttttcttttttcttatgggtaggggtggggccgccagcgatttggtttcgggtttcagaagtcaaacggttgacgtggcgccagccacgcacagtcctgcagcacgccaagcattttgctgaaaaccaaacaaactactagtccttctcgcccagggtacatatgagatggggtggtgacagtgaagaattctgatcgaatccaactgttcgtgtcattgactcattgacagtccacaggtgacattagctgttatattgtccatggtttctttcttcgtcgagaaatctcgttccacagaaatttgatggaggggaagccgtttcgttcagttgatccaggagaaaaaaagccacagaaatgaaaaaaagagaaaataagagtgtcttctgcggacaatatgatgaactggtggatggcgtggtgactttttgtctgactcgcaaacgtgaaactgcgcgtgttattggtgttcgtgttcatttggacaaatagcataacatagttttatcgctggtttcattttttcctggttttccctcttccttgcttcgatttttgatatgaataattttttaaaagaatcatccgacagtttatttaaataattatctaaatatagacatcttcttctgttcctgtgttatcgttagacaaagatagaaaaagtaaataacttttcagagtgcaaataagatatagaaaatctattggatgcgagacctacctagccaaccgcttcaaatcaaagttcaaacctacaacaagcagtaaaataaccacacagacgagacggcaacacacacattgagagctctaccgagcgaaagagacccaggaaaagccaacgggacgccaaatccattcctcctccctcgtccacaggctgaggaccgaacaccgaagccaggcagccagccgaggaagccaggcgacaggcgacgccaagtcgagaacaccctaggtggtcgctcgcaggctgcgagtgagagccgtggcggagtcgccgtccttgcccacggaggaggacacggccgccgccgccgcagtggc

SEQ ID NO: 7796 - DNA, 821 bp, Zea mays
ctctctctctctctctctctctctctcccaaactcaccttgcagaatttgaagctgacaagatcgagtcgttctgcacacataaaaacagtcgtaccgtagatgktttctgtttcgatgcacgctttwaaattgtttgttctttatgcgaagtttacgtttcgatgtacctgaattaatttgcgtgctcgtcgatctgcacatgctgttctattttttttcctttcttctttcgaaaacggaagcagcamcagtgcagtggagcgcagcaggaatatatcgaaaagctctccacctatactatactatatgttgatcgatctgtataggaataaaaaacccccattcttctttatttcagaatctagctagctagctggttcctgtgttcgtatcgcattcgcatatatatgctttttggtgccttatttctttctctttggcgagagaatatatatattctttcgtgggcactttgacaagcgaatatgcatatataattgtcctgttatttacatacatatacatatatatatatacacatatatatatatatatatatatattctgaattgtaatagtatggccaaaaatatatacatgtatggttcgaggctgatcgaattcatgcatggggacgacggagagttacgtactgaaacagaaacgcatatatttgcttaattattggtaacgtacgtacgtgtgattaatggttttcatttcggtttctcgtgtgtgtgcgtgccaccagctgcaattaatggttttcatttcttcgttccctttattattttgtatttcaagtggtttgaattgcag

SEQ ID NO: 7797 - DNA, 486 bp, Zea mays
ctaattagagacattccgttctaattactttataaccgaacaacaacataactaggacggaatgactccgttatacttggctcttcaaccaaacattgcctagtgtttttcaatcgtttcctaccgttttggtccttacacgagagagagagagagagagagagagagagagagagagagagagagagagagagaggccactgcatccccgctttgtctccaaaccgactctgcggtgccgattccgtgtcgtggtaccactaccgcctacaggctacagcccaccgcggcaccgctgaagacaccccaaaacctatcccaatcggccgcgcctccgtccgtggctccgcctgccggcgacccctcagatccgcgcgccccgtaccacctcccgccgcctcactgccagatccggccctggctccgcaaaatcctgcgacatcgcagacgagccgggcgggagagcggaggtaggtcacagcagcc

SEQ ID NO: 7798 - DNA, 220 bp, Zea mays
ctgcaggaggatatccaccttgagttgggtagccacccggctgagggtacccatattgtggtgggtatgcgccgggtggaggaggatacgcccctgggggaggtgggtatgctcctggttgcggtgggtagccctgcggagggtatccctgcggggggtacccatggccaccggcaacgccgtgcatcaagtttgagaagagccccttgtcgctctcgtc

SEQ ID NO: 7799 - DNA, 750 bp, Zea mays
catagcagtttgagaacaagtccccttcaacactagtcatttatgagaaaatattggatctagttaagaatcattggcctttgcaccaggcaggtcagctgggaaaataggttgcaccatgaaataaaacttaggattgttagttttgcattgtcttctgacaattgtacaacctatttgaattttttgccagtcattgagtatcatattagttgacataatagtgtgttaacttccacattgataatgccatatttcaccctgcggccatgttctacctagcaaatttcatcatctttctccgatatacagattcccagaagaacctgctgaacatctgacttttcagaagtgatagttatgaaatgattagaaaattagctgatgccatcaactataaaaataaacaaatcgatagtttttcactttttgcatgagctggtgcayatttattgtttttaagaagaggccattactaccccttttctttttggaccattgattcaaactggatcatatgttgcaatgctttctacatgtctctgtatccatgaccagcttgcatcttgttcctttgtcatggtttctttgcttaggcctgttttgggccaatcagtgtgaaaacagaagggttatatctgtaattgcttgatcttctcaactttgatcatcattagtacttagtagatgtttatactattggatatataattgcatactgataaaaaatgatgttaaaattgaaggtcg

SEQ ID NO: 7800 - DNA, 245 bp, Zea mays
cctccccactgctcaaagcttgtgatgagtgatgcctgatgacagctttactcctccctaatctgatattgatgcttgctttgctgggtgagcttggctggttgcatcacactgcacttataatatttatgattagtcacctcgctccctgcagttcaagctttggattcccggatcccacaccaccggtctctctcggggagtgtaatccagcgagcgttgagttgaaagccgcgcaagtggag

SEQ ID NO: 7801 - DNA, 1500 bp, Zea mays
acggcccctcggcgcttcttccgtttgtctgagtcgcagaagcctgtgaatacgatgaccagtttctgcagggtccggttccggatacagctggtaggattttctgtaagatgcatgttccagctcgtcaaaaatgcttgaatcttggtgtacatgcttcaatcaacagtttttttttcttccttcctaaaaagggaattgctaatgatggtgctatgttcgcctgccaattttaccggagcacatgcaagcagagcacaggtcgccaaatcaccgcatcgaatccagcccacaggccagtgaatggatagacatgggcatggcccatgggtcatactcacgtcctattaattcagcacgcagtgtacaaatacaaatacagaatcgcgcaaattctacaccctcgcctgtactgtacattagcagtgtttcatactattttctttaccgtgtgcatcgaatgtcgctgctgtacccagcacaggcagcaggtagatcgattgggcaggggcagggcccgcaggggaaaacccggaccagaatccaccgcccacgatccacgatcaggctgctcggccgctcgcagccgcagagccggttgactcgaacacaggccagagcggcagcctggttgaccctcctccccaatgctcccccgtccgctcgctatgcccgcccatccatccccacacgcgcggagcacggatgcacctgcgcgcaccaccacatcgctgcctgccacggcgctgccttcgcgactcgattcggcggccccagaagtaatagtagaaccgcagcgccggcgccgtcagatcccagaaatccaaacaccagcgggttcttcggcgtctggcagcaaatcgcggacagcggataggaaggaagcaaaactaaccctttccattcaaagccccgagaatttcaaaaacattaacagcttcctccttcctctccgcaaaacaaaaaccccgcaatacttacaatacaagcaccggcttcgtccatcctctcctccccactcctctctctctcttccccagctccggccgtcgcgtccggcgtgtatactgctacctctgcgctcgccggcgccaccgtggccgcaggcgagctcgagaggtgcggaatttgggcgctgctcgtgctggtttcgaaccggagggaggagtaataattgggagacagttggaggagtgtaactttgggcattaatgccggggtggtgagagagagaccctcaagtgaggccgggccggggtggtgagagagagaccctcaagtgaggccgttctggtggtggcgccctgtagctagtaggagagtacgtactacctccgtagctcggcctctgcccccattcgccgtcgctgcttttaatttccctccggattccagcgcttccttccgcctctcctccccaatcccatcgacacctgtaacgcaagtgcacatgggggacggcggcggcggtatcggcaggaggccctcgacctcgaggcg

SEQ ID NO: 7802 - DNA, 1500 bp, Zea mays
atttcgctgcactaaatatatatatacagacaacagcgggaacgtaacggatttcttattcatcagtttatatatactgaagttgcgctgctgcgccttaccagttctcggagacacagacacgcggagagaaaaaggagaggccataaaccaaaaggctgtaagaatatatgtaaagatgactaaatggctatatatgggtaagcaagataacaggcactcgccatcagtagtagtggcattttgcccctgctgtgccatctctctctcgctctcgctcctctcctctttttctctcctgctcagccttgcttcccgtcccatcctttctttcccttgggcgcattcagcagcttcagcctggccggccggcctgctattaaaccactttgcttgcaagtccaagaaactgctagagaggaacaaggtagagtagcatctcttttctatctaggttatctctttacatgctaaatttcagccgtatttctttctggatcagttctgtatacttctgtgatacacatcttgcgatgcggcttgtagtagtttctgctagctgagcgagatcgatctcgtttgtactttctccctttgaggaaacaactccccttttctgtgcttcaagttgttgtaaggaaaaccatgccgactagcttctctgctgactgctacttggataatatgcttcttatttgtttatcacactcgatttccctttttcctgctttctatatgtatgtgtatccatgggctgcgtttccctgcgttactaatatttgattcttttcttctaatgagatttttccagttctcgtctgcttcttgcttaatttgccataatctaattaacttgaccccagattatattcttggctacctacaatgttctaaagattctttgctagattttgttgcttcttttcgcatctgatcctttatctgcatccaatcgatccacaagtgttcttccagttgaaggagttggacgaagatgagctttctgtttagggaaaaaacaagcagctccttattattgttcatcccatttgctgggtttacgttgtttagtttcctttctgttttagcttattttcttccatctagctttgcgccgaatgaacgaactcgtaaatcttgtgttcctgtgtggctgctttcgttagatctctcggctatgtctatatgatcgtcttggccagcatctctgggttcttttcgcggccgagaggaaacttactaactgatcgagtgtgccaggcatcaatctgtcgaatcgtgactcgtcgctttttcatgtcttcagattttgtccatctgtcaaatcatgtggaaaaattggcatatcttcttgtattctcttctgtcctttttaatgcctccagcggattaatttctagctagttccgttccattgatctgccttcagataatataacttaaattctcgctttcttatgcaagaactaaattacttgcatttcagctgagatctccagc

SEQ ID NO: 7803 - DNA, 250 bp, Zea mays
ttgcatgcctgcaggttgagttttttttttaaaaaagaaatcttgtgttttcctggctgacagtaatgaccatataaagttctaaacctgccttttgcattcttcacggttgttgtactgtgcaaaaaataccatgctgttgaaatatgcatgattttttcaagggaaatttggatccataccattaaaagatcaccactttggatccataccattactatctcacttacatgtgagtccgcatgagtca

SEQ ID NO: 7804 - DNA, 205 bp, Zea mays
accagaaacgaagtcgggctgtggacatatattttggttatggaggcggtagcgttaggctcctatctagctattgttatcctggaccgctggcgattgggactttgttttaagtttatcttgaagaagcatgtcgaattatgtacagcagcagcaggtctctgtctgactgatgctttacgtttccgtgacgctttgactctta

SEQ ID NO: 7805 - DNA, 122 bp, Zea mays
tggaagggcttcatcccagatttacacaaataatcgaccttcctggtacagtgagaagacgatggaatttgtgtgtttttgccttgtaatgggcatcatattgctttttcacatgttggtaa

SEQ ID NO: 7806 - DNA, 481 bp, Zea mays
cacacaaacttcgtttttttcgcaaaaaaaggatttatcgcatgcacatcatatgtccaccgatgtcctgtactggatcctcccctgcatttgaataggtgaccttgagctctctcctgaatatcggtgtgctcccacgcagaacacagaaactgggagactgaaaagtgggtggggggttcgtatgaaagggacacatttctggcacaagttattatgttttctatttgtgtaaatgggataccttaaaaacttgtaaaatggccactctaatcccgaatggcacctactgcctttgtaaatctatgtactcgatcccatttaaactatcatgtatccatgtttatgatgcttattgtatcagcgtgcttcattcagagtggactgtgaaagtttttcatcaagtctcatttagtactgattgatactagtttgttatgtttcaggaggagagcatcacactcatctaactgatattagg

SEQ ID NO: 7807 - DNA, 1500 bp, Zea mays
agtgccacttgtgtgagccccagtacttctgctggctaccttgctatatatgtagtaatgcagacgcagtagtctgtggagtggtccagtgggtcaccttccgattcaaccgcacgagctagaacgcgaggaggtgtaccttttcgggcgttaatcactataacaaaaaccggcggtgtcctctacagaggcgcggacggtccgcggctagggaccgaacggcagaggcgggcccaattgaattcaaaggtattcaaatgaatacccattatttttggcaaaataacttcaatatatatacatgtatatagtgtatatgtatggaaaataaaaaatgaatcaaataaataaaggaattctgttaatttggactaaaatatctccttcatacctttcatatctaactaatccaataatttgtcgtgtaccatgaagcccaacgaagcgacaaagcccacttcagtacctcacgacaaaaaaatcccccaaaccctattgtagtcgcaccatgacagagccaccagatgcgccagccaccaagtcgtggtcacaccttgcagccccgcgtgccatggagacaccagcacctccgttgagacatcgtggctccgcggcgcaactaggtgcctagacttgaccgactaactgtcattgtgtgtccgtcgtccgaggcttcaatccaccgtagtcagagcgttaccgtatgctaggacaaacaaccaggggcaaggtctcatcgtgccaatgtccaaacctacctagctagtggtcacccgacctgacctcccctactttactgcttgcagtactaggctgcatatggagcattagtgattagaaaatgccaaagaacacaagtagcccgctaacaaatgagcaaccaccaacatatacatttcgatttaaaacttttaaaatagttgtatgaaatttgagtttagtagactagttattgaatcagttatgaccatagtgtgtgtttaatcatatgctatacatatatataattaaatatatatgtcgatatatatgttttaatcttctaaaaatcatcctataaaaaattttgaatacccacctctaaattctaggccagccactgtatgtccttgattacatcagcttgctaaaacatccatggaaaataggggaaacagtattcacgaccattctagttcacactcaattcggtcgttttctgcattaacggagtcaggcccaggcctaacctcagttcatccgagcagccgaacacgcccgccgccattctacgccctgctgcccaggtcggacggaccctttgccggagacgagcacacgccacagcaggtatgcccgcccctcttctgtgcaaaactgagcacccgaacccaatttaagctgttctgtattcggatctgatctaatcactagtgtaatcgtatgcatgtattatgcctactaacttccctttttggcaaggaattatcgggcatagagcagagcgaagcgagagatcca

SEQ ID NO: 7808 - DNA, 1500 bp, Zea mays
ttcattctaatagaaatttaacttgtagcaaacatttgaatattatagtgttacacaattagtaataagcattacatgagtcatctaacataagcaactgcataatataacatggcgtatcagttgaatatatttaagtaccgtcttgttttgacattctgtgtgctatatatgcaatgttgccatttctggtattctaaacaaatagctcctttatcttttaccctagctcctatgcaatattgcacttttagttcagtatttttttgctgaaaaacatgatgctaattcaaattgtatctgcagttcacatataattttagaaatgaacaatgccatcatgaaaaactacacataaagttatctgtgttttaacaagggggggggcgacaatatgcatgttggtaaccaatacatcattagcaacaatgcacgcattacatgtattatctactcaggaaactactgtaccaagcagctggctggctgatcattcatactgataacaacacaacctgaaacggatgactcttcacagcaatattgtaaagcagaaatcacttcaaaagtaacatgatccttaaaatgtttcctatgtcatcatcatgatgttttgaggtaacatgcatgtattaatgttgatcagaactttgaaaaaaatcgccccccccccccccccttgttaaaacacagataactttatgtgtagtttttcatgatggcattgttcatttctaaaattatatgtgaactgcagatacaatttgaattagcatcatgtttttcagcaaaaaaatactgaactaaaagtgcaatattgcataggagctagggtaaaagataaaggagctatttgtttagaataccagaaatggcaacattgcatatatagcacacagaatgtcaaaacaagacggtacttaaatatattcaactgatacgccatgttatattatgcagttgcttatgttagatgactcatgtaatgcttattactaattgtgtaacactataatattcaaatgtttgctacaagttaaatttctattagaatgaaagacaatattgttgaagtggacgcactaaccagttcaatccaaaagcttaagctgatggaagaaggtagtcaattcacttatacacttcaacacctccactcacgtgcagccagagagaaaaacgcaaacgtggaaataaatgggtggaggcacaaataaagcctctgtcatgattcgaactcgagacctctggctttgataccatgttagagtggacgtactaaccaattcaacccaaaagcttaagttgatgggagaagttagccaattcaacctatacacttcaacaagtatcatctaccaaactgtgatcaacattcaacaggtcgacaaaatgtttgtatgaatgctaaacttacaagtaacttttatggagagtagagaaaatattcagatagataatgaacttctgatttaccaactcagtagtctgcagagggga

SEQ ID NO: 7809 - DNA, 798 bp, Zea mays
gcgcacgcggcgctgtccttctgtcagactggccagtggagcagtggagtgacggcggtcacttcggctctgccgggggcgcgtgtcaggatagaggtgtcaggccacctttgcgttaaatgcccccgcaatttggtcagtcggtgcggcgatttagtcaaggttgcttctgagcgaagccaaggcctcgggcaagccggtgatgtgtccgccataaaaagggggcctcgggcgagacggaagtctctcgaggtcggctgcctttggccgaggctaggctcgggtgaagcgtgatcgagtcactcgtgtggactgatccctgacttaatcgtacccatcaggcctttgcagctttatgctgatgggggttaccagctgagaattaggcgtcttgagggtacccctaattatggtccccgacaatatggattggaggggattgatatggattgagagggactggggattgaaactgactcaatcccctttaggccctgttcggttgttccggattggagtcccggattaattactagccggattacttcactaatttatatagatttcgatgagctggaatgaatcctggcttattacggtacaaccgaacaggcccttaatccatatggattgggttgaaccaaacaagcccttagttagtttttgcaaagcctcgccccttcggctcttcgcatcttccctcgactcccgtctcccgtccgcatagtgccggccctaggctacccttgaactccacccaattcgccgctccctctcgccgaactcgacgtaacccca

SEQ ID NO: 7810 - DNA, 487 bp, Zea mays
aagacccatgatgttttgtgtcattattgtagtcaattgtaaaggacataaatgtaattttacacaggctgcgccctgtgcctataaataggtgaatagtacccctgcactgttcacgcaatcttgtaactgktagcatattacgctggaattattgctttctgccaagacgaaggtataaatgcacctaaatattatgttttaatatttagcttcatataataaaatatgtgaataatgttatctatttttaatacatctttctataatgtttcatgtctgatcacgaagatgtgaccttcgtggtattttgctcatggtcttcgtccgaagctcattaaatccttggggagataatgcttcagcggacgaagggcattaatatttaacattttatgttgccttgttcttaattcatagcatttgagaacaagtccccaacattggtgcccacctccggtgaactcacttccacttttttgagctg

SEQ ID NO: 7811 - DNA, 296 bp, Zea mays
cgatccatctcaggctagagagcccaaggtgttcggagatacgcccgttccaactttcttgacgcctactgcaaggcagtgcttgcaccgagccgaaagatcgccatcgtttgccaagtaaaaatcttggagtaaaagaaatggaaagaaacaaaattactggcccttgcctgtcactctctagcacagtcagctcagatgctaaattaatcgaacatttgggtatataagccgaccatacctgatgcaaaatccctccctttccccatctcaagctactcctggttaacgtgcaa

SEQ ID NO: 7812 - DNA, 386 bp, Zea mays
ggtcagtgcaacgttgtcaggctattatcagttattatagatataatgtgtcgggtaccagattatattaaagtatggatggaatgtttgtttcgtagttctgggcttaatcagtagagctgattctttattgcctccattgcaaaagatgttgaacccacattggtcaaagaattccttgcatatgaccaatcaccaaataccactgacactagttatatttggtcagttacattttttttacacgacctcttaataatttacccttatttaattgaacttctccttttctgtttgcagagtaatggattaatgcattaagcaaggtaatgaaatgtaccaaaagtgacttatggaaaagaaacagagcttgttcactgctctga

SEQ ID NO: 7813 - DNA, 594 bp, Zea mays
tgttctactagttagatgctcgtgtattactatgatttttatatatacacgagtagattttgttttaataaaatcaaaaatataaaagttctgttagttaggtaaatgtgaacgtggagcagataatcaatgttcaaaacctcacctgtacacaagtttactttatttttttataaattggcgcgaccgtggaaacaaaaaaaaatcggtgatttgtgtaatagaagaattctccaatttgggatatacgctgattaaaccagtccagcgcaacacccaaaactcactcgccagattctctctcgctcatcatcggccgcaggcagcagcttgagagggcggagaggatatcatggcacggcagcgccagcggtagcagcaacgcagacacacagatgtgctgtgtgagagacaagagagagaaaggagtggagagagaagggcaggaaagcttagaagaagagagatccacctcgaagtaacccctccctccctccctcctcgcttgctcctgctggagtggagtcgagcctgctgctgccgctacctcctccccggcgccaggagagggagaggcgaggagaagccgcggcc

SEQ ID NO: 7814 - DNA, 52 bp, Zea mays
atgccttagcaaacttatgtgggtaacaacactgatcttgatgatgaaccag

SEQ ID NO: 7815 - DNA, 150 bp, Zea mays
cgtaagtgatgctgttgtcacggagttcagtaggacacagaaggctggtgtactacagtcatatgcattcgtagccctggctgcaggatccttgctggggaacttgtctggtggttacattctctgcttaaaacacaggaaccaaagatc

SEQ ID NO: 7816 - DNA, 538 bp, Zea mays
gagaaagtttgaataagggggagaaagtttgaataaggtcttatatttcactcacaagtatccgtttttggcgattcatgccaaagggggagaaagtattagcccaaagcaaaaggaccgcaccaccaccaatttcaaaaataaagtctttcaaatttgtgttaagagaagattttttcaattggtatcctatttttgataagttttcaaattggtataccctcttcaaaattaatatctaagaaccctcttgaacactaagaggaggatttcattaagggggagttttgtttagtcaaaggaaaagcatttgaaacagggggagaaaattttaaatcttgaaaatgcttctcaaaatcttattcatatacctttgactatttgcaaaagatttttaaaaaaagaatttccaaaacattgcaaaacaaaacaagtggtacaagcgtggtccaaaattttaattaagaagaaagccatccatgcatgtctagtagaaataattattggtttcattctaagcaacctttgcacttacatt

SEQ ID NO: 7817 - DNA, 673 bp, Zea mays
ttgtctaataataataagtgaacaatataatagattctatttttattcatattccttttcaactgtgttacttttacagacatcaatcagtcttggcacgacttgcaaactgggaagctattacatcggtaagatagcattgttggtctatttttaaatagtcatgcaatccctatcatgtttatgtgttactggtttgattaaaaaacaacagatgtagtccatttaataagcagtttgactatatttcaatgaattagccggttatatgacatattgtgcttacccccttttttctttcatcagtcacactctatccgggaattcgaccgccatgccacttgtgttgttgcaaaatacgaggtattctttctaatgctaaaacctgcaccaccttcttttgcacaatcagaaaagtattcatattttagattgtctagaagtattggttacagtttcactgctctctttgctcatcagtggtaactttattttaagcaaaaccacaattgatccaagcagaaatggactcacccccaccccaacccccgtgccccacttcatccatggactactctttccattagaatgaactgatacagatacagtagagtgtgtccagccaaaacatattctttttttaccaaaatgttgcctaaaatatgtagcttac

SEQ ID NO: 7818 - DNA, 726 bp, Zea mays
aaacagtatagacagagtgccttgatagcatttcagcttctgacaacgatgacaaggaactaaatgtcattgatgatgatgcatctaatctcgtgagcagaaataatctacaagatcaagggtactcactggaagaaaaaatatatcatgatttttccttaaattctgaagacgagacaagcacaaacagaccaaaagttgcatctattttttatatatgtatagagatgcatccggcttccattaccctacctaaagggtcttcagaaaaggcagaactagaaacaacaaacatccctgatgacaattcagctgctatgactgatggagttgcctcatgtattggtaactgagttgtcctccctctagctttaaggcagcatatgtgtttcgtgtttcaagaacttcgatctaaccatcatgaattggatggagaagctttgtgttgttcaagttttcagaaggagatccaatggcagtcgttcgagtgaagaaccaattatttgtttcaaggatagaattgagattctaacagtctggcatttaattccaactgagtgaaaactaattcagacaacaacaattgtcatctcaattggaattacaaatgcctgatgtccagatgctacctcataggctcagagccagtaaacagtggatacaagagggacctggaccttttatggacatggatggtggatgctcacacatagaggttaagcaaca

SEQ ID NO: 7819 - DNA, 1500 bp, Zea mays
aactttaatccaaatattaaactatgactatctccttccatcactacttatacttataaatgcaatcaaacaccacttaaggttcaagttcgactgatgaaaaccagaaatataaaaaaacctcaaaagccctatccgaaaattcggtaaagccgaactcccagcctgacctggagtgagtcgagcagaagcagagtttgcagtctgagaagacccctgtgctgtccagccaacttttccacctcagtcttggatgccccccctccgccgtctagatctccccaactcctccgtcctcttgcttcctgtcgtcgacctcggtggccgccgcgagctgcgggtggttcatcgccgtcgacctcgcctctccgctccttctgcactgcctgttaccggcttcctggtggtcgaccggtgcggcgcgggtcgtcagtgaagctccgactatccggattgactcggatcgacctctcctctcgtgggtaagcgactcgagctttgcctcagttggaggttggagttcgctgctcgccttgtccttggcgaccttcctgtcccgtctgcgctgcgagcgttaaaattcgattttttttttctaacccggttacctgtggactcttgagctgcgtggtgtcctagttatggagtcgagaatccatctaaaatcttgcctagggtcttcagcgcctcaagcaaggttgcggccatgccattttggagtccatctggcgatattagctggcaaggtttagggagggttttgtgctgtgctgtggaaaatttgatgagcggctgcgtggacatgtgacaagtacgtggaaatagacagtgaagagaatttagcttaaaattggtacaggccatgaaccagggagcataagggaaaaaaagagagataaggcagacagagcttgtatttcgtattatccctaataacttgagttcatttatgggtagaaactggcaagttccaggtaaaaagtcaactgtcctgctttattttgtaacctagaacgacttgtagaatctcctacttgttaactagagcgttggtttgattaaaatgtgtagttgtttttcatttttgggtaacaagtatatatatagtttttccccattttttttatttgtaagcacctccatcaatatttatttttactttgtatatgttttaatattctgtcctttagtatgcacatgtagttttaaactttggattcaacctagtgcaatatcaagcagtttctgaactgttgtttgtcttcgaaatagtttaatcttctatatatacatgtctttttgttatacaatatggattgttggtcaagacacaaaaaaatggtacttttggctgaaagcctgaaggttaaactaaaatttcctttttccctgtgttgtccaggtttttggattttgatcagttatatcagaggagtgcttatggatgatttcatggctgtagcttgctaggccctgctttcctgtttgtacagatacatc

SEQ ID NO: 7820 - DNA, 243 bp, Zea mays
caccaaaccaccacgcatcattggatagcccttggcccttccagcgggtcagcacttgctcgtgaccgtgtgatccataacttgtttgaccatgtagtgtagcccgtttaatacgaggcctggcctaccacctgcgacaaaccagtcaccgcctaccaccgttttataatccacccctcccactccccctgttttttcttcttccgctgttctactccggcgtgttggtcgacggcggcgcag

SEQ ID NO: 7821 - DNA, 430 bp, Zea mays
aaaccctacaccctccgtggtccgtctgtgtcttcatcacgccacaagccgcatccatctgcccacggcccacctcatatggggagaccataaactggcagttagctaggacactgccgccgatcactccgattgttccccttttgtttcataaatcatgagccaatgagtcatgcctgtgttcatgcaattgaagctagcagtcatttctggcggtgggtacaaaattgaaggtgctagctgttgcggggaggacttcctcttcctcaccctcacatggccggtgcagtgggggcagatcgcagacgtgtgaggcaatggaacaatcttgaggcgagacgtgagagcagttccagttccagttccagagagcaatgagtggccaccgggcctctgctccttcattcttggagtagtgcgtcttgcgcag

SEQ ID NO: 7822 - DNA, 377 bp, Zea mays
acactctgttggcagtttataagcagctcctttccccacaaccatattataaaacccctggtggagccactactctttcctccccaaatctcccaccccctgtagaaaaatgtgtatgaaatggaatatcactgttgaaactagtcaatgtagtggaatgcttgcccatttccccgtccttatattttattcccacatcaagcttgcttattcttcttcccctccctagtattattctcatcacgttcgtgtcttctttcctccaggttcctactcccaccacacacctcattccaatcctatgctggtggtgtagagacagacagagagagccgggagagaaaagagaagaggaccaaatctgagaggtggaagcc

SEQ ID NO: 7823 - DNA, 1021 bp, Zea mays
tgttctgcgctgctcgtcgtcgtcgtcctcgtcctcggatgggggctgtcctgctcctgcggacgccttttgcagctgtaggggcgtcggactagtggctttacacgcacgtactagttagtacctgcgacatgagggcgcctccaccgcccattccaagccccacttttttctcccttcctttgaagaaagaatccagtcatccactcaggttcgttcccaattccatgcgtgcccgtgcgtttgctgcaccaaagccaaaccgagcgatcgagctcctgacgcgtgccgggaacagcagcctctcatgcgttgcgccgggtccggtccatgcggaatcagcatagagctgtgaagtgaagtctataggcatttttttttgcatgaagtttgctttagtttagtttaggctaatccctcgtagcacaaattctggaagagcttaaataaatatatatacgcgcgggccttatccggcccagtggtcaccacgtggtgggccaccaaacctgaccgctaccgcgcctcattcgtttgaccggggtcagcgccggccatgtggtccacctcaccagcgcgataattcactcgcgaaaccgcgggatcagcgagtgagggttttagttttaccgagaggggagaggggagaggggaacggggaacacgattttgattttgactagcgaggaagagctccatgtcaatgtgactcatccccgcattataatacggtggaggagaggggaggcggggaaaaagcatgcgaattattcgaggcggctttatggtcggacggatcacccccagcaaggagccgccacccgccactccgccagagcattgcagcgccagccacctcgccccctctcgctgtcccgcaccacccgctccgagggaaggagaggtaaccggtggcgggcgcggcggcgagcggagatcccgggaactccgatcgagcgcaagcggcgggacctgcgggagcagagagcgcgcagggaggagaagtgagtagcgtggttcg

SEQ ID NO: 7824 - DNA, 519 bp, Zea mays
ggtgtgtgtgcgacgcggggggtggcgggatgaccggaggggatgggcgagggaggggcggggatgatgcggcgcccgtggcggcggacgagagcgggggcagaggcaccgcgagcgaaggtgtggttcagcggcggcacggtgaaggctgtgaatccccctggccgcgggcatcgcagggacggggacggggcaagcatcgacgcatggggtggttgcgcgggccgatgatggcgggcggcgatagatagtgcgatgatggtgggcggcgatggagggttcctggaattgcgcggccaagagcgaggcaaggggaggatgtcggaggcaggcagaaccgtgcgccaggccaatgtgcccacagctcaggaatccccacagctcacacaggcacacagctcctcttggcggcgcctctgacttctcctttttcgtcgcccttctcctttttcgtcgccttcgatcggcggccgcctccttcctccacttccgtcccttcaccgagccgccgccgccact

SEQ ID NO: 7825 - DNA, 1256 bp, Zea mays
gtggggggccaggatagtcctagccaatttctataatatgcaattaagtaaatacacaatatggtatacaagttaaaaaaaaataccatgaaattcagtattcaaacatatataatataatgaaaagcatgttatatataaggtctaataacatctcaataaaaataagttcaaaagttgtataatttgttgtaaatagttctaaaataatgtgctgatcagtggtacacagtgcatttcctgaaaagagatacataaaaaaggcttactatgacatttcatgattctaacgattaacgaacctaattactttaatggtcattgggactcatcaaataggctataaaagttaccaagcactgaacaagcagagcagatgattgaaaagtacctgccctttgtttctacagggcgaaagaatgaacttcggcgcacgagcttgaggctccgccgtcgagtttcagagcttcttgctcgcgatgggcgccagcgcaaccagggtcttcttcacagggcgtcggcggggcctggagtaggcacggcggccgtcagctgaacttggagaaagcgcggcggggcagtctccgctagtggcggcggatgcggcggtctggcactttaaaggttctgtttgtttgtctgatgccctccatttgggtactgactcccagtaccagcccggtacccgaacgtcaaaaagaaccgaaattagcccagcccaaaagcttcaactcgcccagagcatgccgccagcgctgcgccgcgccggccacctcccagtgcagtcggccgcgagatccaccacgcggttgtgtgcttacagggtttcttcaactccggtgagcctagttcgagtccgcggttgtgtgcttaaaggtgaatggagattgtattgtttatttggaaaataacacacatgaaaaacacgatcatatttgagctatctttatattctattcagatatgatcatcaatcggcagcatgtttgcctggaagttagaacgacagaatattgtggagacgtgcaacaatactcaagcaatagaacagaatgggagctagaatctagctagggtagggtagtaggtatccatgccaacgttttctgatttttttctttatttgaggtcttcagttctcctgatcttatcttactcgtgtattccagacagacaggtacaggcgtacaaccaggagagtgggagaggcacaaaagcagggctccaatttctttttttcgatcgagaccagatac

SEQ ID NO: 7826 - DNA, 1301 bp, Zea mays
ggagcttcgagcttgcttcaaaacttttcagaagaagcatgtatctggtctcgatcgaaaaaaagaaattggagccctgcttttgtgcctctcccactctcctggttgtacgcctgtacctgtctgtctggaatacacgagtaagataagatcaggagaactgaagacctcaaataaagaaaaaaatcagaaaacgttggcatggatacctactaccctaccctagctagattctagctcccattctgttctattgcttgagtattgttgcacgtctccacaatattctgtcgttctaacttccaggcaaacatgctgccgattgatgatcatatctgaatagaatataaagatagctcaaatatgatcgtgtttttcatgtgtgttattttccaaataaacaatacaatctccattcacctttaagcacacaaccgcggactcgaactaggctcaccggagttgaagaaaccctgtaagcacacaaccgcgtggtggatctcgcggccgactgcactgggaggtggccggcgcggcgcagcgctggcggcatgctctgggcgagttgaagcttttgggctgggctaatttcggttctttttgacgttcgggtaccgggctggtactgggagtcagtacccaaatggagggcatcagacaaacaaacagaacctttaaagtgccagaccgccgcatccgccgccactagcggagactgccccgccgcgctttctccaagttcagctgacggccgccgtgcctactccaggccccgccgacgccctgtgaagaagaccctggttgcgctggcgcccatcgcgagcaagaagctctgaaactcgacggcggagcctcaagctcgtgcgccgaagttcattctttcgccctgtagaaacaaagggcaggtacttttcaatcatctgctctgcttgttcagtgcttggtaacttttatagcctatttgatgagtcccaatgaccattaaagtaattaggttcgttaatcgttagaatcatgaaatgtcatagtaagccttttttatgtatctcttttcaggaaatgcactgtgtaccactgatcagcacattattttagaactatttacaacaaattatacaacttttgaacttatttttattgagatgttattagaccttatatataacatgcttttcattatattatatatgtttgaatactgaatttcatggtatttttttttaacttgtataccatattgtgtatttacttaattgcatattatagaaattggctaggactatcctggccccccactggcc

SEQ ID NO: 7827 - DNA, 991 bp, Zea mays
ctgttggggacttgttctcaaatgctatgagttaagaacaaggcaacacagagaatgttaaacgttaaagtccttcgtccttcgaagcattatatcccttttgagaaataatgtttttcggacgaaggttgagaaggacgtaccttcgtcaaagcaacatatgaacgaggaaaagaaaacatatgaggtataaaagataatatcaacagtcatttattatcatcaactcatttttattttattattaaggaaaaataggaatgttaacaaattacaaaagtaccttcgacttgaaagaaagtgaaaatacaagcgtgacgcaaaggcaaagatgtccagtcaacgtgggagtactgttcatctatttataggcacgggtcgcagctcatgtaaaattacatccaaactctttgcatttgctaataactctatagtaattcatcggggtctagatagccttttcccctttaagtcagtttccttttttcctgtcatcatgccgaagctcccttgcgcacaacttcggctctgttccatccttcgtttcccttgtgcttcttcacattgtgattttgactcaagtccgaagggtccaagtccgaagatacatgctcatgtattatactccagaaacattgttaaatcacgtttttgtggaccttaggaagccgaaggcccccaactgtagcccctcgcaatattaatttgttagaatgataaattcagattgcgatatggacgaaggccttaagccgaaggtccgaaaaaacaccttctctttgctagaatagcaacagtcaatgacaagcggggccctcccacttgcaacgtactgggcgtataaataagagcgcaccgcgagcacatttggcacgctttcttgccatctgctcttgctttcccaatttttagctcttgcataccaacgcttgcctggctttttagattttttagcttcggccttaagagcacgttttcaacatttccgaag

SEQ ID NO: 7828 - DNA, 1500 bp, Zea mays
accctacgtcctggtgagtatatgagcgtggttacaagagggttctccggatagaggacgcggagagtttatgtgggtggctaagtagaacagggtcgatcgttctgaaggggtgccccctaggccttatatactcgaccgtggggcagtacacatgagtatgataacaacaagtagctaaaagatagtgaacctcttgagtttatccctacgtaacccttgccgacttatcctcgcatggctctgttgcatgggggcttcagcgcgggaaagtcgggtctctgttgcgattcattcgttcgacgttgtgggccgtctgggtttgcactaatcagtctcacgtcttcttttctttgttggttgtctttccctaggcccacgaaagaatgaccttacgaattattgggcccttgggcctttcgtgaggccttttacttctttagtggacccaggggatatctatcccccacaagcccccgatctttgggttgatttagaggtaatcaactcaaagatccaaggtccaaaaaatgacttcctgctgtcttctctggctctgatcactcgttcgaccaaagtttggttttgtgcttgtgccttagaggtcggcattttggattgtaagactctggacttcattgggtgcaccggaggtgcacccaatgggtgtagcccccgacctttgagtagattttagaagataatctactcgagggtcttcttccaaaggttatctccattcgcactcctgcatctcggttgaggattggtcttttcaatcttgctctacgccttagaagtcggcgctatatcggtttagaataatactccatggggtgcaccggaggtgcacccaatgggtgtagcccccgaccttcaaatggattttttaaggataatccattcgaaggtcttccttttgcgtctctttgctaaaaattatcctttctggtttgtggaaatcggcatgaagctattcgcattatgctttggaggtcagcattatgtcatcaatattttgcttcagaggtcagcatgtattttatctttagcagccgagttcgcaatccatccatatcttgctaggtagtgcaatttatttgctctgtgactgattggacgtctgatggacgttctctgtctagtcttcacatcgcttctgtcggccatattttgtacttcactggctatatttggctttcctctgatccttactggtatctcatttttgtcttgaggtattcactgcgtgccctgcacagatgtgaccgttttgaaaaatatactgataattccttggcgtcccccccaatgggtgtgggcaagggacggcttggtgcgctgagtgttttagccgactgcttctgagtagtaatgtgatgtgacggcgggtgtaatcatatcctccgcgctgttgactggagtcccaatgggtgttgtgttgcgtgaaacggcgtcagccgcctgacgtgtcttcagacgggttgaagtgcttattga

SEQ ID NO: 7829 - DNA, 262 bp, Zea mays
ggttttaaagatctatcaagtctagcttcatcaaattacatccgaagcaatcataagaatgagaatcttcgtctgggccgtgaggagccagggcttggagccaaatgcaaaaagcttctgcaatatgcattaactgttatatgagacgaaaccctagggcaaagagcaatatgataacaattttggctgctatagcttcgtcgctcgttttggctcgagctgtcccgtgccaaccttccagaaaagatggcctggagactgg

SEQ ID NO: 7830 - DNA, 651 bp, Zea mays
caccccctcagtcagacggcatgaagcacgcagcccaggcccacgccggcgcgcccgttccagcttcagcctccagcatggcagcatccacgtccacggccacgagcgcgcagcgtttccgcgcaccacacccacacgttccgagccccgtccaccgacccgcggacgcctcgccaccgtccgcgcccgccgcccggggcccggccgaaaggcgtagcagagggcaaagcaaagccgtggatgccgtaggcccgttgcagtccattcacgtcccccgccgccgcccggctcggtccccaccgaccgccgcaaaatcccggcgaaaagccgtcaccagacagcaaaatacacaaggcgccaaaaccctcaccataaccgcccagccggccgccccgaacacgcatccccgtacggcgtctccccgcactcagtggccgtctcgggctcccgtcgattcactttgctcccaaccgctcttttttctactccactgtgtgcgcctttgcctctttgcgctctcacctgcccgcccgtcccgcctgcctcgccgcaagcgccaagcgcacgcgctcggctcgccgcgtcggggtcgccgcagggcgaacgaaaccctaggatcagggaggctccgggcatcgctgctcgaccccc

SEQ ID NO: 7831 - DNA, 1291 bp, Zea mays
cgtaagccttcggtacagcttctctcgtaagccttcggaacagccggaacaaccgtttttttatttatatttttatacgagacgtcggattataatcggaggggtgaaaaaatatgtgtgacgtggatagcacgattgcgcgtttagggtcagctggttaatatagtaaataaatactttacgtttgtactctcttcatctcttatgtaatactagctgcagcacacatatcacacatgtggttttgtgtatttattataatgttgtctgctcgaccttttcggtggccgcgccgtgcttgtgtatgcatatatgattatacaatgatgaccaaagcagctagctagctaaggttcgtttagaaacttagaattggaagtgtgagaggaagtggagctgcttgaagatggggctgagtgcttccatgagattctcgcagggtgattatggacggcctcgtaagtagtgaccactgttaaagatatgaaatatcttcttgttagataaggcttgtacgcctaattgtgttggcttgtaggcctgattgtgttggagctgcacctccttttctagacatggttattgcctatattgttgccccctttctatatgtcacgcatgtatctcttcatatattcggtggtggagcacctattatggcctactatggctgaaaccatacctaaaaaacatgtttggtgtagtggtaagtgcatactgcttgcaatcaataggttgcaagtttgaatcctatgtgttgcatcattttttttcttttttatccttcttcagccatacctaattattattaggtaatccgccactgcatatattaataggataacagccagagaggctgattgccttgcgccattcaacatggtaccagaactatcgactcaatagatgtcaaactcgtccaccacatcttccctcaccacatgttcccttacgtcttcctcctctcttcagatcaccatggccgacagtttttcttcccagcccacacctccatggtgacgctcctgttagaaatatgtcctagagaaaatcatagagatgagcatatttctttgtatccatgatatatatatatatatgcttaattaaatatccatgaaaggcaccttgtattgattagcaattatgtgaattgtttgtgagattcttcacttatatggttattctaaatgatgtccctagtcagagtcgatgactagcacatgtattagttgatgactacatttcacaagacatgaacatggagatgttaaactaataatgtgggcgc

SEQ ID NO: 7832 - DNA, 1413 bp, Zea mays
atgtatctatcatccatgtaatctagctagtgatatggatcggaaacagaaggtgctcgatatatatgttcgcaactaaatgcggttgcatgcatgcatggtagaaaaccactcaaacgtacgcattaatattggttgatcttgtgatactctagtcgatcgtgcttgccatcatctggtgtttttgtacaccaataaatatgatcttgacaagaatagacacatcatgtactagactagaatagacacatcatctggtgtttgtattattgtatacattactacaaagttgatcgacttattctagttcctccgataaaaactacaaatatatatttgtcacctctagtcctctacatcaagagatgttttcatcagatataagtattttgtttagatttttcatatcccctctacatatctagattttttttttaaaaaaagtaaacgttttgaaatgtattttgtggttctaaaaattgacaagtatttattggattttttaactgaaaaaagacaaaagcatcttcaaaacttcaccaaaccaggatacaattgaagaagagtatgaagttttttagaagatacagtgtagtataaagatagaatgaacttttccacaccgggaacacttgtacatgtgagtatagatagccaatagtgccgggctaatcgggccggcccggagcacggcacggcacgacccgattggtagccgtgcctgggccgaacaccgggcatgctgggccggcacgggcacgacccgattagcccctaggcacggttagacacgattatgcatgattagatccaagaacgactagttagctgtgtgttgtactcttttttcatatctagggttttctcacaagggtgagtttttacctagataggtttttaatgagtcagccattacactaaacagcttaatattagctattttagtatgttttaactgtgtttgtgaatgtctgactaaaattatgtggtgtagtgctaaacggactaaatgggctaaacggactaaacgagctaaatggacctaccgtgccggcacgacacggctaagcaggctaaatgccgtgcttagacctgatcttaggcactagtgccgtaccagcacggcacggcccgggcagggcagcccatttggccatgtatacatgtgagcaaccacggcccgatccgcagcaaaaccttgccgcctccgcgggccgcggcactccaaagccgccatcttctcacgcacacggcacaccgcgcatcccctgctctcggcagtctccgcgggctccctcctccgccgccgcttccatggactccacgccggcacccgaggcagcccccggcgcgtcctcttcctctcccgccgytgccgcggccgccgaggktcttgcggggggcgtggcggcg

SEQ ID NO: 7833 - DNA, 1148 bp, Zea mays
atatatgagtataaactatctctgaattattatatatattccctctatttgaatttgaaacagtttttttcgtttcatcaggacatgctttactaaaacatagtgatcatgacacgaacatagcatctcactatattatattcacgttagaaagcttgcctaggatataattttgtatcgcaaaaaatactccctcacaaaaaaagtttttttccttgtcttagccaacatatcctaagtataaacaacacaattcgcaccatcagataaaaatcgttaggtcaatcacaaaatatattttatactttaccttttatatatacagtaaatattagtagttttctttatagagtttgttaaagttaaaataatttaacttacacaaaatagagatacctatattatatttttattaatacaaatagaataatatattaatatgatattatgggccaaagcaatgtcctaacgaaaagagaagaaaaggtgtagttttttagtggaacccgtacttatagccttaacttgaattcatttatttacatcgctacatttagggatgacaatgggtacccgaaacccgatgggtaaaaaccctattagggcacgggtatggtggattctgatacccatgagtattttattgggtcatttgttatgcccatcgggtatggtgggcgtgagtatgttctcttttgccccatacccgctacccgatggggaacccgctaatatatgacatgtgggtccagatttatatgtctcatataaaatgaatgctacgttttgtccatagttttgtagaatcaatgctatgttttgtgtgatttgaaggcatgatattgccatttaatattgaatattgttgaacctgtgataaaattatgttgggtttgatatatttgttatgttggtatttatttttacgattcaaatgatcatgtctatcataatgttaatgggtatgggtacccgatgggtacccgctacccatggtgggtatggatatggcgtaattttgtacccatgatgggtagtaggtatgggtcaatttttttctaatgggtatggcttcgtgtgtccactggtaccttacccactgccatccctacccccaccacggccgaaacggatcgcagcgagcgaaa

SEQ ID NO: 7834 - DNA, 1500 bp, Zea mays
gtatcacctgcatgcacattggctggttctttgccacccaacaaccaataaggtgattaaacatatatataatcttgggcaggtattaccaacctgccttcccaccccttccccttttttgtgttctttgtttctttcttattgatcatgttacttttttttattaaataaaatagtgttgtagttgtaggggtttaccctacaacctttccccttcaaaaaatctgccttcccgaggcactaaattgaatgagtgggttgaattggacatgaatttatatagtctcttgtccataagataatataacagtcctgctaaggtctaaaaaggtgatgactggaggtcgatgaaaaaactgaattttggacttgttagataataatagctcctaaaaagatttctcttctatgtatgtattctaggacgaaagacttctgacgcccctgagcttgagtttccgttggagccgatttcaggcttgattttttttttaaaaaaaattcccatattcgagtttccccctctatgtattgtagggaggaaaaagtaggattttactcttgttgtgaactgcttttactgctgatctgacagaaggcaggaaccccctagaatttagaccagaaaaatgaactctcattagttttttttatgtttttaatgggcattattgtaactactgctccattccttgtgttgactatgtgcttaccatggccggctatgcagatggtaaaaattaccgctcctcttccacaaattctacagacacgggaggaacgccgcgctgcagctgagcaaaccggtggttgaacatgtagaatcttgaaaatgtatatttcttgaagttagcaagcagcaggttctcacagacgttagagttagacactcagacatctgctcctctgacaactgtacaacggcgacctctggttccgcttgacgcagcgccgtctcatgtgacgtttaggccaggctaccgagatgcagagataacatcaggtatttaaaaataaatagagtactagctaatgagctctgtgactgtccctgaatcttgttcagtctattcgaagcgcaattcgctgaaaaaatgtttcttcgctcacacaaatatgatttggtttgaaatggagggaggtgataattgtagaagaagatttccaatgaattcatttgcgtgcaatggactgaccctactttcgcgttacacataaccaaacattcctccccccaaaacctcccgaacaaagaggattcgaggggaattaaaggagggcgcggcggtggcgagcaccttccgctcagcgaggtagctgcacctgcaccggcgagctagccgcggcctctatgctcgcggggatctgaactagccgccgctgccccatcgcggcgatgactgcggcgccctctcctcatatcccattcccaacacaacactcattttctccattcccacgtaaaagatagaaaggcgagcatcgcagtgcacacgcgca

SEQ ID NO: 7835 - DNA, 65 bp, Zea mays
tattaaatcacaaatgtaccttcagcccgtgagaaggtaaaagtacaagcgtgacgcaaaagcca

SEQ ID NO: 7836 - DNA, 973 bp, Zea mays
gaggctgctgtcgacgggtgcaccggacagtccggtgcgccaccagacactgtccggtgtgccagccactgtccggtgcgccagccacatccacccggttgttgggttccgaccgttggagctctgtcttgtgggcccgcctggctgtccggtggtgcaccggacaggccctgtaggctgtccggtgtgccacccgcgcgtgccctgctcctctgcgcgcgcaggcgcgcatttaatgtgttgctgttgggggccttcggcttccgaaggtcctcaaaaacatgatttaacaatgtttctggagtaaagtacattaataggtatcttcggacttggatcagagccacggtatgaagaagcacaaagaacacgaaggttggcgcagagccgaagctgtatgtagaagagcttcggaatagcagcggaaaaggaaaccgacttaaagatgaaaaaccagattagaccccgaagaattatcatagagttattgataaatgtaaagggcattaatgtaattttgtgtgggctgcgacccgtgcctataaataggtgaacagtatccccgtactgttcacgctgacgtggcattcgctttttgcatcacgcatgtacctttacttccggtcacaccgaaggtacacttataatttgttattctgaatatggtaatacaaataaaaataagttgatgataatgtctatattaattttcgtatttcgtatatgaattctgccttatcatttattgtgcttacgaaggttttttccttcataaccttcgtccggaattcattatatccgaagggacataatgtcttgaaggacgaaggactttaatatttaacactttttatgttgccttgttcttaactcttagcatttgagaacaagtacccaacattggcgcccacctccggtgaactcacttccattttttgagtcttgaacactttcggcaagcatcaccttcgtc

SEQ ID NO: 7837 - DNA, 1500 bp, Zea mays
cgcgccatggccagtgaaccccatgctaacccacggcgcgcaattacctgatacgctaggtgcaaatcgaggctaagacaacgacggatccaggaaggagatttgtactcacgattggcttgatgatgaacttgcccacggagcggggcggctttacggcgggaggtaagggacggcgagcaattcccctcacaccgcgggtccacgtgctcgattccttcttagctcatgatcctcacccccgtcgggctgtccgggagcgcaccacgggtgttaaaacggggacggcggcggcagacggctatggcggcctccggcggcgttcccaaatccaaaggcgagctcatgggtcgtaactactagggcgaagcacgaagcggatgaaaccggaggttggcgcagggtttaatatggcggccgggcacagactcaaggggttgaagttgggaacgggttccctgtgcatgcgggggaggccggtatggcggcgtggttccgaccttcgcggargtgggagctgacacgtaggtcccgcacggcagtgggcatgtacgaggatggcgcagcggacccacacgtcagtgagcagagacgtgcgcgcggtatcggtctctggtaaatgggccccatcgcacagtgagacagttcagtcgcgtcgtgggcacgggtgtgcggccgaacatgtagggtccacccgtcagcacgcagacagggaatgggctatgtggtggaacttgccaattggcccggtccagttggtttcggcctacacagctgtttccttttattttcctttttcttttacaatttatgatttggatttcctttttaaattcaaaagtctagtgtttaaattcaaatttgttgtgaacttcattcttaggttaaatgcataatttctaataccagtatgaacatattatatttatttatatatttattttctttattttgtatagcatttttccttcttttctccaaactctaaattgtaaattaggtctaaattccaaatttggacattaatgtatttctactattattattattattattattattaaatgcagacataaataaattccaacatgatgcataaattattgatgtgccattaattaattattcactttaattacggttgttcatatgttctaataagtagagggcaaaacatataaggagatcaactcttttctcattatttagaaattgggtattagttactcccaatctttggaaaaataattatcgaacacccttggagaccaatatcacattagaatctcgaaatgtaatttcttatttctaggaggccacatacatcagccaaaaaacttcattagtgaattacagctaataagcaatctaaaagagggcaccacgaatgatgtgttgttggtaggaggttgctgggtttgtcaaagcaagttggacaaagggcagcaactgattgaagttataagagggttgcgtggttagccgcaaatagctggtaga

SEQ ID NO: 7838 - DNA, 814 bp, Zea mays
gagaaccaggttaggatgagaagagaggagaacaaagaactcttcacttgattggttctttaggatgagtattaaccttatgagcaatattacaagtgaatataagaactcaataatacatatgtatttatgttttatatcctatacttacataatcacttcgctatgatattcaaacatcacatcaccaaacacccactaactaaagtttaggtcgtgtcctatcaaatgtttgaatatcaaatatgcgtatcaaatataggtttaattagaattaataaatttatctcatcttttaatatttacctatttaattagttttttaattaaactatatatatatatatatatatatatatatatatatatatatatatatatatatatatatatatatatatatatatatatatatatataatagagactaaacttaragtggaaccaaacttctcctaagtcttaccatggccggttcaaaactaaccaatcatgtgcggccatgtgcctacgacagctcgggacttcgggagccgcgggtgatcggaccgcgccccggccgggtggccttgcgtacggcagtggaaagtggtgatgcgctcagccgacacacacaccgcaaaaggcccacgagaagaccccgccggcccgccctctccctccccacctctactccacctccaatcctccccgttgctgtcccgccggcgtcgaagctcgagagaagggtgagcaccttgccgcgaggtgtgtccggtgagctagctagggacgcgccagctcgtgctgatctgacctggaagctctggaggcg

SEQ ID NO: 7839 - DNA, 428 bp, Zea mays
tgctgtgttgggtcgaatcttggcttgtttgtgcacatgtttgtcttgacgatgtactaccagaatccttttatttacttgactgaggcctgatcccaaaggataaatttctgaatcctgttttttctgtgtttttgaaataattcatgtgtaattcctatatcattaatgtgcacatgggagtgttagaattcccaacgcgaccccactgaccggagtgcgtcgcgggcgcgccttgctgtctctcgcgaatctcgatatacgctacgcatcagcggcggcagcacgacacgagccgccgtcttcctcaccggcgacaccctgtccttgctcttactgtgtcgagaagctatttcaatatcgaccagttcattgcgtcacaacttcctaccgatcccgtccgccgtgcactttcctcaaccacaacc

SEQ ID NO: 7840 - DNA, 1500 bp, Zea mays
agaaaccagtatcatcttacatgagattggttaggactacttgctcattctcatattagatgccccctgattgatttcttgtcatgaacattgaacactactttcagtaggagatcctgcagtttcccctggttattcagacgtaagaactttgtgcttattacaatggctaacctgtgcatggtattttctggtacgtgttgcccctatagcagtactcaaatataattcagtgtttcaaaggcgtcggctagacgtcaaggtatccagctcgccttgccgtccgggcagacctagcactcacatgggttccgttgtcacgttagactatctccatactcgctctcatttccatatttaaactctactctacgaacaatataatctatagtttaaaactgtgtaaaacaatgttttaagtaacgatacaagtaaactctgctggacacggtctcaagtttggctctaaaggcttcggtaccttaaatacaagggagattctctctcctatagcctacatatgagattccctccatcctcgtctattcgttttaatacttaaacaatagatagatataataaaactaagatatgtataaaatatttgagggtgtgataaatatgtacatataaaaatctagagcaaaatatatctctaatatatgtatttaatttatatatagatgatgagatataaaagatactgttgaagaggaatgagatataaaggagtaaaaggagggatatagatataaaggagtaaaaggagggatatagatgacgctactggagactatcttacattagttttatgtattttcagataatttatgcatttttgagtgtaatcaagatacttgcaaattaggtaaacctcgaatgcaatctgcttaacttgttatagcaacatacgttccataaatccaacactaacttgtatccacgattcttaagggcttgttagtttcactgtaaattcatgtgaattggatgtattgaatcagtttaaattcataacaaatcaaaatacatttcaatccatttcgatacactccaatacatatagaatttgtaataattaagcgtttgttcttagcgtggtgtcgtggcggttgcagttggttcagtaacttcagaggagtaactgattctttgctaaacgaagttgcccctttggccttttgtttactgtaacggttcttgcatgtcactgaattctgaaggtatatatgtgatctctgatcagttcgtccttacagtagcagaggctgagactgtcgagcacttctgttttgcttgctgcctcccgggcgcatcccatcccgtcaccccgtggatcggtggatgggcagatcgaggtggggtcaccctgcagggagtcagattccactagccgccgcaagtcgcgaactcctcgctatcctcttccaatccgaaccacccggactcccggagcaagcggccgccggctaagcagacacgaacgcaggtccggcggca

SEQ ID NO: 7841 - DNA, 369 bp, Zea mays
tcggagctccctcgccgcgatgcttaccacagagtcgaggcggagaggcagggccgtgcctcggagagtcgaggagagacggctggggtttatgccgacacgagacggcgggggaggcccttgcctagggttaggggttttccttctcgacttttttcctgctttttttttctgcgcggacgttggtggctgttagaattttgcaagtgggcctagtcagtttagaggcccatgatcagcccattaataatcttgtcgtccttgtgacacgtgggccctgtccagacgcgtggtggcaccgcggagggggcagacagagagtaaaggaggcaagtaggcgactccggcgagagaagtgcgggtgcggcc

SEQ ID NO: 7842 - DNA, 243 bp, Zea mays
tatttagcaatttagatactaaaatagaataaaatagatggactaaaaattagtcctataaaccgaacagaaaatcagtaatccacaccgccgtaacagttgggagcttgttaggatgctagagcagcacctacctacctacttaaaataattcgtcacgcttatttgtcttgataacagacaggtagagccattacttaaaagccaaaccaacaagtgcagattatctcaccgttgtttgcc

SEQ ID NO: 7843 - DNA, 1500 bp, Zea mays
  unsure (1)..(1500): unsure at all n locations
cctacactctagaggaccctagaaaactcgtcgtcgtgctcaccttatgaattgccctgatggatcaaactattaagaaaccctaatgaagggttatgtaggtaaatacggagcttattcatgaggggtctcacttttctataaaaaaggaacatgtacactcttcataatgatagagagaaagagagggtctgaggcacatgcctatatcatatgtcatgtgcgtttttttgttgtgcttataggaagggaaacgagttttccacatcttctcatgcccgatatgttggtgggagggaaggaaacggatgcggtgacccatagtaacgtagtttttcaacacaagcgactgagagaatagaaaagcagatgaygtgacgtggcccaatgatgtgaccgaatatcagtgtttttatatacatttcattggatttatgtttttttttgccaggtcaaaaagcaagacgcgcgctttcttttgatgtgcacacaaaatcattttgtgtgctggagaaaatttttgcttacatcagtttaataaatgttcgtttcatgtattcgtcgtcagtttacccagcagttagcatttggggagagggcgaagccgataaaaatactggcaccagaacaaatatgcaaaaaaaaagtaaaaacctactatagtagtaggactaggacaaggtttgtgcagaaagacgaaggcaggymaccaaaccaaagcaaggtaacggtaaaaaaacaaaaatacggatgcatgctgggacgacacgaggcagggtagggtactgaccaacacagctgccccctgaatctggtcgcagctcggcgcgaatcgcgggggtccggtcgagctggcgcatgtcatgggtcatgggtgccgccgtgccagtgccccagacgggcagacgcacgcagacccctccatgcatgcacccgtctggctcggctcgtcggcggcagactagacctatgctggcccggaccggcgactcccaagtcccgctccagcaagactggtggtctcgtcaaatctctgcaggtggaatcatcaggaatccctccatccatgtccatgcaatggttccatcacttcatttcgctcgcgtgcgttttccttgctccagtcctgatgagcgcgcatggctggaactcaattattggcggcaagtccggtccaacaaccaggtggcattggtacgacacgaacacgaacacgaacacacctaggctagctactgtacgtaccactgtttctttttgatgggagcctattcttagtaggtggtattgagagctttggagtagtggatcgggtggtggtctggcggttggacgacgataaggtggaggaggtgtggtggnngggaaggtnaaccctgatgccgancggaggttttcgatgagttgctagctggtaggtttggcagattctggcattttcaggctgcagacagattggggattgtttgcttgtacaatgctgtggatcggaggctggtc

SEQ ID NO: 7844 - DNA, 622 bp, Zea mays
ggcatgaccatacattagtggttggtatagttcgttgttggatccaaccttaacatccgttagtcatttgtaagggcatgtctggaagcattataatttttaagaaaccagtttttatctttattttctagaaactagtttatgactaaaactaggcgatggtgtttggaacccgatttataagaaatcagtttctagttttttacatacaatgactagtctattatttctatattttaaaaatcagtgataataaacataaattctatgaaaccaacaaaagcatgacataattgaacaaataaaaaatggttttagctgggaaagactaagttttttttaagaaacttagaatgcaatatctataaattagtatgttttcacactaattttatgaatcagtttaattgttaagtttatcttcagcagcttatctatgtatattacagtctaccatataaaatagtgttgtggaccaccagagtgaactgctgtactatttttttagctgcctagttttttagtcgtttcctcttaaaaaagttgttgtgcttctcgtttcaccgtgcgccacaagcacacaactagggcgaccgccgccgacctacggccagctgtgccc

SEQ ID NO: 7845 - DNA, 1500 bp, Zea mays
cctctctccagatccgacagttcactactggctactggaatggtagtagttgacactggaacaaaacccatgaagttcactgtgccaaccttcacgaacatgctgccctcaatcctccacgtcattcagtttctatagcattaattcagctgccacataaggtaaaagattatgtggcaggtaattaaataaagaaagattaagaaattggatcttacatgagacttggtttcaacacgatatctaatacacaataagaccagaggagtattaaattcagttaattaatattgatatttatattgaagaggtagtgtctagcagtagtttctaaatgatgtgtaggctatagaaactataagtagtgttttaggttcggactgctcgaatgcagcaggcagcagctctcgttaaactgtgcactagataataaaaggggtctggctacggattttctaattacttttttttaggagatgcccctagtgtagcagtaccactattactgaatgcgtcgcgctcgagcctttgaattgatgagggacgacggacggttaccgctttgcaaagggaaagcaaaacaaagcagatgggagacaagttaataatgccgtcgctttcatgcattattgtcccccaatctatctttgtcgcttactacacctttcatgaggcgggcgcgtacaacaactgtgcccccgcggtgatctacggtagtgaaaagttattaataacaacaacctatcctgccttttcttatataaccacccaaatacacacagtgacgtagcttacaactaccgcgcggttctcctgcgtgctgaattgctttgcagctatagcagaggttccaaacagtgcaggaagcgtgcgagttcgtcgagcctcgagcggaagcgtcggtggggttcgtttcgtcggcgcatgaccggaagccgcctcttgtacgtctccctctttttgtacccacgccaatatgcaatcacgcaaatgcgctccgcctgcatagagacagtagagagcgggcaggccccacaccagcgcggacgcgcataggcgcagcagaatccacactccctccctgaccctgtgacacggcgcggcgcggcgcggggcacccaccccacccgtcggtcgatagcgcagtgcgcagcggcaacgacagaggagacagacacgagtgggtgtgcgagcattcaggcgaagccgatcaccctcgcccagcccaaagggtcggcgggcaggcgaaagcaacgccccaaccacctgatccctccaccccatcgcacgccataacaaagcagagcgccacgccaccaccaccccagctcactcgtgccgtgcactcgacccgtcccccctccctccactcgatccacccgccaagacctcccattgccgccgccgagccagccagggggggagaagagaggccagccgcgtcgcggcgggcggaggaggaggacgagcgggagagccgagccgagccggccgggcagg

SEQ ID NO: 7846 - DNA, 1500 bp, Zea mays
cgtgattgcatattggcgtgggtacaaaaagagggagacgtacaagaggcggcttccggtcatgcgccgacgaaacgaaccccaccgacgcttccgctcgaggctcgacgaactcgcacgcttcctgcactgtttggaacctctgctatagctgcaaagcaattcagcacgcaggagaaccgcgcggtagttgtaagctacgtcactgtgtgtatttgggtggttatataagaaaaggcaggataggttgttgttattaataacttttcactaccgtagatcaccgcgggggcacagttgttgtacgcgcccgcctcatgaaaggtgtagtaagcgacaaagatagattgggggacaataatgcatgaaagcgacggcattattaacttgtctcccatctgctttgttttgctttccctttgcaaagcggtaaccgtccgtcgtccctcatcaattcaaaggctcgagcgcgacgcattcagtaatagtggtactgctacactaggggcatctcctaaaaaaaagtaattagaaaatccgtagccagaccccttttattatctagtgcacagtttaacgagagctgctgcctgctgcattcgagcagtccgaacctaaaacactacttatagtttctatagcctacacatcatttagaaactactgctagacactacctcttcaatataaatatcaatattaattaactgaatttaatactcctctggtcttattgtgtattagatatcgtgttgaaaccaagtctcatgtaagatccaatttcttaatctttctttatttaattacctgccacataatcttttaccttatgtggcagctgaattaatgctatagaaactgaatgacgtggaggattgagggcagcatgttcgtgaaggttggcacagtgaacttcatgggttttgttccagtgtcaactactaccattccagtagccagtagtgaactgtcggatctggagagaggtgttaaattatgtctctcgctcagtcctgtcttccaaacttccaatcgagttcactcactttcagcttcagcttcggcttgggctctttggctttggcttccaacctggtcgacgaaatgcttgattcgggcaaccattgcgttgtgatgctcagctcgggctcgggtctcaactctgaagaaaatcgtttcagtcgggcgagatgcatgggatgaaacacgcgtggtgtgaaacgtacggagatccagcgtcctgggaatcagaggctgttaggtttgtgatttcgtcaaggctgcctccctctccctctcactcccctgcaacccggactccgcgggctcgatctgctctcctcccatccgcgaccattgcctgcccctccatccacctatggcagcgccaagcaaaccagagagatgcagacgtgatcgcaagcgcagtgatccgttgttggtttcgcttacaagatccagcttccagttccagccagccattactcatctaacatcacc

SEQ ID NO: 7847 - DNA, 402 bp, Zea mays
tgcagagcagcgcgccagcgcccgtggaccggtgaatcagtgagtgtgtttttgaagttctgagctttcacaaatccgaaatctcataccctagggtttgacagtaagcactggactataaatttggatttagagattgtgtatgtgtgaaattggtgtgtgattcattattattggctagggatttgttcttgtgaatgaaatcagagcatagaattgaatgaaatttcttgtcgtggaatcaaacttaatagaatcaatttggttaatttgtagtcatgtatagcaatattttattttttaccttattgcatatactttttttttgactaggactacccttgtttcaaatcctgggtccgccattgggggcggtgaggccaccctagtagaggctagagg

SEQ ID NO: 7848 - DNA, 501 bp, Zea mays
tacctccatgtggtcacctcactggtacttcacacaatgccaatgcaatgcaccagccgacgaagcaccaacagcacttcaccaaataatatgtatactaccgagtattgactactaattcgcgtgcaccagctaactgaaactaaagtttttacataggagccttcactaagccgatataaagtacaagcaattaacctttttcacaaacaagtaattaagcgaaagttattaagagcgtacataattcttctgtagctgcaaatgacatgcataagtacgccggaccggtgaaaagcgatcaggcaaccgaaagagctagtcagtaaaagatacatgctttaccactggtactgcattaattaatgaaggagctagtgctgaacagtgcggcaaggactcctataaattggctgccgtgccgctaccatccaatccactccactccatcatcccgtgcctcacgagtcacgagtcactccaggtccaggctgagcagca

SEQ ID NO: 7849 - DNA, 623 bp, Zea mays
ggtgtgttagagggtcagctatacttagtagattttgatagagctgagctcgacacatgcttgattgctaagactaacatgggttggctctggcaccgtcgactagcccatgttgggatgaagaatcttcataagcttctaaagggagagcacattttaggattaacaaatgttcattttgagaaagacaggatttgtagcgcatgccaggcggggaagcaagttggagtccatcatccacacaaaaacatcatgacaacggacatgtcacttgaactactccacatggacctattcggcccgatcgcttacataagcatcagcgagagttagtattgtctagttattgtggatgattattctcacttcacttgggtattcttttgcgggaaaaatctcaaacccaagataccctaaagagattcttaagacgggctcaaaatgagttcggattaaggataaaaaagataagaagcgataatgggacggagttcaagaactctcaaattgaaggatttcttgaggaggagggcatcaagcatgagttttcttctccctacacacctcaacaaaatggtgtagtggagaggaaaaatagaactctactagacaaggcaagaacc

SEQ ID NO: 7850 - DNA, 1068 bp, Zea mays
ttgccggatcaaagaggtagagaggaaaacggcgcgaggagagagaaggggagatctcggggcggtggttgaggaggagatagacgacgggtgggagtagtattaatggccctggttttccagggttggcttcgtaatggcagatatccgttctctccctacttgatcttcataattgtagatatattttttttctagtagcactcactcttaagactatctctcgcactcatccactatcttatcttctattttaaatttctctctacaaacagtgtcaaacagtatcatctaggtcccatttgtttcctttcattttgaggaattgaaatcttactaatgaaatagactatttttttagaatgtgacatttcactatttttcaaagttatcatataagactatctcaaattcatgtaggtgagagatagaaattgattctatagatttacatactatttttccgatgtacaacttatagcacacttttttacttacttggctataacataaatatagtatataattatctctttcatatgatttaagataatatataaatatatgaatttaattagttttatctaaattataattattaaaatgaaattcaattgcaactaaaccaactgtccccgaaatcgcgttgcaaagacacttctaatgttccgtcgcactgccgtagcagccatcaacgatggtttttctgctctcgagacgtatccaaaagaccagagcatacgtatcgtgggcccgcacgtcgatgcatcgtacgtgtgcgtcctatattcttattttacgcatacactgaccgaacaacaatcgcgccgggctccgctttctactctgcacgtctgtctctaccagccatatggctgtctgtgtctggcacagcaggtcatggtgtcgcctggacgtccaacacgtgcttcccctacgtgttccattcatggcgatggcgccacgttgccacctcgctttgcaccttatattagcacagaccttgttgccgcatcgcagcagggagcagctcacaaacgcaggggagagctagcagagcaacaaaca

SEQ ID NO: 7851 - DNA, 527 bp, Zea mays
ggtgaataggtgatcctgtaaaacttaaaacttaagctacaaaacttggttaagtgttagcacaataatcaccaagtggctagagagaagaacttgcacaatacgataaccacaaagagatcaacacagagatgacacagtggtttatcccgtggttcggccaagtacaaaacttgcctactccacgttgtggtgtcccaacggacgagagttgcactcaactcctctcaagtgatccaatgatcaacttgaataccacggtgttttgcttttcttttcttatcccgttcgcgaggaatctccacaacttggagcctctcgcccttacacttttgatgttcacaaagaatcacggagtaagggagggatgagcaactcacacaagacacaaagatcacggcaaatacgcacacacaagacccagacttgagctaaaaaagactagcacactagaacgaggctcaaatcactagaatgtcgaacaagtgcgcaagagtggagtgtgagtgatcaagaatgctcaaggg

SEQ ID NO: 7852 - DNA, 1164 bp, Zea mays
ccgatcagtccacgactcgactctagttgctacccggttgacaatcactcatcgtcaacccgaaccacaagatacaagtcaaccttgtgttcactggttgaggagcaggccccactcatcggtgaaaccaggacgcacggctgtctgttggagccgagcgacgggaaaagatgcaataggccgagttatagcaggggggagggtkgggccgaggagtggggccgccagagtaccggtttgtcctttttcctttttwggttttcctattcttttctaatttcagttttattttgtatttttaattccaaattcaattttcaatctcaattctaatcgatatacaatgataaaaaattctagcatggaattcaaaaacaaaaacttttttagctaatgcttgctaatgcattattcacttaagaaaataaaattcaaacaaacatctctcttttagaaaaaaactatctagactcttaattagacttttgaagtttacaccattagtttattagctaggtcaatctagttaaaatcagctaataggtagctagttaatttcaccaagaattttttagctaataacaattagctctagtatattcaaacatgtycaaattatttgtatggaatatgtatgtgttaaattttataaaaataagcagacaaaacatatatttaattaattttcatgttttatcttaatatgtatccctccgatctaaattataatttatttgacttttttttgacacgtctgatcgactcgttctattcatttttttggaaaaaagaaaaatacaaagttatatttaatgtaaattatatgttaaataatatcacaataaaatttaataataattataaattttctgaataagacgaactgatttaatttgaggtaaaaaatcaaacgaataaattgaaaagtattagtttcaccgcatatagctactgagctcccgatctggtccaaaccccaccaagctcctaccgtcctacggtccagccacttgaagccaaatccctccaggctccagctcatcactcccacgatcccactctccccgctcacctcaaggagtcaaggtgcaaagctaagcttagctcattgctcaagcttccgtctctttctctctgcgagactgcacactgccaccacgcgca

SEQ ID NO: 7853 - DNA, 365 bp, Zea mays
tactgaggtatttaacaagtatgaagctaagtttggtgcagtgacctcaattagaccctcacaaacaacaaggactggtaagaaaaggactaactaggggtatgatatatggtgatgatgatgatgatttgttttcaaccccaattggtggaacatgttcttcttccaaccccactccatctgcttctctatcttgacacacttcagctagtgctttgctgcaagcagcaagcaattgtgcatctcttggggctggttctgagttatcagcatatttggatagtgatactggccaaaagtatgatgatgactttaatctgttgacgtggtggcaggatcacaagctgacctacccatctctttct

SEQ ID NO: 7854 - DNA, 1500 bp, Zea mays
atcgacaaaataccctgttttcgccgagtgtagtgttttggcgagaatggcactcgacaaatcttatcttcaccgagtgcctgacatttggctctcagtaaacctatgaacactcggcaaagagcgtgttcgatagtgctaggaatccatcttaatccatcttaacgtaatggtagtggacaacgtcggccctaagggcaggcgaacggggcagtcgcaccgggcccctcatcttcgagggccccacccattcgacgtcatacatacatgtaatcaaatatgaaatacatttggttaattcttaattaattggttctactcgtacgagaggtaagagctcgtgattgtacgtcctgtgtgcctatcaagggtgcgagaggcgagacgcctcaaacaacaacgtgagataacatggtgtgaatgatcatgagcctaaatttaattcatctcctactaaaaatggtaatattaaagaacaaccaaattttattgagtgtttatattgatatgaatgttttaaatgtttcttaagtacttatattaatatttttatatattaaaaaataattgtatgggtttctatttaagccttgtcctgtgcctctaagatctcacggccgccactggtagtggatagctagaagcagcaatttgtgaacactgaaattttgtgtatgtatatatcatatatgaacggccctgatatataaaatgaaattctacgtgtacgtacacatacattcggtacggtagatagtctccagatacgcggaataatgattgagaaacgtgaaaaaggatgaacaacaagcatggggttagcttaggcatgcaacttcctatctagctgtgcctgtgcctgtgccgctgtgcgtgtgatcaaacgtcgcaactagcgcaacagcatcttctcacctcactcatttaaacatgctcgtccgtcgcaatcacggatcgatagctgtttcgtaccaagatcgtaagagataccgttgcgttgcgctgtagatcctccggccgcgccgcgtccctttcctccctccctcccttccctcccgtcaccaaccacggttgcttcaggggcggagcgatgatctgcatcattcattcatccggcccgagagcagagcgcacaccacaccacctccgtgaggtggagcggagccatcacctccgtcacgcacgcgatttcttttcaaaccgagtagctcgatcgagtcctcgttacgcaactcgaccaaccggcgtcggccagctgatcgagccgcccggccggccgcgcctggtgtgacgcgtgccatctcgatctcgatggggcatcttgctcctcctcgctctcttcttcttaatttgccgctgcgtgcggccttttattcgccctgcctctagctgctgcttcttccaggatcggggatcggagcttgtgctgctactgctactataccagcgctagctagcagcagccgccggcctgctcgcgcaagctaaggaaaggtcgac

SEQ ID NO: 7855 - DNA, 830 bp, Zea mays
attacgagtattaaatagtctaattataaaactagttacacaaacgaaaactaaaaaactaaagaacgagacaaatttattgaacttatatttaatactcgtaattgatattcaaccatttaacgtgacacggtaatcaggagaaccaaacgttccatataaaccaaacattagcaactcgtaattgatctgcgcgtttaggtggtgcctatatggtagtgacctcgtcgcaacggatctcgacgccgagaggcaacaccgtggggcggtaacaatatttcacattttataagttgagatcacgctcaaaccagacratacaattggcatggtaaatactgttaccactccatcgccgtcagagtcttggcgctacgatctatgacactgagatccgtgatgtcgaggttgctaccacacgggcgtcacctaagcgaacgaactcaagactttgttaagcagacgtaatcttagtatcaataatgatgtcgaggtgagaatctatttattgaaatgaagacgtatttgtgatttttattttgaaaaaaaggccaaaatataaaaaaacggccgagttgccgacgcaccgaaaaaagacagctgacgcgaatgcccaaacgttcggggggcgaggcgggatttggaagctgcgcaacgcgcttcccatatctttcaatcccgacccgacccgaccccgtccccgtcgccagatctcgcgcctcgtccccggggctcgatcggataagcggcggtcggcgattcggggacggggtcatctcgcctaggcttgggcggggctgggctggtgggagccgccgagccggggagcc

SEQ ID NO: 7856 - DNA, 564 bp, Zea mays
ctctgtacgcgacacgttttttctcgctgacaggcgcccacctctatgccaattgcccccccggacgatcacagctgttgatcacgccagcgcggcccaaactgctcgtatctgcgccgtccagcgagcgggccctacatgtggaggtggggcgcgtgacgccagctggcatcggacgcaaccttatcctcttttcccgaggcatctcgtgcctaggcacggttcaaggagcactaaacacaccgacacaaccaacgggtccatatgtcagcgacgactagtccaggacgctgaccctaacgcacccgtggaaaggaatataccgacggcctctcgcttccacccatccggtcgcgtttcccccagttccaaattcgccaacccacaccaccttcctctctctcgccgccgccctcagatcagatcaaagcggaacaccaactcctcctcttcctcctcctcgtagggtttggtgtgttcacctcacctctcgcggcgacagcgaagccttctcttctcttcccctccgctccgctccgctccgctccgctcggtgtttcagcc

SEQ ID NO: 7857 - DNA, 256 bp, Zea mays
agtggtgatcttttaatggtatggatccaaatttcccaagaaagaaaggactgaaggaaaaagtcacccccgaactggttactggtgggaagcgccgcagctccacctcgtccggtccggtgtggtgtggtggactgggtgggtgtctctggcggtggtcgccgatgctgaccccctcggccggcataccgccgccctccctctccgcagctagcagcccctccacgtcctactctctcctctaccttccccgacg

SEQ ID NO: 7858 - DNA, 1318 bp, Zea mays
aaatataatagtgcctatcattgcacctagtttggaacatcacttgacaatgaatgaggatctgatcactgaatgcttagtccaaggaaagggccacattctcatgggtagtttagggtcgtgtagccgcttaacttggtcttgtaccctaagccaacacacccaccaccctagaatagttgaccgagtaccttggaatgagtacttggaggaccggacctcatccaaactcaggggatgctccaaactaggattggctagaataagcactactattggagaattgattgcagtagtacctgaagcgggatttgatttttaattacactcatgtaacctagattatgtttccaccttatcacctgatttcgggatccttcccttgtaacaggtaaggctcgggtcgtgaagggctaggtgcaaagggagaggagcacgttctcaggggtggtttggagccgtgcaaccgcttagcttggtccagcaccctaagtctgcacactccaccatcctaggatggttgttccagaacctagggcttggccgttaaaggcctaggccttatcctgaccaagattcgagctctagattatttaggtgacatgtgtagcaatttgtgccttttcgtgtaacatatggtctagaactcgttttwaatatgttttcctagtttaatatcactatttagtttattccactctaatagtaaagaactataagttttttatcagtagagaggaataaaactcagtagtggtgctcaattggtagcataaatttaaaagtcccgtaaattagggtggtgtttttttttcaggtctcatttttagaatctcattctagaatctaattattagacaaacaatttttaaattttgtattggattttgtgtcacaaactcagtctcatcataaattgacaatagaatttatattgagtatacagctttttccaaaatctatagaaccaaacaccacctaaactaccggcgaagtgtcgaaacacatgacttgatctaattccggacgccctacgcccctaccacccaccaaccaatctgacacttgtactagtatctgtccatacacgagccgccacgtgtccagcgaattcaaaagttcgttaatacgctcaactaccaacagctaaaccctacccaccttctcgccttaaatctcccccgtccccaaccggccagcccaatccatccggcaaagagctcgaggcctcgagcaatagtaagatctgactgatctcgtgagctgcctctccagtgtgctctgtagcccgcgcagatcagtgatgccttcggcggcg

SEQ ID NO: 7859 - DNA, 1497 bp, Zea mays
cagacctcctcccctataaatataaaggggtacagccgattgagaaccctgaacacattccaatcgaatcaatctactttatttaccttttctaccctaggagttgatgtaacgtagatttagttgtacctttccatatatccacctccaccccattcgactctacgtcgtctagatccatcctgggtggcctgccaaccccaaaacgatcctagggtcttacccctcctaggggcaagatctacttcatcttcttcagtcaagatctcttcctcgaattgtcttaattctgaggtgaccctacatcgtatgggactccctgagtgacctgttgacttggagcaccctaagatctttcccccaggtggtgggatctaggttcccacgaagaagaagacgaccctatgccatcgctgaccgtcaggtccagagagcggaccatccgactcgatggacggaagaagtcgcttctgtcaccaggtagyagactatccgtccctatgtcgtagcttgtttgcaccgccgtagagagaaccgccaggtgatctagtgacccatcgtggaccaccgccactgttcacctcgcggagccgaacccaaggtattgctcatcacgagaaggccctagggttcgttgctgtttggtcccaaataggtggtgaccatcatagaggtgttgcccccacatttaggataaccactttatttgaccctacatcatctaaaggtgccaagtaccgccaggcggttcattatagtgtttggtgacaaaaaggcaccaacataagttatatgataatatttatatgtgacatgataatatgataaaactcgctgtgggctaatataaataaaattgctctgcctatatcctttaattgatcatatcattattaaaaatattcccgagacaaaccacggtatagcgactaccggaaacacgtcgtagaaactagaaacagaggtggagaccgtgtactgtgggcccgggtgtggaacacgcaggctggggcgcggggccacgtggcccaggggacggaagcgtcgcgaggcgcggtctcgtgtccactcaagtggtggccggagcacggagctgtttcgtttccgctcgcaggcaggcacagcgccaagcggcgaccgagagtccgagacccattcccatccacgcgaccacgctgccgttctctccccttcctccccgtcgcttccattcccgtccctcacaatctcacccccgccagccgagccccaaccctaacgaaatttacacctgcttcgtcggcgtgagcggtcttaggcgccgggcgtcgctgcggtccagcggtgtcggatccgggtcccgcgccgttaggtcgaggtttcttcggcgacggtgcagccgctggatgttagtctggcagatcggggccgaggtaatttccacgaacttagggggcaccttttcgcgttggtgctcaaaatggagaatttcggtgccgttcgggcaggtagctcctg

SEQ ID NO: 7860 - DNA, 273 bp, Zea mays
gtgtctttttttcttgttcaagcagacaagcacagcaattatgttctagcctaagtgcctgtattggcttattgtttgttcaacaacagagcaaactgttttttcagtggaaacaagtgcatattatattaccaatcagaatagcaatatattgaatcacttcttatggtttgattaatctgtaaactggccacagttcctcggaacttcaggctcctagaagagcttgaacgtagagagaagggcattggagatgggacagtgagctatgga

SEQ ID NO: 7861 - DNA, 473 bp, Zea mays
tactagacagagtgagtatattataaaattagagcgaaagtgagaaattaaaaaaaaccagaatcgtatattcatacaaaaggcaacggtaacacaccacagttcacccccagctggcgttggcccgcaaaaacaaacggaaataaatcagagaatcccctgataatcaatccagtccacccatcgaaccgaacacattttctctctcctgcggctcagcccaccaccgaacccgagtgacccacacacgcagacgcattcgcaccaaagaaagcgaggaagaaaagaaaagcagggtcgtgacaggacggggggaagagagacctccactcacggactcagcccccgccggaaagcactgagcttccgagcggcccgccgcgaggaacgcgtgacctcgccgcgcgctgttgcggctgggcgggcggcgcattcaggatctgctagggttccccgccggtggggtcctggcc

SEQ ID NO: 7862 - DNA, 1464 bp, Zea mays
cataataactagagattttgcaatatagagttcaaggcatgtaaacaagctccctcatgtttgattccgggggtgctttcattgcaacacgaagcctaaaaaggggcgtacccagtaggctttccacacttttccgcagtgtgcggggtctgggaatggtatctttagggagtgtttggtttgaggaatcactccatccaaaatgtggtggtgcataatgggtccattcctcaaatttggtggaatgaccacattcctcatattagtactaactaactaactataaagaatgaggtggtgatgaattaactcattccattcaataaaccaaaaaaaatgaggagtgagaagatgatggagtaggtcattcctcaaaccaaacagcctacaaagtcttgatagatgtattttatatgtgtgtctaggtttattatcactcgtttgaatatatacataaaaataaagagctaaaacgactactaccttggttttcaaatatttatcgtccgttagtttgtttttgaactaaaatacgacaaataaaagagaatagagcgagtactattttagaacggagagattactatacaacctacctaggatgcaaaagttcaagttgagcaatacaaatacctccactagtacaattgacgacggtgaatattcatattcattgactctggtagtctctggtacacctccggcaaacccccgtttgtaagagaaatcgatgatgccctaagtatatactgaaatgcttccttcagatcctaatacaccttataaaaaaaagattggagggagcaaataacttggtaaccatataccaaagaaatttatgaactactattttcgttctcgaatatttatcgctagttaatttgtttttgaattaaaacatatttcctccgtttcgttttagtagtcgttggatagtataaaattaattatccagcgataactaaaaagaaacggagagagtaataaataaaaaacagcgacaactaaaaagaaacggagagagtaataaataaaaaacaatataagactagcgaagagattcgttcccatggatccctcgtgagccgtatacttcagcacaccgcgccacgtctccttccctctgcaactgcagcacccagagccgtctccttttgctgtatataagcccatcgtctccctcccaactctctaatctcccccttaacaactccactcccgcggaaaaaaaacccatatccctccggcataaacccaaaaaggttagcagcctcctcctactcgatctcccagatccgcactatctctgatgctacctgcttctttattactagctgtatcgatcgatcgatccagcgttgtttagctgacgagtcctgtttaattctgcgtgtttagctgcaagcagtgtgaccaaaagcaggcctgacggcgatcctcggctctctagccaggcagcaggag

SEQ ID NO: 7863 - DNA, 1122 bp, Zea mays
tgcagatccctagtgcatcacattagttcttgcatctatgtactaattgaatgaattgtgttggtatactcttttactctggtcgttgtcacctagtcgaccgagaggttcgtagggttattaagtggcttggtgattgttgttggcttccatcatcggagattcacaaaactaactttagtatagttttgttttgttttataaggtgtttggtttctttagtcactctcttaagctttagagactaaattttagtctataaaaaacctatttgaaagacttataataatcaccccgtttttagagactaatgtttaaaaatttggaactaaacaccccttagttggagtgtctctctagtttagttgttctaatgctcaattattcaacttatgtatcttacgatgctcaactattgaacttgatgtatgatgtcaattgatatattaaccacttttttttaactcactacaacaaagatatatgttgttggcgattaatcgaatagagatagactagtcatatgtccgtgtatttctacgattttatataatataggataaattttattttaaaaaacataaaatatatgatttttatttattaggtaggtgtgaatgtggagtcaacaaccaacgttcaaacactcacttatacataatttcatcttattttttatataaacttttatattataatattatagaagagattatatgagttcgggttgatttaaaaaaaatgtagggatttttttaaaaaaaatttgacgtggtataccgttaaaattagtgctttaatatagaaaagattattgtatttatttaattgttttaaaaaatatttatataagagggatatatggcgtccaaggtgtcggcgttggcgagtggcgactggcgacttctctgcctcgtcctccccgttttcccctccgcgttccagcccggcgggacgccgccacgcacctagccgcggatccgaggcgcagatccaatccagcgatggcgtccacggcggcgaggcggttgcgggagctgcaggccccagacggggaacaagacctgcgtggactgcgcgcagcggaacccgcagtgggcgagcgtctcctacggcgtgttc

SEQ ID NO: 7864 - DNA, 623 bp, Zea mays
gataatgaaaacgccaccatatatgtttagggtaggtattagtagcctcacacaacactggtagctcgcaggatgtagaagctaagttatactactagttcattttcgagggacatgcatatggacacggcgcggcggccaggtcaagacaatctcctcgaacggcttctggcgatcgcaatgcgcgcgagcagaaacggtttcgttgcgccgccacgcgccgcagcagctcagctcgttcgttcctccgtcggccgccgtgcgtcgtcgtcgtcactcgtcagtcgtaacggaccaaaggctagccaagccaggcaaagggcaaacctgactttacatgtatattattagctccacaagtcaagttattaacaatgctgcaagtcgcgcggagcatgtacatgcgtagacttcatctcagtagctagctagctataaatacgctccaggctcatcatctctttccccattcaaacgctagcacgcattcgactggatcgatcgggctcaccacatccagccggtcctcgccttttgctgctatcagagctagctagcttcgacgatccatctctgttcgtttgacgacgatcaaatcaattcgtgctcaagatcaacgatcc

SEQ ID NO: 7865 - DNA, 607 bp, Zea mays
atttattatcactcatttgaatatggatgaaagaaaaaaaagctagaaaaaaccatattttagaaggaagaaagtactactacctctatctcataaagaatgtctttaatttttttatcaagtttgactgactcgttttattaaagaattataattattatttatttttattatgatttagtttagcatactatatactttaactatgaactaaaacttttatatttccacaaatattttaaataagacaaaccgattaaattcggtctaaaaaagtcaaagaacggagggagcattatatttgccttcggcccaaagaaacatgaacctaaaaagatcagatcgttcatagggccaagtcaacacgcggtaggtcttggaactttcgtcccgagtcgagactcgagacggcgagaagcctttctgctaatctcttcacggcgggcggtagcacaggccaaaccgtctaagacgtcatcctaattccttcacgctaatctctctgcttcctctgttccttccctttcccctcctccccctcccgttttcctttccctttttcctccacacaagcaacctgccgcccgggaaaaaccctagaccggcg

SEQ ID NO: 7866 - DNA, 88 bp, Zea mays
tggctgatgaagctgaagagaaacgagaaatactcaaatagcagatctttaggtgtttgtttgcttgcttcagtgaaagcttagttgc

SEQ ID NO: 7867 - DNA, 1330 bp, Zea mays
cttgacgttatgttagggaattctacagcaggtcagtttctgcacaaataagcccgaaacaagatactggtactaacaaggcacaggtaatcccgaacgacacagctaaaagtccgaaacaaagcgcaataaagaaaccatctcaaccacggagatgattgtgcaagcaagcttaaggaagctccaaaaaggaggatgtcgatagcctcatggcaactgagtatggcataaatcacaatctcagatgacactgtaaactagcctgtccaatcaaacacagggaccacttcaacgccacagagccaaaatatggtattttcccgattttaatggccttttacaacgggttgtttctgctcaataagcctcaaacaagctaatgggtatggacaagtcccagtccatctcaagccacaaggcggaaatgaaaagcaattaaaaaagatacagaagaatggtcgcaagcattcaaacatgcttcggctcatagtattttcttgtcactgctgcataagttgagaggtaaaccaacaacataaatcacaaagtgtattgtgtaatctaggtacctagattgtaataatccataagcaggtcaataagtgcttatataatccataagctagattatataatcccggaaggagacgagacaaacagggtcaacacatttttgagacattgcaagagcatcaagatcaccaacttcaaaattttctcaggcttattcaggagaacaacgtcaaccacatcattctcagaccaactccagcaacactccccatcccactccgcatccgcattatacacgctcagagtcactatttcgctctccagcagcctccgcatccgtctccgcaaaacagacgccgtgtacctgcactctccttttccacggtttctctctcctctccgcacaagactgcatgcgccacctcctgctcgcgggccccagctgtcatagactgcatgcggagtgcaaatacggagtctgctggaaacggggacagatacggagagaagagagaaactgttggccgtgctaaatacggatacggagagggagtctgctggagttggtctaagctgccaatgaaatgaacycgtagctgcctccaagaaacttctctccccgtttgccacatgctcaaacttgctgaccgtcgacctgtgtacacctggtggctggtgccctataaaacctcaaccatggcctccgaccacaacacatgatcagctgcatgcaactaagctttcactgaagcaagcaaacaaacacctaaagatctgctatttgagtatttctcgtttctcttcagcttcatcagcc

SEQ ID NO: 7868 - DNA, 1500 bp, Zea mays
agtgagtcttaataccgtagagtatgtctattagatcaccgaaaagaatgtgaatgtctagaggggtaaattaggataactattttttcactaatctagctctccaactttttgtcttaaacaaaacataagcggataaccaagtgttgatatgtgtaactatggttttgtataattgttgctatctttactgcaaacagatttatgtaacctaggttttgttcctaccaactagcaggtaactaagatagaaaaggtaaaacacacaaacagaggacgaagaaaaaattaggtacggctctacgctgtatagtatgtagcacataaccaattaaattgtagaataaaaatgcataacatatatagaagtagaacattgtctaaaatgagaataaattgctaagaaacatatgtgcggtaaataatacataatacaaaatcataccgataattttactagatacgtcttggagacataggaaattgtgcttaaaaggcgacttgtgaattatatgatttgtgtccattatcacatttctcagttaaatgcctttttcaactaggtatggtttggacytagccataattgggcccttcgcccccctgacaatagggtttggatattttttgttgttgttgcgatgtactattgtgtgctatgttacttcattaggccttacgtgccacgacaatctattgagttggctgggtgtgagaggtatgaaggagatactttggcccaaattaagataacatcatttatttaatttattttctattttctatgtatttcctattttcaatggtattcaattgaatagcattgaatccaatgaggctcgccccagattgaatctgttttgaaaggatttgcttggcaaaaaagaacttcaaataacttgaaattagtagtaaagctatgtcaaataactgaataaggcagtctatctatatgtgctcttatgtggtagagacgtcacatttcacttaccttggcgatagtgaaaccaattacgtataaaagtcagattcccatgttaaaaaaatccatggagatcacgagtcaacaagcaacgtaacttggccctcaagtgctattacaacagtcttaactccaaccgttatctcaactaaccaacgaaaaccaccataaatccgccccctagatagcttagctaagctacctcaagcgtggtccagcagcaaaggcacaggaccgaaaaaataaacaaaccttccgtcggaaaaattaaaaggaaagtgaaacgaacacctacccctctgtgtatattccgaacaggtgcacacgcgacacgagcgagactgcgagacacaggcagcggaaaaatagagacaaagaaggggcaggagcagtgacctgccacaccagaggaaacgagagagagaaaaacagcccgatctcctcctcccactccgatcgccctaccgatcgccgcctcgtgaagcttccctgttccctcccgcgacgcccgcgacgcc

SEQ ID NO: 7869 - DNA, 312 bp, Zea mays
cagcttgcatgcctgcagacaatcttgttccccgtccgcgaggcgcggagccccgactccatcgccgggagcccgggacccctacgccgcgccgctgccaccaacagcgacagccgagagggcgagccgcctgccgcggggccgcgacacgaccggcaaccggccgaggggcgaagcaacaggccagcgtggacgccgatcgtgccaagcgcccagtcccgattccgccctgtctaacagtacgagactctaagtccgccctggtgagtgtgcttcactgcttctccggttcttcccctcgcactggtcccg

SEQ ID NO: 7870 - DNA, 127 bp, Zea mays
ggtcgttaatagatgacgacctgaacactcctgttcttcgacagggacggtgtggacggcgacgacgcacgccatcaccgccgtgataggctccggcgtgctggcgctgccctggagcgtggcgcag

SEQ ID NO: 7871 - DNA, 636 bp, Zea mays
gtttatcaacaagtaatcagctggccaggtgcagaaatggagcagtctgctttcttacctacaattgatcagttagacaggcacatcaagggcttagttatatccctataacttatatacccatccttcatgcccaaacaatcagcagagatcaacgattttataatccagatgtacaggtatccagttcagagtcaaaaacaaatgactcgtatatagggaggaactgatagtaaggaaggactgatggtatctttcagggtatggtatgatttttttttgccagtcttgcaagactcagctcaaaactacaataaaaagttctaccacagccaaaactgcagctgataggagtaaatccagcccctcaatcgcaaccaaagtgatggctttgcaaactacattacgaccaatgcaagaaaattatatgcctaagatccacaaatctactcacctggaaactgaatcataaacccaaatagtccactgtatctattttatttcaaatgagcacatcaatcaaataagatcgcccacgcctgagagcttgaatctgaagctcgtgggcgaacaaatcacacgttgtcggataagcattcgcacattgccacattcccaccgacaccgcaaaatcct

SEQ ID NO: 7872 - DNA, 1132 bp, Zea mays
tttttagattttatggattttcttataagttagataatttttagagaaacttatagacacatttttacaagttataaatattttatttagatatctcatgtgtcaacttatagacacaatcgtcaacttataggtgcgcaaggtggtcctcacgaactttctagttacatatatacaattcacaaactgccgtaggatcaacatatttttactcgctatcggaagacctgtttaattcccgactaactctatcacaacttatttaaggttaattggctaaattatagaactaatgttaaaagattaggcagcgaaccaaacacatccgcaaagctttatcattttccatccaacgtacaaagtgtagaagtgcgctgtgctgtctcgctctgccaactgcgatgtggatatattagctgattgattatgtttattagtttccagcttgtgacaaactcaacagtcctactctgcctttcttgtctgtctctcagattgtcccaagcgacaaaatccagaagttggcgttccactaactggccttaaactgacgggaaccaacgcgggtaggaatccccggtttcaagcaaaacgcgaacagaaatcagaaacccgactatttcaaaagctgacacgcaagatcatttgtaacaattcgaatacccaagaaaatcaattgccatttcacacgcaacaccaggaaattcccccacccccacctcccaaaaaataaaaataaattagtttataacttaaaaatgagcmacccgactatttacttcttcccctcattgtgttcttcaccccaacatcctgttgcaggactgaacacccaataacttaatgctcgtcttcgtcaccattacatcaatttttttatcttcctccgagtgccgacgccgcggtttcgaccgttccaagcaagcatttgtacaccttctgcttcagctggtcaacggtttcggccaaaccgtccgcggaagtgtccgcctcgtcctgcagcagctgatcgagccagttgctcgtctccttgagctgcgacagcaggaccgcgatcctcccgtccccacccttgggtttgggttgtccccgcacgcgttctctcgtgttcttggtggtttggccctcggac

SEQ ID NO: 7873 - DNA, 1147 bp, Zea mays
tatatatatatatatatatatatatatatatatatatatatatatatatatatatatatatatagcatgtgtcagttatagagatccatgtgtcagcatgcgtaataccctaacggtaagcacgaaagcgaagaagattatacaagctcggacatgttgatgcttaagagcgtttaggacctccttgacaataataaggctgatcaagaaagtgtggcacatgtacgtacaacgttggtgcaaaagatcatagagttcaccgcatttaattagattgtgcaatgtatgattcatcgtaaccatctgcacacaacatcaatatcaaggtgtttaaattgtatagttctaaattttcgcgtggttgatacattagatcatgcactgtccaaagtaacatcatcacgcaccttttatgatgatgaaacatgatcagcaagcacagatgcaacacacaccttttatgatagaacatgttcactcatatacagttagaacacaccagaggtctagcattgacacgatactgacgaaacatgtgctactgatgacctactacacacatcgatgaatataatgggatgcacggtcccaccgaacgcccatgttaattatgggccccacacgggtccacatttaacactgtttgcgtcatacgtttaagaaaacaaagcacctacatattcacattttacataaataaaaaataaatatagttttgccctgtccggcacgccatccatcgtcttcgaccttcgttgctgccactaacccagcagattttagacgtactcccaaaaccgcccctgccggctctacaggatcccagggtatttcggtcatcttacccctatcagaactctataaagcagcacccgaaatcgtgatatcccctcacacacacactgaccgacacagcagctccgctcgtcgatcagctctcggctgaccactcaccgccagtgggtgcctgccgaccaggtctcgccaccgccgccgccgccgcggtagagaggggagggagagggagagggagaaaaaactggcccagatcgagaggtacagcacgaaaaagagaggcaagagagataggggaccggagggcggcgggccggggcccaagaccgaggggctcgtgcgcaggaagctg

SEQ ID NO: 7874 - DNA, 130 bp, Zea mays
aaggttagtagtcatggtgattttacactccgatcatgcatttctatttttctatcgatgccttaatcttacttcgcattccaggacagtgtagtttttgtgtggaccctgtgtgttatgtctgatccta

SEQ ID NO: 7875 - DNA, 895 bp, Zea mays
ggaaaagatgcgccttcgacggacggaaaggataatgggggcggccatggagaagagcagctaaggaggtagaagataacatttttttcctcttttcttttttttggaaaaaagttgtctatacttttcagaggatcgcgctctccagcggaaaaatttgtggatttcatttgtcccaaatccatagtgtcatcctccaagcttccttgcgtgctggatcctgccgaatttgagtggcactgttctcttgtgacagtttgtgaccgatgctacagctttcagctgaaagttgattttataggtaacagtaaaaaaactgccacatgggtaaaattattgttaatgtgttccattatcactggttctctcattaaaaaaactttcttcttaatcctgtccttaatctggcttataactcaagttgtgatcgagcaaccacaaagctgaaaattcattaacgcttgtggttctggacttgtggttaacattaacaataccatggggaagcacctgacatcctggtatttgcatatatctgcaccccaagctcaacaattagtactgcatctgattcagactttcatgtgtgtgacttcccaaaactaaaaaagcaacagttgcattgactcttcataacagtccattggtttctctatagcagcactacaagttacaacatacaaattcaaagtggaatgaactgtcctcatctgcttcatgtggcctttggggctatctaattcacctcagcaacaccaatacaaaacctcatcttgaatcatcaagaaagaacaaatggggcaacacgaacaaattaacacacaacatagatcaaacacaaggtcgtcgatcgcaaggttgctggatctagacgacctttggaggtgcctccagc

SEQ ID NO: 7876 - DNA, 1500 bp, Zea mays
ctgcgcattgaatttgctagtcacgcatgcccgggctaatccggttagctatataaaaaggttgtctaaaaagactaggtactgctgtgccctcaacttggatcggatccacctgtgaaagagaggttggagcaattctgaacggcacgtcttttcctacgcgaaattaagacactataacctggccaggtcctaagcactgcaccaggttgggccggccgagagggtccattctgttcccctgctgttttttttcagtcgttttcttcttgtcgtcttctctctcccccccgtccacgagtgttctccagcacagcgagccgagctgcctcccgtgctakcttgcttgcctcttctatttttatcgaaaaataaaattgaagccgtgttgatgctcaacaaccaacagaatttacccagacatggcgatgtcacctggagcctatgcatgtcgcctcacttccagcttccaggagcggccatagctcgtccaagtcaatatacggtttcacagtgtcgccgtcgtcgtacctacggcttcctcttctcgagcggcgcagatactgctgcgtgtaccatatcgcgatcacactaaacacgccagctagcgcgcacatcaccgaacggaatcacgtcactccagtctgtctcgttgtcgtgctcgtacgttacgcccaacaagaagaaaccggccacaaaaatcgcctggtccaattggtgatacgtcgctcgtacggtgccccgaggatacccgtaggcagcctagcaacgccaccaagtacccagacggaatcaaccggcaccgcggacagactagcgttacggccgtgcggcacggcccggtgcgcgcgggacagttcggggactctggagctggcaccagccaccgcgcgttgcccccggatcgccctccaaagaccccaggcgtggcgcgacccggcggcccatgccatccatcgcccatcgtggcgtacggctgggcgggagtcagacgacgaggcccgacgggaacgcgtggcgtctggcgaggcgcgccggctcctccgttgccccccgtcacgggattcgcccggaccacacgtaacagttgcgtacgcccccgccacgggggtccgtcccgtccccttgcctcgctgtcccgcacgtggtcgctccccgctccgcctcttcctcgccgacgccatggccccacgacacgtccccccacttgtcagcgaggccgccgcgcccggtgcggggcctaccgccggctctcctccgcctcctactttagtagcagtacccccggcgctaacacaacacaacacagcaccgctcgtgtactgcccgctactctaatttgtcctctacacttgaccactgcagctggctggctggctcgtgagggattcgttaggggtggacgggtgggagagtagagaagagcgtagacagacagggacgccgcgtacgtgcggtgtggcattgttcgagggccggcagctgtgcggtgggggagga

SEQ ID NO: 7877 - DNA, 1436 bp, Zea mays
tagttaactacctcagaaattatgaatcaaacatggtacaaagcttcttatttgataatgttagcaactttaacaaagcatcttctagatatacaacctaatgaaatatatttgacaggctcgacacattctagcatatttttatgtgtcacaaagtacaaagataaattcaatgtacttacatatttaacttatatattttaatggaaatacaaatctatttactgttaatgcctcgataacaaatggtgaaaattgtattctgagttaaacataggcgaattcctttgtagaataatgatctcccactttggactaccaatgttagataacaatatttatcctattgatcacaggtcgtcgacaaatacacagatcagctcaccaagcatgaactaccattgtcaccaaagaagtaagtattcgaaaacattacttcaaaacgaatcctctgtaatcttgtgttcacagttaactacctcagactaatactctaccaatacaaatttatgaatcaaacacggtacaaagcttcttatttgataatgttagcaactttaacaaagcatcttctagatatacaacctaatgaaatatatttgacaggctcgacgcgtcctagtatattttgatgcatcataaagtacagaggtaaattcgaatatgtttactgttaatggctcaataacaaatggtgaaaattgttttcccatttaaacacatgcaaattccttagtagaataatgatctcccactttggactaccaaagttagataataatatttatcttattgatcacaggtcatcgacaaatacacatatcaactcaccaaacatgaactaccattgccaccaaagaactacttattaagtattgtaatctcatttcgcactacaacttttagtgccaaaattctcacttaaaattcatcaacagctgctgcaaagcaacataatttacttgcttctgatcttgttctcaaatatttatgtgccccaagccccataacgactattctccatatttatgtacaatttccttgtactacaacatgcttatcaaaaggaaaaaaatgtaaaacaacatattttgcatatgtcttatcttgtttccatgtacttatatggctcaaaaacttttatccatgttcatgtacactttccatgcactaagacatgcttatatgaaaaaaacgatacaacgcgcgcagtacactagtaaaaattgagggtccatgacggcatacaatcttaccatagaaacaagaaacataaggggtgaacatgctgcaaaaaagtaaattcttagcctgcatgacacggttggaacaaataccttcctgtgaaagtgggcctcgcgttcatagatgccagtcctcccctccccaaaacccagcacaagcaagggaagggagggcacctctaggctccagcc

SEQ ID NO: 7878 - DNA, 525 bp, Zea mays
cgtgcaaactcatcgtatcgaatatttagggtttgtatccgacggtaagcgggtgagatgtcatcacgaactgtgccgtcttgtggcttatttgaccggaccccacctatccggcagcctatttcacgcatgctccccgtgacaatgaccttggccgtgccagttacagctactcaaaacgatctagcctccaccacactttctcgttgacaacccggtcctacaacccggtcctacaacccagtccttcccttgcccacactccgcagagccggtggtccgcgatctcgagtaacaaaaagtaaaagccgcctctctgcggtgccgactattcccgagattacattattatatatatcttcccgcgcccgagattccccgtggatgactcgctgacatgtgggccctctctgcgaacctcgccagcactaatcgagccgccactggcagcatctgaagagaataaaagacagccccacacgcagctcgaatcccggcacgtgagcggcggaggcagggacggcc

SEQ ID NO: 7879 - DNA, 1386 bp, Zea mays
ttttcgcgcgacgagtgtaatacgcgggcgtcgccagagaatcgtctgaatctgataccacttgtcagcaaactggacgtccggtgaccactgtcggacaggaagaagggagcggaagaagaacagaggaacaagaattggggaattatgattctgttaaatttcttctccccttctctgtcaacaacaccagtatttatgtctctattacaatacggcccatggccacagcccactgctatttcttactggacccactcagctccagacacatactgattgggccttctatcacgccggcctagcctccgaacgccgtctgcttcttgactcagcccctcactgtccttgtcttgtattttcctagctgatgtcctgacaccgttgcggaaaggatgcatgaattgtaaatatgtgtgagttgcttcctgacgtgcgcataggtgataacctgatggattcctgttatacgtctatatcttgtaatcatgagccttcacactatgactatattaaaattaatactccctcctttccaaaataaaatttgttttaccattttagttgattcatacaataattaatatatttttatatatgtatctagattttatcatcatctatttaaacacagatatatgacggatgaagtatatgatactacttccgttcttaaatatttgtcacttgctagtttattttttaactaaaacacgataaataaaaaaagaacgaatgaagtaccaaattatgatagtaacacactctgtcttcatcttataatcctagacccgtcaccctaaatctgatccttctatgctctcattttgatagtaccacacactccgtctttactttcttaaaagtttttgaatcagttccccatgctcccttattttcccagttgctcgtgacaaagtagtgctaaatgattgaagcaattcacaccattatattggacggccacgacgcacggctttgttattcgctatccttggcctgccgtaccaataaagtccaaatatccccccttttcacgtcttttatgttgattgatgcgagttcaaaaagccctaagcaaacgacagaaccctaccgtaatttcaagttaaagaaactagcaacaataataaccactaaaaacagcggccacgacaaccatcaccactggactggattagtgacgagacgcacccagcggggccccacgtaagcgtccacatcaccatccgcacggggccctataaatacggtccaccgctgcccatcccatccacctctcatgctactgctgctactgctaaaatccccctcacactcacacccctctcctaatcatccgcttaaacccacgagcccggcaggcaggcaggcagcccggtgccg

SEQ ID NO: 7880 - DNA, 657 bp, Zea mays
attaaagaacacatcctaaatagaaattttagggactaaagtatagttcctaaaatttagctaaaatttagattaggagggtgactaaaattagttgaatgcactatagataatagttagctactaaaattagtcaaaaacatcatacatactagctaataaattagtaattagctacttttaacaaattagctaatagttagagcatctccaacaataaaccctaaaataaagccctaaattttgaaatagaactaaatatgtttagggtcttgaaagaaatgtttactccaacagtcagatcttaaataatgctatttagtaaataaatcatgttattaggaaataaatggttgaagattaagtcgaattgaggatatgactcagtatatagggtaatgtatgtaggactcgagagactgagccctataattatttgatraaattttataaaatagagccaatgttggaagagtgttttatggttttgattcatataattaaaataggattatgtttagagtctttatgatcttagctacctaattccactgccaatttttagccaaataactagctaaacaaacacccctcggcactgatagaagagagaagaaacagacagcctaaagcccttcctctctcctcggcgccgga

SEQ ID NO: 7881 - DNA, 406 bp, Zea mays
tgtattgaacttttgtgcgcacggatggacgatccagattgaacaacagccatgcgggctacccttagagccttaataagtagtagagataatactttgtccttatatatattttatttaaatccatttgcctgaagtttgctgttggaagcaaagctgcttgagtctccgacattactttttttttctcaccgtcgcgtcttgcgctgcaaaatctaatccgtttccgaccttctagaagccttcaacccgccactttgcccactctcctcttccttctttgctacccatttcgtcgcagtagtcggcagtcgaaaccctagtcccctcgctttccttccactcgccgtcgcggcgccgatagagccagagctgaaaggcgtaggaaaagctggtggaggagggg

SEQ ID NO: 7882 - DNA, 533 bp, Zea mays
tcttggctgtgggggtgttggagtttatgcttattttgtcccttgggccttatgtacctaagccctatgagtcgttgtattatggaaacatttttctccaataggaatgttgtcggctgtcgccggtgttgtcagtcttttgtactaagatttctatatttggttcatgagttactcatgtgctaatgatgtatcttgcacacagctagttattcttttgaccccacggattctaatataaacttgtgcaatatcttcatggaattgttacatacctaatgagctatggatagaatccatgtcttccatagtttaaaatttttccaaaccattgggttataatccacgatgagtttaaccgaataaaaaaactgagtaggcttggattattttgggatatgaattgtgacatggatttgattccaatccatgctaatctagagctggattagtgtaaatgaacaagagtgcaaaacaattgacaacaagcacaaaccgttaatgctgaagaaactaaaaaaaaggtttcgaat

SEQ ID NO: 7883 - DNA, 1500 bp, Zea mays
gaaggtaaatcgaatgcgaaccatgtacgtgccaggatcagaaattcacatacactgcgattacataattggacatcatcacgcattgctcaaaataatagcggaaataagtactttattacatcataatgtccaagacatctatagagtcattaagttaagtcataatcaaagtgttgaatgaaacatagtatgataaggccttcacaaccaactaactaggggtttgccactaatctaatctagaactcgtcgaagtctcgaaactcctgaaagtactccatgttgccttcatcttctcctgagcactggttacaatggcgacaacttgtggtttggtgtttttaagcaagggtgagtacacatcaacgtactcagcaaatgtcccgtttggctaaagtggactagctatatatggggttaagcttaaagcagttgcttttagttggtcaggtatttattactagtagagagccaagttttaacaataatcccaagttattacccaaacagtactccctccaagaggaaagaccagaatccataattataatcaccatcattaagcatcatcataaagatatccagagtaatctctaatcaaaggagctcccaaggctgctcataaccgtgagcactctgatataccaatttctaaccctctacaaaggttgcacactttacccacgagtcgtgatcccttcccagcccgggttgtacagacccgatcttcactaccaaggtgaatgaccaggaattcactatgtagccttcacaaagatttcctaaaggtcatagctgtgggggacagatatcccccgggtccactagaaggctagaaggcctcccacggagcctcaggccatttacgacgcaaggctttcccttcgtgggccgggctagaactactggcggattggcccgacccgagaatgaagcagattcaggcccaagcaacacgtcaggctcgtgcgctatccgcagcaaccgcccgactttcccgcgtatggcgcccttgaatatcggggtggattagggataagttggcaagattgttggaagatcagttcagtcggttcactattatttaggagacgcgtgatcctcatgtacacatggagtgccccacggtcgagtatataaggcccagggggtaccccatcatttccatcgactatctacctatctcattagcttttctccattcaggagacttcacttgtaacccaccacataaagatccacaccagtaagtagggtattacgcctctccaagcggtaagaacctgtagaaaattgcctatccatctcttgtgcgtcccgcacgaaccattgagctacagtcgatagcaccgtcctacccaaaagcaccgcaagggataaccctgggtgtgcggtcggactctaaacaccgacaaggccattgattaaatcattcatccaagggtttcttctggaattgctttgaagatcttccttgtagtgctcccaattgtattg

SEQ ID NO: 7884 - DNA, 1306 bp, Zea mays
tggctcatgacgctgagcaaagagtctaaatttaagaattgttcctacaagaatctaaatgtgaaatttctctgcaaaagggtcctaaaatgaaaaaaaaatcagtcgaagggtcacaggtgtggaccacttttctacggacgcggacacgcggtgctttggctgattctttcctaccattgtattgcggcttgcgtgggaagcgttgtgccgagaagctgtgggagaatctcggcgtttgttatcacgtgatctccttttttcgtttttatatttaaaaattcaatatttgtttgtttatgagtgtttgatgagtatattgtacctcttgtaaactgaagcacacgattaattctttgttaaagaatgccatgataatagtttgctataaatgaaattaatgttaaatcaatttgttaaaaattatggtttcttctgaatttagttattgccgatagagaaaaaacattgaaaaaatatttagatcatatacggctgaatttagttattgatgatcttatttgttatattttatttgtttgaggaatacacgcttattttacttcaccctgtttgttactttagtcactagattaaactttagtttaatcgctaaagtacctcgttggtttcagtgactaaaccagactaaagagcattaattgatgtaaataatgactatgttgtccatattaattagtggatatttgctgcaaaaagaaagtgaagagggcaaataaggtaaaaatcctactttaatcccttttagccatcccttggtgactaaagaattaaagtttagtcacaacactttagtcaccatatttaattctttagggactaaaagtgactaaactttagtcaccccaaactaaacggtaccttagatctatttatttgaggaatgcaagtgtttgaataactattctatttaaataagatctacctaacgacgtayggacatctaactagtatagaattaacgtacacatgtattgatttgagtgacccatggctgattccagtgatcaacaataatcctgccaagcatcaagctaatcccaaggtgccacggaatggtctcgcccgccgccgctggccacatataccagcaggtgaccgtcggattgggtggcgcttggcacgtgttcgggtggtagctggctcctccatgcaatgcctatgcctgtcgtcgcgatcgcaaccaccagtcaagacgaatggcaggcagctaagtagctaacaacaacaggcttgtattgtatgtacagcaatatatatacatctcgagaagctcctagcagag

SEQ ID NO: 7885 - DNA, 816 bp, Zea mays
tggtagacgagggcggggtcggcaaaacgagtcacgcttgtccacacggccgggtgaacgggggtcaagggagtggcctgcccgcgcacgtccgagggtgagaccgcagtttcatcgtccggtgagtggaagtcgcacgaaccctagaagcccccctgctgcctctctacctctctccctctgataccaagttggactgaaaaccctaaccctaactaggttgggagtgcatatatatataagctgactaattaggctaagcccattacactgagtgtatacaagtaattacacagggactaaccccaaaatcctaaaagtacttctaacaattaagatcataattatccctatctaccatattggaatattaagtacactaatcagcttggtcaaggattttgacacatcttgttctaatgaacaagattgtcgactctagcagtagtaccccatgatgctgcagtttgattgttaactgttttttaacaagggcttaacatggtacggtttattatatgtcagacttaaactcttacttccagattactctaaagtaaccaaatcaccatcactttctacatcagcaaatagaaaagcatggaaaacacagggcatttttttagtgatattgcacggagctatacatatatgcgggcagacatccattgcagttgcaatggagctttcacatcccttttgtctgcggagtttggtggctcacagcatatataaaatgcaatagaagcttaatgatagccttgttaacttagtgcttaatctagtacaagctgccagctgatactaaattgatca

SEQ ID NO: 7886 - DNA, 921 bp, Zea mays
actgtgatatgtgccttattaatgcaaactgcgactattgtgccttgttactgcaaaatatgattctgaaacgatttttattgggtcactacattatgctggatgtgttggatggagcgcttgattttttatttggtaattgcattctgaaacgatttttattagccctgttrtatgagctggatagggcgctcggttcccgtgagctcatgcgggttgttggagcgcctacttacaagttacaatgagttctgcagcatagctggttgcgtatgcacaagcagactagccgcgtgcagcatgcccttcaatcctgttccatttccacctgttgctgcgcgcgtcttggcttttcagcagccctgacatttgactgctagtgctagctactagtttcttcactcgccttacaaagttacaagtgatctcggcaaagtgttactggtagtttagtttctggaaaagcttgttctcttgttgttggatgattgatgacaatttgataaggccgtaccttctggcttcagattttcttcatggcatattgtatgagctggatggagcgctcggttttggctaagctaaccaagccaaggagccaagccgattagtgttttaaggatggagccaaacgtgtttgctataagattagaccacctaatttggagggaggagtttgacagaataaaagttgtaagtgggtatttgaaaacaccccaaacttgcaagtgggtttatgcagttttccctaaataaaaagcagggaatattaataattgcagagtgccaaatgattctcaaatctcaatccatcgtactagtggtaccaccacacacagccccctgtgccctcctgccgtccgtgacgtgacgcagccgagccgcgcgcgcgctccgggccggacgcctccgctcgaatcg

SEQ ID NO: 7887 - DNA, 698 bp, Zea mays
ttgccagtcggggctttgagtaccctctgtccaagactgcggggtgttcagcaagctggttgcaggcttgcagcagccaagccaacagcagtgcactgcaacctgctgcagcagccacagacaatgtttttttttcacctccatcaatttaaattagggaaaactgcaaaaacccacttgcaagtttggggtgttttcaaatacccacttacaacttttattctgtcaaactcccccctacaaattagggaggtcctcaatctgtaattaatggctcaattcacagactttgggcttggctgattagcggctctcacacgagcgatgagcggctcctcccagcaccgccagcacacgagccgctcaccagctcccagcacctctcgggcacctcacacgagcgatgagtggctcccagcaccgccagcggtcctcggcgctggctccccggcggcgacatcggatcgggccctgggatcccgttgcacaggcgagcccccgacgctggcgcgagcggtcctcagatcgggccccgggatctcgccgatgtcctgtaatggagccgcagcccatcggctcgaacaggcagaaggttcgttttcctcgcttttacccttgtcgattcattttgttctcccttgctgtttaactcgttgtccctaaccctaaacccttgacgacgacgaccaccgtgcgca

SEQ ID NO: 7888 - DNA, 1500 bp, Zea mays
tagataagctggtggaagacattttttctacaaaaaaaattctattcatattaattaggaaggatatagaaagtctcctgaaattgctctaagagcatctccaacaatgcctcaaactgatgtctcaaattgaaatatagggctatataaagaaaaaaaattactccaataatgccttattttataaaatttgattaaaaaatatagggcaccatctcaagtacatcaaatatactaaaccgtagtggtctgccctataatttagatttaagactttactgttagatcataatattttgttggtgccttattttctataaaaatatacttatttttaaactataaaacatttttataggtcatgttgatgaagatgatctaatacgatttatggaaaaaggtctatttccatatcctcttccgtgtttatttctcgttctcatgaaccacgacccaaacagctgatataatttccaccgatatcccacaatccaagccgatttttttattttagcccttttcagaaaaaaatttacgtttgacccgatttaatgtcgttgttttgacctatttctcggtgttatggctcatagcgctcaaacatgtctcgcgtcataagccatggcgtcgaggtacctaatgcgatggtatctcgatacacgctgtcagctcatgtgacctagctcgatgcatagattttggaaccgacctaggcaatggtctcccagttgcctctgccgaacatgcatgggtacatatgtatgtgtcagcgtgatagtgtcagacgtcggcacgtagataaaaaatacggtatataagatgatcgaaaaaggatgtataaccatctaatatctttaaaacaaaagaataaaaaattataccctacatgctaataacgacggtttaagaagcataagtcctactcaaagcactcatacctacaagtgacgtggatagtctcattattgtcattttaaaccggcttccatatataaaaaaactgtctatatgctgtagcgtggtgctccatgatatcaagctgtcagggaggttgtgtgttgtagttgcgtcagggagatgtcaggcacggtcgcacaggaagcctttcaaaagcacgcaccctttcctgtgaaatccgtttcttctccttatccaatcagccattgtctagttcggcgccacaatcgtgaggcgtagaaatagatcacatcaattatcagcgtgccgtcgagacatgtttacccaacgtcaccagccttgacgtcgagcaaaacgtctaaaaaagaaattaagtcgtccatcagtcaaacttaatagctaaagttaaaaaaaaattcggacgacccaaacaccacccaaaacacgtcgtccacctccatgcccgccgtttcccgattccccagtggccaaaaccatagaaacctccagccagagggaggagttcaagagagagtgtgtgtgagagagaaagagagggagcgggagagccggagaggggct

SEQ ID NO: 7889 - DNA, 113 bp, Zea mays
agtaagggcttgtttggttagctctcaatccatgtggattgagtgagattgggtgggtttaaatcccaagcaagtcaaagttcttctaaatttttttcaatcccattcaatcc

SEQ ID NO: 7890 - DNA, 530 bp, Zea mays
tgaatgaagctagcaaccgacaggttttgttctaaaaaaatgttttaaacttctaaaaaaagatttgcatcttggtatatgctgtaatttttgttgcttcttgacttgtcaaggaaaaaaaaagagggccagcatgtgatcacctcaagaggagtggagaaaacccatgaacgaccaaaggcttcaactgacaagctttgtcaaaccgttcttccataaaaaaaaactgttctcccctatcctcaaagaaacgtgtgccgagatgcaacctcacgctgactcggcgcatatactctgtatcattggcgcgatttctcggtttcttctgacacccgacttggattgtctcgttcgtcttcgtcatcgtcactcaacaactcgtctcatcgcgccgcatcgtttacctcaaggttgttttgttgcttccttgtcccgctctcaccagcaatcccgtcgatcacccagacctccacggcactgctccgtctcctccgttccgttccgaaccgcaagctcccaacccttccgcg

SEQ ID NO: 7891 - DNA, 863 bp, Zea mays
ggttgttcatttatgctttattttttcctatcatgtatttcctttttgtgtgttatagtaatgaatggatcggaggatgcatgcatggatcgagcagcggggtgtccaaatcgcgcgcctgtgagcggctcacgggatgtgcatcgccggcggggcgttgtgccatgacagagctccagggcctaacctcatctctcctgtcgtaggacggtaagtgcattttccctgttcattcatctctttccttttcttttcttttcttttctttttttcagaccactccatccgtcctcctccctcacctgtcctgcaattttgcattttttagacctgcttattttggtctggtctaattgtgaaaatgggtgtgtagggattggaggaccaattttgtagatagtctggtcagaactgcgagaaggtccatttgtcttctccttattattgtggtcttcagaggtggattttctttttgcacaaatcagatatggacgacaacgacggcagcctagatggccaggcattcagaattggggcttatatatgacactgaaatatcatgcatggtggacatataatgcagcaccatattggctatgggatgatatcagatgcacgatcctgtctagatgatacaaccacagcatgagacacgtcttcaggaacctcctccatgcagggaagaggaatcaccatctccattgattgaggatcactcggtattagtactgrgccatctgtgaagaggagtcaccaaagcctaaaatgttgttattccactggaggatggggaacccaatggtcatgcgccaaggaggagacctaataagactctaggggtggtgattaatgtrttgttgttc

SEQ ID NO: 7892 - DNA, 275 bp, Zea mays
ggtttatggtcgaagtgttgaaaatttaatagatcttccttcatcagataactcccgaagctattattagaatgggaatttttgtctaggatgtgagaagccagggagtggagccaagcgcgaaatgtttctgcagcatacatgaacttgcatatgagacgaaggccatgggcaaggaacaatatcacaataactttggttgttatggatttactgctcgccccaacgcaagttatccggtgccaacataccgaaaaaggtgacctggagccggg

SEQ ID NO: 7893 - DNA, 249 bp, Zea mays
tgcatgcctgcagcattccatttccaggaaggccacggcggcgagaactcactcgggcgctgccggcgatgtacggcacttccgaccccacagctgcggagcgcacggctttccggcgtgcggagaaacagtacaagctttacaagacactcaacgtcaagggcaggtccaggtccaggtccaggtcaggatgcaggccgtctagcggagagggaggtggcgctgatctgtcagccgtagttgacttcc

SEQ ID NO: 7894 - DNA, 596 bp, Zea mays
tgcaggcatgaaagctcatactttaataaccttgtttctgtatagatccatcttttgcatggacagcatacttgatcttgttttatgtgttgaatggagacctggctaaggttctagcgcaaagttgtctataagctcctcctcttagcaggggcgaagccatgatctaagattagaggggaccaaattagattaggggggctgttagaacgattttttgtatcatttacatgaggattagttaaaaaaaaactaatagctcctatagaattaggccccccgtcgtcgcccctgcctctttgaaccatgattttggcagttcgtctctctttttttttgaatatctattacatatgcagtctagtgctatcttaatacatttgagcttaattcttgtaatatatgcatactagtaatacgatgcatggtcaaaatgaaatcattgccaaatggatagcgttctaccacaaagaaaggatttgtgtctgatcttttggacataactactggcacttgtcatgcttattttgtatgaaactaacttgccctaactagctgtgtatggtgtttttttttatctccaggtactgttgctg

SEQ ID NO: 7895 - DNA, 875 bp, Zea mays
cacacacgcacatatctggcatcacatttatggattaaattggatataaaaatgcctaaattcctaacacacactcctgtcgtcgcacgaccgtaccattgccggggagtacttttgtcttcttttgtaatgtgatctgatggttcaagtctttttgagcacgtcgggagaggggaaaagggcattcgttcctggtactactttctaccgtgcccaaacagcacggcagaagaaattttcgtaacggttggaatatgtccacggttggtatacggcgccggtgggatcggacgagccgaggctcgcacgagcgcactcgtagtaagggcgccgcaaccgcaagcaagacggcacggaaagaaacggctaggcgaggccgcacggttgcgaggatgcacgtggcagcatttactcgcagtgcatgagcttggcatggcccatgggcccctcggccggtctcgtacgacgccacatgcgcacgcgaacgcccatgccagtctgctctgtgtgtgtgtgtgccacggtgcctgcaactgcaatgcaatctgcctgactccggccgagagctctgaattcgaaattcgaaagccccagccccaaccccaaccgtcgtccgatccagcaatcatgaccttctgtttcgtcggtaacgtacgtcactgacggcgcggaacgggaagagaccctgcgctgctccgtccgttgtccgacccaacggcgcgtggggctcggtcgtccctcggccgtcagatccggatctgacctctgaccggaggccgggcaccttcccttcccgaggaccgtggctaataaaaggaggcccgatgactgccacaagcgcggtggcctgcgcctgcgccgtttgtgttggcccg

SEQ ID NO: 7896 - DNA, 1193 bp, Zea mays
agtgtttacaagtgatgtactttacatgatttaagtgatggaaataatgaatttactaccgagttatcatattttaaaatatttaacaacctaagaatcaaaaactattggaggttaaggttgtttttgttcctaatatatatttagcaacttgctaaatcagagtttagggaacattttttatagaactaatggatttgctctaacaaaataaaatatgacygaatctctaaaatatgagtgtttttctcgtagtaacaaaaataatctctatctctaccgtataaaagcaccactcctcttcccgctttattatattcagtactaagtataatataaaacaaagtctacctatatgatatatacaacaatgcatggatatctaactaggataacactcttttaaagtaggagttttatgtgtcatgtgcgaagcagtatagatttgttcatctcactcgtttctggcttaccaatgggctgttacactatagatggatcgtgaaaaatcatccgagcacaatagacatggagacacatgcaacacaacacttccacatagtaccatctcgctagctaaagaagagcgagcgaccgaacaggctaaaaaaaggaggtcagactaatttttcaacccatatatttctcggccttttggttaaggtaaaatgtaatatttgttgttgtcagtttaataactgatttatagaccatatgttcactttgatattaaaattattttttatggatattaaatatgagtgggtgccgtcgcaacgcataggtattggactagtatagcattagaagtaagttttaacaacccatgatgatgctctaaaagggttcgccgttaagctttttttaattcactgacaagtttaaatgggttaatcaccaaattggtcgctctggctgcatgtggcatgtgcatcagcaaatgggtaaaccacggagtatacggggaactcaaagacaggcccatgtttttgcaacggcccaacgcgcatctacatgtacgtcttcctagggttttggatgcgtcgcagataaaaagttccctccctaattacaatcttcctcagcgccgccgctcccagacaccgagcccgactgcccaaccccgatccggcgatccgtctctttcctttccttcgttctgcaggccccgatcgcttgcattcccgtcaacc

SEQ ID NO: 7897 - DNA, 734 bp, Zea mays
ctggtaacagattttttcgtgggtgcagtagtaccataactgacccaccctctaatctttactccgacctacaaggtactgctgtagcctgactcaatcaatgtgattttactgaagcattcaccgattatacaatcatttgtagccacaaatgcacaacgttttttaatctgctgtcaacgattgcaacttttttatttcaatctggtaattcttaaatcaatctgctgtcaccgcatgcaatacttttaattttgatccggtaattcttagattaatctgctgtcactgaatgcaactatttgattttcatctggttattcttagattaatctgctatcaccgattgcaaatattttgattttgatctggtaattcatggattaatctgctgtcaccgaatgcaacacttttaattttgatctggtaattcttagattaatctctgtcactgaatgcaactatttgatggtaattcttagattaatctgttgtcaccgattgtaactttttttaatatctgcgtcagtactggagcattgaattctattgttctgagttctgtttaccaaattgtctgcagttgcaccttgtgttacatgattttaattaaactgcataagacaaatgaaattgttattcttatgctggctgtgtaatcttgatacatcctatttcaataatttttagcatctcctgtaatctgaaatgttaatctagtaggaaaagaagta

SEQ ID NO: 7898 - DNA, 1500 bp, Zea mays
gtgattctgcacctgcatggtggcctagatctaaaaaactggcaatcatagtcgatcggcaccagtgcgagattaattaaaatatctactgcgagcagtagtagtaaactaatcggccgctgctcgcgtacgttacgggggtttgaaatgtctcttaccttgcctgctgacaaaaacggccgtcattttctgcggaaagatggttgtatatattagcagtagatagattggtggagggccaaagtgagatgtttatagcagccttgatccaacaatgatcgatacacttaatcaacttgtgagtggcctcccgttctaaccaaaagactagctacacagctagcatgaactccgactgcgggctcgcgaatgagggccaaaaagcaatgcaaaagctacgtacctgcgtgcagctcgcgattagagctagctaggggcgtgggccgagtcgtaaggctactcaatttctttgtaagattttgtaggccatagaggtaggaggagtattattttacagactcctatttctctactgcttacctaagactcgtttctaaagtatatatatataatcccgtgtaatcttcttgtaatttacaagattgctctccggcgcgggtacgtacgtccgtttcaacgctaatctttgcgtagatcggcaaggagccgtttagatgtattattggttgatcaatggctacaaacaagtccagatatagctcacccgactctgattttgatagaacgccaaatcgacgacgtttctgcacttttaactcgcgcgtgtgtgtgtgtgtgttacctttcactggtggtggtgctgtgcatgcaaactatcattttcacatgatttaggcacaaattgagaatcccaagaaaggaattttatattattttccttgacttttggacggggagaggccacgagtgagctaagctttgcataaattctgatgaaaggagaaaataaagaatagagcgatgacctaacatttccttccaaggaactagcactatatattatatataaggagacaacattttatgggggtggtttgcggcggcactacctataaaaaggggatccctttgatggtactactatcaatctacactatatactcataatattttgcaaggatctgaggtagctcggtttcttgatctcagcacactactgtagtagcaatatttgttgtcgttggcatgtatagactgattattccttccctgtctagctagttctttggacttgtgtagccatgtcctatattccttttttttcttctctgaaatcgtcgtttctctatttggatcataatatacaccaccagatcaagatcactgcaacgacaatttctactgtacactttttgcgaaaacaaaaaaaatggtttggttttaaattatcttgggcatccatcaataataacaatggtatcatttgctgctgctgcagctgttggagtgttagaccaaccccggccgtcagctggcaaa

SEQ ID NO: 7899 - DNA, 327 bp, Zea mays
ggtgagcccgccctccctcccctctctctccctagcacacggccatggcagccttctcccggaccaccggcagcgacatcgtggggaactgtgccatcgcgaagaggcttacgcggccgagcaccgccagcacgctccgctcctccctgcgcagtgtgttgccatctatcgacccctagatttgggagatttctgtgcgtgcacatcaagattccaactgatgcgtcttggtttttttcctggattctgctgggcaactaactgtgttggctacaattagtagtatccgatcccttctttagtattataatatagaaattttgcaat

SEQ ID NO: 7900 - DNA, 1080 bp, Zea mays
gctaaagttggtggtagatttggagcgacaaaagatgccgaggacaagagtagtataataataacatgataacgtgatagtgtatcactaatagactggaacggagtctaaccaactcggctagacttgctgtttgaatgaaacataaaagttggtttggttcgagctggttcagatttttaaatctctctaagccaagtctaagcgagaccgagttttttttcagcgtttggtaccctctgcccctgaggccggatcctcccatctagctttcctttttaaacgcacgccacgacgccgatcggcccccacccacgacgatcttcgaattctcctcctcttttccttcctcttctgcagcgccagcgccagcgccgaccgaacccaacgccaacggcacggcaagccaagcgaagcggagcaagggtttgctcgccccacacccgtcccgcggccgaggtgagctctcgcgatcctaccgaatctgttgcgtgtaccggcctacctgggtgggaatcggctgggggttgtgttgaaatgaatccttggggaacgggcggggaatgcgggatcccgtgcgtgcgcggatccaggccctgccgccgagctgcttagcgaccgcgttggctcgctgtttctgttaggattcggttcggtttgtgttgccgtgttcctattctgttggtcgaccgatgatgattccgtgcaatccgatgctggattcctacgctgcaatcggaggaaagaattgatttccgtctgggaggttcgtcttcggaggctggatttgttcctggtttgaggcgtgagccctgggggaatgtgatgaatcggaagggcttgctttccatttaaacatgcctttctttcgtctccagatcaggagaaatagtcgatccccgtggttgcgtagggtgccgctaccgcagcatgcactgcagctctagtctaggatggtacttctgtttgccagcggtgcgatattcttgcgatagcctgacaaactggcgactcacgggtcgttgttcttgctgttgctgcaggctctgcttctcatcgtgacaagcctggcgaactgcc

SEQ ID NO: 7901 - DNA, 161 bp, Zea mays
ccgggacgcccgcttctctccgcgcccatgtttgtccacgcgttcacttccaccgccacgccgcaaagaagagagctaactcctgagctaggaatgctcgtttggccgcgacccctgcgacgcgcatttgttgagaggcggcctactacgaactaccgtcg

SEQ ID NO: 7902 - DNA, 373 bp, Zea mays
ggttggagcagagatgaagttcctactagtgatgcacattgtttccttgcaatgtatcttgacgtaaggaatataggcaggtgggattagaatgattcaagtgctacctataacaaaaatgatgggatggctgtcttacgatataccagttttcttatatagtaattcattcagtttgacataatttgtgtttgtgtgctctctagccattgctgagacatttttttgctcccatgttttaaatttacagcctccttctgagaaggtgcatcagataattgcaaggacagccttatttgtcagcgagcatgggggacaatcagagattgtattgagggtgaaacaaggagataatccaacatttggattcttg

SEQ ID NO: 7903 - DNA, 169 bp, Zea mays
ctgagggttctataactgagcaagagaagccttgggtggcaaggccgaccgagccgagggactcctacgcctccgggatacggatacctcactcgtcaccatccgcacagggcaactcacactcggttaagcggttcagctagccgacaggcgagtcctggtgctcgaa

SEQ ID NO: 7904 - DNA, 985 bp, Zea mays
catgatttccaccattctgcagttcccgccattgacacgcgtttctctcccctgcttctcgtctaacaaataacgatgcgtggtgggctggtggcaaatcagcccactaatcccgctatgaatcacggggcgatggaggcgtgcttaggggagtcgggaagttcatgatgggaaggagatcagatatcgggagtccatgacggtcggcctcgttactcaacacattatcaacacggctaattattaattagcatgctctaccgtttctttgccaacgaacggtatgttttccttgacctcactaaatttctcttgcggcttggacgcttggttgatgacttgatgttactttcaatctagattatttgactgtgttgaatgaactacaggtatatgttatttcgatctactcagttcatgagaaaagaagggggaaaaaatcaccatcgtcgtcatggtggagctggagcgtgtcgaatcggtccacatctacagattgtctctgtcgtcaacagcaggcactgatccgtccacatctacagattccacgttttgaggaacccatgctccatgcattccgttaataataagcttattagcagcatgtatggagcatgggttcctgaaagctgctgctagctgctggtggatgatgacatggaggaagagcggcgagaggcggaaggtgctggtgtacgcgatggggggagggcgtgcatcacggcgctgatcgagcctgaagctgaagcgccggtgaatcgtcggaatgaatgacaacgcaagatctagaagatcctgatgatatctggagtgtatggaaggagattaatgacctgccggcacaatcagatcacggtttcgagtctgcgcataaataatcccccctgcccccggccggagtacctctacaaaaggcggcagcaccgatcgaccgcccgccgttcccacaaacctactacgccaacaacgaatccatcctgcaaca

SEQ ID NO: 7905 - DNA, 249 bp, Zea mays
ctcttgcttcctgggatctgaatctgatcagagtttacaacagataattagccgttaaagaaccaagcaaatggcgcggtacaataacagaattgagctacagtagcatcccctgtggtctgtctctggaggtgcataaaagcacttgctgcacaccctgagtgtcctcctgtacgtcctgagtcctgacctcgccgttctctcttcttccctgccgatccccgctcgcatcacctcgctccagcctcc

SEQ ID NO: 7906 - DNA, 459 bp, Zea mays
atgtcactaacacaatatttttatcgtacacgattaatttcacaataagtcaactcgtcattgccaaacctagctcaccggagataaagaaagaaagatacaaggagaatacattgccgaaagagatccgtatcacacatcagcaaagattagcatgtgtgccgtcgacacatgacgtcgaataatacttattatttagtggctagcccatagcatgttgcagctgtagtgggagcagtgaatgcaacaagtcagagtgaccaagtctgatcgatcccttcaagtgttaattaggaccgatcgatcagtagatcgactagcaggcccatgactggtctggtcaagcaattagagtcaaattacttgacgtgcttgttgcaaccgttggattattgctcgatcacattcagctaaatagcaagtacttccattgttctaactaacaagacacagctgtcg

SEQ ID NO: 7907 - DNA, 1500 bp, Zea mays
gccatcgtattccatttttcgccgcatgccttccctatctgcagggcaaggtatattactacaagactaaagatttgaaggtccaacactcaagtactgaaaaacttacttcctgcattgattttacacttgttttttcttgcttataaaccttccgaaaatcctcccttcagcacaacatagagcttcattatagattggtgtataacacaaaggcaaacaactgaaagagctttcacattagtgttacacctgaaaatgtgggagaaaccttaaggagcaattgatatgttcggtgatggtgtgtcaatatggttgaagcataaagcatttatattaaataagaatttaataagtaacaccacgtatgattcttttacaaacccatgtaaagtcgacctggactgagtacagtaagatgattactttccaaatgttcttcacaccagtgccatatgttaagttcagcaatgacattaaccaataatctcaatcctagatgaaactgaaagacaaaatcacagtacacaaaaaatgtaaacctataatggtgagcatcctaatttcccaaatcaaaagcaagaaatggcaaaatcacagcatcccgagatgaaactgaaagacaaaaccacagtgcacaaaaaatgtaaccttacctcccagcatcccaattcccaaatcaaaagcaataaatggcaatttgttaaaagaaaagaaacgaaaagactaggcaaaagcctgattgcacaagctgctgagctacaatggtgagcccatttagcagtaccttgcactaacactagcatacattagaattttttgatatgtaagagatgcacgctagaacccccaactaatcaaaattgcttagtcgcggccagaacaggcattaaatccgtaggcggcaaattaacaggggagcagccagcacagaacatacatgatacatgaagtagaagaaggtggtgggtggcttcttgggtgcgcgggggtcgcccttccccgccggcttcggcctcggcttccgcttagggccgctcggtctgggggccatcgccaccgccttgagaggcttcggcgcaatctgcgacctcgccttcatccggcaaggcaaaccccttctcctatccgcgtgacggttggggctttacgcgacgtttggagcccggcgaatgtggagggcggcagcgaagatgagatcatgagagagaagagacgcggacaacggctgaaggctgaagcgctcaagcgcacggaagaggagcgggaacggaagacgacctggccagtggccaccgagcattctgcctctagtgggccggatgtgtgatccacctagtgctgactgggcttccacacgacccaaatagatggttcggtggtctatgactgatggtttgtgtagttttgtaccacatcggcgggctgtgtcgcgctgaccggtaacggtaacgcctccgcgctccatccgttcccacgcaccacgcgggaccgtaaccg

SEQ ID NO: 7908 - DNA, 621 bp, Zea mays
tcgtcgggctggtcggtgtccgaggtctcgaactcctatcgtggcggtgcatgctrcgacgtcgtcgaggtatcggatggagaaggtcgcgacgccgcaaaggaggagagaaggcggcgaggaggttgtggagagcgcgttgtgcgggaggaggttgaggaggaggcttttgcgcgttggcaaagccacgccgcacgtttctgtttgtgtgggctgcgaagggaattcgatgcgctgcgatggggtgggccggtggcggtgaggcatcaaatcgggtggactgcgggttgatgagtaaaaatgtaagagggttttttttgcaaaaaaatggacgcacgaggaccgttgaaactgatgcactgatgctttaagtatagtatagaagtatagatataataaaaactccagacaacgactggttcgccgattccccctccccctccccttctgcccccggcaagacggcaaggcattaacaacctaacctgactcgtggcgggacggatgacatccccaaaaccctaaccacgcgacgctcgccgactcgccgtcacagccgcacctcaaccggagtcgaagcgccattgatgaactccgagcctgccgtcgccgcagctagcg

SEQ ID NO: 7909 - DNA, 1079 bp, Zea mays
cgtaagtttggtattaacgaccagaccagaccataagtatgttagtgtttagaaataaaaaatatcactggcctaaataaaacaggagctgtagtaggagtagagatgacctcgtggtgtgctccgcgtgcagactgcgcggggcaggtacactaaacgcgagaaggacgtgtgtgcgcacgagagtggagggcgctgcctacctgctgccacggcgcgggtgcccaggcacgcgtggcgcgcccaggtaggctcagcgaccgccgagatgacccgcagctatccactccactcgcacgcggtagcggccgtagggtctcgacggcagtgcctccgtgagctacgcgacgccacgtggactgccgagccaaccgccgcaggccgcgtcgcgtactgccggaccgacgtagtacgacccacacgacagatgaagagcagaataatttatattaaaaaaaaactattgatgaggtcgcctagtttgtccttgttgctcccggagtagtagatcctgcctgcggtccggtccgggccacagactgaaagccgtgtcccaatgcccgcgcgccagcacgaatcgtatccggcaggcccgacggagaacgagatagaaaacacggacagcagaagtgcccgcgcgcggcatctcattctcaaatctcaaccaagctcggcgagcggcggtcatgcagcagcggctcggctgggcatccaggggttcacggaacttgtggctgcagaatgcgccacggaaggctccaggccctcggacacgcgtccggcctgagtgacttggcagctgtccctctcgccccccacacccccgccaccacaagtagtatatgatgccgctcgtcaccctcctccccttgccatctcggggatccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgatta

SEQ ID NO: 7910 - DNA, 568 bp, Zea mays
gctcctgcctggccacaaggagcggcgagcgcccagttgtgaaggaatgtagtattttttttcttgagatgctggaatcagttgtttgcaatgaacttcggtgaacacccaaaaccgaaccgaaaaataccgatatcggactcgtcggctgcgacttgcgaggacgacacgagtcagccgcgaccgcgagttgctgcagtacccacaaaaaaaaaagagatcgcgaccgcgagtcagggtattttgggcaccaccagagcgccaagaagggaaggttggcttctccttcctaccctttccgcgctgcaaccgccaaattctccgactgcctcgcactctcgcagcacgtggggggtgattctctctttcttctcttcctcagccgccaggaaggtggattcttttcgagctcttgcccagctgattataggtaggtacgtggctggatagaccctactgctggatagagcgtctcagggacgggttgactctttctggccgcatcagcggccggctattcttcttgtccggctatccgttccaggacttcggattaagaggcgacgag

SEQ ID NO: 7911 - DNA, 48 bp, Zea mays
ttgccgtctgtgcgaggtgaggtcgctcggaaggtagtatggggggcg

SEQ ID NO: 7912 - DNA, 417 bp, Zea mays
gtgaaaccactaaaaaccgctaaagttcttctatgtgtatctttatagttttatctgaaaaggcgctaaaaatatgttcagagatactttcagttacactacgcgaaagtcgactcaaaaaaattgtttcctattatatctatctctttgatttggtttttagcttttaaaaaataaaaaccaaagtcaaaatccaaatcaaacccaccgttacttcagcaaccgccgcggtaacctgaaaaattttaaacaaggaagggaaacacaaaaggtggaagggaaaagggtttgatttccccactcctgtwgcgccgccgccgcgtgcccgtgaacctcccgccttcgttctccyctcccgcttgccccggtagtgattttcttccttggttcacggcggatcccatgccgatcgacggg

SEQ ID NO: 7913 - DNA, 104 bp, Zea mays
gggtcaaagacagtaaatgctagtaccagtacctagttactccagcagaaacattgaccctacaaatcaagcatgtgttcaaatgtgatacactgcctgaaaac

SEQ ID NO: 7914 - DNA, 1500 bp, Zea mays
ttcctctctgtttccttctttcttctaaaacccaaatttaaaaaggggtaaaagcgtgtttaacctaaagctaacctaaagctagattcgagcttccgcgcgccccgaggctaacgaatactactaaatctaacttgtttatttgccgcgaagaaaggttgagatttaacggaatctcaagtctgaaccctgaaaccgcaagctccttcagcaggctttttcagctggcctttgtttttttttcctcaaacacactcccctgttcctgcttctatgctgtaactgaattcataactaattgccagagggcctgacagaagacaagactggaggaggatgcatgaaatgtgcacgggagaaaggaagaaagaggatgaaacgaaaaaaagaaggtaggtttgctttgccgtggtgggtgagagggtaagggctagtttggaaaccacattttctaaatgatttacacttttctaagaaaaaatagtaatagaaatttctttgaaaacagagtttccaaagtagctcctaagaagatctaatgcctcgatcggcacacaccctgctaatgttgactaccattttttttcaacaaaactaatcatgcggaccatggagggcgcgtgtaaataactggatgtgccgaccattttttttaaaaaaatatccagcagtcaaataatgattcgggtaggcgggggcgatgggcaatagtttacagccagaggcgccttgagcaaagcgagcggttaacgcccgcccataaacaattgcccgtgagagttggcattgtcagggatggtggtgccgtgtgtgctgtgttcgatcagcggcgcccttcctctttacgcttgctgtgcctgtgcgtgagagagagagagcgcagtactcgtagggagtaagtaagcaaaagcaaaggtaaacagcatgattaaaagagctgtcaagaaagataaagcgaggcgagacaccccttaaaactagtaagatccatcgaggttaaacagcaccggccatggcggtggtggctaggagtaaagcggctgcatgcaactcctgcagctaatcgctgtggctcaccttgcatgcactactcagtagtggtgaaactacagcagcctactgaacaacttgctagcctttgcctacaataccatctctctctctctctctctctctctctctctctctctctctctctctctctctctctccttcccatgcttctcgccggaacatatagcataagaatctcccgtgtccgggcatctttccttttcctgccataggccgtgacgggagcttcttgcttgcgtgcttgttccgggccggctatcatattgcctgcctatgaagctctctgtctctggccaatggaggagctacttctcctctagcctttctcgtctctgattcgtccattgaccttgggtgacgtcggcgccacttctgcgccccgcgactcctcgcgtcttgtgtgagtgtgagtgctacaagcaagcg

SEQ ID NO: 7915 - DNA, 158 bp, Zea mays
ctcgaccttggcctcccacggctctacagcattgccgcgcgccgtcggccgccactcgtcgtactgacgcgagaaggaagatgctctaggaagttgggggcctggctagggacagcctgtgtcccgccgtgggatcggtgggagagggggaggcagsc

SEQ ID NO: 7916 - DNA, 126 bp, Zea mays
tggcggccggggacagcacggcaggcaataaagctgctggctcgagctcgatcctcgaacgaaggtgacgagcgagtagaagagtagcttctattattcgcctgtttttggtaacagcagtgtaca

SEQ ID NO: 7917 - DNA, 937 bp, Zea mays
aaataagacactgttggagtaatttttctaatggaaagtcatatatttcaatttaagacattagtttgaagtattgttggagatgctcctaacaaactgaacttgaaaaaacaacagttattacaaccttttcatcagatttgttctgtataaacgtcccgcaacaaatatctacgaaaccaacacacggttcatcacaaaaaattccaagaacgtgacatcacacacccaacaaacacttcattctgcaaaacttttggcctcatccgggccgtctgataagacgatcagacggtgctcagtttctggatcggcggaggcacacgcggcaccgtagcggcggctgaacaccgccacgctgcaaagcctctcccgttccttttttgcaaaggcgtggggatcccctgcactttccgctgccctgttccatcttcatctcccctccccacatacccctgctgccgcacccgcacgcacgcacacaacagcagcacagcgtctcttcctcctcccaaaacctctctcctctccctttctctgtctctgagcgtgtgtctgtctgtcagtgagtaataaatggcagcgagcagcgtgcgtggctgaaggctgctgagcagagcagggcgagcgctcgctagtcggctagtgctgtgctgtgctgtgctgtgcarcggttgctcctcctggtcctgctactgctccgctctcctcgtcgcttgctcgtcttttttccacactggtaactgctgcactaaaccctcccaaacccctccccctgtacgactggtacatcataaatccattccttttttatgttcctcgatcgccttctccctgttgagatttcagagatggcgccgatcagctgcccggtggagtgagctggtttctttgtttttttattattagggcggatttctttctcgcaaggagcagg

SEQ ID NO: 7918 - DNA, 693 bp, Zea mays
cgacccgacaacctgctaagaaaatggtagcgtcgcggacggagggatggacagtgaaagcaggtggtacgctgacgactagacggagcgagtgaggaagggaaaatggcagcacatgacacagatgagagagggagatagagagaaaaagaatgagtgctacctttgagaaggaataagttggaatagaaaacactcgatccacagctgggagcaatggctataggtttcggggattgtataactggtgcaatagttaggcagtaggatctcgtcatggagaaacaatccgacgacttacaaattttggacgacgtgtccaccttggtttgggaggaacggtcctggtttaatatatagaaattggcccccaaacttgtccaggtagaaagaaagaaaaagaaaaagattgagcgagcgtgatccatatgagggcttgttcggttagctcttaatttatatggattgagtgagattgagtgagtttaaatcccaattaaattaaattcttctcaattttttttctaatttcgtccgatccatatgttacaggattaagcgaagagggttgaagaggcccagcccagctgacaacaccggcctccgagaagcagcgcaggcgcagggcattccagaacgttcggcggcggcgaggcgacacgcccaccaccagtcagccgccccgccacagcc

SEQ ID NO: 7919 - DNA, 1500 bp, Zea mays
acaaggcaagtaggcggcgggtgatggtgccaactgccaacagccatggatgccgctaccctgctcactctcgctggccaaaagcgtcaaagcgggaagcctgcttttgaagctaatatctgtgccattgttggtaggtactggtactgtaccctacgagagcatcaaaactggaatggaaaagcaaagagtccaacgaatcatgaatgggcctttctttcctccatcctacagagtacgtactccctccttacaaaacatctggttgggctctagtacgcgctacaagatgcggccgcagcccgcaggcccaggacctacgggagacggtacgcgtgcgtagctgacgacgtggcatcggcggggagccggctccgcgtccgaaccgcgtccggggtaatacggtaatatccgccgcttggaaaactggagcgtgccgccccctgtttggaagtcatgggcacttttgtttatagctggacgcctgggccacatggcgtcatatctgcatttttccaaaaaaaaaaaaaaattacgaacccacccttgccgagttgacgttccttctggttgtgggtatttttttataaactactctctctgtataaataaaattaattttaaagaatatatataaagcaaacatagttcgatatatcctgaatatactttcatagtttattctctaatgatagatgctaatgctttctctacaataatggtaaataacttaacttatgacaaactaaagatatggagtaagtagggttaaggttcaaccgcccaaggcatcggtacaggccccatgtcttccggttgaaactagtgccaacatatatttgaactaaagatcgcattgccaagatctcacttgtcacaattcacagctagcaagtctcatatcctgtagcttccttatatgctaccctgttccatgtatgtgctagtacgacggagatcacgatgggacgatccatggcattgatagatccggccacaacacaacatgcacgcacgcacgcataataaaccacgacgtcgacacctcccaaatgctggtgaacaaacaacagccaagccgtgcccaaccgaagtgttggacaagcgagccaggtcatcgcatcgccgaaagttgtgcctggcgatagagccagcccatgatggtacgtcccaatcagtgaccgcgtccagcatatcgggccatctcgcacactggcatcccctgtcagtccagcctgggccaaggggcaccacgccaccaccacagccggcaagggcagttcggggaattcgcggggaagggagggcgtggacggcggaacggagcggacgggccgccggccgcacgcgcatataaaaatcccggtaaaattccccccccacccccgacgcgacgcctcaaatcgctccctgcctctggtcacctcgcttccgctcccggctcccctccggccacccagacatcgtccgttcgctcgccaagagacaggaccggagacc

SEQ ID NO: 7920 - DNA, 1500 bp, Zea mays
cagggccaacgcccgcccgcatccgccatctgcgtcgctcgcccccaacacgacaccgccgcggcgcaaaacgatgatgcgagtaggtacgtgaacgtgaacgcgcgcaagcatgctcgctcccgagtgcgatccgccgcgcgcgcgcgcagcgccaagagctgggctgtgaacaggcagtgcccgttgcgaacgacgcgcacagaacaggcacagtgcgtcggtgtccccggccagaggactagacgacgaccgtcgaccagtgcctggcggcctctctggccgcggcccgcggctctggtgtgcgtgtgcgcgtagcgcgcatggggtcgccacgtggggtgtctcacgaggcgcagcgcattgcagtgcctaggattcgacctcggagtgatggatggatggatgcgcccttttcttttccttctgcatggcctcttttacttttgcccgatggatctcccaccattctccgccggtcgtctttaaatgcggcgctaaacgctaccgcctcctcgccctgtgctccgctgctctgctccactctctgcatgcatgccgcctaagcctagtagtgggctgtggttagtgtactggctagctagtactcactctgcctgctgtccctacagcgcgtgcaacaatgctttcccgcctgaccccggataccacagctagcacagggggcatctatacgtagcagatgatcaaagctaacaaatgaccaccaacccaaccccaccattagaggctttgggtgcagtactttaatccggaaagaggctgaagtagcatggaagctatctgtttgttcttgcgtttcccgagacgtcattgtttggaatctgacggggaagaggaaaacggcacatatatgcgatggcagaccagatgtaaacttgaagctaaagcaacgctgcaacgggagaggagggtccaggatgtggctacgtgccagtgccagtgccaatgccatccttaattaacaacatatatgcttcccattcccaaacaacaacatcgacactgaccagataattaatccaaagtttcccaacgacatgattgcggccattattccttaatctccatacagtactggacagtatgtgtagtacactacgctccacaagcgctttaattaacaaacaccttattaatacacatcagccagaaggcagcagcagtagtacaggaaggcacgcggctagcggccaccgcagcgcgcgcagcggagtgtgcagttcaactcggatactgccccaccccaccaccaccagtccacagcttttgtcgcctcccctagcaaagctcgcacgagatgaaaccctgagctgcccttgccatcgccgcggggagggccggagcgacaggggcgatgccgtcattatattgcgccctccacgcgcgcctccaattataatgccgcggcacgcccccacacgccgtgcttcgctgctcccgctcggctgaacaaacggctcagggaacacagaggct

SEQ ID NO: 7921 - DNA, 1500 bp, Zea mays
gtttttttaaggagctactcccttttttctagaaagagctcatcaaagagctttctctttgggtagatttttttaagaagctgttaaaggagccatattaaaggagcaacatcgtgacaagatggagattaggaagttatggccttcttgacaggctacctagttttgtttgcattgcaaaatacgagacaagatggagatgagcatgcaccttggtaagtcattgacaacttgtgtctatattcttggttcactcatcgccatgcgcacgggttaaatgattcttcacttttgaatgctttgtccagccaatggcttgattcattttcgacttgatcttctcgatctgtgtccgatccaattgaaagatgagcaatatttataccatcaccagatttatccgtctctctttttcccccatcttatattagttatctttttttataatacccctcggtccagtccattttataaactacaatttgttgatagtttacttattttatatttgtttataattataagcttattatcattagataattcatctagtcacaaatttaataatgccatgtctatattaaaacagtcaaaaaaatgtagccaaaataatgataaaagattagaaaaaactttgacttttaatgtacatgcatctctcaagataattgagtgtcacgtgccaatcatattacaggttataacgatgcatgctacgtggtctgaaatatatacgtgtcaaacccataaagagagtgtgcgtgtgcgtatggctagaaacatgtataaagagtacatttgttctaaaataactactcttttcatccatccacaaaaaaaatatagctataggttttctacaagtaaaactaacttacctttgatgaaacttagatcgaatagtattaatatctctaactaagtttgctgtaatatatatctgtaatatatatatatatatatatatatatatatatatatatatattaaatgcttgtgttttcttgaaattttttttatcaaattttaaattgttactcttcataaaatgagaattatatttgttttaatgaacagaggtagtattatacatctcgcttctcaatttttttaaatttaactaacactataaaagcagtatcaaatttatatctccaaataaatgttattataaaaatatgcgtcacgatcaatacactaatataaagagtacaacttttatgattattatttatatatgttaaaagctaaaaatattttatcttctaaaaacaaaatgtataattatttgggaaggatagggtatcgagaaggtactgacgactgacgtactgtactccagcagtggtgttaaaaggcactacgtaacgtacctgaatcctgatgatatgtagggcagtaggagacaaggagcaccgtctgctgctcgctctataaaacgaacggaggctgcagagcagagcagagcagagcaagaagctttacagtgaacgagtgagt

SEQ ID NO: 7922 - DNA, 159 bp, Zea mays
cgacgcagttgaagagccgactccacggacggtgcaattgcgggtacgtggtgcagcccctgtcaccgtccctattcttggaagtggaacggctagcagcccctatcgccgcctttgcctagctccacggctccgcccctgttcttcccatcctttcga

SEQ ID NO: 7923 - DNA, 775 bp, Zea mays
tttttaattgttttaagaaatgtgtatttttttcaaataatgtaatttgtgattctttttaaaagttatttattttctatttttttaattatgtggtcgatgatttttctaatacaatttcatgttttattttaaataaaggtttataaaaagaaagctaatgtgatattgagatgactatacgctgatgaagtctgtgcattaaaacattatggtagataaagattgaccacatcgttgtatgatcggtaggagcctagcaacgctagaaccagcctaagattcgcacaaaaaaacaagtctgttgttgctacggaatgggcatagccgcatagcataattgatttctctcttatcacagacaagggagacacacggacagacacccttttgagctggttgtggtgcagctcactgagcactgtgctgcgcccggcgggcgacgtaatttatcacctcacctcctgcacccgggtgcttacgtggcgtgaaaccaccggctgatcggcgcaggaacggagtaagcgcagcctccattccccgttcctcgctggccgctactactcatccctcgctcttgcggaggcgaggcagaggcttgctcctacctccaataattcccttccgcctctcctcccgtcctctcgcaagcccacaccacacctgcagaaatcacagcggcaggtgcagcaaaaatctccatgcccccgctcggcctagatctccgacgagccggccccgcgcggtagcagattcgctcccctatcccgacccg

SEQ ID NO: 7924 - DNA, 60 bp, Zea mays
tgtgagtagccaaagggaatgaagtggtggtatcaggtgtgaaaactgggcttcagcgac

SEQ ID NO: 7925 - DNA, 303 bp, Zea mays
agtcgatatctaaagttactaaacaaataaaatttatgtatattaatgcatgctctaatcttaaatttcaactaaggcaaactatagcacaatatgctatttgtcatttttcctagatttggctgatctgatgtcaaatgctcaatagggccaaatatgctatgtgccatatcagtactttctgcatgctgcttcccattattgtcaaacatcaattagacagtttgtttgatcaaattcagggcttgctccgtttgaaagagccagctgtattgctccgttgccgcaaggaagatcaccatc

SEQ ID NO: 7926 - DNA, 1500 bp, Zea mays
acaattactttattaccaaaccagccctcaagggttaataaggctagctatttcaaacaacatactcatccacatctctatattcaaacttcactctgcaaacagtacaatatacaatgcaaaacaatgttttagatgactataactgctgaacacgatctaacataagaggaaattaaaataaggtcctttcgacagatgtgtcctcccctatagacctagcttgtcttactgtttctcattgaaaacaaacgcagatcaccaatatgtagaaagtagaaaatgaagaacaccaacttgaggttgaacttgtacatatgaaaaaagagatattttattaaggggtagatcaaatacaaaattaattagaaatagctatccgtccagacaaataaatgtgtttgggtttgaataatcaattcattatagatgaggtggtggatgatgtgttcgttccacaaatttggtggaatgaactcattcctcatctatacctctaaatggagcaccagttcaaattaatctagatccacctaacaaatgacccccgctgagatgtgttttatttcgtgcagccggttttgtacacataagaaatccccctccatcatattgaactacccagatatcttatccctaattctttctctcactcattcacatctaacgatcaaggacatccagatcatccatccctcacccacgccctcatgcatcctcatgcacgcacacatcctccaccgtcgctcggctctttctctgcccgggagacattttactagcagtattcctaattattagcctacaaggaatcaaatggtgatggatcaactcatttcattccacaaaccaaacaataaagtgaggagtgagaagatgatgtactagtttttctcaaatcaaacaccctataagtgctgaatccccacctctcctcggctcaacatactttagagacgtcttggatggtctgtcgattccaagacaaccataagatctgtttttctctcttgatgggatcctttcatgagggcaagatctagtttttgcaggagatttacgaaaccctattcgcgtctcgtgaatggtccgttgctcatatgcggacgcgtctcgtgaatggtccgttgctcatatgcggacagtccacgcatctgcaaggaagaccaaagcgctttgcacagtcgcggacggtccatgcttacgcagaaaggaccccgcgcgccgtgcatttggccctatggtttgtttggtgattagcttaaaagccagccaatacattcactgtcagccttaaaaaatgccatgcaaataggtagaaaaattttctcaacacacgtagcatccttctgaatattcaactcgaactttgaatatacaagagaaaccgaaaatacagatttgaatgcttattattatcctctcccgattccctgaaaaatatctctctgttttttttgtttcctccggtaaatgtcattgtttgaagtggaattcagt

SEQ ID NO: 7927 - DNA, 365 bp, Zea mays
tcggacataacgtggccgtcgaacgtttccttttttactatagtgaattgttaggctaataattagctacaatattaattgatagtgtttggaacctaataactaatttttaatagttaactattagttttagaggtttcaaacggaaccttaatggccagacatctgatttctagcttctttagctatctcaccgcctcagcttttctccctctcctctatataaacacaagcgaacggcggcacctgacgccccactaacagactgcagcttacttgtgaggccgagatactccagcaccatacgtccataccggtgcgggcggggagcccggggggtaggtctacgtagtcgtgggacgacg

SEQ ID NO: 7928 - DNA, 221 bp, Zea mays
ttaacgagtaacaagtacatctcgccgccgccacaagttatgccgcccgcactgttggtcggtcccaacccggccacactagtccaaactataatacagacggaagaaacctgttcaccgtcaccgcagcccgccccactaactattgactgtcggattccctacccgtcggcgacaatccgctgcccccaatctgcctggtaggtctcgcacctccggtc

SEQ ID NO: 7929 - DNA, 1481 bp, Zea mays
tcttcgggtcgcggcagtgggagttcttcatgacttggtcgatgacgagctgcgagtcaccgcgggcgtcgaggcaccggacccctagctcgatggcgatgcgcaacccgttgaccagagcctcatattcagccacattgttggacgccgggaagtggaggcgtagcacatagtgaaagggaaatgtgcccttgggccatttctaagtattttggtgatttagtgtccaacacaagtgcctaagtgtaaaatggtggacaaagtacaaatcaaggattaaggtatgtttctcagacttagtacattgttttagagactaatgtattgtgtctaagtgctggaaacaggaaaagaacaattggaattgtcttggctcgagcagccaagactctgctcagtctgggtgcaccggacagtgtccggtggtgcaccgaacagtgtccggtgcgccaggctggctcaggcgaactggccgctctcgggaagaatttaacggcgtacggctaaaattcaccggactgtccagtgtgcaccggactgtccggtgagccaacggtcggccgggccaacggtcggctgcgcgatctgcgcgagacacgtggccgagccaacggtcgtgagggggcaccggactgtccggtgtgcaccggacagtgtccggtgcgccaacggctccatggctgccaacggtcggcttcgccaaataaggaaggaaatccgcaccggacagtgtccggtggtgcaccggactgtccggtgcgccaggcgacagaaggcaagaattgccttcccggattgctctcaacggctcctagctgccttggggctataaaagggacccctaggcgcatggaggagaataccaagcattccttgagcactcttgatcactcacactccattcttgcgcacttgttcaacattctagtgatttgagctttgttctagtgtgctagtcttttgagcttaagtctgggtcttgtgtgtgcgtatttgctgtgatctttgtgtcttgtgtgagttgctaatccatcccttactccgtgcttctttgtgaacatctttgtaagggcgagagactccaagttgtggagattcctcgtgaacgggatatagaaaagaaaagcaaacaccgtggtattcaagtgggtctttggaccgcttgagaggggttgattgcaaccctcgtccattgggacgccacaacgtggaagtaggcaagtgttgtacttggccgaaccacgggataaaccactgtgtctacctgtgttgattctcttgtggttattgtgtttcgctaagactcttctctagccacttggcaatactatgctaacgcttaaccaagtttttgtggcattaagtttttgtggcattaagttcaagttttacaggatcacctattcacccccccccctctaggtgctctcaattggtatcagagccgttctcttcaagaaagggactaaccgcccgaagag

SEQ ID NO: 7930 - DNA, 274 bp, Zea mays
tgcatgcctgcagcttttgctgcgctgtggcgtaaatttcagacggcgggctgtccgggaccgggtccgatgagccggaacagcccaccagtgccaggctcaggctcagtgtggcagcagccaccagatgtttcatacgcgtcatgacgaaatgattatcctcaaagtgttatggcggaagctgtccgtatagctcccggtaatgaccagtacgatagcacattatattaaacggcatcgccgtgaaaacccaacgttaacgaagaagctgtat

SEQ ID NO: 7931 - DNA, 65 bp, Zea mays
gggaaaaaacgccccatttcatttcagaattgcaatcaccgatcgttccgcggattgcgatcgcc

SEQ ID NO: 7932 - DNA, 1500 bp, Zea mays
tccttcttaaatgaaatgacacgcaaatctcctgcgttgtttgagagaaaaaaagtagtccaaatatacacacttgccaactagccagtgctacaaattttcttcttttaagacaaatgatgaaaacaacacaggttagtcatagatagtttgttttcatcttcataactagtggccatctttttcatgctatacacattctttttttaatgcctctactaagtactacctccgttctcgaatatttgtcgtccgctagtttatttttgacctaaaacgtgacaaataaaaaagaacggagggagtactagccagtgtcttttgtaggattcaaccaaaaatatcaggatatgttccttgcacattttgaaggtatacgtttaccctttcggttttacgttggatagctgttggtttgaattaatcatagctttgcgtgagcactatgttgttgccattttttggaaggttcattttcactacgcggatgcaggtatttgttgccaatccaaacaaacctcgagagattatctcaggttttggctgacaatcacagagaactgttgaagctactccacaatctccccactagcaaaggtattactactgtattgcctaattctaacttaaccctaaccctattctgtgtccaagcaatcgatgctagtaatagagtaacagaatatgatgattggaactcgatgttaagatttctgagtgatgtgcattgaagcgctaataatgtgccccattttaattatcaaagaaatcgagaagcttgcgcggatgtcagtataaaccctcaggaaattcgaacatagctccttgatgttgatgttcaggaaccctttctcacctcaaagttctgaagacatcctgtgtaatgtgctgccctgtatggagcttgtttttcatatatggaaaaggtttggccacaaactgcattctccgtgtgaaacacttagcattcgtatcggaattcattgatttatgcacttgtagcagaattcgctgcaggaataaactgcactgtggtttggtgttggtaccatcgagaaaattgggtgagggtgtgtagtattttatatgagtaagattgtcatcaagtggatccatctgttgcaatgggtgtcgaggctgattatcttattttctctctcttattcttgctcttttctctctcttattcttcctctttttttctctctcttcatcttctttcttcctttcccttccccttcttctttcttcctcttctttccaaaggacacgtacacttcggttcaatttctcaaggccaaatacgtatatacgaattggtacgagtgaacaaatgtcgctagaaatgtttctatccttctttgtacatctgacacctgtcacgtaagtatgatatactttatatatttgcaattggcaatgagagatgataacttatttacaagaagcaattgaattcgatcgaagctgcgagatggctggcttcacaatggccggaag

SEQ ID NO: 7933 - DNA, 1500 bp, Zea mays
ctaatcatatagcatccattttctcctagtcaaaatctagtcaaaatgtatgcaaaaaacaagtcatcttatctgcaaaaatggttttgattaactattgctatcttaaaaactagatcgggagtgaaagatcattctcctggtattattattagagcaactccaatagttatgtataattatactacctaaatcttagatttagcaagtccttaaataatataggaaacaaaaaaaaaactcatctcctccaacagttctctatatattactttctaaatatgttaaaatttaacatgtcacccatttgagtgggaccatcatcgatgacatattcaacttggtgagttgtgttgaccttttgatttacggttgcaattgtttatttatttatttccaacatgtgcacgtgcggctattgtattggcaattatttaatctctagctgactatcgttgtccgacgcatgggctctgttaatatatctttactacaaagtgaaaaaggcagcgaaatacaaaaattatcgtcgtttttttgtttagggagttggtaaatggttgctaaatgtagagagaaaataagattagatgagaagtagctaaatttatgaagttcatttagagaactgttggagaggagtttttagtttagttacctaaattattgatttagggagtcgtttagagaactattggagttgctcttaggctggccgcagtcggatactggaaaaggaacgctatccatatcaagtgatgtatgcagtaaaaactcagtgcagcgagccgctctatcgtctactctaaagcagagagagcacgtgaacgctattttcagggttcctagccgtgcaactggacaggccagaggtgggtcycgaggtggggccggaggcgggcaagggaggctgctcaggagagagaaataatagaatatatggtagaaataatattatatatgataattggtatagggttgagatatagagtaaacatgagtgcggaggattgtggtatagagtaaaaaattttgctgatcaggacagaatattctttttagagtagaaatttagagtagtatgagtgcggatagccttaggccttagcacgctatcctacgctaaaaagtttttagtcctgatgcaaccgaggcccttatgtcgtttgttttatgacagggtcccaggcccgtatagctcggctgcgggactgcttcagatgcagcgacgagcctgccactggccctacatggccagccagaacttgggtccgcggctccgcgcatccatacataaaagaggcccaacattcatacataaacaggcccatgtaaatgcactgacaacatgggctagcggcccatacaacaataactgcgccaactactcgcacccaccagaaacctacccgaccagacccgaacaaagcagagcagcggacagatcaaatcaggacaggcatgctgaactaggcgaggtggactgggcgagcgagcgag

SEQ ID NO: 7934 - DNA, 187 bp, Zea mays
atcatcaagattatctcaataatttgcatgtcattttgtaataatttggatagggagccactgcttcctccatcccgttgtggatcaaaagggtgaacgattggcacttacctgcatggtccaatacctattatatttcttaaacagatactatttacggctattgtaatttaagcccaatacctgc

SEQ ID NO: 7935 - DNA, 122 bp, Zea mays
ggtagttaacgtttcatctgctattccatgtagaaaaaaatggatattggattgagagtgggccacggccacccaatttattcagaaactagcttcaataagttcttgctttcttgcagtcg

SEQ ID NO: 7936 - DNA, 1500 bp, Zea mays
tgttcgcccgaggctggctcgggcgaaacgtagttgtgctgctgtcgtgcagtgcctcgggcgaatcgggatataggtcctatgtggccttgggaaggttgggagcgtgtttgttttgtgaccccttcttacccaggcgtctacgcacttttagggatgtaatccgggtacccctaattacggtacccgataggtgatgtcacatcagatgtttcctgagatgccgtcaggggttttcgacttattacaattttcatttataaattgcgagacgaatttatcaagtctaattaatctgttgttagggaatgcacgatattgtcaaattatggactaattaagctcaaaagatatgcctcgcaatttacatgtaatctgtgtacttagttatttttttcgtctacatacatttagaacatgtttggttcatggctaactgtgttgtactttgtctaaagttaatcgtccgaaatgaaggactaatcttagaaaaaaaaagttaagaaaagtatggtaaattaggtaccaaagaggctttagtactccgtatttgtgtccaaacattttgatgtgatgggtcagccccttatacgattgccttacgttatgaatgctataagaatattggaaacgacatcactagtggaagtcgctggtcgttgggttgcagcgtgtatacgtggcatctaggtggccttgattttcttctttgtcgcactgtttctacatttcattggcagatatgtatgaactaaattattggccacttaaggaggtgtttgaatgcaataaaactaatagttagttggctaaaattgttagtgaaattatctagctaacaaatagctacctaactattaactaatttaccaaaaataacttatagttaaattattagttgggctgtttgaatgtctcaactaattttagccactaacttttatctttagtgcattcaaacatggcataagtctacgtttgatttgagacggtagcatcgtgcgtacggaagaggaaccaaaaggattttccttgaaaattttcatgcacgtgggccgcctgcagacggagatgtgcaccgcgaaattaatctggatagatcgtcgtctcgtcaatcattgcggtgctgacggtctaattttcctgcaaccagcaacttgaaagagacagtctaggaggattgtcaaaaatatataatgcttggcttctacgtacgtacctgttggccctggtggtcaaagatgatcttcaagaaaacatcctggattttcctctttcatatattcatattcaccgtcagtacgcgtgtatgatttggctttgtatttgcttcttgtacaagagatgaacaaaagtgcaaggaagcctccctcgatcccctcctctatatatatatatacaagaagaccttagagccgcaggaaggaaatctatccaagcaacaaacttggcattcttgcctgttcttaattattgccaggacaggagaaacaaacaaag

SEQ ID NO: 7937 - DNA, 843 bp, Zea mays
gatggagaaggagaccggccggctgccacagccacggtaacaacatgtcgttgggggcgccgagggggggaggtggaggcacgcaacgaaggcgtgaccccgtccccgtcatttaactagccacggcatggttagtgtcaatcacgcaggagatggttagattagggaagagacgctggttccctctttgtttatggcggcggcgacagtatagtagagcgcgcgcgcaactgcttccctccggcaaatcaacagctcattagggcgagcgcgggttggtgtgggtaatcttatcgttgagagacggagctagcggcctggtgatgctggggtttaaaattttcacgagttgggcatgacggttttcacgacatcgacgccgccagatcggttttgcattggccccgcccggagcttctctgctgtccactacgtactgggcaccatgaacttgcaaaagatgtgacctgctcaaagaaggcttagtgcatctccaccgtccacaccgacaggcccttcgtttgccgatccaccgtccacccgacatctcgccgcctccccgcagaaagaggagtaaaaaaacaaattgaaaaaacgccgcagagtggagccaaccagcgcgcgccaggctacgcgctccgagaaaggcagccgttctcactggacgcgtgtagcacccgcgtcgagcagctataaaatagctgcctgcggcacggctcctcctctgctctccacctgacctgctttcgttttcgtatatgtgccagcagtccagcagcaccaacttgtccacactcgacactgtgttgattgagaccttagctctagcggtttcgtttccgg

SEQ ID NO: 7938 - DNA, 1500 bp, Zea mays
gaacgtctaaacggtttgaaaactttatatattgaaaaacaattgttagttgatgttgatatcaacactatcattgatgacattgtatcaaraaatgttagaagaaaattttacaatattgtatggataatttgaaacatttttttatgttatatcaatttctattgataaaaaatatgtatatattgagtaaaactatatttatatagaagaggccccagtatttgtgtccgccccaggacattaaaatgtcaacatagacctgacagtaggaaaaagtggtcgaaacaaacttatagcattgaagacgcccgctgaaataaattgatatttgttagtctagatgaagcttcacttgacttcgttcagttcttatcagctgggtgaagctcttcacccactaagtaataatcgattattactgaaaataatttagtaattattgattattattgactggatgaagattyacctaaggtgacaaataacatatatatacatgctaattttacatcctagatgccaaataactatttggcaccagacccaaccctcgcacgcgcaatagctcgcagccaaacagaccctcccatccgcctacatcagtcgaacggatccaactaaggccttgttcggttattcccaatacacatggattggatgggattggaaaaaattcttaagaagtttgacttgtttgggattcaaactcatccaatcccactcaatccacatggattgagagctaaccgaacaagcccttaagtggtgctccacttcttacctctttcggatgctcccattgtcacactattgaggttacaactgaaatgtggtagaccttattccttctcgtacatagtagtagccacaacataaacgcagttggtgtgatcacacaagatataaatctgattttaactgtgagctgtgaaaagcttatgtgagctgacggacatgaaaaaaattaaaatatatttggttaaaacaactgtcaactgaaaattctacaagagcatatggtaacatagatgatataaatctaaatttttagcatagaaagttattctaaattaaactagaacaatacatagattttcagaattctattacgaagttataccgtttagttaagattttatattttaatattaaatctagttaaaaaatctaaaccaaacaagctgatcccaacctagcgtcctagcccaatcagctcggctcctcagcccacatatgggccgccgttgcgtgacgcacttcccttcccttgccccctctcatagtctcatccacatcggacgtcggcgcgtcgacgcgtcgtgccgtcgtgctcgttctcgtccataccctgcttggctcctcagtcctccccaccttccccctggccttaaccagcaattcccatatcgccactcccccaaaacgggagctcagcggcggcggccgcaacccctcccctgaaccctaccccgttctacccggccaccaccccacaac

SEQ ID NO: 7939 - DNA, 1346 bp, Zea mays
gttcgatcgatccgtgtgccacaactccacgtctcccaggtcccagcgctagttgctaattttgtcgcggagccaaaaccccggcatcgtcctcggcgtcgacggtcgacctcatctgcggatctgcctcctcggctccacctccacgacgtccacgcacgtgatggccggccggcaaagtgcgcagcagccagcagcaagcagggcagcacaccagcacacggcacgcgccgtccacctcacccgaacggcgaacccgtgtggattttttttcgcgtggccgacgaagggccagcgcgctcggcctctcaagggcacgagcgatggccggggagcctcacgcgaaagcgccgcgcggtcggtatgcacagaaatcgcgccccgcgccgcgcagtggagcagcatcaccgtcgtgcgggcccgggacacacggtggcccgcgcttcggcgagccgggcaggagcgcgagggccggggcgcggccacgtagcggtgctgcgcgccttgggatggcgccggcgaacgcgtggtctcggcagcggccacgcgggcggggccctggccgtgcgatttgtgaaggctggacggctgggtcgcggccgctaaaaccccaaaccctgtcgggcaattaatgctgtccatggagcaggtttttcagggaggacctttccgtttggaaaccatgaggtagacccccctacggtctgtgttgttcccacgcagatggacctggacgtaaaaagtggaagggttttatggaattctcggggctgttgaggagctgaatcgtaggaacctgccgtgcgtggcgtcaaaaaagcactcttggtccaaccaaatacaatacaagcaagcgaccaggagggacaggaaggatcgcagcggaggagatagctagggaagggcaaatctgcagggcctgagagggtgaggtagagcgcgccagccagaatgcaggagcaggcggcgagctcgcggccttccagcagcgagaggtcgtccagctccgggcaccacgtggacatggaggtcaaggaaggcaagctagctactacctctggcatggcaccccgtgctgtggaactatcctgtgcatcttctttttggcttataagcttgagtttatcaccaatcccagttctttcattgtttttttagaacttcgttgttccaagttccaacgcttccgataggttctcgtttgcttttgtcgtgcaactgaactgctgcaagacttgtcaagcaagtctactcgagttcgagtctcgagctctctctccaagatcttgactcgtttatttggtgaactgatccagccacacctgtggtgtgattgagttgcaggg

SEQ ID NO: 7940 - DNA, 123 bp, Zea mays
ggtcatttattatttactatatagttattagttaataggtagttactatttatttattacttagtaagtttttaggcttaagtacctagccattattgagttagtaatccattgttgcaatag

SEQ ID NO: 7941 - DNA, 524 bp, Zea mays
tatatatatatatatactacttaagacgttagtgtaggcgtccacattttttggtgcacggttctgccatctgtcgtcgcatcgccggctacaccacgcccccgctccatccctacagcgcgtccgcggccctccgccctcgccctcccccctccccgcaaatcttgtctcctcacccaacgccatcagcgctgccctccgctccatccctgcagcgcagacatccgccaccgtcaccgcccttcctcaccgcgcaatcatcgcccttccccacgcgcctcggccgccatccgcggcatcaccttccttccccatgcgccgaggctgccatccgcgccatcaccttccttccccacgcgtgcgccccctcctccgtgcgtgccccgcccccgtccttcgctcacccgatgccccgccacctccgccgcgatagcctcccccacgaagtgcccccgtgatgtcttccattcccttcctccctcattcttcccgttgcagcgattgctcccagcggctcggtggca

SEQ ID NO: 7942 - DNA, 225 bp, Zea mays
ttgtgattgtgacacatctagcgtctatgcacttagtgtcagctgcgcaatattcgtggtccataatctacaaagtgaagccgaggaacattagggatctggtccaacagcaccaaatcccatcaaatgtaactgcagcaagcgcaagaactggcataagaggtcgaagacagggtgtagaggggagaaatcggtcgagggggacttattttcctctcacctccg

SEQ ID NO: 7943 - DNA, 157 bp, Zea mays
ggtaaatacatttgtcggtgggttctgcctttacctagttgtatcaattcgtcacgtttcctgcttatattactagttatactgacacgtgtaacggtgtaactttaatgtttatgttttatttttttcctcccaacatgttaagtatttcgcaata

SEQ ID NO: 7944 - DNA, 477 bp, Zea mays
ttaactaataaatcccgcaaaaaaacttcggaatcttaaataattctgcgcacgcgcgaaccgtctgcgccaccaccgtggattgctcggcctactatggcggaccgtccgcttcccaagtgggctcaacacaaagtataacatttttgtctgtaagttcagagatcttcggtgtccaattttgccattttggattctgaaaattggacgaagcaaacgaaggcaacatgatgaaacttttgcactccaggttctactgtaaattgagccgtgtccaacaagcgagcaccattcgttgcagttggcccaaaaatacttgcccggcccaatcgaatctctgaccgatataccgaaccctagcccagttgttccgccgagcgaacgacccacaaccagaagccacccattgggcgtacgcgaggcgatcggagcatcccgtcccaagaggagaaactccggccggcgacgcgggggaaa

SEQ ID NO: 7945 - DNA, 182 bp, Zea mays
cgcgatgacaggtccaccggccacttgttcctacgacgtgctctgcttcgcaaaggtgctgctagagctggtgaccggcaacttgggcatcagcggaccaaacgacgcggcgtcgggaagaatggctgtcgaacacgctgaaccacatcaacggcggcgacagggcgagcatcgccggcatc

SEQ ID NO: 7946 - DNA, 875 bp, Zea mays
ctgcctgacgcccgaccagtccgcgcgtacgcagggacggcgaagatcgccgacggcgcttggatctcgctcccgggagggaccccgtcggggagtagagatcctaggtggtgtctaggctcgggcaggccgacctagactcctctaatcgacgtagagtcgaggagaggcggagaatttggggattgggaggctaaacctaaactagactagaactactcctaggataaaatgcgaataaaagttgtattgattcgattgttgatgattacaaatcggccgtagacctctctatttatagaggaggggggctggaccctttacacaactgattccgagctaatcccgcgaatatagctaacaaccgtagcacaaaactcgaaaccctaatctgttctgcgcacgcgcggaccgtccggcccacaggcgcggactgtccggaccgcggaccgtccggcctcagggccggaccgtccgcacgctcactttttggttcgaacagtgttctaaagaaaaatttcagagttacaaaatttcgacagcgacgactttctccaaccgcctccggtcgtctccttgccagcgattgagccgacgtccagctcagggaggaacggagaggcgcgggagctattggccgttgaatccgaaacagacgagacggatgaagtgactgcaggggcaaatggggctgactgcagacgatttccgcttcgggaaatcctcctcccatgtcccgtttcctatccccttcttcgccaagcaatcctctccccctttcagaaaaaaaagtaatcctctccggagtccaagctccgaccagatccggacccccccccccccctccgaacaagctcgggcatgcccagcagctg

SEQ ID NO: 7947 - DNA, 117 bp, Zea mays
ggttcccatacttgctgggcatatggtgcctatccatccctctgaattcactgcacctaacttcccggtaacctcatctgcttccaggaatccaagtgcagcttgacctgaagagca

SEQ ID NO: 7948 - DNA, 113 bp, Zea mays
ggtaaatgagacatttggcgcctgcccacagttggccggtggttagtttggacgcacagatcccttggtaaataaggagcaggggtggtaagcttcagagttttgctcatcta

SEQ ID NO: 7949 - DNA, 552 bp, Zea mays
caggtggcatctaatgatccacaaacagttgactcgctggatgattacctgaggcagcgataagtcagtagtaccaaactgtaggagcctccttggcttggctcccccactttccgtccgcacggtgtcgctcgctcgctcgcttgtcgccacggacacggagcaagtggccaggcccacgccacggcacgcactccccttccactcgcccggccgctcatcactcactaccttcccagttcccacgtcccaacaacaaccaccccaggatatgagaatactatgatccccatccctcccctcccctcccctgactctactactcctcccccactgccttgccttcgtcgtcacatgcgcacaagaaagaacccgcgccgcccctgaccctggcccctcctctcctccagcgcgcagccaagacgtcgccgcgcccgcttccatgaccctcgtccccacctcgcgatgagcgacattgcgccgtggtggcgcctgccttttcgttcttgaccgcccgtcgagctgctacgagaaagggagggaggccgggcg

SEQ ID NO: 7950 - DNA, 495 bp, Zea mays
atttccgttgcaacaatcggtcactcagctagtaatgatataaatctgccaacatttcaaccatatatggagccaaaccgagtagccgcaacaacgagccgacccgaacatgagccgtacgactagaccgggcaacgtgctttaagatttgtgcaagtgtacgtgtcgtcaatccagggctggctgcagatctccactgaggtttaactgtgtcctggactcggcctcaatggcttgtcctcgctctcgatgcctccaccaatctcatcctcaacccggacggcggtcacggcgcacgcgagcagggttgctcacgaatcgcaggatcgcgggcagacggcggaccgaaagaagaatgtcgcacgtggccatgtctcggccgcgccccgctcctccgtcacagcctcatagtcacaggctcccagcctcccgcgtccggagtccggatccggacacgcgctcgaggccacccgcgctgtcccgcctccggcagcg

SEQ ID NO: 7951 - DNA, 679 bp, Zea mays
atgatagaatggcatgcatgtgtgttgagacttcagacccacaagcaccgatgaggggtggcgctgacgcggtcgtttgtacaatactgtgttcaggacttctatacgtttatgtaaaaattctggcgtccagctgggtaattctggcgtttcagtacggtggcctgatgaatgttgttgtgtagtttgtagcatccattattagtgctgtaagatgatgttttgaattctgatacaccagtgcgagtgtgatgaaccaaattcatacgacacgtttggaccatagaaatgcagagtactgttatrgatggagtaggacgaatctgcaggaatcatcagctcagctcgtgtcggatcctaggagtgtaggatctatgaatctatcgatgcagcctccagagatttcgagtatgtttcagtatttggaatctttgtcagtgtgttacctcgctgagctagaagttgaaacaagcaagacttttggattcagcgagttaaatacgcctctcaagtagacacgtgcttctacggctctacggagggataggtcgctcttcttcctcactgagagaccatgagacgggtcgagacgacagcggcggatgcaccccacgacctccagtgactctcccagtcccaggctcccagccccccttcctcccgcctccgcgagaccgcg

SEQ ID NO: 7952 - DNA, 458 bp, Zea mays
atatggaatatgtgctgcatatccacattattatcttttctgtatggatagatggatggtagtagggaccattgcaattgtatgctttatttgaagtgttgatttgcttgtggccgatattcttgtttatattcctctaaagatggttgttgcaaacttgtgatgttaagatacaaaattgcctgcatgaaaaaagagttcttagtcagacagatctcatcaactaactgaagaaattgattttgattagttttctttgaactgtgatgatatagcctgtgccagttaaaatgttcacaaaggcctcattttgagtacttgtgactgcacagttctcatggatttgtacctcacacgcaacaagaacacaatatattctcttgagttatgtttttattcattattttatgtatccttactcttgcgcaggattctgattactcttcattaggttataa

SEQ ID NO: 7953 - DNA, 1500 bp, Zea mays
tttgcagcttctagccacaaaaagctgctgtggactgccaaacactcagcttttcagccagtttctataaaatttgtttggtaaaaaccattcaaaattaacataaacatataatcgattgagtcgtcgcaataatagtaatccgtcactttatagatcctgagcccatggacaactttacctttctgcgcacgtaatcttaatgatactcagagattatctacacagccagattctctccacagctagattctcggaaaagctggtcagaaaaaagctgaactaaacaggccctaagtcagtctcgccaggtacaaatcgcccgttggcacctggcccagtttagagatcacgcatgtagttacgataacttataaaaaaggcggccggttccctgaagaaatgttgcgagaaacgaaacatgtaggcgcagtcggcagcaaatgtcaagcasggcctccaaacccaccatcagcctcatcgtcgagggctcaggcgtcgacacgcgtgtgtccgtatttcagagaaaaccatcaccccagatgttgacgctaggctgatccatttgtactacagtgcaccgtgcacaaccatttgtacagtctccacgtacggcttcccagtgctcgcggagactcgacctgacctgacaccccctccactgcattaccagccgccggcctgacgttgaacaggtctacgccggacgcacgcgccactcacaagtcccaatacacaaacgcggcaagagacggccggacccacggcctggtctcttggccggtggccggtccccgatccgtccgtccaatcactttggctgcgcgcgcccagatgctcccaccttgcgcgcccccattgggcagcccgtcgcgtcggaggttgtcagcgtcgtgcggaggctgccacgttgcgcgcaccggagtggtggagcccaccaccacaccacgttccgtcgaaccttgtcccgcgcaccagcgcgctgcacccagcagactaccagtatcactgacatctggtcccgcaggcaatttgactaacccagcaagaggagaggaatcaccgaatcaggtggtgggctctgggctggtggctggcgcgagatctggctgtctgtctgtctgtgtaggagtacgggtgcggcgtgcgcgaggccaaacccaaagcgcgcacccaactccgttgagatttcgtcgcggcctcggccttggcggcgttataaacgcccccacacggttcctcgtgggtgacacctgtccacccattcccctcgcctcgccgccgcggacttcccttcccgcacccgcatcaaattcctcttgttccgcggaatttcccttgctaatcctggtatctcctgtcgctaagccactctactccgcctaacccccgctctgagctcaccggactggcggctccgtccggctctctcagcgtgcgcgtgctcgtgaggagggctctttcgaagcgtgtgaatccggtgggcgacgtgaaccaggg

SEQ ID NO: 7954 - DNA, 1500 bp, Zea mays
ttagatgacaagagtgttacgacatgacaaatgtgggataatggttctcataagtcttatcagttgtcccttcacctcgtacgggtgagggtacttataggataaccagagagtaaccctcaagtatgggcttaccctcgactacctgctacatcataacaatatcttgttgcacaatgtcgttgggaacgattatagaccttcggttacaaactaccaattacatacacgtagtaatgtttgggtagatttgctaccgatggtatgtcttgtttagcttaaaggggtccatgttgccactgtatcatcgatgttgttcttcggctctccaagtgagaggtcttcgaggctttcgttggggaccctgcatggagcaagagcgacgagaccgaagtctttggtgccttcggggtcgcccactagttgattggccttcggatatgtctatggccttcgatcaggcctttggatgtttgtcgctgctagtggagtctgcctatcagctgtcaccctaagcagagaccttgccttggacttcgtaaccttcgacggaagtgtcctgactgttgggggcctacactaccgaaggtcctttgattagttgtattacactattgccttaaaagactacaaaaaagctatgtcgaaggccacttgttgacgaaggaacaatcaactacctaacatataacttcgcccataagcaaatgtgttttaggaactctttttatagacgaagctaacctttggctgaagcggtaagcaaaggtgtttcgtctacatgcaagcggcagaaacaaaaagcgaaggcgatcgcttcggacgcaagtcaaaaagggaagccaatgaacaacgaaggttgagacccacaaagatgaaggcggaaaaaatacgatattatccttatgccatttgtaaacaacgtgatgggcattattgtaaatctgtacaaagtcggtttgtatcccctataaatagatgaacagtactctgcataagacatctttttctaaacccccaacttcgtagcgcttagccaccaaagagccatcgtacatcctttcattcaagaaccgaaggtatgcttgtaaatacatccaatgtaatgagacatattgaaaattccaaggcaacagagataagctctcatgtgttatttcatatgtctcttcacatcacattttgccattcaaaaatcttcgtatttcgtaatcatactccgaaggagtactaacctctggacaaaggttctcataacacatcgacttgatttttagtatcttcagaagattgaaatcaagcatatgacagtttcatcttttattgtacatttaaactttcatcctcaaatgatcacaccgaaggtgtattatcttgaggacgaaggttytcgtttctcagcttgtattgccttgatttcaatgtcatacaacaattgaaaacaagtatccaacattggcacccaccaccggtgatttcacgaccacatcaacatacacc

SEQ ID NO: 7955 - DNA, 303 bp, Zea mays
ctcgagtcccgacttgatccgagcccgcgttcaggactgggcccaagagtggtcgatccagaatctgacccgtcgaaacggcgcacgaatctcaaaactatggcatcgtcttctccaaagggctggctccacctccaccacagactcgtggaccccaaatctgcatcggcacgcctcccatttcgttgatcacctgcgcgctcgtcgccgtctcgtcacctctcaccagtgacgtgacatctcccccaccctcacagtcccacactcacactggcacacgcgacggcacgcgctagctcaacc

SEQ ID NO: 7956 - DNA, 51 bp, Zea mays
caggtagaagtgactgaaaaaattatatgggagtctggacatctggttgtc

SEQ ID NO: 7957 - DNA, 205 bp, Zea mays
gcgtcctcgtcgtcatcatgtgtgtggttgtgtttgtgtgtgtacaggaaaaaaaacaccagacggtttgttgtactcatgtagtggacactggagatgatcatacttcacttttcatataacaacaatacacacataaaacatgctagtgttagcgaatttcagaatcaagaaacatcttggaatgtctgtataagactactga

SEQ ID NO: 7958 - DNA, 131 bp, Zea mays
ggtatgaaatgaccagagttggctcatttttagcttgaaacggccaactagttgaatttttggggattaagtaatgaacagctggctgtccttcattttcatggctacaggtgttagcgggactgctaagc

SEQ ID NO: 7959 - DNA, 339 bp, Zea mays
cgttttttttttataaaatagttttatctttgtttttaagaaagcaatgatagcacattagcacgcgtttatatctacagttctacactatacattaggacagtacagaatcatgtctactcctagctaaactgttctcgaaacctgtggttggtctttccttcccccacgccacgttggcaccttccgacttggtagagctggtccacatggaagtgtcgttcatacatgatataaatgcgacacctcctattatttccatgtgacgcgtgcggcgtgcttattaggttgtttgcgacgagagaataggggaacatccaagtgcgctcgccatcggag

SEQ ID NO: 7960 - DNA, 426 bp, Zea mays
atcgattctttattcgtcttgtctgtgaattgcagcattcgtagtgcggttgtggttgagcgtgtgaaggtgcttctggaaggtcaccctggtctcctccgccacttcaaccagttcctgccatggggttacataagggctcatggaccagtcgggaggatcagcgtctgatgcagccagggcagggaagcgcgtgtggctacctaaacaagcctaaacctactagctggtgctttccatcgcatgaatggcagaatgggacaagagtatctggttggcccgtcatgactgctattctgcattggcagtaccattaagaacatgtaatgctaaacatcagaccggccgtatctttcttgcattatgtcatgtctgttccataatggtgaagccacctgactggcatcttctatatatcatgtatat

SEQ ID NO: 7961 - DNA, 1112 bp, Zea mays
cagagaaaattcaactggaaaagattggctcgaagcagccaaaagtctgctcagtctgggtgcaccggactgtccggtggtgcactggacagtgtctggtgtgccaggctggctctggcgaactgactgctctcgggacttcgatggcggcgtacgactataaatcatcggactgtccggtggtgcaccggactgtccggtgagccaacagtcggccggaccaatggtcggccgcagaatccgcgcgcgacgcgtggcaagtgccaacggtcagatggggcaccggactgtccggtgtgccaacggctccaagactgcaatggtcggcttcgccaaagaaggaaagaaatccgcaccggacagtatccggtggtgcaccggactgtccggtgcgccaggcgacagaaggcaagaattgccttcccggaatgctctcaacggctcctagctgccttggggctataaaagggacccctaggcgcatggaggaggacaccaagcattctctaagcattcctaagcaccaagacttcgattccgcgcatttgattctttgtgatagcaactagagctccatttgagttgtgaactcgtcgggttatgttgtgagctcttgttgtgacttgtgtgcgtgttggtactctgatttcgtgtcttgtgtgcgttgctcatccctccattactccatgcttctttgtgaacatcaaagtgtaagggcgagaggctccaagttgtggagattcctcgcaagtgggatatagtaaagtgaaagcaaaacaccgtggtattcaagtgggtctttggaccgcttgaaaggggttgattgcaaccctcgtccgttgggacgccacaacgtggagtaggcaagtgttggacttagccgaaccacgggataaaccactatgccatctttgtgttgatctctttatggttatcgtgttgtgcaagctctcctctctagccacttggcttaattgtgctaactcctaatcaagtttttgtggccttaagtttcaagtttttacaggatcacctattcacccccccctctaggtgctctcaatttgtatcagagccgctctcttcaagaaagggactaatcgcccgaagag

SEQ ID NO: 7962 - DNA, 774 bp, Zea mays
catctcccatcgtgtcccgcatgatcagataaaaaaaacggaaccgtcaatctcgaagccacgctcgagttgttccagcagccacacgagctgcagtataatccgtctctctaatcatctctggtacgcctgagtgagtgagtgagtgctcgacaagtcgtcgcgtacgtctggatggacagagtcggctggagtgacgcgagaaggaccgggatcttccgtgctggcgctgggatttccaacggattacgccaccgggaaggcctaaagaattccggtggcggtggggataaccaatcattgtcggctcggcgaattccggcgtttggggttccctttcttttgcagcaggtaggtgagccgtatgcttccgagagttgaatttcagaaaaaaagacatccctgcactgaaactccaccgcgcgtcgctgtccacttgtaaaactcgccttctacgactgagcgtcccttgcgttcaagtctcctccctggatggacctagctggaaccctacaacaacgagccaggcaccacaactaagaacagttacaagaattctaacatcccattagcaccatcttaattatcaggacatatattattagatagtacagttagaaaccaaaccactccatttggtctccatctctatccattccccaagtgtccaagtcatgcatctctgtctccccttttaaagcccaccacctctctccctccatcgtcttcccgtctcccaatcccagctgcgcgcgcccgtggacttgtcctgcc

SEQ ID NO: 7963 - DNA, 1055 bp, Zea mays
tatatatatatatatatatatactacgtcgtcgtcttcctgctttcggtcaatataatataatatatcatgcattaggtacggtggagaaaaaaaggcacctaaattattaattaggccatttggaagatggatataaacacagcgtgcgattattattttgcaacaccacgacgttatcccgtttgacgtcaaatgaatgaatggcttctcttccggccgaccggcgggaagcctttgcctccatatatattgtaatcgtaaattaatttacgtgtatatatagagcatatcaagatcttccatgcatggtacgtattagatatataatcaaatatattttattacgtgatgtggtgcctaatgtcaaaacggtacggagaaaattccaaagatatcgacaattaaaaaatgacacgttcgaatatatataataatggtgttaatctgggaagaagaagaaaacgcctaattgtaacatgagctagctggtagccttttggcaaataaacaaaaataaaaaaaattcgtgagctagctagggcggccttggcatcgcttgtcctaattaaccactccatcatatatcgatcccttaatttctttaatggacgcgtctttgacaaaacgcacaaattagttaaagggcctggtggctaataatatatacttgcatattatagccgtctagaagcattggacttggaccgtaccatgcatgagaaagaaaattacgaccacacctaccatacatgatggaaccattcgcagctagcattattcgagaggaaaggaggaagaactggagaggaaacaaaagtgtaggatcgagggagagggagagcggccaagcgtggaccaacgactcctcttctccgatcctcccgcagctgcaggccgtagctagctctataaaaagctaagggagcctgcctgccatcgtcgtgcatcgtcatccaccacgatcgataaagctaattaagctgctactgctacgctagcctcgatcgatcaagcaagcagctcacagacccaccggcccacccacccacccac

SEQ ID NO: 7964 - DNA, 742 bp, Zea mays
gctgcgacatttggcttgtcttgcacaagagcgacgctttaatgagggtattttagtttcaaatgagaaaaaaaaatcgggacgtcaatcttttttattcctaacgagggagtaataattttggctaccctcctaacgaggtgaaatccactatccattactaaaagaagaaaaaaaatactaggctccaacgcaaaaacaaaagccaatcaccagccgtctcggtcgcatggagcagtgcgccacttttgacygttacccacttacccggaccatcctcctgcgattatgcatggcggcaagcgaagactcgcgtaattaccgtgcgctttgggccactttgggccataaagcaacagtaacccttcatggagttcctccctccaccactcgccagaagtgccgtaccccctttccctccacgcatttcgctacccttgggcccaaagcacacccgaccctaccccgcagggtggcggcgcccaccccacccgcttgtcctgtcctccgctccctcttgaagagcgtgccccgcgccccgccataaagaaacatcgagcaacgcgaagaaagctgccgctgcctgcctcctgctagcagttgcagcccccgccgccgcggaggcggaggaggtgaaatcaaccgcggttgtccccggtgggcgcaagcgaggccagcaggtcgcggaagtcccaattcccagctgcggccctccagtcggttccgtgccgcgccgtcgccg

SEQ ID NO: 7965 - DNA, 1053 bp, Zea mays
gggtcggcacaaggcccgtcatgggtcgtgcttcagtttaggtacaagtcgatcgggcggcaccaacacaactcatttgctgtcacctcatttagcatgatgctaagcacggatagcccatcaaatcgagcatggtctaatacgacttgtttgtggaccagccttacttgtcctaaactagcccacatatatataaatatgaccaacttgacccacactttcaatctatttcgagttttgataaaaaaaaatgagaaaaataatcacaaaaacagaaaaaataagttatttttgagctctgttataaggtgggccttgggccgcctgacacggtagcacgacatagcacaatagcacgacacgacccgttttaaactagtcgggctgtgtttggacttagatttcgactcacgaacgagtacgacacaacccgctatttatctgtgccatgcctcggtccaattaaatcggcattgtccataacaagcttagaccataccggcacggtacgacctacccattggccatatatatttggtagacacgggatagaggggattggaggggccaagccctatcgtgcattttctttcccattttctggtcggaaagtgtcggtttccagtcggattttttgaaagaaaaataatgatttaatttggaaagttcgaaaatccataattctgcctctgctggtgacggtgatctccggtgtgttcccagtcggtctggcagtgactttctgcattgggttccgccggaatccttggttctcaagatgctgccatcccagacaataaactaaactcccgttcggaacatgtggtgtggtggttggtcttgaaccgagtgacgggtgaacacatggaaatcagtcgttgtcaatcatcattcatcattcatcagacaacctttaaactacaagcgcgctaagtcgccacagcgatacggctcacccccagaccccagtcccccacacccaggccatcataacacgaacacgatagcaaatcaggcgccgccgccgcagctactggccaacaggcaacagcg

SEQ ID NO: 7966 - DNA, 1356 bp, Zea mays
gggtcggcacaaggcccgtcatgggtcgtgcttcagtttaggtacaagtcgatcgggcggcaccaacacaactcatttgctgtcacctcatttagcatgatgctaagcacggatagcccatcaaatcgagcatggtctaatacgacttgtttgtggaccagccttacttgtcctaaactagcccacatatatataaatatgaccaacttgacccacactttcaatctatttcgagttttgataaaaaaaaatgagaaaaataatcacaaaaacagaaaaaataagttatttttgagctctgttataaggtgggccttgggccgcctgacacggtagcacgacatagcacaatagcacgacacgacccgttttaaactagtcgggctgtgtttggacttagatttcgactcacgaacgagtacgacacaacccgctatttatctgtgccatgcctcggtccaattaaatcggcattgtccataacaagcttagaccataccggcacggtacgacctacccattggccatatatatttggtagacacgggatagaggggattggaggggccaagccctatcgtgcattttctttcccattttctggtcggaaagtgtcggtttccagtcggattttttgaaagaaaaataatgatttaatttggaaagttcgaaaatccataattctgcctctgctggtgacggtgatctccggtgtgttcccagtcggtctggcagtgactttctgcattgggttccgccggaatccttggttctcaagatgctgccatcccagacaataaactaaactcccgttcggaacatgtggtgtggtggttggtcttgaaccgagtgacgggtgaacacatggaaatcagtcgttgtcaatcatcattcatcattcatcagacaacctttaaactacaagcgcgctaagtcgccacagcgatacggctcacccccagaccccagtcccccacacccaggccatcataacacgaacacgatagcaaatcaggcgccgccgccgcagctactggccaacaggcaacagcgatgcttgcccggcgagacgcggaggatagtggcagcggcacgaaggcagcgcacttcgtgttcgtcccgctgcgagagcagggccacctgatccctgccgtggacacggccctgttgctcgccacccacggtgcgctctgcacaatcgtcggggacccgtacacggctgcgctggtgcgccagaccatcgaggccgcccaggcggccggactggcggtcaggcttgctgagttcccgctcgactacgccgagtccggcctgccggaaggggcggaccgctgagacagcgttccagcggtgcac

SEQ ID NO: 7967 - DNA, 658 bp, Zea mays
cctgcgcgtggttcggcaaggatggaaggggcgcgcatgtggatcggtggagcacggacgaggatggaagggatgcggggaggagtatggaaggggcgggctaggatggaagggaggcgggggacgaggatgacggtcggggcgagggaagggggggtcacggaggaagggcgcgggcgtgaggcagaaccgtacaccgtgtgaacgtctacactactggaaaaggggagacggatgcggagactgctggactgatgaatagtgtgctccgctgtgcaaaaaagggatacggagccgcatgcggagtgctgctggagttggtctaagaagtagtatagatatagatatgggagaagttcgtagaaacgccggagcagagacttggcatttattggcaatcggtcacgtcacggcacgttggcgctacgcctcgaaacgcttcaccagatcctgaaggttgccgtgagacgacccgccgatctgcgtggccagctgcgcctttgacgccagcgcgcgcgcccgccgcctcctgtcctcggcgtcctcgctgccgcccatcacgctccggacggccgcctccaccacgtcccttcccaccaggatctccttcttcgtgatctggtacgtcagcggctccttcacaccgacgctgacgccc

SEQ ID NO: 7968 - DNA, 478 bp, Zea mays
gaattgctagcatattattagtatattgggtgaaggaaagttaatgagtatatagttagcatatacttgtagcatattgtttagaacattgtttatcatagggttagcatatttttattatgtagctatcgtgcagttttctgtgttggcaaccatcgtgttgttgtttttttgcaggttttagaaacatcaatttataggggaggtgctgccaaattttttattgacaatagtatttttgtacataggtgtcctttcgacttgaccttctccaccgttagcttgactcgtatgcgatcataggtatacattgttttcgtacattattcatagattatgtaatttcgtttgatgtggtcatttaatatttactatatagttattagttaataagtagttattatttatttattacttagtaagtattgatgcactagtatttagccattattgagttagtaatccatatttgcaatag

SEQ ID NO: 7969 - DNA, 1367 bp, Zea mays
atttgattattagtgcgttgccgtaattataagaggcggagtattgtttgtatgttgtgacttgagaaaacaagcaaacatctgggtaatgccgcgattgttacgtattcctactatatatgtgttaccaatattcgggcctacagattgtatcttgataaccactggcagatctagaattttactatatgatatgctatttaatctagaattttattgtaggataatgccatttaaaatttacatatacattggatcaagcttcaagacaattagcaaaatatttttacaagataattagcataatatttttctatgttaaacatttttagatgtctttttattctttttataattgtgtgtatatatataatataaagtctattaagaatctaatgtggacacccggtgataccacggcttcaccctccgcgctaccacaccgtacaaaaaatagtgcacaaagcgagcactcgaacccacacctccttgctcaaaacatttgggggtaaccaacaaaccacacataccttagtgtttataaataaccaataattatatttgaataaatatctcaatacctatttatctatactactctattaagaacctacccttcacactgacactctgggcccaccccacatgccccgactggttctcctgttagctctctgactggttctcccgtatctctctcagctactaccatgtgaatcccagctcccacgtagccagctaccgcgtttgctcagcatccgagcccacccacgcaactatcataccacctaaaaaaaagtgcatagtgagcactcgaacctacatctcgagctccagaaatttagagctaaccaccagaccacatataccttagtgtttataaataaacaagaactatatttaaataaatattttaaatttatttatgtgatatataaaaccgtagcaaagcatgtataactgactagtcaaactaagatgggatttatatcatcgcttcaacgatatctacactggattccacgccgccgcgtcgttttctagtgttttttgattcgtgagcccggccaagagcccgtgaccagctaagtcggcccatcccattttccactccggactcggtgaaatgcggttggagttcaaaactcagcccgacccatccagctccgacactgcacagcccgcaccacgcaccaggacatcgccaccggcaccgcactacggcgtacaggaaaccggacggacagctatgcccgaccgcctcctttctggttctcctcctccctcctccctcccgcgcagatctccacaagcttccagagagcagcagcagcagcagctcgcctccacgcgacacgaggacggac

SEQ ID NO: 7970 - DNA, 1088 bp, Zea mays
gacttggctcggtgcagccaaactcagctcagtctggcacaccagactgccggtggtgcaccggacggtgtccagtgcgccaggctggtctccggtgaaaaggccgctctcgagaaaagatcggcggcgtacgactataattcaccggactgtctggtggtgcaccggactgtccggtgagccaacggtcgccagcgccaacggtcggccgcgcaatcggcggttgacgcgtggcagctccaacggtcggcggggggcaccggacagcgtccggtgcgccaacggactcagagctgcaacggtcgtctgcgcccaatttggaaggcaatcggcaccagacaggctacagtagctgtccggtggcgcaccggactgtccagtgcgccacttgacagaaggcatgaatagcattccatgttgatcttcaacatctcctagctgccttggggctataaaagggacccctaggcgcatggaggagacacacaatcattcattaagcatcctaaggcatccagactatgttcccgtgcattcgtttctttgtgatagagatttgagctctattcgagttaaggactccctatgttgtcatttgagctcaagtcttctcttgtgtgtgtgggtgtgctgctatttgtgtcttgtgtgtgttgctcatcccaaccttactccgtgctttcattgtgatctttgttgtaagggtgagagactccaatcttgtggagattcctcgcaaacaagaataatcatctaaagggaaaaccgtggtattcaagttgatcatcggatcacttgaaaggggttgagtgcaaccctcgtccattgggacgccacaacgtggaagtaggcaagtgttacttggccgaaccacgggataaaaatcgcgtgtcttgtgttgatctctctgtgattgtttgtgttcacaagaactcgcttcaagttatatagccgtactaacactcataactaagtattgtggctactagtgtttgaattttagaggatcacctattcacccccctctaggtgctctcaattggtatcagagtcgtactcttcacgtaagggactaatcgcacgaagag

SEQ ID NO: 7971 - DNA, 368 bp, Zea mays
tcaaccaacaggctcacattctaggaaaacaattagcatcaggggaggagccaggggcttttattgggtcaggtgacccccgtaaaatttgaaaaatattatataaatatattgttgtatttagacgatgattagtaaagttgacttgataactttgttgtctagcttcgccctctattagcattctactggagatactctaagttattaaaatttgatttgaacctcacgatgcaaaggcacacgcgaatccgccccgcaatcgctgtcgtcgattctcccatctccactaaaagcatccgttggacggctggagtcattccggcgactcgagaaccgtccgacgtggaccaccaacgaaccgggaa

SEQ ID NO: 7972 - DNA, 380 bp, Zea mays
gctgcgcctcacaaaccgcacacattattgggtgccacggcccaaaccggcgggtattattggccgccacaaaccaacgcatgtggcatgtgtcctgccgatcggacggctgggcgcgctcggccccgcggatccaacggcaaggaaaggaaaccccatcagccgtcagcggctgccggctagcgccccactccgaacaagatagagccagccgcagctataaaaatgcacgccagcccccctcgccgtgtgtgtgtgtgtgaccgtgcgtgaggcgtgagtccgtgaccattcccgtcggccgtcccaaaagaagcggaaatttacaacccagtccaccacgggccacacaatccccaaatctaacccctccgacggcg

SEQ ID NO: 7973 - DNA, 183 bp, Zea mays
gaccaagcaagcacgggctacaacttaattgcacatttcagtcttaattaacgctgtcatcatcactacatgcacggaaatcagcccagcaaagtcaaaagagacgcacaagacaaagaccacatcgtactgacagacttcagccagggtgccatgaaaagaaagatacccagctaacgctga

SEQ ID NO: 7974 - DNA, 268 bp, Zea mays
ggtaagcatccttctccgttccctcccctccctgctctgtttatctaacttctctcgttaagagatccacactttgctttcttgggattttttggggtttcgggaggcacaggtgagcccatggcttgttcctcctgcccttccctcccctcccctccctgctcccccgactctgcgcggatctggtactatctagcccatagagccgtgttggacaacacaaccacgaccacaaggcatcgctgtggagcagtcggagccatttgtg

SEQ ID NO: 7975 - DNA, 1268 bp, Zea mays
atgatgaatctatttgtttttatatgtcatcggtaagccaatttttacataaccaagagattattttacaatagaaaaaagtacggtatgtgtaaacttagggtgtgtttggtttggcttttgggtttggtttttgccctaaaagccaaaagacaattcaaagggttggaactagaaagtacttcctccgttcataaatgtatgacactgttgactttttaaaatttgaccactcgttttattaaaaaaataatgagttatcatttatttgtgatttattttattacttaggtagtttgtgcttgaattaaaattttacatttatgaataaatattttgaataagacaagtgattaaagttttcgaaaaaatttaatggtgtcatatatttgtgaacgtaggtagtagcttgtttaaaaatcgattttcttacagtgtaaaactgaaatcacttttgagcctgcttttagtgattttcggatggaactgtgaaaatataaatggaagaacttttagcggcttttagtggtttccaccaaataatttttagcactttaacaactcaaagaccacaacagttctttttatagccacagtctaactaaagatactcttagttgctagaattgaaaaactagtactaaacataaaagttagatacattgtgacatcataaacagcaaatcaaatagttctcttatacttctctactacctattaagactctaaggggtaggctgccccattcctggttctgccatttccattccgatgtcctggtcgtggcatttctcattcccacccacacactgttgtctgacaccaaaacccggtcccacaaccatggcatcttctccattcccattcccacgcatcttttccgttcccacacctgtgcatcaacgccaaaaaagctagatgtgtggggtgacagccatgaccaactaagactacacaagttgtttcacactggaacttataaacaagtgtgtgcgcaatttagtagtcgatgtggtactaagtttagcttccaaatacgaagtacatgcgtgctgggagtcccatctgctttttgtggcccagacctaggcccactatcggagcaaccgctctccccacgaaatcctcccccgggtcagcggactccccctcccccaaccccgcgctccacttacgtgactcgcgcgcgacacgcgagcaggaggttgagacgaagacccgccgccaccggggatggcccaagcgccgccgcgacctagggagcgagg

SEQ ID NO: 7976 - DNA, 790 bp, Zea mays
gaggacccgtttgcatccttggaatccaattctattctaataatagtaacttaggcacatatcaactaagctaatatagttttatgtaaaatatatttatatattattattgataagatgttaaaaatatttatgtgttacatttttactataaagtagtgacccgaaaaacgtcctatatattgcaaagtagaaatacattctaccgattcataaaagcattttttattcttcaccccatgaacttgaaaaagtcttatatttaaactttggaaattagtgaaatattaaatttcaagctaaataaattattttattaagtaaattataatttctctaaaataaatggatctaaacgccccgtgaaagaatattgcaattgcaaccacgcatatatttttttccttcattctctttgacaaaacatccatttcgtatttcctcgtttcaatgcttctcgctacaaacaaaaaaaaaacaatttggataagtctggacataacgcaggagaaaacggaatctcgcctgtgggccccgtccccaactcccgtgtcgacaactcgccaccaccttctcttccgttccagaagggacagcgtccgtgtcttccttgctcactctcctcaccactaccctgacctgacctgctcccaagctccctctgcctgcctttataaatcaccggggcagagcgcctcagtgacacacgccgctgctccaagaaaccaccgccgagcccaaccgcacaagcgcgcgaggcaggagagagagagaggcggggagcaaaaca

SEQ ID NO: 7977 - DNA, 1004 bp, Zea mays
aataaaagttgtttttgctaattaagatctaatactttatgtgttgttagagtaaatcaattggtgaaaatcctttgtaaaaaccttaatggctgatttggtgaacatagaattagagggaatccatatggtgatgaatctcctcgctatttaaaattgaataacgaggtaattcctctccataaatcctctccaattctctggtcaacaatcaaccctaaggacttgtttggaagcaaaaataatagaggggtttaagaggagggactaaaatctcttgctactgaattttgaatagcaatgatttttagcgtyctcaatctaatatctacaaaagtggcctcggcctttttgataggagagtaattaaaactgttaagagccaagttaccggcatggataattgatcaaatagctctatcagcctcagctggtccctttttttttaaaaaaaaagctgacgaaattcagcagcgaaaccatctcgacaaactgctttaattcgttatgcgtcacttggaaaacactcttttccgtaggaagcaaaaatcatccgaaactttgagagataaaagtctgcaccctggtgagctgggcaccacaggtcgttcttgattgatcctttttcatggcaaagcaaagcacactcgatcctccatcacaaaaaatcccctcccattccccaccccaccctagcgcgaggccgtagtacgaatccagcggcggagtacgtccacacgaaatccagagagaggggataaggttccggggccagccaaagccatatcgtggtgcagccactggcgcgccgccacgtggggcggcggtggtcacacctgcgctccgtcccggcattatcgccagggcttggcgccacagctagtatattggctagcttttggctcggcagctaacgacctgcagccaaccatctaccagcgactcagcgagcgagagcagcacacactgcacgcagctagctaggagcagcagcagcggcggcg

SEQ ID NO: 7978 - DNA, 1353 bp, Zea mays
aagcctctgattatttgaactaaattattgcgcacatgaatagaaaacgaagaacggtcagaagaggacattctgcaagatcacacgtccaacttaaacgaagaagagcaggatctcacatcaaaataacaaataattaataatatagacgactaaaatctccctactagtatggaatccacacatgagctattgagagaaacagatgaaagaacaaatatataaataaaagatagatagatagatacaagtatgaaaatataatagcaaagccgattttagtacgttgaagaaattgctagccgaacaaagcctgaaggccgacctcttcacttgttccaatgccgccattccatgcatgcaaggctacatatggacttaaactcctcaaattaacaagagtgctaatcaaccaaccaactaaccatccatccatccaagctgccaagatcaacagcaattaaaccacagcaagctagggttagggtttcctccttccaattgacccaacaaacccatcctccaaaatcacaatgagatcttgctaagtacgtacgtagcgcaagtaacaaccaatattattgctacaaaatgcaatgctcatatatacgctagctctatatatgcggtactgatgactagtgatgagcgaggcaaaccctagtccgtccgtcggcgccgccggcatgaatgcatgcacgcagcaggtagagaaggctcgtcctcagtggcggcggcggcgggctactgccacgacgacacggacagcagcggccgcgtctgccacccgagaaagcacgcgccgcgcgcctcctgcacgaggtagccctccgacgggtagtgcagccgcagcagcagccgcgcctgcgacacggcgaaagcgctgagaggccgcgccgcaaatccggcgccgcgcgccgcggctccccaccgctcgagtccgcgccaccacctcccaccggagggacccagcgcggcgtcgatctccctgccgagcacctcgtgctccaccgccagccgctcccggctccccggcggcacagtcgcctcgagcgcctcgaacacggccgagtagtgatccatggctaccgcggaccgctggggcaggtcgtcgatgcggtcgaaacccccgccgattgtctccctctccgcgatggtcaccacggcgggggccatggccttgacccacttcaagaaggcggcaagctcgtcgtgcccgcctagcttgtgcaaaaacatgacgcagttgacggctagcgtctcgtccgggtgcagctccagctggctcgtcgtggccgcgctcgaagtggtggtgttggtcgtggtgctcgcgctggtgacgacctgctgctg

SEQ ID NO: 7979 - DNA, 922 bp, Zea mays
tgcatgcctgcagagcataaggagctacatcatacacacgttagttcatgggtcagcactcagctggccaaggcaaaaaaaaaaaaaaaaaaaaaaaacctgcacatgccaccgacgaggttttaaaatgggcctcagcttcacaccggcctgcccgggcggacttacgtttgcgtaacataagatcgatcgtcccatccctccgcatcagctcccacttcgggcgtgcgcgtcgcccactccaacgtgtaccgctctaccgccgtgtcgtcttgtcagtgtccccgtgcccgcaccgcatgcagacatgggcgggctgctactgctaggccggagtctgcgacctgaccgcgcgccgccggctgatggaggagtgagctgacccgacccgagccctgtcgtgactcgacaaattttaaagactgtgcaacaaaggcgactcgacgggcgctagcgcacaagtttttaaagcgaggcatgcatgcaccaaatccatcaagccgtcacgaccccccaaccgcgccacttccccctgcccaggctccccccacatccgcgctcgatctctcggataacaacaaagcacaagggccgggtggaaagcagcaacggacgaggcgacgtacgcgcgcgcgcgcggccggggcgcacctcgccgtcccagccacctgccgttgtgcatgcgctctgaatctctgatctagtcatctgatctgtgcgggagtgtggccgccaccaccacgaccaccaccataactgctcgtctatatataaaccaccacaaccagcaccaccaccacaccgttctccccccctgtcctgccgccgtccgatcctgtggttgcgccgactctctggccgcgctagtccccattccttcatccgacgaatctaccctcgatcggatcctctggccggcggc

SEQ ID NO: 7980 - DNA, 208 bp, Zea mays
gtcacggcgaggagtgtctcgtcaggtctctccggtggccgtgacatctatactttttttttcgttcgcgggtcttgtttgtcttttcgtttttactttattgcccatttttggatgaattgttcttccctgtcattcaaattgctaggagtatgtcatgtcatgtaacgtccttgtcccatttttatgtaatgttaactaaataaat

SEQ ID NO: 7981 - DNA, 392 bp, Zea mays
tcgggaaggaagcggtggcgagcgagatggtggccgtggtgggtttgccattcagcggacgggtgggctcgtggcctgggaaaagagagagcccaaccaaggcggcccatctgcgacgcttcggcactgtcaagcatcccgcacaggcgcagcaccgcagtcatcggtgagtcggtgacatttgtcgctacagctgtttcaggcatatctgccacctcggtcacatgccgtccgccacgtcgagaccgcgagctccatacgtgtcacgcgcagccattcccgacgtctccggtgccgtgttttaaagaacgcgccgtagcgcagcgcactgcgccactcatctgatgccgtaacacaaggctgaatttttgttcggtctagccgacccgacg

SEQ ID NO: 7982 - DNA, 554 bp, Zea mays
tgcagaatagatgttatggcttagaataatcgacaagaattcgtagaaaatggtgtatgttttctttcacgaaagcaagaaggaactatgcaactcatggatgaagatttatacaaatataaatgatccggtgggctacataggggttatagggttgttatatattgtcgtaccaataccagttcaatttgtcaagcaatcggttgctttgatgtgtgatagtaattgtaaagcaagagcgctacaacaagctgcccaagtgacagggacaatcgcagcaggtcagcaccagaatatctgaatgtgctgcgcccatgctgagttcctgaaaacctcacgaactgacctgacctgaccgttaggagacaacacgttcctgggccctatgttcgcggacggaaacttggcaccacacactcttatccacaacgagagcgtgggtgtgtgtcccaacactctccacgcgttccttccctccctccatctcctctctgttcataacctcccaagaaacaagagccaaacagcgcttgcgaagctcaagcgccgcagca

SEQ ID NO: 7983 - DNA, 1500 bp, Zea mays
ccggcacaaaagctaccccaacggtggcgaggatgacgaactgatcattgttgttggttctcctctgcgtcacctctggcgtcaagatgacgcaacagtcctcgatatagtagtcgtcgaacgcgcgtgacataccgagtactgatgactcttggctgggctgtaaaatgaagtgtgaaagggaattaggcttacacctagtccctaattaattttggtggttgaattgcccaacacaaataattggactaactagtttgctcgagtgtatagattatacaggtgtaaaaggttcacactcagccgataaaaagatcaagttttggattcaacaaaggagcaaagagtcatccgaaggcaccggactgtccggtgtacaccggacagtgtccggtgcaccagaggactccaactcgaactcgctaccttcgggaatttctcaggccggcgcgctataattcaccggactgtccggtgtacaccggacagtgtccggtgctccaaggaagcgcggtctccggaactcgccagcctcgggaacgcgcagcagccgctccgctataattcaccggacatgtccggtgtgcaccggactgtccggtgtaccagcggagcaacggctatttcggcgccaacggctacctgcgatgcatttaatgcgcgcgcagcgcgcgcagaaggcaggcgcgcccatactggcgcaccggacaataaacaggagatgtccggtgtgcaccggacatccaggcgggcccacaagtcagaagctccaacggtcagaatccaacggcagtgatgacgtggcggggggcaccggacatgtccggtgcgccatcgaacagacagcctccaccaacggtccacttttggtggttggggctataaataccccaaccacccccacattcattgcatccaagttttccacttctcaaccacttacaagagctaggcattcaattctagacacaccaaagagatcaaatcctctccaattccacaaaaggctttagtgattagcgagagagatttgtcgtgttcttttgagctcttgcacttggattgcttcttttctttctcacttgctcttgtgatcaacactcaattgtaatcaaggcaagaggcaccaattgtgtggtggcccttgcggggaagttttattcccggctttgatttgagaagagaagctcactcggtccgagggatcgtttgagagagggaagggttgaaagagacccggcctttgtggcctcctcaacggggagtaggtttgagagaaccgaacctcggtaaaacaaatccgcgtgtctcacttcactattcgcttgcgatttgttttgtgccctctcttgcggacttgattatatttctaacgctaacccggcttgtagttgtgattatttttgagaatttcagtttcgccctattcaccccccctctaggcgactttcaattggtatcagaacccggtgcttcattagagcctaaccgctcgaagtg

SEQ ID NO: 7984 - DNA, 1052 bp, Zea mays
agtaagttcgcgttttcgatccagctccttcgtacgcttctactgcgatgtttgttgcaaccgcttgtctgaagagggctcccactttgcgtccggtgcaaatctcgactagatccccacgaaatcgggttaatacttttgatgactacttgttgcttactgcgcggtattagtatttgagttgatttgtggaactcacgaagctgtgtttgcttagtatcgtataaatacgagaagcgctggggctttggtactatatactcacccaaattttcatgtgtgcttgacgcgtgataagttcggagataacacgctcatagtttaagacctgtctgactactggcagaacatgacatcatttgattttctgttcatagttgggaaatcttgttttgtttcggactaatgcttgttccatggatttttaacgaatacatttagggtctgttcttctaatgttaattcatgtggattggaagaggttgaggccttccgtttctccagcattagatccagaattgttccagctgatcaaatcttatatattttagataagcaatccggctggtaatcgtttttcgggcggtcctgactgtgtttaattcccaagcaactcctaatttcctccaatgcacatggaatgggaataactgaacaaacccttagtattctattgtatgccatggaaaaacactactggtagaacatggcatcaattgatttgctgtttatagtcggaaaatcttgtttttgttaagactaatgcttgtagaccttgtacagttagctgccaagatggggttagtagttgtgtttcatggatttttaatgaatacatttagtattctattatatgccatgaaaaacactgtagaagtaatctgactatgctgtgcatatgctcattctgcctgcttaataaaagcactgttgtatattttgtagaaaataatgctctgttttgcatcaattcaatgatttatatctgtttgcactgaataattttatcactgcagtgcattgctattatgctgttgataaaattgagcttt

SEQ ID NO: 7985 - DNA, 780 bp, Zea mays
gaaaggaaaagtcaccaagcaatgatttaacaagatttgtctgacgaaaacgatatgctttaatagttaattgatattacatgaaaaacaaacaaacggacggtcagaattgattttggagtgttccattgcaccagctctgaactattacgagtcaactatcttatcaacgatcctattattgcacgaccaagtcaacacgaaagccatttgagatcttcatacgccttaaataaaaaaaacacaaatgttgctggaccaagtaaatgtaatccaacactaattctggtcgagtcgttaaaaaagaaatattttttacattcctaattttgctcattatcttatttgctatcacacatttcttaatcactactatatatgtcactcgattgcaattccttatcgttatccttctataccattgtggcatagaagagattaagacatgcaattcgtgttacctttctatgctactgaccatgacatcgaacagtaagaaattgcatttaagcgacatagaagagattagattagtacgtttgtgatgataaattaggtacagacagtgcttccgcgctggctgctcggcatgttcgccgcggtaaccacgacgaggcgacgacctcgtcgtcttctaccttacgcggtcagtcttatatgaccagagaaatcgaaaacccgtttatactatatattagcggatacattattctgcgcatcacgattcacgaaccaccaaccgaacacctgcagcgccaaattaaagcaaaaaaaaaggac

SEQ ID NO: 7986 - DNA, 390 bp, Zea mays
aggtaaggtggaacctcggcgtcaacctcacgtcacggggagactcgcctctggtcggcccctgctccctattcactattaaaaaacttcgctatgtaaacaatatgtttaccgtataatacattatttttttcaaccatatacataatttgtcggagattaatgaaatagaaaggcaaaattgtcgggcccacatgtcagtcaaccattcaacctctagctagcatgtacgccgttccccaacctctggcgtagtcttgttcatcttcgatctcctccatctcccttcatcctctctctcgctgtttgaggagaactgcctgcccctgctccctcttccgctcctccccgcgccccgctcgccatccccagacttcatttcaggccggg

SEQ ID NO: 7987 - DNA, 680 bp, Zea mays
caaatcacggttcttgtgatacatcttaacagtgcaaggggagtaaaaaaaactcggccggggagggaaagaccgccctcccggtattatattaagaagagaccaaaacatggtcccggccgagaaaatccccgaactctggccccccatcactagcgggccgtcaccgcccactctgcaacggcccagccggagggtggcgcgcaggacgtaacccgggagcgggtggggcacaacgaggggatttttttaaccaagccagaaattcgcccccgagggggatcgaacccaggacctggaggtgctactcggaagccttaaccattacgctagaggccctttcgcaacgctatgacagcatcaccctaatccatctcccctcgatttggcccgatcccttagagctagtgcacagaatagtcatcaacaccgcaagccttaaaaaaacgcatgggccattgcaacgggatcccctttcctctttatgggctcaccagtcattggctcgagatcgatggattaggtgcaaaagtggatcgcgggccgacgccagtacagctgtcagctcggcccaccttctcggcccgacgccctgatttccgctcgtcttgctctcgcacccttcccactgccggcggcggctgaaggcggcgcggtatcagcttggtgatttgtgagcg

SEQ ID NO: 7988 - DNA, 139 bp, Zea mays
ggttagtctcattatctgaattttttcctgagctatctatctgaaaatggaatgagaattgtggtcaactgaatgttcggttactcggctttcctctgaacttcatgctgtgagccttgttcattttaccagggaaggg

SEQ ID NO: 7989 - DNA, 1500 bp, Zea mays
tctctttatgcttcaacatgtgtgtttgacttagagatagagatttgagtttgatttgcaaaaacaaaccaagtggtggcaaaggatgatccatatatgccaaaattgaataaaactcaaatttattttatttgaagtgattttgcacttgttctagttgctttatgttgtgttggcataaatcaccaaaaagggggagattgaaagggaaatgtgcctttgggccatttctaagtattttggtgattgagtgccaacacaagtgcttaaatgtgaatctatgcccatggatgaacaaagtgcaaatcacaagtaaaggtatgtttctaagccttagtacattggttttgtgtactaatatacttgtctaagtgttagaaacagagagaagaagaaaagaagagagttggctgtgtacagccaaaaggctgtttcagtctggggcaccggactgtccggtggtgcaccggacagtgtccggtgcgccaggctgcctcgggcgaagaggccgctctcgggaatttgccgacggcgtacggctaaaattcaccggacatgtccggtgtgcaccggactgtccggtgagccaacggtcggctgggccaacggtcggtaacggaatcagcgcgcgacacgtggctggaccaacggtcggaaagggagcaccggactgtccggtgcgccaacggctcccagatctgcaacagtcagcaacggttggctgcgctgtttatggaaacaaatcgggcaccggacagtgtccggtgtgcaccggactgtccggtgcacccgacgacagaaggcaaggatggccttccagatttattctcaacggctcctagctgccttggggctataaaagggacccctaggcgcatggaggagtacaccaagcattcctacaactcttctaagcaccaagacatcaatctcacgcattcgtttcaattgtgatagcatatagagctcttgtgaagtgtgaactctttgtgttgcgttgcgagctcttgttgcgacttgtgtgcgtgttgttgctctgattttcgagtcttgtgtgcattgctcattcccatcttactccgtgcttctttgtgaactcaattgtaagggcgagagactccaagttgtggagattcctcgcaaacgggaaaagatcaaaggaaagaaaaacaccgtggtattcaagttgatcattggatcacttgagaggagttgagtgcaactctcgtccgttgggacgccacaacgttgagtaggcaagttttgtacttggccgaaccacgggataaccactgtgtcaactctgtgattgctttcttgtggttatcgtgttttgagttctctctagccacttggcaattactgtgctaacgcttaatctaagtttttgtggctataagtttaagtttttacaggatcacctattcacccccccctctaggtgctctcaattggtatcggagccgttctcttcaagaaagggactaaccgcccgaagag

SEQ ID NO: 7990 - DNA, 55 bp, Zea mays; identical to SEQ ID NO: 2436

SEQ ID NO: 7991 - DNA, 1500 bp, Zea mays; identical to SEQ ID NO: 7989

SEQ ID NO: 7992 - DNA, 1500 bp, Zea mays
gagaggactaggagaagcatctcccacaacttgggcagggccgattgattgagccggacgcccaaaaaaaaagttgtgttttgtccggttgcccgcaagtgggcgtgcctaccacactactgtacacacgggagcccgcaagtggcggtagcttccctgcgatcccactgctgcccgcttttgtgtcgtgtgtaatataccggggctgcctgccgccgaccggtcctggttttgcggctcagttacgtcgcgtcgtcaccatcggctgcacgggtcccgatacatctactggacttcgcccatgttcgttggtgtcgtccaagacatagtgttcttgttgaaaagcagttggactttttcaactgagttaaattttatcagctgagttgaactttctcagctgarttgagcttcttcagctgagttgagcttaacttcaactataaaactctttggctaaaaccattttaacttgccttcggggcagttcaacctgtattttatgtcctgaactttatggtcaataccagttaaactggccctaggggcagttcaactagtctctaggtcaattrctctgtctgacttgactgacagacagactgtatgtcaacttgccaccaggcggttgaaccggccctagggcggttcaaccggtgtcaggacctgttgaccagtctaaccgatgtcatcgaccatcttgggcatgtacaagctaaatatgttgttgttgttgttgttcaaacactagatacacctaagaaactcattcatacgagctcttgtatttaagcttagtatcttattcactcaaactctttaaggcactgcttatttatatggattgtatgactggaacagtatcttgaaacagagaaccgtgctaaaaacattctttcaccaaaattcatctcttatgtttttttcacttaccttttaaataactcttaagatacgtatcatttatgtgggatgcccttacccaccctccctgagtcaacacagcacgagttcttgtataccaatgctgcagccaagtagtagctataaaaaaaatggcatttcacaaatgacaaggccgcgagggccgagggcgtttactgtgtctgtatgttgtttgtggttgtggaaaaccagagacaaagaccggcaacgggaagcaaaaggcagtatctatcatctcatggtcgcaagttgcaataaagaaagcgtgggatgtcactctccatctccaacaagtcgaagccaccctgttgcctggttgcaagttgcctcaggcagccagatgcattcccctttctgctttctttctcccgctgtgtgactgtgactgtgagtgcctccaatccatccccgcgctttctactctgcttcagcagcygccacctataaatatgcgcccgcaaatcccatcgttcgcatcgcaaaaaccacccaaggccaagtcgcatcgcagcagccaggcagatcgatcaacaccttaaaatcgagcgagctaag

SEQ ID NO: 7993 - DNA, 380 bp, Zea mays
atagttgatctcactggtcattcttttcaacctgtacttagatttttatttgtgtaattgaatatcggatccgtaaggccgtaactaagtatttccttgttgttcacttggatcttaatttttttctactgtgtatagtactgaaatctgtactcaaggtacacaaatcattcatctgtacgctaacatgtcagagcactcaaatcttaaacctatgaatgcttattgttattcacagttcttgttgctgatgatgtaacatgtattgttacattatgattcccttccatatttattgtgttcaactttattagatcaactgaagaattggcttagtcgtcatgatttctattagacaaggtgagatgtactgattaaat

SEQ ID NO: 7994 - DNA, 147 bp, Zea mays
ctgcgaacgtgtgagccggactgcatgtcgtggaaggggcgagtgcaaaacacacgagcgagatgtgtatctgtgattctggataggggcgctggcaccgattggctccggatatcgcagcgtggcggtcgctcagttcagtccgcc

SEQ ID NO: 7995 - DNA, 1130 bp, Zea mays
tgataaatttacttttgatttgtcatatgaagaaatgactaaaactaaattatgcatcttgatgagatatacaactttgtagttgaaaattgactttgtctaatgtaaaaaaacactcaacaaagaagttctttgcctagtgttggaaaatgtcgagtgtttttttaacactcagcagagaagctctttgcctagtgtcggaaaaaacactcgcaaagaacttttttgtcgagtgtcaaaaaacactcggcaaagaagttatttgtcgagtgttttttgtttggaactcgacaaagactttctttgctgagtgacaaaaaagacactcgcaaatagccgattttcgatagtgtatrcttgttagagttacttgtcttattgcctatctagccttgtgtaggtgtgtttggttagtcacttttagtacctaaaacaccaaacgatatgactaaaatargtctttcaaaaaatataatttctaggcactacaatttagtccctaaagttagaagggtgactaaaggaactaaacatccactaaatttaattgtttttgcaagtaggtaagagagtagggatatgtcatcgatgtgcaataattacatgaccagatctttttatttggcaacttggaagcaagaacaaccgaaattcatcaaacataaacttttagctcgtattatgggggcgaaatttggcatgaatcagtagcctcctaaattaaaaatgtacccttgcagttctagctgcactgaactgtttgatgtgagggaaaagaaacaaatctatgacgtatgacggtaaaaactggtactcctatttaaaagagtaaagatattttctctagctaaccaatactactgctgattgctctgttgactttaaaacgtagctacagtaaaactatgaggagagagaaggggtcgtcattactgttggctgctgctgaactaccaccgggtgcgggtagctagcgggtagggtaccaaaacggcggcgctagaaaggaaaacctgccgtactgtcccctcttcccttttactgccgcctgccggccgcgagggagggagggacggaggtgctcatctgtgcggcggcttcggtgtcggtcccaggggaggcggggagcc

SEQ ID NO: 7996 - DNA, 99 bp, Zea mays
tacttaagaaagcatgattgtagctccgcttcttgctttgctctaagcagaaagacttatctgaaatcgcaggttgggttttccaaccaaaagaaagac

SEQ ID NO: 7997 - DNA, 352 bp, Zea mays
gggcggttggataatagagtcattctagtgtgttttcagggtgagcccgtccaagacgcccgtgcgtccccgcgcccctcgccagctgatgtcgtcctaggcatacatataggaggtgctgacgatggcactgctcatatataagtaatagagatagacatgtatgaaaagggtcttttgttttcaagtagtgtgtagttgttgttacttttaacaactgatgcaatctggatgagtcacctatgaatgtcatactggaatctgttgcgcttttgttgatcattattattttgcaatccaggctaggggattgaagaagcacttgaagaggctcaatgtgcccaagcattgg

SEQ ID NO: 7998 - DNA, 883 bp, Zea mays
gttttttaaaacccacatattttagaagtgcttttaccctttattccaaccatacgaagcaaatgcagaaatcctttgccatgctttgcttttgaataagtaacacataaagtaaagtgcgatatcttttttgacactatattcaatccaaagaaaattttaaaaccacataaattttgaaatggctatctctatctctaattttttctatttatgaattcatatgcatatggttgaaatgtactaaaaatatatactatttgaattgcatcataatcattagtatgataacttgcagtaagctatctttcatcttagtcatgtggaaaacaaccggagtctgggatcctagatgcattccagtgttaaataaaccagcataaaaccgcagaaaactgtctgatttcccaaaactagaggagcccaagaacggttttccacttttttttttcaaaaatcgtttatttttttacaatataaaacagaaaaaaaattataaaatactaaatattttcctgatatatctcacatatatattttaatttttttaaaaaactaatcagaatttttatttaaaaacaatgaaaaccgctaaaaaaacgaaaccggcgaaaaataccaacatccaacggccagcagctcttctacctcgccttctaggcttccactctcaccgcagtcgccggtgtcgcctccgcctggatcgtccgccactgccagctgccattccgcctcggatctgagtcgccttgctgcctctgcgcccggacacagccgcgcattccccaccggctcgccgagcaggggccctgctcccacgctgctcactctccccaatttcccacgcacgcctagcgaggtcgggggttgaggtctggcggag

SEQ ID NO: 7999 - DNA, 352 bp, Zea mays
tgcagttattcgtaagtctgtacctgccgatgcaaagcttcaaggatacagagaccacagagactccatgcatttggaggaggaacatactaaggtgagctgtgtcactggaaataaagtggcgctggaactttttaaacaaagtgcaagcacgtgatttagttgctgtcacctcctcatcttgatatttggaagttggaacctgtttcacactattctaattttacctttacacccgtagggaaaatctgacaaacaactatcagaagctaaaccagccaataatgcttcatgctcaagagttagtgcatcaattgagaaaacaacaaaaagtgttacacaacttgatttg
